United States Patent 11,559,588 (MATERIALS AND METHODS FOR TREATMENT OF SPINOCEREBELLAR ATAXIA TYPE 1 (SCA1) AND OTHER SPINOCEREBELLAR ATAXIA TYPE 1 PROTEIN (ATXN1) GENE RELATED CONDITIONS OR DISORDERS) - sequence listing, part 2

SEQ ID NO: 5303 - DNA, 462380 bp, Homo sapiens
ggaggagagagcagagtataccgcagacatcatttctactacagtggcggagccgtacaggacctgtttcactgcagggggatccaaaacaagccccgtggagcagcagccagagcaacagcagccgcaagacattgtttctctccctctgcccccccttccccacgcaaccccagatccatttacactttacagtaagtgactatttttttttcctcctccgattctttcccccctcccccattcccttctccccttatttagattaaaatccctcctcccccgatctcccgagaggggcaaaagcaacaaccagcaaacaaacccaaaaccccaatcggctgcacggaaaacagctggaagaggagcgaaggaaatcgacgcgtcgtgttctgtgtgtgtgcgtgtgtgtgtgtgtgtgtgtgtatgtgtgtacatacaaccgtccccggctccaggctcccgggccgacacccccactctgggcgcaggggcggccggcgggggggctgtcaggggctgggtgggcgcccgccgggctagggggcgcgcccgggcggggggcgcgggcggggagagcggcggcggcgccccgctcccccggctgctggtccggtcgcaagtgcggagagccatgtcctcctccctccgggtggcgcaggggggaggcggcggctggggttggggggtggtccctttcccggccgccctcttcccattcctcctccccggagagggcggtgagagagagggggtctcacggagggctggacttctccgcgggtggtcgcccggcctcggcgccctggggcgggggtctcccctcggagggccggcctcgccgggtgtgcggctgcgggcggggaagggactgctcctgcagccgggacgggactttgcgcgcggccgggtgccgggcggggggcgcagaggggtggcctcggggaccgcgcgggggtagcgggtgtgcgggtgcctggagcgcggctggagtggcggtgacggccctggccgccgccgccaccgccgccctgttggtgcggccgcttcctgatcatgtgcagcggcagccgccgcccggagccgggagcccgcgagcgccccagtccgggccggcgcccccgccagcacccgcggcaggagacgaggagccgcggcaggcgctgccctgagccgggagtgaacggctgcgcggctgctgggagggtgaatgaagccaggaggaggggaaggaggaggaggcggcggccgccgcggaggaggcgctgcggggattgggatgcgccctggagccccactgctcgttcactctgggccgggccggagactctgccactcccgggggcgccgccgcctcctcctacgtggttccagtgctgcgcgcaggccggtcccgcagggggcagggaagggggccggacgggcggagcgagaggtgaggcggtgtcggagcgcggcgtgagtgtgagtgagtgtgtgagtgactgtgtgtgtgtatttgtgcgcgcgcgcgccgggcggggggcgagggccgtcgcgacgcggagggggcccttccttggctacttggctgactctgcagcgccccgacccctcttcagccccccgccttcaggctgccttcttaaactccgtggcttgtgctttcattttgtttcagaccacgtagggggctgactgaaagggatgaaacaattcaggttttctagggagattgagcaagaaccttagtgggggtggaagtagggtggtgatcgagactctgccagaaaacaaaacaaaacaaaaaaaaatccgtttctaaggacggcggggattcggttcgagcccgtggctgctctgttttgttttgctttcttggtatataatcctacagataaaagggtaatataaatatttgagaagagggaaattgctgaagagtagtaagggcaaaaaaaaaaaaaaaaaaaaaaaaaaaacagtcggaagaagctggttatataatgcgcgatgtggctaacaagaaaggcaagctatttttattttgtttaccgtatgctgtgcagtagggactcctccaaactggttctgtccccgaagagattcttagcttccctgcgagatccacaggatacaattagcaaaattagaagaccctattacacccacagaataaaaactaatgccttacagtggctttctccctgcacatcctgtcgtgcatgcacgggaatgtgtgtatgcaaataagttctcctttggcaatctagtagtcacatctcaatgacatttgtgttttataatgcaggctgtttttaatatttaaacatcattgttatatattgcacacagcagtgggtagttacttggttatttttaggcacagctagttactttttcaacagtgttagctgagacatttctgtttgggttttttaggaggctgcagttcctagaagccccccttaagcccacccttcggtttatttgatgggtaaaggtagtttgatacttgagctttttttggagtgaagcttatgtctgaggaaaccaccagagagaagagaaaatcctgcacaggaactcttggaaagggattgcaccataacggctagcgctgtggcatttaatctcctctgattgccctctcactgtgcatgcatcagtcaatattttagcagctccgcaaataaatggacttgaatgccatcttctacataaagcagaggttgaagggctcccctgaacctcctggctgcctgtcagtggtgtaggttttcggtgcacttactccagtcctgatcactcatgtaattagatcaggctgccatggcaacagacagtgttcctcgtccattcaggtgggtttgtcttgtgcctgaactactccaagtgttttatgcacagcatttatgctgcccaagccagacgagagactccactatttcaattgcatcttctttcagtcatttggatgggagacactgaatgaggcttctagctactcaacttttataaaggagaccaacaagctgttcttcctaggtgcagtatgtaaatgcatctccccagacagtgaaaggagcctgacaatcctgctggtgtttattgtgaacagatcaacaagtatttggtacttgttagaaacctttcagagctcactaaagcaacatttcttttgcagtctggtgcctttggccttgcagtcagtcacttaaccctttcaagtgtgaagagcgttcatcatttggaacctccattgcccatagcgatggctggatttctaaagggtttactcaggggaataacttattcggaaaatatattcccattgtcacattttaaaacttgacagccatcataacaaaaactggtactgacagtaggcagacattctgaatgtattcattcttaatttggatctattggctgtgatttgaatgatctttggtagtaagttaaaaggatttttttttccttagctaagcgagaaacgatagaggcctatagctagaggactgatagtgcatggtgcttttggacaataaacatgtactttattttaggatgtaatttagtgagcagttagaaagcagtattctagtctttgcattagggcaccactgataaagctggctaagcaaagagaaataatattatggcaaaaaggaaaaaaggaaaagttgctttagttgctgaagctctgtgctgctcaggcaatccaactaagtggggcagggggcgggcgggggggagtattttcataaccctggtatttgaaagaaaagataattgagaattatgtcttgatttagttgtgactgccagtcagtttacaattttatggccaacaaagctaaactggtaaattttttcccccagggctaggattgagagagctactcaactctattcccagggggtttatgagtttttaccgttttgtgagtttatgtggttggtaaattcattgtggcctggtcagatgaagcactgctgtagttaaaatgagctattatttcttctagctactcaacttttataaggtggtaaatagatgggaagcaaggatgtcaatattacacaatgccttggaggtcctggattctattttgcaacatatagaaaaatgctttacttgcagtaaaatgtgaacatatatttttcagtgcacaaataaattcatgtgaaaataagtataaaaaaatgtacctggtgggaaccgccaaaggcaatatttttccttgcggatttcgttttaagagggtttggtaaacagaagtgacactttgtcaaaaatgttacgactagacttcaggacttctgaattgtcttttacacttagaggaagattaaacagaaactctttagccacaagattacatgtcaaatgcctgtaagtttcaacatacctaagtcagttgcctaggagtcctgggaaaggccagtgctgagattattgaaatattagtaaacattactatgactcctgtttttgttgtcattatggagtccaaggacgcacatttctttgaataatgttgtgcctttattgtttttcattctgaaatgtcaagtggattttacttttttgcacataccttgagtgacagtttctgatgactaacactaacactcattttgtttcctattaaaagttaagcaataaacatattttactaaaattctgaaactcacgtaagtaggtaaatgtgggagtgaatgttaattctttaaactgtagttatctgaaaataacacatagattaggatctgaacagcttaaatacttgcatcggtaaagtgacaatagtgaagtaagacaggctattatttttaggggagagatagattatttgactttccttgctctgtattttcagagtaattcaatagttcgaatgattagtttctgtgagagatttagatctgtgcagcttaattgcttcaaataacagatttagttctggtcatacttccaaggttatcagaagcaggccctccttattttgataaaagcattgaaagcaatacattgtagaaatggtaatagaaataataatttctgttttaggaccttacatatagaacttccttttctaagataagaattttaagtcatcaattatgttcacattttattttcatgtaatttagtttaataaaataaatgtactcattcaaaatttttttaagaagtgatatacagtgtcagttttacagaattttttaaatgttggctgaaagaacggtaattacattgagatttttaaaaatatataaatgcttaaaattacagaagtaataaaaagaatggttttagacaaatcttatggaaagttttttattttattcttttataattatatttatggatatttgtctttattagtgtagtaatatattttataacgctcataatttgaactttcaggctaatgtactataaatatttgtattacgcattactaccatcccaaatgtaccaaaacacgtttagagagaacaattatggacaaaaaagcaacaagcattatattttgtttgacatatttcatgttagcagaaatgtttcattgatttttctgtaacttttaatgcatcccatttgtggagtaatgaaaatgtaatgataattgccacaatgtaagcaaaaattgtatcctacctgaaaattactttccagaaaattcatggtagtgtactcagaatttgagactcaagagggcagaggtttccccgattgtgatgttttgatttgggctaagaggaactctttttttttttttttacacttaggtgccctttaacatgacaagttttgaatgagttaggtagcagaagtttttcgtgacagttattgtagctactaacctatagcatctatccttctaacgttcaaagaaaatatatttttctgtcactgtgtatggcaaactttattttcttgtgcccttaattttgttcccctttctcacattatctcctggtacttactgaccattacctcagttttgtttaggccgtctttcttgttaatcttccaatattaatagtattgtattatgttgctctgctgggttttaaaaatattgagtattccatttttggtgtatattattgtataaaatgtcctataaattattttctggtatattattttgtaagtttttgcagtgaatacgtgctgccttgcttgtattcttgccttcttccctctgatggaatacaagttatgtaaactctctgtattatcctaactagtgcagcaacacaaatacttttgaaataagaaagcatactcatgcaagagtaaagtaatcttctatggcatttacatcatgtttgaccctcctctgcacttcagcaaactaggaggaggttgtaacttggactctataaaaccttatctgccaggtgatatgtaaacaggattgtgtgcacacacattgtcatataggcaaacactctcccaactggtgagctcataaaaagcactgtctgtaaatttatggtacctgcacctcatttgagaatcaagtattttgatgcttaatttgagatgacatcatgatcctccctccctgcttcctcatccttaaagaagtactaagattaaatagaattttgtcaacttctacttaacttggccattatttatatttgtaactcaacaggcttcttggtggagggactgtgccttctaaagatctgaaagaccttatagtgtataacagcttaccttccttctctgtacgcacagatcacatgtggggaaaccaaggactacaagaattccttcttttgcatatcagtcctcggcaggcaatcaatgcttaaataaatgcttggtgaatggattagttagaagtaagaacattttggctactgttcattactttgaaaagtgctggaaagaagtggaagttattttcctttccagctgggctgtgctcttaaaaatagtgagtgtgtatggatgaaaataatcatgagtaccgagatgtgttgccatgtacccaaggataattggctcacttacctgtttacggattattcacattggagatcatattcatagctccagaatagtttctttctgacatccaatataaacctgggcctccttcttcctactgttacctggcgtgagcttaggaaacccaaactaagtttaaaatcagcctaagcaaatgtgcagatcagctccagtaatcaaagactgaaaatcagtccagcattcactagtttggggatgattttatagtaaccctgctactgattttaaaaaaatttttttttctgtttaatgtggataattggtaattaccggtatttaagaatataattttaatggatagggctaaaaaaatacgttagcagatcgagtcctcaacttcttccgtttctatgcataggttttacctcacaaaaactactacaagcaccaagctccctgatggaaaggtatatggaagattcattcattctttctttcattcatccattcacacattcactcattcatcatacaatggaaaatttttacttaaccatgtgcaaggaattgtggcaaaatgaaaatgagatgtacattcagtatttaaataaagtttagtggaaagtttagtgaatataaatgcacactttacactttttttctgcattttttcctttcttctattccattggactggtatgctaatagctgtgcactttcatcattgtgtttcaagttgcatgttgatagataatatatgccacattaaaattaggctttggctcaattactattcaatccatgcccattttcacctgatactccttgtagttaccagcatgtgtttatcagatgattggctagaatcattggagaaaagaatgacagcggctggctcaaatggggagaccatcctcttaatttgatggaagggatgacctttttgtatgttggcctccctctgagccttgttgagtaaaaccagacctgccttttgagctggctgggatctgtgtaattctcatacaacagaatgccgaatgtgatgttcttaaaatttgtatttcggtgcatagacacttaaggtggacttattttttaaagcagtctattctgtttttcattttggatttcctctcctgcactccctcgaccattgcaggagcatcgtgcatcaagtcaccagggtggtccattcaagctgcagatttgtttgtcatccttgtacagcaatctcctcctccactgccactacagggaagtgcatcacatgtcaggtgagagttttgcgatgctctctgttttccatctgaggataaagtcctgacctggaaaattgcctcctagccatgctcccttactttgttggctgttgaatatcattttctttgcaaactctgtttgggcatagtgtgggaagttgagaaattgccaagattgttttttaaaacttcgattaaagtatctatctatttggtttaatctatatgttcatgaagactttcatttgactttgcgatgattgataattgccaattggggcttgaacctcatcattttaattgtcagttttccttaatacaattaagaatgctatgctaccagatatcttaagtcacagtttttgcattttagattactgttgtagtataatatgtgcgtagcaaaacagagacctatttgtttaggggaaccagtatttgttgaatcttgaatttctttgtgtctgtttggattttacaacttcctgattttcccacgtacagtaagtttttctggcctggagagtcatgcagacatagggtgtatgcaatggtgatgactcatggttctctattgaagaaagggccagaggatattgcctcaaattaaatcaggaaggaaaaagaggtttgctagaacttggggcagtaagggcttgggaacacaagggtttgagtgtatgtaaccaagggagattgtgaaatagaaaataggggatcaatttctatttgccttggaaatggacctgcttgaaactgtgaagacagactagattagaggttcccaagcctggctaggcaacagaatcacctggagagcttaaaaaaatagaatttggagctccaccctagacttgatgaatcagaatgtttcctgctggaatcattgatctgtctaggcactgatgctccacaggtttgggaacccctgggtcggccggtcttccagcaactcttcctaagttatgttctgtagacttagttggtgagaagctcattctacttttagcaaatctcccatttgaaaatttgaattttcaaaactcatttttcaagaggtagatggatatttgctttataacaggttcatttaaacaataattgaccagatttctttgaagaaagagctgcctctttaccgtaagagccaatttttaagttacatataaattctctggcatcttagataagagcatggagctccgtaatcaacccatctggacttaagatctggagctgccactatgaccttgagtagtcctatgtcctttcaatgcctcagtttattcatgtataagatggaggtaatattagaactttcttatagggctgctgtgaggatggactggagtaaaatagtagatatactgtgggtagaatagtacctggtgtatggtttgtatcttttaacagatgctatcaagtaacttatccctcaacaggttgattgttatggtcatgttttatgatggttgctcctgaaccatacatgactagaaatatgtaaatatacctggaccttggtctttggacccaccctgtagacatctacggctctgcaaagccaaggagccttttatttgtttttgctgaattttaaattctgaatttatcacaactctctgactgatgggatgcatgtgtggtttttttttttttagattgttgtaaaatgaactgatgaattgcatgcataaatgtggttatttgtggtctgagtaaaaataaacaaaaacctgagtgactgaagtattatgcctcaggaaaaacagccaaaaaagtcccagtgggggacaaggtggaggagggaagagtcatcacagacacgatactcttgtaaaatatggaactggattccttacattttattggctgtggattagagaggtgttctttaagtggaaatgtaacctaaagttacatgcaaaggtaagcctcttaagatctacaagtgtcagctgaatgaaaaaggtagggtgggccaggcacagtggctcatgcctttaatcccagcactttgggaggctgaggtgggtgaatcacttgaggtcaggagtttgagaccagcctggccaacatgatgaaatcctgtctctactaaaaatataaaaattagccaggcattgtggcaggttcctgtaatcccagctacttgggacactgaggcaggagaatcgcttgaatcctggaggcagaggttgcagtgagcccaggtctcgccactgcactccagcctgggcgacagagtgagactccatctcaaaaaaaaaaaaaaaaaagagaggaaagaaaagaaaaaggtagagtgtcttactgctactttatctcttagggatgatactcattttaacggttatgtgctaggctgaaaatcctcacatttagatctttggggaaatagtttaattgcaaatgggttgagtacacgtgcattttttttaacctgtggtgttgaaagggagtcatttgtgataacagaaatatctcaagaattttattgtgaaaaaacaggcagcaaaaagtcatatctcttggtcaatatgggcagcttattgagaagagacctaggtttttataatatgttaggcaagtttaagtgtcttatgaatactaaaatactgacgaagtagcgcaaagtcaccttgaattttaagcgctgacattttctatgattgcatttaaagaaagcttataagcattatctaaacattttgcatcaataatggcctcattacagtcctcacgattgacggctcaacgtaggcagaaaaatagtatcattcatgttgtactcttttatattcattcagtttttttcttaaacctacattatagttctttctggttctagttattttataaatatgatacagctatagcaagttatgacctaacttgttcacagtcactatttatgtaaagaaatgattcattcatttattcattgtgaatttttttaaaactactgcatggtgctgtgggaatggaagtgaataagagctaccggaaggcagttattttcttcctggtcaggcaggggaaagaagaaactctctgaaataatgaatacgaatagaatggggttctaacagtgttctaacagtgaaggaattcagaagagtgacgctgagtaggagtgatcaggaaagactttgaggaggagggatcacttgagttgagctctgctgactagattgcatttctgtgggaagagatggatggagcatgaggaaggccatgtgtgtgtctgggacataacaagccaatgcacggtatgtaactgaccaggacattttgactgaagcctaggtgctggtggacatctgaatttctggattcgagcagacagtagagagtatgggaataaaactgccgagaggtcaagtctgaagataaatttggaggagtccttggcataaaagtgatctttgaaattgggttcttgggcctggcaaaaagtttgacacccaggagggggatgactgaattcagggatgacgtcagctggtgtagaatgtgtagagagaaggtaagaggcagcggagagtagcttcaacattgatgtggcatggccttcgtctgccttcttttcatgatctggggtgaaggaggctgggtggctggaggagttgggtgatgtatgcgtgggccataaggactcttctgcagctcaggcaccttggaaactcagtgctgaactacagttcaatgaaatcttgtcaaaacctctcttcctttaagacctttaaaaaaataggaacttgagctaattttagctaaatctaatgtgtgtgtgtataaaaatgaatgctgcgtttgaaattcagcgtatgcggtatctcgttaaacaaatgatccttctattttcctctaaacagttttattaagattttcagtgaagccctgtacgttttaacaacaattccagcatttctttgatcttttctaccgttgatttattcatctcacatgatatgcgtaaatcacaatgtgccatctacttgactctgtagcaattgttcatttgtggcaattcatttactgtactttgataaaccacattaatttgggtgtgttttgtaactttagaggattccctggaggctttctgcagactctttaaaatgtgagatgtgtgtgtttttgtgcgtgcgtgtatactgtatatacctagctactagacacagctctttgaacaatttggcttcccatttatactttatagaaaataaagagatatagaattggtgaatcttgggtctggggagaaagttagtctaagacttcctgatgtaaagtgaaagagaaggctggagatgatgttacgatgatgttagtgagcagtctgatttaatgtaatgagagaaaatttgaggattaagttgtggtttttttttttggtgctgagttagttaggatgggctctctgtgtagcccaaaagggctcagaataaaagcagtgacttatttaactttcatcaaagacaagaaggttaagacaggaacaagagggatggagcaaacaactccaggggcagatcgttcttgtctgcaattatttaatgagcatctaatgtatgagacgcattatgccaacaaggccctctagggaatatggagatgatcaatagttcacatttactattctgcatattaacttattgaatcctcattacagtcctttgaggtaggcatcattattttctccattgcacaggcgaggaaactgtggcacagagagggtgaataatttccccaaggtttcccagctgttaagtgatagaatcgtgcttggatcccagtctacactctcagccctgttccttaagccctgtccttaagaagcttacagtcgagtgcataaggcaaggcatggcttggagtaatatttaaagagccatgacacaggtaacacagtctaggaagtcaggatcaaggaagggtccttccttggagccttctcttttgatgcctgcctgtctgttcagtcacatatgagctttctgacacaggctgtcccatgcaggctttgtggtgttttctccctttctttcactcttactcatatctccttgagattcctatgcactttcaataattattaattgaagaaaatgatgacagtggcaatttgcttatccgtttcaggggattggcttaagttggatccaaatgttattcagcatcaagagtctcagcgagatgatgaacttttgactcttaaaagaacttcactgggtcattgctcagcttgcaagatttggcagatatgaactatttgtctctccagtgtgataggtggtggtgtggcgctgaacgcaagctctaagaataaaacgtgcagcaaaaggaggtcacgctttagtcagggtggccataaggaagcttagaactcacatcccctctgcccctgcctcgcccagtctcattttctctccttcactagaacagtgaatgaatctgagctcattcatgtcaagatgatagagaagaaagatcactttctcttagctggcttagggaaggccagattgtctttcttacactgagtgaaaaattactgaggacttttgttttttttttttttggtcttcaaggcaacatctcttgcttttacagacccacggaaatcgagaagaggatgcaagatttactattcgtgccctagcctggcagcttcagcctacatcacagctgtaatcatatgtgatgcatttttatttacagattagtaggctctgactctgacatatgactaaccgggaagctcctccctgtaacagttgtatgtcgtctgcttcagagaactaattgcttggcaattcccctttggtaattccctctttattttctgatgagttacttaacagcgatgggcttgttgagcagagcgtggagtttaatgtgtgctccagaaactccactgtaggcctgggggatatgtttttcgagttctgtttagctttactgaaggaacagtgaaaccattatatggcctgttaatatttcactcaataccagattaaacaccgagcagcgtgcagttttccaaaagaaatcaaaaccaggcttctttttaaaatgtgcccctgtgcattagaaaattattaaaaaggaatttaatatgtatagaatgtttaatgatcttttgaaaatatggtttcaaatggagtagtcttccaggaccctacagagtgagtatggtgtgctgttggactggtagtttggaggctcagtttctgttgcctgccctgcaacaggatgacttgtgctactcactgtaccttgctgggtctcagttttcctgtctccaaaacacaaggaggttgaaagaaatgatctctcgggactcttctatctctgacattgtacagttccatgaatagattttattgtaattcttgctcccggctcccccaagacctttgcttctgtcaaacatcatttgctgttgtttgactttgttagattttgtatttaattagaatttatattttagctattattatgtcattatttatagagtaagtcataagcggtgcctaaattcatttatcaccccatctatattagtttcatacctgaatacttcctccgctcctttttactgttcttgctaccatgtcccaaacaacatccatttctggaggtggaatgcagtataactggaaagaatctttcagctgattgtgggattattttttgcaagaggagtgcagaagctctgcttttctaagcagtaatatcaagggccatattctgcttttaatttgcaagtagaaatcgttttgatgtcatttggttttacctgcaggtgcaggttttagtctctaggtaattccttttctcttctgcgtcaactttcccaattagtgtgtgcagcattgccttgtctttttggttaattcataagcagttcatacagatgcctcttgattcattgcaattattaatagtttctttaggcagctagtgcaaatagaaaaggtgacatttgagagggtttgttgttttaatttatttgtttcatagacagagagggagggtgaaaatgaaggctttaaagtcagggagattgaggcttgaatccttctggctctggctcctggctttgtggtccaggtcacattccttaaatctgtgatcctcaatttcctcatctgttgaatggggatgataatatcacctaactcacagaatcactggaaagattaaatgtgcactcactctctagatgttgcttatggtagtatctcaataactaataaaaacagacacacacacacacacacacacacacacacacacacacacggaaggcatagcatttaagagctgaataaaaaaagcaagaacaaaggaaagtgctgcatttgaggtatagtcagggtaggaggagcttctcagagcagccagttttagtaggcagagtttgaatctcaaaaggacctttgaaatttgggaaggactaagcaccctccactaacctgtcagtgacgttttctgcaggtagctcttgggaaggactaagcaccctccactaacctggcagtgacgttttccgcaggtagctctgctctacagaaaagagtgtttactacacatgactgataaaaataccatgtttttaaacatgtattgcccaaaccttacaataataaaggaaagccaataaaagcaaaagttccctttgattccaccattccagtccataaatcaagttcatttttatgtgttgttttttagttcttgatgatgtaacttatatctttttttcagttttgtgtttcccatttagcataaacattcttagtaacttcagctatacagttctcatttgcaaggatcacataacattctatcaggttgttttatcttaatttttaagtttcctatcatttttggacattcgagttgtttctaattgtttactgttgtaaagccgcagcgaatgtctttgcacacaagtatttaccgaggacacactcacatcagaaggctcaatactaagttagagggagcttgctctgaattgctttctaaaaggctgtaccaatttacattgttactaatgatataagaatgtctctagcttcaatcttaataattgtgggacttactattttttggctaatttaataggctctttggttttaaagttttcattcctttgatccctctcagagatggaacatttccatctgtgtttatttactaattgttctttttacaattagcaaatggaagtcttgatgttttctaatctatgtatatgagctctttatatgttctagatattaatccatttaaaaagtcctatttgctacagctacttccctagtccagtgtcctttcatttcagtgatgatgctttttgttgtacaacggttcaagtttttatatgatcagcctctcttttcttctacttgtacccagggccaacctggcaggaataaatgagattaccgcagctcaaattctgcaccaggctggcgagtggtccactggatggctttgctgggaatagctctttctttcttctgctcacttttccccttgggaactgtttcctgttgaagtcccagtctttctatttccaagggcccctttccccttctcccacctgcccctcactccttgattctcacccaccctgtgccggtttcctggctgtggcatcctctctgcccagttctcaaccctccgttgctgacctgtgtgtttctcagggagccctgtcctgggagcagtgggtagaaacatgtctggcagcctccctgactagggcctagagagatcagtcaggaatctcaggcctggccaaagtctaaccattatccaagtctctggggtcggggtctttacaacttctgtcttacatttctgctacgtagcaggctgccctgctaaggaatgggctccttggcgctggttttcatccatgtaggaaccagagaggcacgatgctaccctgattcctttcctgttgtagctcttctccggggatagctcttccagtggaaggttgggaacaacttcctagggattgaattttttgaggaaggctggtctcaaagtgtgagttttagctgagtggctctgctgagctggggtggtttggcatatgatatacctcctaaatggcctgtctagatgtattgttgttctggtccaacatgtttttcctctttgaagccaaaatgaacatttgttagtatttgaaatctgctgacatctctgtttttcttaactccctccctgggttctcatggtcctcaggataaagtctagaatccttagcctggctccataggttttgaggaccttccttatctctccagcctcatcactcacatgttgccctgtattcgtcccacgtcggtcccatcgcacttcctccttcaagtgccatactctgttttttgctccagcctttagacatgttgttcttcctccttagaacccagctcctctctctgcactgtctggctacctttccctcattcttgaaatctcagcttagagtctcttcctcacgaagcccttggactagggactatgttatttgctaccttttctgggttcccatagcaccccattcttccccttgtataatacttcacaacccctttcctggcccagcgataggagggactgccctctttccagtatgtggcatctagtgaatgggcaatacatacgggcattccccctgtgatgcttatgttacaaattggatgtgattccatctattaatatggactgtgatgtatataattgtggtgtgtataattgtggtcaggaaccagcatggggtcctgtgaaccacagtggtggaaaaagctatggcacctgtttgttccactggctttgtgctttgtccatcacacagtgagtgaaaaggtgacaaaaatgtgtaagaagcctgtgctaaggagaaagaaaggtccaatgatgaattttctggaaagaaagctgtacgtaatagagtgctgaattcgctcaatcatatttaagttttatagtactgcacttataaccacacaaaacactattattattgaaattcaatacaggaaaaatgcttttgtttttgaacgtctaagactgtcttcctcctcattgaaaaaattcctactgaatttcgattatatgaagatttttagaaatgcagctattgcatcgaatgaataaatgaatttgaggttcacgttcttaacatctgttttctgactttgatcagtctcctttaagtgctctcgtggtcatactctgcaactcaggtgaaagtttctagtgagatagttatcccaaggagatacttttatctggaagagagtagttctgaagttctaagtgaggttggttggttagatttaggttaaggtaccacatggaaaggagaactgcttaaaggggtagggtgaccatgaaaccttcttctgcaaaccctgctcgtcaagtatgaaaccggtggggtaggaggtccatctaatcttatctgtgcccttttgagttggccggccgggtgaccatccatctcctctgggttgtaaatgacttcatctcgaagttgcactgttggtggtaggtgaggacgccttctccaggtggagggagtgcatttgtggttgatggtgtgagcgaccatatgttggaccatatgtcagaacctgttaagagattctgacaggtatggaaatgcctcccattggaaactgaagccctgggtcctttgaccgctgcagcacccccagaggagagtaccctaaggcccttttaaccttgccctgccctggcaggttccaaggggaggcagaaatgactctggatgaattttgttttgattattcttccccttttccaggctctgtgtccagttcacctctggagctgcctgggtcactgcaacccagactagagagaagtatgaccccaagttgtggcttttattgggagacagccttcatctaaggaagtgggaaagaatgtgttccccagctgctgcctttctggtgtctgatctgatacttttcaaaagatagcagttttgtttggtttgatttggattttttttttcttttgtaagtggtcatagacccataagacaagtttattattgtattgacagaagaaaaaaatgccatggttatttatttaaaaatctctttccatacaactttgctttctattgagtttgaaggaaatatggtgatggcatctaagcccaaatttcggtgttttattttggctttcctgttctgtttaagcctctgtaaccccttgaacctttctctactcttcagaaggaacaagttatattttttttccatctcaacatcgtccaaatgaaccgtactattttaacaatctgtgtaaacagatataaaaggaggaagactactttctttaattttcctcccagcgagctgcaaagctgtttcagtcatcctagtgattagcagaatgtgagtaataaacaacattaaaatgaagaaacgtctttctgagtaggaccttgaaatgtgggtctcaccagtagtatatgagccttcctcagactaaactccatgacacagttcatatcatctttaagtcctggagggagggttttttaatatgtgtaaatgaccaaacacagctgttggctgtcctgctgtacagagaacattcggtgacctgaaatcgcaaagtttctgtctctgaagggtgcacttaatttaactttttgccctgaagtctcaagaaatgagacttcctttaaaaaaagtgttcttaaaactttctcattttaaatgtccagggtcttcaaagagtatactgggaggaaagtcctgtgtttcctgtttctcttgtaggactagtcaaaagtaccctttctcttgatggtattctgcagtctgagcctctgatttagtaactacagcctttaaaaccacagttatccagaccatgtgcagtggttaatgtgtcatgagtctgcctcagctgataatagcacatcacagaattcagagtgccttagataaattgtttcagtggatagtcataatgactgcttgagtagaaaagtaccctcattttctaggggagaaaacagaacctacgaggttgactgatttactagattccagtggttagaaatacatgtagcctgtgctgtaaacctgattttctgacttgtagttcagctctcttctccatctccttgtacagccaagataccccagaaattatttgcgtttccgaagttgtaggatgaaaagacatgtctttgcttaactgagttagccccctagaacaatattgagatggagctggaatggtgaagaaatgcaagagtccaatcccttgggtatgtgcaattcccagttaccccttgaaacagtgcttcattataaatttagatgttagaggctgggcatggtggctcatgcctcgaatcccagtgctttgggaggccaaggcggtgggatcgcctgaggctaggagttcaagaccagcctgggccacagagtgagaccctgtctctaaaaaaaataaataaataaataaaaaattatatgttagatgtttttatagtgccggagcctaaacttgatggataaacagagaatgattttcattttgcagccactgcacctttaaagttgagctttttgaggtgtatttcctttaatgcacccatgacagcaaggttgaaaacatcaggaaatcaaattgatctcatatatggaatcttgaaatttaatgtcatctgctctgagaagtccttgtggatgggaagattgtacaatcagatcatttctctgtgtaggtatctgctgtctttctactagatgttacagaagagattagaagaagctcttccagccacctgtgaatcagctttattctgctaggcaagaaggagctggtgctggacatttgtatctgcaaaaaccatgagttacttccccaataattaagtatctactgttacaacatctagtggctaatcttttagtaaaatacactgtccatctcttggtgccagaagcaataactattatgaagccttttctttctttgcagaagtagtttgctggtgaccatattgttagttgcagaaatactcagaatctgattcacatttagacttgacagaagccagattttatatctggaaacctcattagtgaaactgcaaacaagacaaaggccatctatctctctcttaggtgccctcctcaatctctttacagcttttcccccaggagtcaaggagatacagcctggcagggacttttgcttggtgatggagtagctaagaatgtttctctctaacaggtcacagaacagaaagtgctggtggacatctcttcttgccccaagatcttcgttggaagtccccgggacttggtgtctttgccgttcaaagtgtttatgaactcgccaggaggcataatgtgtcaccattttattctgggccaccctaaaggatgacacccagcttcagagacctcctcttggacgacatccctgagaatcaatgttttagctgtcccatagtctgacgtctgtttccgaccgcttttgagctggcgcaggcttagtcattaatggccaggacgatgttaaatgttctgcctgattggcttgcagctacacaccttttgtcatttgcagagcagcaactccctcttgagctcttggggagtctttacacaaatacactagaaaaaaggcacccatccattttttttccatcttggcattagctcacaggcatagtcctgggatgacctggagtagaggcagtggaggataaattcatcttgcacagacttgtttgtgctagttctagcctgtctctcgccacagatctagcttttaaatactcaagtgattggttttgtgtaggaatgtgtggattgttggattggaagaattttctccctggatttctagtgtttacataagcagatacaaaaaaaatttgatcactgatttaaatagcagggcttattttaaaaagttatgggtgcttcaaggtggtacagaataaaaatgtcagggttttttttttttttttttttaacaagtcgtaacacaaccaaaatgtatatattaatgttttgtcaggaaagggtcaaaatggaaaatttgcaacaaagacaaactacaatagaacaagtgcaaacagaagctgacaaatatatgcccctcgttgggagttcagcccatggaatgttatgtaggacaaaaggaatggaagagatatttcagtaacattttgttctctgtcaaaaaccttctgaaatataaatctgctgtgtattggagaatggatacagcaattgattcaagttgaatagctttcatttaactagaatatcccacagaaagcagttcttgttctgacaaccatatttttgctttctttcacttaaagaaaattgaattcatgtttacatatcttatagggttgttttatggacaaagacacgggtcaaaccccatcacagtggctagtgttacaacaaatagaaacatttctaaatgaaataacatttctaagccagggccagtgcctgcagtaataatactaggttggtattatgaagccatttgcaactataaataattcagtcatagatgtgctttttttaaaatcctggttttttaaaattctagtcttttgccaatacacacacccatacacatacttcacctatttgcataatagaggaggaatatgaatatgtatataataaagtcactttattttggactttctgaaacagattaccttttttcttctcctcatgatggctccctgagttgcttccaattgttgaaattccataattacccacaaatatggatgtgcccttctaagggtcttgccatgtcaaccagcccagctgaaagctaatagccagtgttagcggtttaaggaactgagcttcagaattgagagcccccagcaaaggaagttctgtttttattctccatttctactctcctcaaggagaaattaggtgtttattgttttgttttgttttttaaattcccagatcattctggcattggtcctggattcgctgcaaatgtaatttttagcaacatctattactcctgaaatattttggctcttcgtggcctgtatgattcagtagactctgaggttttccaagtacattaaggacttaaatacagaatgtcttaaaattttagggctattgatcaagagaaagcttctcgaggaataaagttctgttaggttttagccctattctgctttcaaaattcttaactggatgccgtctattttgttttctttctgtgtttataactaatttgctacttgggtttattgttttcttacttagaaactacttttttttttgttttgtaaatgcacagcacttaaaaatataaaacagttccaaacagttccaacctgttcattgtttataccttgaccatcttttctgtcttattgctgaaccatcgcttctctttctacttctcttctgggatttcatcttgctcagctaaaattctagtgtgttattctgaatattatggctggagtttcctgaccaacttcttgcatctgagtccatttcctgtgcttaaggctgctggcattccattcactgctcctagtcaaaactgaaacttctcctgctaatgagattaggccttacaacactattaatttcttcctctctatttcttgctccattgttatttctcagagatgaaaatctatttgtcattatgagattcattttggcatcacttactaaagttcccttggatttttctgttcttcatacaccctacagcttcaaactgcaacagtcatcaactggtctttgacaaattagttgtctctacacatggtttacaatattacactagctgtttaaaaataattaagcttctttctgtgttctttgctgtgggtcaggaactttacttcctttgccatgcaacacagaagttaatcacaaatgggtcctctgaaccaaataattaaaaatagagcaaagtttctgaaccaggcggttggcagaaacgtctgtacttccatctgtgcatggttaggaaaatatttcacgatatttaaatagcatcagctttgctctcttttgtgtgagagtgtgtctgtgtgtctatgcgtaattcattgctttgaaggtttgtttgactgttagataatcatataaaaaaagttactggcaaggaaacaggaaagcaaatccaggtgttttgtgcatacattctttatttaccagtctctgtgaaggagcaatgatcttgcttttgcttttctctctgactgaaagtttttgccttgttatgtgctgcagaaaactaaataacattgcattttgactttgaaatctttatgtctcttgattttccacttacaaataacctttgctaatggctttggggagctgttcgtatgtacccgaaatgctgatgaatctatttcagtttgaagtgtggcagattaggaatttctgctctctggaaaggggatttatacctggaatatgcatcaaattcacaaacactttgcgatatacgtgcagacacatgagtgactggttttgacaggaatttaatccttcaattggatttccctttgttcttgtgagtaatcagtatctcataaaatatattcagttttggctaattgtacagctatgatacaactttaagtttctaagatgtaaattactatgtgatataaagataattcccctctagcatttttcttttgtaacagcctctttttactcctgaaaagctctttattttaaggttgatttcattctactaggagaactgttgtgttagataacaactaatgcccaataaatacactgaagggagattaggaactgttaaagaaagaacacaaagcaaatgccttaatttcgttctttcagaacgtatatatttcccaaagttgtcagttcctttatgtttctaaaaacttaccaggtaggcatattcttaatactttgataataaaattaaacactgaaatcaaagctgtagattgaacatgctcacattaagtgaaattaaggagagaggaatacatttcattattaatgtatcagtgaattctggagtttagccatgaatatcagctataatcaataacagtttgagtatttaggcagtttgtaattcatgaaatttaaatcagaagggtctttaaacatctttttgtctaatctcattttgcattcaatttaattctattttttctcagcctactatatgcagagtactatgctagcagggaaaaataatgcggaataagttgtggcccatggtttcaaacagattaatctttgattactctttgatgctttttttgtattatttgagggacagtttttttttcttttttgagatggagtctcgcactgttgcctgggctggagtgcaatggcacgatctcagctcactgcaaccttttaaaaagagttaagtggatcttcctaatgattattctttgtcaatgtaagatattaggacttaatgtattttgtgaactctgagtacacctacaggtgagtggtagatatcttcatactttaaattactgctggattttgtctgtaccccgagacagaattttggtcttctcttatatatagcagttaatattaatgaggcttccctgaaagggttcctggatattcagattcttcacacttttcttataaaccattagatttgtttcctccattcatttgggcatcttctagtgacacacggagtggctcttaaaaaagtggaacttgattgctgatagttttattcaataaatcattgttaataaatatttatttgcgatcagaaacacaaggagggagtgtacacactcagaaaagcccacaatgcagggagcctgttcttctaacaataataatggctggctggcatattgaggatttaggatgtgtcagtcactgtactaatcacttaatcctcacagtaaacctacataggtcattattatctccaccttacagatgaggtaaccgggttagtagcttgcccaaggtcacagagctagtaagtggtgggactgggcttcatgcatgccattttaaccttagaccctgtgcttttaactaattatactctattgcctaccacctgtgtcattgtagaacttgcaaaattatgttcaaaaattgtttttactaaatataaaataaaatacagtaaaatagaaatacaaaagtatattcacaaaataaatgtaaattataaaaaataagggttcagtgaacactcctttaactctacacccatattttaaaattaccatcaactggatgtcctctatgtggacctccccaatcttgtcacattcttcccacctcagaaggaaccactatagaaacatgacgttttaaaatatttttaagactaggcacggtggctcacgtctgtaatcccagcactttgagaggccaaggcaggtggattatttgaggtccatagttcgagaccagcctgaccaacatggtaaaatcctgtctttactaaaatacaaaaattagcacacgcctgtggtccccgctactcaggaggctgaggcaggagaattgcttgaacctgggaggtcgaggctgcagtgagctgagattgcaccactacactccagcctgagcgacagagtgagactccatctcaaaaaagtatacatatatttttcacgaaagtacacaaaaatgcacaccagccagatcactgtttgttttctctcctttttctcttcttttttccctactttttcatctctcatccttcttccttcttttctcgcaccatcatggagaacaaagaagaactgggtcagaacaaacctttaaaaagtgaaggcgagcgttccttgcggggatgcccagtgtcatgactagtgttgggaattcttggtgagatgacaatatttttgcctcactcaaatgaggcatgcccttccaagtaaagcatgctatgttttgtagcaaacagaacacctgagaaggatgatttcatatgactgtgccaacagatctctcacaagcttgtcaggttataattcacaaatcttaactctatagtctatagacattttttttttatatggggtctcactctgtcggttgcctaggctggagtgcagtggtgagatcttggctcactgcaatctccgcctcttgggttcaagcgattctcctgcgtcagcctccggagtggctggggtttcaccatgttggccaggctggttttgaactcctgaccacaagaaatccacctaccttggcctcccaaagtgctgagattacaggcatgagccactccacccagccagtggttctttttcatttgagatggagttttgctcttgttgcccaggctggagtgcaatggcacgatcttggctcactgtaacctctccctcccggattcaagtgattctcctgcctcagcctcccaagtagctgggattacaggcatatgccaccacacccagctaattttgtatttttagtcaagatggggtttctccatgttggtcaagctggtcttgaactcccgacctcggcctcccaaagtaccgggattataggtgtgaaccaccatgcctggcctgtttcttttttttttccaagaggtcagttctcagtctgttgtccgaactggagtgcagtggcatgatcacagctttactgcagccttgaacccttgggctcaagtgatcctcctacctcagcctcccgattagctgggactgccgctgtgcaccaccacacccaactaatttttaaaatttttttgtagagacagggtcttgctatgttgccaaagcttgtctcgaactcttggcctcaagccatcctcccgcctcggcctcccaaagtgttgggattacagacatgagctgccgtgcctggctgacttgtggttcttaatagtgtggctcttaaaatagcaaacatttttgggaaccaatgtgagggcacttcataacacaatcaaaaaccattaagtggaatatgttaagataatgtaaccttgttgttgtcccttaatgctttaatgcaggctttcagcaagtagtaatacctggtatggtgggtgtaaaactcagaatgggtcccggcatggcaggaataagagaattctttcatcggttggaaaatatgtttgaataattcactacatttaaaaaataggtaaagaggcttttggttttggttgcaaattgcactcatccatggaagtttttcaagggccatacaattctgtagatggaggtggcaatttaatgcagtcttagctgtttaggatttagaactatgttacttttaatttacttccatgaaattacaaaaacatgtaatgaagctaaaaagatttcaaaagaagcacatctagtcaaacataaaagtacttaataagggcatacatgtagaagtatattagtctttgcacatatttacatatgtatgttttggttgcttaatatttttcaagtgctgcatgcatttgtatgtgtaaatacagtgtgcaccctttatagaactagtgttgggggactcttttatcagctattatgatttggagctttatcaaatggagtgatttttttttgtgtgtgtgtgagatggagtctcactctgttacccagacttgagtggagtggtgccatctcggcttattgcaacctctgcctcctgagttcaagcaattctcctgcctcagcctccaaagtagctggaattacaggcacccattagcacgcctggttaatttttgtattttcagtagagacggggtttcaccatgttggccaggctggtctcaaactcctgacctcaagtgatccacctgcctcggcctcctaaagtgctgggattacaggcgtgagccaccacacccggccggagtgatattttccaatggtcatgattctggcctgtaacaccaagcagtataacgatgagattgaagtgtgaccatgtgcgtctgcctatttttatgttctatctcatctttttgcttggagaaaaattatgttgaaagactacagtgtgcctataaagcttcaaatatgaaaaaagagctacatatgacactttgttgcagttagtccattgtctcaaaaacatgctataaaaatatgacaactagaaaagtcttggcaaatgtagcatgagtgttgccggtttaaaagccgtgtttgagtactctaaagtacttttctgtgacagctattactataggaattggcaccagctaagaaaatttacagtttaatactttagagcaaataattgcttagggtgctttaaatagcacaggaaatgtgtagagtgtttacttgacatttgctatattgaacactaatactgaaacagattctttgaccacagagaatgccagtgtaggaggggtgggggtaggtgggagaaagaggcggagaaggaaacggcaatacaattagataaaaattaaatgacaaatgtactttttcatgatacagagatatcatggggaaaaatgcccatttgtttgatcaagtaatcttctagtgtggtagcagaaagcaaagtacagacaacttcctgggattaggttcctcctgctaaaggctgtcttcaccagaaggtcaaagccttgcagcccttggtcgctctggtttatttttcaagctcctgaaagcaagaggaatgacctccgtttttattaaaaaaaaaaaaaaaaaaaaaaaaaaaaagaaaagaaaaaaaaagcctctctcgttatctgtctaatctgcacatgcttgtgatttttttttatgacgactctgatgccctcatttctcattgcagctcagtgcttgtgatgtttttttcccctgaatgcatcttgcactcccagaatcttcttttcattcttccctggctctgttaatacgggtcttatcttagaacggggtctagtgcagtttagtgtagctcttacatgcagagcattttttttttgcacaaactgcttctcgtggattgtgattcagttgcacttaaagggaaaaatagagtatattttaggctactaaacctccttccatttgtaggcatttgagccagttatacagtgtctttcagggagttttacatgcatatgttaataaccagtggcacctgtgataggtccaggaatgtgaaattgtgcaacgttaatgacatttgtccaagcttcttccttctatcttgtcaatatgagctacttttaaatacacaaaggaattttgaaaacaccaatcaaaagtcaaaatttcaccctgcagcatggcccggcacccagaacactcagcaagaggaaggtctgtatttatggcttttccactgacttgaaatttgacctggaataaatcatgtttaacttctttatgcttcaattagcttttgaaagatatgtgtggttgtgtttagccagtggaaaggcaataactgaagttcacaacgaaaggagaacttgaagggaaattttgttaggaaagaacagtgggcaagaatacaatcttcaggcagggtgctattcctaaaaagtcttggtacacatggttcctaaggaaggtgggacattttcttataatattctttctgtattttgtagaattaagaaatatattattgtacataaatattttatattacattatatatgtataaatacatttatatatatatatatatatacatactgttttaccctttaactccagaaagctttgcgttcacacatctttttccctaacttctacctataaagggatttttagtgataatcttgaatttaaattgtaatcaagcagtaacaaacttcatttaatatgcagacatctaattttataaaggaaattccaagttattgttcatttccatttattaatttatttattttgggacggagcctcactcactctgttgcccaggctggggtgcaatggcacaatctcacgtcactgtaatgtccatctcccgggttcaggtgattctcctgccccagcctcctgagtagctgtacaggcgtgcaccaccatgcccgactaatttttgtatttttagtagagattgggtttcaccgtgttggtcaggctggtcttgaactcctgacctcaagtgatctgcctgcctcagcctcccaaattgctgggattacaggcgtgcgccatcgcgcttggccaatttttgaagtttctttttttaatctgttgccatctctgagatgagaggtttttcattcatttggggaaaaaggaagaaaggtaatcaacatttattgagcacctactgtgtgccaaacagactgctaagcacttagtccttaagtaccctacgtgactgatgttcagagggccattttctctgtgtcaggaatcaggtgggagggccagaatccatagaacaaaaatataaccgttgcaatagataattaaaaagagggaccttttagttagtggcacccaaagcatcatagtgtgggctgtgagatctcagtaaaccagttgttggtaggttcccccaactcagagacctccatgagggttggatggctggattgcaacatggtgctaaaccacatctccctggttaagccatttcagttattgcctcatttaagttgcattgctgtaaaagacataggtatgacaagttgcaatgcctaaaattcgaacgaaagaatacaggctttgaatgttattcagagcttgactccggagtcccagatgcagtttcagggtgagtaaatacaaagccagcagctcccaagtttagatgagaaaacatttcaaagaaagccagcgaacgcttatatatttaacacaatatccatgactcattttctctttgctctctcagtccagccgttattcatttaccgctcaccccacaggaaagctccttttgaagtctgcctttggctactttgcaaaacatataaatatacaccttgggagaataagggtgagagagaaaaaaggcagaggtcataatttttaatcctggttctgccaataacaaactttgtgaccagatactttgtacagtaaaggaggatgtttttaaaacccattctcagttgccagagaggcaggcagtcatcattctgtaggaagacttgtttcaggatttctcagatgtctgctgtgtttggattgctgaggtccctaaagaaccttccctttgagtcagctcgactaggcttttggaagtagccctggaggtgtgatagcaccttaaaaattcttagtaactaggaataaatagaaggagaatgggaaggaatagaagctgggtgacggggaagggaatgccaagctgtcctgcagctgggatccacacttggtgaaggttgtgcctgcgtccctcatctgtggttgggtataccagaattttgatatctctctagttcgaataccagccttgacatttaccaccttggccaagtccctgaacctatctgtgcctcagtttcttcatctgaagagtggggattatagtcaatgtaaggactaagaaaatcaatatacgtaatacccctagtattcacacttcacctgctatgatgatattaccattctcctttggagttttctaacttatttgtgtagcatttagggcaaaataccaggcatatgggtgatggcgtgtagtggagttggtgagagggagaccttgagttgtagaaagggtgggcagaacctggtttctgtcctacatcccagatgttgcccatacatatcctgtttgtttctgaccaccctgctttgctgtgagggttcccagcccctctgcctttacctgtcctcattctgccccactgtccatgcccagcatgaatctccacttctccgggacggaaagttttccccagctgcttcagcccaaaccaacttccctccccactgccctgtgcgcacagcttatttgatcatgtcatttattgcttcattttgtggcttagatgtcttgcgtcccagtcagactccatgtgactggaggcctttgcctcctttcagctccagggtagtgtggcagaaagagcaaggagcagggagggaagggacctgctctcttctccagccctttctctgtgataaactcagcatgctccaggcgtttaatctctgtaatcctcacagcctcctcatgcaaaatgagggtctagaccaagtgacctctacagctgcccttgcagcttccccattttagagtagtagatggtgaataagtatggcccgaatgaatgaacaaatgtgcagtctcaagttggtcagttgtggcttaaattatttttgtgcccactggcatctcggcttggtaaatggaggaaacggtctctgacgaattttcactttcagtagacagaaattttgttaattttgatcattttatagtccgaatttgtggacacattgaattaatatttatattagtaatatgtctaagaagaaaagattttttatgctaacaaataatataaataatgtcacagactaataacagctaagagtcagtaataaaggaaatttgtttttaagcactttggaagttcctgtttgcatgcattatatgattatatatacataatttgtattacattattatataagctctcttagtctattcattaagtaatttgatgatcattttgaaatttttttataagtacttaagagagttaaaactatatttcttcttgaaacattgtaatttggacttgttttcttattcatattagatgtcttctctgagcccagttactgagtatgtagtaacttttttgtgtgttacaataattgacagagacggtggttcaaattttcagcatcaaacctcactttggaattatttatttccattttttctcttacctactagtatatatggatccaaaattaattgcttttttattatatttaatacatctatttgctttgtggttttactgatacttgaaaattgtaaacaattatgaaagattttgaactttaatcatcttaatttgcttaattaacataatttactagaggagagaaagagaaaacagacttggttacttatttatgtttgtaaccacctttgtatatgtagtaacaccagagcaggcacttcataattgaaaaggctttagggtaataagtcactgtctgtttcaaactgtgatgactttctggaaaaaatagcttttgtaatatttgtcatactggcccagatccagaaagtagtatgttcagtgtctaattgtactccatatggcctgaactcttgagcaatccatctgaagtaggaccctgttaagaaattattctttgtttttttttgagatgaagtttcgctcttgtcgcccaggctggagtgcaatggcatgatcttggctcactgcaacctccacctcccggcttcaagcgattcttctgcctcagcctcctgagtagagtagctgggattacaggcacccagctgttttttgtctttttagtagagatggagtttcaccgtgttggccaggctagtcttgaactcctgacctcaagtgatccacccgcctcggcctcccaaagtgctgggactataggtgtgagctaccgggcccggccaagaaattattctatgtcatacataattgggtgcaagaggtcttagtaatttgcattttaaaatgataattggtatcatctacgaagagaagttctaccttagtgttttagtttagcagtgacactaagatattatacatatgaaaatctcttaatgttagtgggcagaactgggaacccttccctttttttttttttttttgagacagagtcttgctctgccacccagactggagtgcagtgatgcaatcttgactcactgcagcctctgctcccccgggttccagcgattctcttgcctcagccacctgtgtagctgggattacaggcacacgccaccacgcccagctaatttttgtattttagtagagatggggttttgccatgttggccaggctggtcttgaactcctgacctcaggtgatccgcctgccttggcctcccaaagtgctgggattacaggcatgagccactgtgcccggctggaacccctccctcttacagttcacagggtataagaagctactttctagggcttcatcttaatatggtgattgagttctatattatggccaaaaggaaaattatgtgggtattgtggggaggaggagtcagagggctaggggcaaagcgggcagagaaatatcagctgcctttatttagcaaatatttaccagtcgttcctgcccatatgcacttgttccttgtgtacttggatctgaattgattaaaaaggtctgtatgtattgagtcttttcccttaggagcgcttaagctttcttttgatgctttttttctcttcctttaaaatggtgcaggaaaatgttggaataaacatagtcagcttgtgaaaggatgattctctcccttatctgggcataaatattgttgaatgtgagaatgtgggagtagctactgggccaaatatgcacaatgagtgcaagtgattattgaccttactgatgagaggaaggaagagaaatactttaaaactattttcacagggcatttcaaccaagatgtttttctaaattcggtttctgattcaaaaactggatttagctctttttcttgtttgtttcatctgaacaaatttaccctgaattgaatgggagagtgtttcttaatcccccatgtctttagcagtgagtcatttccatgttgttgagacattttctagcctttattgctgtgtgtagttcatgcttttctctggatgttttgactccttaaggaactcgcaataacaaattaacaatcacactcctctggaatgaaaacacgcagtatcggagtaataaatagcagttctcgaaacctaaataaacacagaaaactcagctctcgtacttaagaaggctctagaggagtccagtgtccaacattacaagcaagacacaccatttaaagccataggaagttaacatactttcattttaattttccaagggatcatgttataaaaccatatagccacttccattcttcaaaacttaataaacggttagttttagtcatctgacctgccttctctcaaatggatcataatttagtttaacaggtttgacattaaaataagttgtgtttctctgggaaactcatgttagcctggacttctccacttcctgtctttctctggtgaagctggtaatagtgactgagctcaggccatggcgggatcctcacagccctaagactaggtgccacctgtgtgctgcaacccagtaccaaaataacaggaaaaatctaaagttatccagataaaatatgtcaaattataaagcctctgagtcatgacagtaatcaaacctgattctatatcagcaatcaaacctgactctatatcagctttaccaaacactattaatatatcctataataaaaattaaggcgtcattcctcaggttctttagcaagtaagtcagtgcatctatctaatttgctaaggctgaaacctattgtacatagaactcgggtctgaatggttgtcccgtagaaagttttagagcagagcaaggttgtaaatagccagctccagtggctgtttttcaccctgttcatgggttgcttgccctggttgtatatttagttgcctgtgatggatggagtgaagtgcacaggtcgtctctcaggggtgaacactgggtttgattagaggccattgtcatgaaagatactccagctcttccatgaccatacatgcttagaagaaaactttgatgcacaaagaactgaaagccctaggcactggaattcctgctcatcaaaaagacacctaaaaaattcttttggagacttcatgaattttctctcgattcatactgaaggactggtgccagtaatatttttcctctttgcctgtttcagtttctcatgaagtttttccatatttagacacactgcccagttaaagggaatgccagtcactcggggtttaagacaatgaagtatgtacttccctcaccaatcagttgggagagctgattgggctgaacttccagtctgaggcatgtgagtcacacacaggcagagatttaaatgttattaacatgagaaagatcttttgaacgtgaagtcatcatgcttgaggttactttgaactttcctcatagtctcttttatgatttgtgtaagaatcaacatgctttagtcttatgttaaaaaaacacagtcgagtgaaaatggacatgaatttaaaattgcatgatagccagaaacttttcatactgtggaaatgttacactgtgataaacatttagtgaagctgcttggctcatgggctatttttttaatggcttttgggttcagaaatttcaaaatgtcagattctttgtaatttaaatttccttctaagtaaggaagtgcactatgttattaattttaaaaatatatatacttagaagttgaaattgtgtaattatcttaatgctccagagtctcttttctgactaaacattggaacttattctgttgaatgcagggaatttgtccagaaaagcttaaggaaatttagcctacgaggggaaatgcgctagattcataaataaaaggtttatccaaaggggtgatatagaacatgattttatctataaaagattgtacttgagttttgtctcttcctcctccttttaggattaagtaatgattgtagcttagtttttatagttgatttatagtaataagttatgtgtaagctgactgtgggtagttgaactcatttcaactgcagaaggatagattgttgtttaaaggatcatacaaaaattattattttttaataaaatgaaaatgtccccagagatgttacacctggaaacttaaaagtaggaaaaatgataatatagtatgttactctatctctggaaggaatgatctctcccactgaaaagtaaatagtccaaagtttacaatgtttagttgaaatagcttataaatcacggcagtgacttttaatccttagtagaattctcctttatttctgagaagtctgtataaatgtttatggaaacacagtctgaaatattttaaatgtagcataccaatagtacttaaagagaactttacgcatgatcacacacattcagagttgttgggtaaaaacaccttgtaccttctttggtagaaaatacttctgtatttgcgtgtgtgtgagagagagtgtgtgtgtgttttaaattcttaaacataacagatcttttgaagcagagcagaaaactcgcatgttactgacactgcattctcagccatggggaaagcaacagtgtgtttcagctttagcaaattacatgtgttgactcactaaagaacctgagtaactacacctcagtttttattacaggaaatattaatagtgttttgtaaagccaatagagactcaggtttgattactatcatgactcagagactttataatttgacatattttctctggataattgtagatgtttcctgttattttggattttttattatcgttatttactgtgagttttgcgctcatatacatgtagcccagaaaagcgatagtgagatggttcagtgtatggaatcagttttattgaacaaacagtggggcaggtggggggagatacttttttgtaattagactattattagtgagcacttcctttggcttttgttcatttaaatgtatcttttctttataacttcacaggacgtggaacatgtaaatgcattttgagttgaaagcagaaaatcacatttcagtaaaattaaaagctcaagatttcattttcttgtaaaatttctaatcatccccatttgctgaactttgggccctttcttggcattgggaggtcatggctaatgaatgcatctcctgttgcctggcttacagccgccccctgctgcagtgccatttgggagaagtgtgtaatgtgcgtgcttggactcgttatctcctttcatttcctcaacatcagttaatgctgcatagtttgcaacatgatattgctttgagttggtgcctaattgtgtaggctggctagaagaacgaatctttgcagtggtcaggtgaggccactgagtgtgcccctttgcggccactgcaataaggtggttgggaattcttcatttctgatcactgaacttttccagaacgtcccaaggctcccccaggaactgtattacagcatgacattctgtgtatgtgggtttttctgggagaggattgtagctttcaatcagatcctccaagaattctgtttctcaaaaggttcataggaaccatttatttagaattgaaagataggcacatcttctgaggaaaacaaatgaaaggcttaacaaaatgttaaggctgagttacagaaaacaagccataagctacctattttattcaattaaaaataaccatgacatggccattttgtaaattattacattaaatctgcattgcagacatacctggtacgtatttatttatttattttttaagaggcagggtctccctctatcaccctggctggagtgcagtggcatgatcatagctcactgcagcctcaaatacccgggctcaagcagtcctcttgttccagcctcccgaatatctagaactacaaggacgtgccaccatagctggctcattttcaaattttttgtagagacgaggtctcactatgttgcccaggctggtctcgaactccctggcctcaagcagtcctcccacctcagcctcccaaagtgctgggattataggcatgaacaaccacccccagccacttggtacatatttcaaatgtggtttgtttcttttgaaataatgaaaaggaataatgtttcagggtttgtggcatccacattttgggatggctacatgccgtaaccttgttcgtagtagctcctgatttttatctgtattagaaattgctcggcatgagacaaatgaggaacatttggggaaatgtgtgagtaattgagtaaaaactaatagctgtcttaagggaaccatcttctggtttgcatttgtattaataggtatgcagagcaggaataatttggaacgggggagctggttatcctctgggtgtgtcaagcacaaatctcagattccattacatctgcacaagtcttgacagtttgcaaaatgtgcctagaggtatgcttgataaggacagacatttcttgcctgggttctaactgtgtcactgctagcacagtatctggcctgaacagcatctaaagaaatattttgctggatgggttacctcaatgggttctcatagcagccctgtggatatagacacagcatgttttatcattcttttctacaggctcaaagagggtaattacttactcaggctcacatagctggtaggaaaaggatttaggcctctcctttataccatgctttagctcgacccaaataataaaagcaaaaaagccatgtttggatcaactgagttttaatagaagagcattggagagaggttgtaaaccctcagatattttcaaaaataatagtaagcattcttgacttgcaatgcagagaatgtcttaagctcatatgtcttgatggtgctaatcaagtcaggcttttataattgagtgaaagcacagaaaaataatttattcattcttatacaaccaagtatttattgaatgtcttttctgcaccagacatggttgtatgcactgaggacgtaacagagaacaaacaaggttgtctaagtccctgccctcagagagcttatgttctcatagtggagacaaccacaagtaaattgcataagtagactctatttgcagaccccccaaaatagagtaggatatgttaggagaaagagtgatggcaggggcgaaggggattcttttgtttggtggagtcagggaaagtcttaggggatgggcttttgtacagagactgcagtaaggtataggagccagccctggaagatgggagtggtgaagggtgagatgagaatctgaggatgagcactgtaaaggaagagaatggccaggtgaaggctctgaggccagaaggagcctttgaattgatctagaggctgcaggagcttggattttacgctaaatgtgatgggaaactctgttagttttccagggctgctctaataaattaccagaaacttggtgggttaaaacaacaggaatttgttctctcaaagttctggagggcagacgtctgaaatcaggtgtcagccgggccacactccctcccgaagctctgttgggagaacctttccttgccgctgtcatcctctggtggttccaggcgttccttggcttgtggcagcgtcactccagtctctgcctctgttttcacatggccttctcctctgtgtctgtaccaggtcctctcctgtctcttagaagaacagtggtcattggatttaggacccacccgggaaatccatgacatttatgtcaggggctggaaaaggaaggacaggtgggatgtgaccatccggagagcctatctcagctgtcatgggttgtcacaaaggccattgtgtggttaatttttatcttcttattcttgtttcctctttaatctttcattctaagccctatagccctgactggcagattcgctgtcgggtttttctagttgtagatgacatgctttttcttaaagccatcttcatttattaatctacattcgtttttaattttaatgcaccaatcaataattatttcacttgacagtttttgacagcatgctgcttgcgacatttagctgtttagcatgaattcaaaaggtgatctatcaatttgcacaaatgaaataaagttgctctttcttcctgtgctttgggggaatgtataaaaaaatgtatgtttatccttccctggagaatttttgatgtagaaatactgaatagttttctatataagaagacagaggactaaagagctttaaaatttgttgtgcttattttgcttgtatcataaattcacgtgaaaggccagatttctcttaattgcgttgatattgtggagatgaatcattcaacaaatgtttattaagtgctcattgtgtgcatggcactctgcaaatgttatgggaaataaagacagagtccccgggaaataaagacagagtccccaggaagtctagtagtcagagaaacaaagccacttcccaaattatggtgggtagaaaaacttaggaaatgacagttttatcatgctacataccttcacttaatgaatcctatgtgaaaattcccagtaaaaacctatgaacaaaagtgtgtggttgtcttcatgtatacattgtgtgcacacatctgtgcgtacaatgcacagctttgtatgaagctagctgaaaactaaacagctaggctgaacttagctgaaaactaaacagcaggggaaatgttctttctcactaaaatcacagtgttaaaactcttggcagttcagatggtctccactgtagctgttggtttacattttgataatttaccaaagagcataatatatttaattcctagttggatggtgtaactcaacacagcatttccagcgaaacgctttgcaaatgggaagtaagcattttctttggaaaccagcagcttccttactcccttggttcttctgtgggtataagcatgacctataggttagaagttctggaacagaaggagaaaaatgaattatgtcacagttaacaggaaaggaggtgctttgcattcttgctccgttgcagttagttttgttttccttccttggtttgggggcatttggccttgcatatcctggcaagatttaggcaaaacaggcactgaccttctttctggaatgctctttcattttgccccatgcatattattaagaggcataattcactgtcatatttttgtggctaaaagttttctaacttctatacactgagcctttgttttctgcttaatagggcaaaagagctggcattttctgggcatcattgacccttcactatgatttagattttttaaagaaacacataaactgttcattgcaccttgttgtgtggcaactctgccagtcactaattggtactgtggatatttggctgttgctcttatttactttcctctggtttttacatcacttaattaaatcttgtgccagtttccattctatacatgtatagggaagcaaacagaaactttgtcctgaagcaccaggttctttggcttcatcatcctaaacagctctgtgaaaatcagttgaaagtgagtagagccagaagtggcgtgtaagccatgctgtcagcgagggctggctggatctgcatacgatcgccgccttctgcccctgcttttggagactagagatggcttctggtctgtgtccagggcttgccatgctgattcagagagctatgccacagatgagcctgagttgagaccatgatgccagcatatcctcagacccacgagatcgttatgccagaatgttaatccgcagtggaaaccattactaacatactctcaaggcccacatgatgagcacattctctctctgtgttaagctgcatgggaatgtaaatcctaactggaagctactttattgatgtgccttgagaaattgctgctctctggctgcaggtatcagcagcagtcacagtgcacatgctctctaaggaagatccatatggagtcaggtgtttgcttggtgagcagggaatcggaacaagggagtgggatgagttgactgttaagtggcaccaagcaaacatagcctgcctctctgttcatctcaggagaagggtggcttttctagtgggaccaggaacatgtcagtcattgcctgctactccctacagtcatctcactagggtggccttgcctgtgaagacactgtattctccccaacaaccttggcattgcctacatagactttagtgactctgtactttcctggctaagccagccctggcgcccttttgaggacacagtcttttcttaaattcatgactatatttcatcaggtgctggctggggcaggggtagtggtgatggtagtaattatctttcttcagttggctttgtatgtccatgttctcatccactaaattttgttcttactataaaccgctaactaggcaatctcttccccgttgtcaagttcttggttggggaatggtaatctttattgtccttcttataagtccctttggaatggatagaggctttgggatggacatctcgtgaactgtatcttcatatcaagctctgtgaactgaatggcaacaaggaggcattcatccagaccaggagtaggcaaactatggtccatgggccaaatccagcctgttcttgtaaataaagttttattagcacatagctacatccaataatttgtctaatgtctatagcagtttttgcactacactggcagaatttgatttgagtcatggtgaaagagaccatagtccaagaaagcctgaaatatctactatctgatcctcatcagaaaatgtttgccaactgtagtctatacctttgcacgtcagagaattgcatcagggaagaactagaagccctccttttgcacccccacaaccctgccacaattcagtgaacaaacagaagatcagagagggaatgtgacttgaccaaagtcacacagctggttcataggaaagccaggacctgagctcagatcttccagttcctagtgtatttgtcttctacttttggaggacgttgtgagttttctggtttacagatgattaaccattacaacatactgaaagaaagcttctttagtggtcagagctattttccaaactgacttccccaggcaaaatcactagccagcttggcattgatactcatttattaatcttacaaacagtacctaccatatttcagggatggggctggggctaagacactgatgaagaagcacaatccctgcccttgggaagtttggatgagaagagtggtcagatagctagatacagagatgcatgtcattttatctgtagtgtgttacttatcatcataggactgtgatcatatggacgaaggatgcgttaatttagccttgagtgggtgggggtgttgtcaggaatggctccatagggttggagatgtttgagctctgtctcaaaggagattgagttcttcaggtagagaattgcagcagaaatggctgtggtcctctaggcttgagtgtgcatggtatccagtaatttgggaatgcttgtctaacacaactagaggtagggcttaggggacgtggtatggggttacaggaaatctagttggaaaagtaagttggagccaaactgggaaacttacggcatttcaaatgctaaggagtatggactttggcttatattctaggggttttctaatctgtagattccaaaacatatgggagaccacatttcttgtaaaagaggacctgcacattcataccaacacaaagcatggtctgtagatttggtcatcagaatcactaacagaaataggagctttcttccaaatatatgtagctggctgatattgtaagtcattagccagaattcattcacagcgttactaagttcatagtatctttttgaccattgtacatcttcttgatcaacagatattaagagttaaacatctagtgcctgaagtctgcaacatttttgattgaagaaaatgttgggaaccactgccgttgatggcagtagtcatgaaattttttgaattaacacatgttataggttccagagtcagctgccctaaattttactagctttgtgactttgagcaagttatttaacatacctcagctgtaagagtctttatctctaacgttaaaataatagcctctgtctcttaagattgttataaagatatgataatgtctgaacgcatgtagcatggggccaggctgatgggatatactcatgtttaaatagaagctattgtaatgatttttagcggatgtggcatatgcagatgtattttagatttgacccagtgtggacgatgagttcaaaagggagagttgtacgaccttcctgttatccaagtgagaaataatggggccagggtgggcaggggataggttagggaaggagaggggagagggagtatgggaaggtgtatgtccactttaggtaatgaagtgagaaatgaaagaagccacattctgtttcatgcccaaagcaacagacaaggcacaaattagagtgtagggaagccagtttctgtgacttgatggcatagaatggtgtggcttatctggcaaattccacgccccgtaactcctggaattgatctggataagaattcaccttgagtaaattttaaaaattaatttaataaattaatagccccccctttgaaacacagaaaaattagaattacagcatgagtatctttttttgctctaaaacagtacagcccagcagttcagcctacacccatcacagagctttcaaaggaatgtatacaagaaaatacatatacaattacaaattttaaaaattaagtaacatgtatatactgttaaatatttatatattgatgcttagaaaaagatgggacaaatgttaagtgtcagctgggaggtttttactttcttctttgccatttctgtatttttcaaaatgaatatgtatataattttaaaatgtgttaacactatttcaaaaggaaaacaatcacaaaaaggaatagattggaaaagcttcaggggacttgctatccttgtctttttgggtagctgttctacaaaggcgggtggtggtgggtgcctcccagctgtgtctcatttcagtcagcggatgctctgctaaatctagtgatgggcggcctacctccgaaaggtgggtgggagtgagggatgagtgtagcagtagtacatgcaaatggggccaggttttggtgtgtgtgtgtgtgtgtgtgtgtgtgtgtgtgtgtgtgtgtgtggtgtgtggttttttttttctttctttttttctacagtcttactctgtcgcccaggctggcatggagtggtgtgatcttggctcactgcaacctccgcctcctgggttcaagtgattctctgcctcaacctcccaagtagctgggactagaggtgcacaccaccacgcctggctaatttttgtatttttataaagacgagatttcacatgttggccaggctggtctcaaacttctggcctcatgtgatccacccgctttggcctcccaaagtactgggattataggcatgagttactacgcgcggccagggaccagttaagatttgacgattacattttattgaatgtttgcatcagaggcacctggaaggcttgtttagaccacagatttctgggcgccaggcccaggggttctgatttaatagttctagggtggagcctgagaatatgtatttctgacaaatccctccgtgaaactgatgctgctggccccaggaccacactttaagtgaggggtagtaagcgggtggagaactgcatggaggatgaaaagcatccagttggattttatatttgctcccccttcttcatatacacacactgaaatcactccactctatgttttctcagattctttccctgtctggaatatttggttctctcttcatgttcagtcagtagaaacaagaagtaactcttggattgagcagttttcacacaagtagcccaaatgatattgacacatcatttctacacagcatcagcttgttcacacacatacgcccccagaggccaatggcgtcctttggctttgttctcctttttaaaaattcagtgagtaagctaattttataggaatgtctcagaaagctattcctgtaaacccagcgtttgtaaattgaaatagaggaagcggtgctgattaccgcaattgtattgaaacttattcatggagcggtccctctagattcagatagtttggacagaaaccctccaactcttcccttaccactccattgtttggtaaagtttaatgtgctcacatggcatctactttttcagccagggttaatactcctagcgattctttcactggaagggatgactcagagaggaagagttggcattaattgcttcatcaactatgcttattatgagtcatctcttgcttgtcttagtaattcagctggaaaaaggagaaatgttatctctggttcctgaggccagcttgggcttcagtgaactaggatactccctcgtagccatttgtgagtttcattcagttactaagggaatgaacagattgtgaatctcattatcctagcaggtacatataaatctataaatggcgaatggcagttacttcctgatgtttatcagtgatgagatgccacaggcaggacgttagccctagaaaggcactgttttgaaggtggctgattaaggggcaaaagaaaaaaaaaaaaagcaaaaacggagggatatgttcaggtccctgcctttactcagttccctcccctagcttccaatttgattaacagaggtgtcgagggaggaagagaacaatttccaaataaaactgcctttggttctttttttgagtgtaatgtggtaactggattatttggaaacacgaatttaggtctcttactttctacttcttgcgttcagttcactcgtgtcttcctgtttggtgtataccttccccttctgactcagtcttctctatttctcttctcactgtagcagaccaccgttcttcccctgccttaggcgtttctcacttgctgtctgccttgcgtggctgttttcactcaagcatgttcactgttcctttgtacggaataggggttatccccacagaccctccaggtagaaagtacatctttcttttcactaataaattagtttattattaatagtgaaaagaaagtacatctttcttttcactaataaattagtttctatttagggagaacatacagtgaaatcaacacatcttaagcgtacagcgcaatgagttttgatgaatgcatacatccacataatcagcatcctaatcaagatatgggacatttccatcaccccagagcccctctgcccccttcctgtcaactttccacctccccgtcatcaaccactgctttgatttctgtcactgtaattgaattttgtttgttcttgagcttcatacaaatggaatcagtcagtactttttcgtatctgctttcttttgttcagcatatcatttttgagatcatctgtattgttgcaggtagcaacagttaatttaaaaaatgctagccagaggccaaggcaggcatattgcttgagtctagaagttcgagatcagcctgggcaacatggtgaaaccctgtctctattaaaaatacaaaaactaggcggcagcagtggcacgcacctgtaatcccagatactcaggaggctgaggtgggaggatcacttgagcctgggaggggtcaagcctgcagtgagtcatgatggtgccactgcacttccagcctgggcaacagaatgatgtgtcgcaaaacaaacaatctatatctatatagatatagatggtttttttttttattttgtgaacttacatatatgtgtgtatatatatatgtgtatatatatgtgtatatatatgagttctttatatagtctggatttaagtcatttatcagaaatatgaattttttctcagtgtttggcttacctttttcattttttaaactgtgtttgatgagcccctttaaattttaatgaagtctaatttatcattttttaagatatatgctttttgtgtctttataacatttttgcttaccctgtggttgctaagatgttatcctcctgttttctcctggaagatttctagtttagccttaacatttaagtatatgagccatttcaaattaagatatgaggtgtaggggtcaagattcagtttttattaaaatgtatgaaacaacaattattgaagtgattttttttccttatgaaattgccatcacacctttgtcaaaaatcatttggttttatatgtgttttaagactctctgttccactgatctgcagtctgtacttaggtcaatactatattgtcttgattaaaatactgtcatgggctgggctctatggctcttgcctgtaatcccagcaccttgggaggctgaggtgggaggatcgcttgggcccaggagtttgaggctacagtgactgcagcattgcattccatcctgggcagcagagtgagaccgtgtctctattaaaaataataataataggctgggtgtggtggctcatgcctgtaatcccagtactttgggaggccgaggcagaaagattgcttgagctcaggagtttgagaccagcctgggcagcatagcaaaaccccatctctactaaaaatacaaaaatcagctgggtgaggtggcatgtgcctgtagtcccatctactggtgaggctgaggtgggaggatcgcttgagcccaggaggttgaggctacagtgagctgtgatcatgccactgcactccggcctgggtgactgagctggaccctgtctcaaaaataataacaataaaattcaaaaataatgaataaatgttaaaattaaaaactaaatagctttatggtaaatcttgaaaacagatagcgtgagtcctctctgtcttgttttttccctcaagattattttggtggtgttctatctccttcagagttccatataaatccccctaccccccaaaaaagcctgttagaagttagttcagattgcactgaatcataagagagaaatttaaggaaaattcaccttaacaatattgaaacttcaattcaaaaacacggtatatctttctctgcctttttaatgaatttctgccaggaatgtttccctgtttttcctgcagagacattgcatatctttggtaaaatttaattgtactttatgcttttcgatataatacatgtaatttttaaatcatccttttcaaattatttatataaccaggactttttttctgatcgtacagggaaagtattaactatttcaccactatttcatcatgatgttagctgtaggtttttcatttgccttttattggattgacgaagtttccttctattctcttttttctaagaatttgtgtttgtttgtttttatcgggaatgtgtgttgaattttgtgcagttcatttttgcctctgttgagatgtcatatggttttccgctttatgtggtgaattatattgattggttttaagtgttaaaccaaacttgagttcctgggataagaaccagttataattatgtgttattttgacctattgctggatattttggctaacattttattaagtatttttgcgactatgtttattaagaacattggtctgtaattttgtttctttatataatatttactagggtttagtgttagtgttagtaatactgattatataaaatgtattcgtggagtcctcctgttttttactattttctgaaagaatttatgtaagattttctttcctcttaaaattgatgaaattccacagtgaaatctttgggcttggagttctctttgtgtgaaggttctaagtttttaaaatttaatttaaaaacattataaagtaaaatattcccttttttgatgtacaattctatgcattttaacatgtgtagagttgcataactaccaccacaatcaggatacagaacagttgtatcatcattgtgccaaggattttgatactgaattcaatttcttaacatatagccaactcttcagattttctgtttattcttgctattggtaagttatgctttctatttttcaagaagttttttatttcatccaagttgtgagatttattgacataaagtttttagtaatactttcttcttatctatttagtgtctgtaggatttatagtgatatccccttttccatttttaatgatgttttcatttacttatttttgtgattagttttgctagatgttaattaattttattaagctcttcaaagaatgaactactgtttgctttctgttcttctcattatttccttctttttccctactttggatttaattttccttcctccttcctttctctttttcttttcttttctttttttttttttgagacagagtttcgctctttcacccaggctggagttcagtggcacaatcttggctcactgcaaactctgttccctgggttcaagtgattctcctgcctcagcctcccaagtagctgggattacaggcatgcaccaccgtgcccagctaatttttgtatttttagtagagacagggtttcgccacgttggccaggctggtcttgaactcctgacctcaggtgttccacctgccttggcctcccaaagtgctaggattataggcatgagacaccgtgcctggcttgctttcctttctctatatcactgatttgaacgtcttctttttttttctgttcctaggtacacacacttttaagattgatgtatcttcctaataagtacaccctttaattattatgaaatgaccctttaactctggcaattctccttgtctagaaatctactgatctgaatatggctacaagagctgcaggctgttcagacttcagccgaggtcttgcaatgagcccttatgttttaattgcattgtacaaattttgatatatacttttattgtcacttaactcagtattttgtatttccattttatttcctctgggaattgtctagtagtaaacattttaattcacagacgtggggaatttttaagcttcccttttttccttaattgctaattacatttttatttatttatttctcttcatagttgttgctttaaatatctctgtgccattttgttagatgcatgtatgttgacgattataaaatcatctttattggttgttccttttgccagcctaggatgtccctcaccatcatttataatgcttttaaccttacattccattttgtctgatattcagagtgctatcctggtttttgtttttagttttgcttatattttcttttttaaaaatcttttagttttaatgtcattgtatatgttcattttacacgcatcattcttcccccccaccacatattgtgcatagctctgtacttgtctctgttatttgattagtgactttatacccagttatccttactgtaatcatttttattaagatttttagcttcatttaatgttttctacttggctttactttttgttttgttttgttttgctttcttcctttggatagatcggattttttttcccgaacacattttattttattcttgtagcatttatacctttatttaaacataaacttaggtataaacatagtttcctttatgtctaaaaattatcagtaatttttaagttccccaaatgactcccccactcataaccattggacctcttctctctcagtctgctattttccccagtgttccctctactgagacttaaccaccttctttcctgcaagaattccccatcacatggaaaataactctcagctgcatcaacctctagcctgtgcaacttccccaccttgcttggaaccggaaatgacttctacttttagaaagttcattctctgggcagagtagaagatagaattcattggggtgttattgagacagagagaccatctaggtactcttgaagaagtccaggagactttaggagggtccaggttagagtagtggcagtagagtgggaggactggtggaacaaccgggaggatttggtgttgtatttgaggagtttgagaaaaagagaagttgatggtgccaagtatgagtggcaaatatcagatttcttttattttttcctaccctattctcttccctcccaaattccatttgcatgacttcttaccaaggtttggttctgccattttaaatgaaataagacatgtaaaacacatggtatatgtcctagtatagaaatagtaattaaaaaaaatagatgctagcttccacatttctgtctcaagtgctgactgtatgaatggggaggaggagcctacagattcctgaggaggaacaacttctttttcttggtggcagggtggttagaaatgtaattatttcatttcttcatcttttgaatttgagctgccaatgagacatttaggtgacagaaaattgtatatctaagtctaggattgaaaagagatgatagagattcaatagctgttaggaaaactgtagaagctcgtctagcgggaggtgataaagtgaagagaagagaaatttgaaaagcatttatgggatggattggaagaaggaggatccatcagagaaagttaggaggcctgaattcttgtcccagtctggtttatttagccctgaataaagcacttaaccctctcagggtcctctttctttcttcctttttttttttttttttgagatggagtcttgctctgtcgcccaggctggagcgcaatggtgcaatctcggctccctgcaacttccgcctctgggttcaagcaattctcctgcctcagtctcctgagtagctaggattacaagtgtgcactaccacgcacggaccatttttttgtgtttttagtagagacagggtttcaccttgttggtcaggatggtcttgaactcctgacctcgtgatccacttgcctcggcctcccaaagtgctgggattacaggcataagccactgtgcccggccctctcttcctttaagatctctttctttctctctgcctctcgttctctttctccattcttcattaattcaacaaagatttcttgcatacgtattgggcgccaaattctgctctaggtattgaggctaaagcataagataggatgtggtctttgacctctagtactgggagcaggcaacagattaatcattgctctctgttaagcattatggtagggtatgtttcatacctgagtcaggttgactggaggaaagggtgctgagaaggcctgcagagcacgtccttcagtccaagcttttcagaatgaggagttgttcagacaagcttgggcaaagaaagacaaaagaagtgcaaaatagtattatatggatgggctgaaggagcaataagcagtttggtaggtccatagtgaggcaggcctgacaccgctagaggggctcagggtctcgatcaggaagggcccttgtgagccaagcagagatcttggattttatcttggatgcaatgtagacccattcaaggactgtagggatgtgaaaagtcaggtgtgtgtttcagtgatttcattctgttagtgctatgcatttggcatgataagggaccaggtggtgggcaaggagaccagagaggaagcagttgtagaaatccaggtgacagaggaatgttgaaaattccagaaccacagagcacctgcttcatgctaatcacaggtctgtgtgctgcggcttctgcagggaccaggacagacaggccccttgttctcatggagtttggagtggcaatggaagtgacagaatggaaagaatgagcagattggagagatgttaataagcaaggatttagaggacttgatgagcaattagatattggaagtgaatgagaggggggtagtgtctggtttgaggaagtgaatgggcaaatgacaccactcactgtgattggggaaccaagagaataactgagtgggaccttcagggaaaggtgcccagcctgcacttgtataaataggtctggatctcaggaacggcctccgtgacttactggatcagggaaagaattggactatgtggatgtttacgttacttgattttattctgctccatcattcagtttgggtctgtgactgttgagtcacctcacagaggacgaggtatccttatatctctttccctaaaacctagtgtggggtgagcaaaacagtagggctattgtttgaagtaggtctggaattctgtatcattaatttctttgctcaccctctgatccctgccttcactttagccctcccccaagtcccagcataggctcactacctggattttggcttctgtgtgaactgctgtgggcaatcgtgtcatattcctgtcacagagactctaggatgctccagcgggtagggattttaggatcactgggtccaatctctgcaattacagatgagagaggtgaggcctgaggaggcaagggggcctgcagagcactggtgtagggctacagtgtggtcgcttgattcactggtctgttttgcactgtgccccctccccctcgctgagtgcttagagagcagggcaggaaaagttctgcacattggtgcagacgtttggaaatgactaagcctgtgtgtgtaactttgagacttctcgtgaaggttgtcaagaagcatttgatcacttcagctctgaggtagggagacagtctccttgggcatcacacttgcattccagcagcccccttgtttggggtgctctccaaaggctccccgtaaggaattgtttcaccccgggtgtagaatcacattgcactgcggcttcaaaggaaaagtaaaaaagtgcagaaattaccgaccggagtgtgggaagtacttcttgttggtaagattttcaagtgctggggaagagatgtgttgaaaggacatttactttcatcagcttagagcatctgttttttatactttaaaaagaagcaacacctcaaattatggcagtccctgggcaagtaagcacttgagattttgatctgtacagattcttagagggagcgcctcgcaggagctgttagtagtgatttgtagcacttaactgattctgtagaccgacagtcaatcttggggggaaagggggttcagaggcaatgatagttaaggaactgctccgtaaaacagcaaataagccattgctcttgcacccgagtagaaatggaaactgtacttagcaggctctggagaccaaattagataggaaatgaaaataaattccatgttttttatttttaactcagtgcgcacctccaaaacattcgtacagtgtgggctccatgacgtgttttgcctgctctcttatacagatttaagtttttaaatggtagttagagacactcaacataaaagctgctgctttaaccgttgttgttattgctttgtttttttgagatggaatctcgctcttgttgcctgcactggagtgcagtggtgtgatctcagctcactgcaacctccaccccccaggttcaagcaattctcctggctcaggctcccgggtagctgggattacaggcgtgcgccatcacacccagctagttttgtatttttagtagagacggggtttcactatgttggccagattggtctcgaactcctgacctcaggtgatccacccgcctcggcctcccaaagtgccgggattacagtcgtgagccactgtgcccaacccactttaaccatttttaaatatgcatttcagtggcattaagtacattcaccatagatgtactatttattataggcacagtttcctaaactgagtaaagaaaggaaacatttacccccacagcccagtatagtcattgttaaaattaagatgttagtctccaagtcttttgtttacatgattttgttcaaacctagttgcaatacttttcatagaggttataaagagaaatatagagttataaaggaatttttttaaaattatactttaagttttagggtagatgtgcacaacttgcaggtttgttacatatgtatacatgtgccatgttgttgtactgcacccattaaatcgtcatttacattaggtatatctcctaatgctatccctcccccttccccccaccccacaacaggccctggggtgtggtgttccccttcctgtgcccaagtgttctcattgttcaattcccacctatgagtgagaacatgcggtgtttggttttttgtccttgcgatagtttgctgagaatgatggtttccagcttcatccatgtccctacaaaggacatgaactcatcattttttatggctgcatagtattccctggtgtgtatgtgccacattttcttaatgcagtttatcattgttggacatttgggttggttccaagtctttgctattgtgaatagtgccgcaataaacatacgtgtgcatgtgtctttatagcagcatgatttatactccttttggtatatacccagtaatgggatggctgggtcaaatggtatttctagttctagatccctgaggaatcgccacactgacttccacaatggttgaactagtttacagtcccacaaacagtgtaaaaatgttcctatgtctccacatcctctccagcacctgttgtttcctgactttttaatgattgccattctaactggtgtgagatggtatgtcattgtggttttgatttgcatttctctgatggccagtgatgatgagcattttttgtcttttggctgcataaatgtcttcttttgagaagtgtctattcatatccttcgcccactttttgatggggttgtttgtttttttcttgtaaatttgtttgagttctttgtagattctggatattagccctttgtccgatgagtagattgcaaaaattttctcccattctgtaggttgcctgttcactccgatggtagtttctttggctgtgcagaagctctttagtttaattagatcccatttgacaattttggcttttgttgccattgcttttggtgttttagacatgaagtcgttgcccatgcctatgtcctgaatggtattgcctaggttttcttctagggtttttatggttttaggtctaacatttaagtctttaatccatcttgaattaatttttgtataaggtgtaaggaaggggttcagtttcggctttctacatatggctagccagttttcccagcaccatttattaaatagggaatcctttccccatttcttgtttttgtcaggtttgtcaaagatcggatagttgtagatgtgtggcattatttctgagggctctgttctgttccattggtctatatctctgttttggtaccagtaccatgctgttttgattactgtagccttgtagtatagtttgaagtcaggtagtgtgatgcctccagctttgttcttttggcttaggattgacttggcaatgtgggctcttttttggttccatatgaactttaaagtagttttttccaattctgtgaagaaagtcattggtagcttgatggggatggcattgaatctataaattaccttgggcagtatggccattttgacgatattgcttcttcctttccatgagcatggaatgttcttccatttgtttgtatcctcttttatttcgttgagcagtggtttgtagttctccttgaaggggttcttcacatcccttgtaagttggattcctaggtattttattctctttgaagcagttgtgaataggaggtcactcatgatttggctctctgtttgtctgttagtggtgtataagaatgcttgtgatttttgcacattgattttgtatcctcagactttgctgacgttgcttatcagcttaaggagatttgggctgagacaatggggttttctagatatatgatcatgtcatctgcaaacagggacaatttgacttcctcttttcctaattgaatactctttatttccttctcctgcctgattgccctggccagaacttccaacactatgttgaataggagtggtgagagagggcatccctgtcttgtgtgtaaaggaatttaaagacagcctactccttctccccttctctgccccgtttatagatgaagaagtgaatggccaaaagggttaatggcttgcttagctggacagtggccatgcttgtcccagagcataggtgctccatcgcctgagcgccattccctgggctagtctgttgttagtttcaacatgtgtcataaaaaattcattggtggtttatttttagggtaatcttcttttttcctctgtctctttctttgtgtagtttctgtatctaaacttttttaatggcatcttcaaataggaacttgttttaaaccagaacgtcacaacacgtatgccattcctagggtttatcaccctgatgccaacatcccctcccaaacctcgcttctgttcagatattaccatacccaggaggtcgctgctttttgttttttttttttccatttgttttgctggttcacggttcattccagagtttaaaggtgctaaaaccaaagtttaaaggtgatagtaattgtcccatgttgggtttttagctggtttctttttcttcttaagatctgttttccacttagaaatgaggtgaaaactcacagaagcaaagcctagcagctaaaagcagcacgtctgcttaccacgttacaccctccgggctgatctgcagcccagatcccctttccatcctctacctagctcctcaattcccatcggtgagcagttttcacctcctcctgcccacgtttggaggtctgtgggtggcggttaggaagccaaaggaggctgaagctggggtatattgtttgggtcggccatggcaaccgcggcaggaaaaggaacaggactagttttgtgctgctctgtaaatggccaggattcagcagctatctcaggacttctgcttggccccagacaatctgatctcctggtaaggttattaaacttggctctcctcttccaccctcctttgatcatgttgtcaggcagcgagtaggaatggccgtaaggggtcggctggtgggggttgcagagcacagcaagatatgcaccagcagaaacataagaacaggggcagaggcaaatcagggactgtgttcttatcttttctgcaccccagatgcagagaagtacatccccaagtccttgccaatactattcttcaagagttgagcaccttgctccaaagagcctgtccagatcgccagtttgaccagcatggaggagaacaaggaagggccggtcctggaagaccccaggatttttttaattgggaaagcattatttgagttttctctgctgcaaagcacaaactgcctaccacatgtgtttcataaaaatgtcactgaaaaggagagtgagaatacagagtaagcttccatggcttaataatagtttattttgtgacttggaatagcttttcttttcattcagcggatcattttaggtgtcattcagtttattttaagtagtgtgtttcatcctgagcggattaagaattttattttttaaaactctgtactgtgttgcttcctactgggaaatttacattaaaaaaatgttcgtgagcaaaatctatttggtcaaaaagaatggcccacgattatcactgaatttgggatgtttttcttctaagggacacagttgattcttactcagaatcatgcgagtctgacatttcatttggggaagtctgaggaagttggtgaggtcttacgttaataaaaacaagtgcttctttttcttcttatcacctttcagtgtctgctctgctggctcatgcagtgtaggttggcttacctctccctggaagtcacattgtccttcagaactctttttactatgacccacaaacagttttcagacctcactctgatgagtcaaaggtaaagctgtgaataaacagatggtgaaacaacatttgcagttctctgacttcagtcctccctgaaacccacttggaatctagctctgaattcagccggacatgtttgttcttcccttttcccatcctcacctactcctaaccttcagtgttctctttaccttttatttttatttttgtcattttagtagtaaatgacagggacatagttactcaatttgtaaaacattgaatggtgaggtcaaagattctatgacgagcttgagatttctaacaggttcagatggatgacagcaacattttgctggcttaattttggagctgtttttgtaggttttgaaatgcagtttaatagtgagtaatagagaagtttctttctgccgtggagctactgaacccttgaaagtaacatgctggcacatacagatgaactgtagccccacatttattccttgcttagtggtaagctgtacactgaacaatagaaaacaaaaggctatttttctttggaagagcagatactgatttctggacaaagtttatgttgtacaagttaaacattttttattcttttctggttagattttctgccttttaaaaaattagcttagttgaaaaagcaggtattattaaatacagtttattttattgaattggacggacaatcgtagaattttaaagcttaaatggctttaattgaacctaatgttctaattttacagaggaaacatttgaggcttagtgcggttaaatgaccactcctacaacacacagcctgtttgtttgatggctgaggctgaaaaccagactccagactcctaatttaatgcttttccttcattggtcatgtctttttagcttcagtgaagatcttttttttttttttttttttaatttttgaggttatttaaaaaatactttgccttgaaaatttaacatttccacttaatcattctcatacttcaagaacagtttctctgttaactttctgtttaacttcttaaaccatacactgtggaaattatctgtctatatgctgaacagtctttaatgactgcatgtgtgccgtagctgttgagatgttttaatccactttagcaaaaggtttatttgtttaagaaaagtgcagtgttgtattaagtctaagcttagaacaatgaagcatcatctcccagctactgggagtgagaatgggaggggcagggagtggttggtactatgagctgctctaaagaaaattcatttcagcttcctcacatgttaatacaatcatatttcagtgaagcccttcttcagcaacagtcactaatgatagagtgatgtgtttagacttgaaggttctttaggtgctgtttaaatgaataatgagtgtagttaattcacaatacaggtgaaaagttaaccacagagtagtggcactgctctttctttccccgtcacctctgtgcatgatctcttgctgcgccattagaagggatgattagaatgggcaaatattccctcccggtgctcctggcaataggaaagcactgtgggtgagatatgtctgcagagcagtggtatagtttcaggaagggacctcattctgctctctggggcaaagcttccgggtgcctgagtgggcctcttcctagtcgatggggcagcttgatggggtggctatttattggtgaaaacagtatccatgtcccattggttattgggacttgattcctaatttgaacttaggtgctgtgaagagacttatgtaacgctgtttaatccatgtttggctttgttagaagagtttaaaatactcagaaggaagaaatgtttggttcctttgaaaaggcagactgttcatttagctagggagagcctcaccaaatgagtcaattaaaaacatttggggattaagcccagtgagagtgctgtttttatatgagacatgaagagggtgggggaggggcgggtggaactatggggaaacagcataggaaaaaaaagatctttagaaaaggaaaaagttagccttagctcttcagagagcactgggtgggaaaaaggatttaagtggaaagaagaaaagccctagagatttttgtaccaaaaaaaaaagagtgctgttaaaaagatgaatcaacagctatattctaaatggcgtctccttaactgggatttgaagggaagagaaggcctgagtagagtcttagacaagtccaagggtaaaaaagcaaacagatagttgaagaagtggaaattataagtttggtggcaaaaacttacttgtaattagaatttttgtgtccttaatacttgttgttatgctgatatgataatatgctaataatatgctaaggaattttcccaattcataatctaaagcaaaattaactaatatatgttctgttatggaaattcacctaaattgcaccagcaggtgtattcatcccgctaatactaacactctgttactagctccactgtggcgtttccactgtaacgtggtggtgttggtgctactcattgtgacagtgtggtgtcccaaagagtgagcaagcctcgccaacgcttccttaaaactcttactgatggaactaccatgtttatatagcaagaatattagagaaagaagagtcgagaaaggattccacaacacacatctagtcttttcctctcttagcttttagggtcaacactacctttctcttggaaatgagaaggggagaaaaccttttccactattctgaaaagagggttttaaaaattctctcaggtcgcctaagctggaggggctttatgacagcactaaccagtaggtcaaaaaggaaatttattttttcccatcataggttcctctctacacagagaatgcaaaaccgtaattcttaagagttcctcaatgattattcacttttgttcttacttccatatttctctagtaaagatttaaatatttaattttgtagactcctgaaataactgcttccagatagtatatttactcagaatattatttaaatgcattaatgctgacattgttagaaaggggagaaaactcaacattttccggcagaaatcattgtaaaatgtattataaaatttcctcccttcctaagtagagtgctactatatagtgaatataatttaactttttttcttggagacttattgtcatttctgtgaagttattacctcgacatagtagcgtcctgatgcctcaaaagctcataattcttctcgatgccacagcctctgtcctatctacttgtcttggttgtcatgtcttcaatctcctttcatatttgcctatatctgtaaacttaagagaaaccagataatcaatctgataaaatcactaagctgaatcatatacattaattctcattcctagctctctccacctagccagtgtggcctgaggcattcatagccatgttctgagtggtgaaggctaagagagcccaggagagctgtccagggttaaataagacattaatatataaagtaaggactgtcggtatacgtgatatttatatgttatcatattacattttatttatttatttattcatttatttatttgtatatatagagagagaaacagagtctcactctgttgcccaggccagagggtagtggtgccatcatagctcactgtagtgtcgaactcctgggctccagtgatcctcccgcctcagcctgctgagtagctaggactacagacttgtgcgaccacacttattttttgtttttaatttattttttgtaaagacagggtctcattccattgcccaggctgcatttttaagtttagtaactgcccaaatggacattgggtaaaataaaaataaatacagtcacttctcttcttaaatcattcacctctcaagatgaaggtactaataggacattttctagaacttcagtgttaaccacagcaaggaggaaagacaggcctgttagatgtagactaagaacttcagaagctgtctccgtcctaggctgggcccagggctctagaattgtcccacacacctggtgggcttgcttgggtacttgggtggtacctgggagatgatgacctgttcatcttcagcttctgttattccaggaaacagaggtagtcatctggatactacaggtttgccagctctgctacttctgcttctactgcaggaggaggagctatggaatttttatgcatgcatcaaaacactgacttggctcataagactgcttaaaagacagagtgataaattacgccttgtttctcatgaaacagatttttcccaaaagtagaaatactaatttataatgtatccttttcagaaagattgtaagtctaagtttctcagagaaacagtgtatgtgatggcaggaccccagtaaagtccaaaatatcccataatggccttaggaccatgcccatcatagtctccatagagccatggtccccaagagccatggtgcccaagagccaccacttcagtgggtggtaggtggttgtgaagaatggtcactgtggttcacagaataacagtgacaattgtgaatagaagccagtcattacctaactgataaaatgagtgaggctagcaaagggcctgacaggaagtgaaatcacttactgaagtggtggtagagtacgcaaccaagaactaagaacaggagggaagttaaccctagggagagttcgactccacttgaggaggaacattctggcaatcaggactgtctaaaaatggaacaagctgattgatttagcagtgaaacctctgtcactggagatgttcaaacagaggtagtaggaccctcttatcaggaattctccagagaggagatgtgagttggatagaaggttattgtagacgaccacttgtttctctctcagctctgaaatgtagtccttaaggctgacgtgtgtttcccagtttctaatcggaaaagataacataatctacagtgttgaaataatttaaacaaagtaaataactgtgcttttacaaccataatacggtttagcctttcattattttgttacgttcctcattaacatagacataatttcttttaaagaagggacaattgtgacgagcctgggcaacatggtgaaaccccacctccactaaaatacaaaaaattagctgggcgtggtggcacacacctgtaatcccagctacttgggaggctgaggcaggagagttgctagaaccaggaggcggcggagcttgcagtgagccaagatcacaccactgcactccagcctggcgacagagcgagactccgtctcttaaaaaaaaaaaaaaaagaaaaaaaaaaaagaagtgacaaaacttacccagtaaactaaatgttaatttcctcttctcaggagcataatactaacttactcctctgtttttatatttttgagtactgataatcggatagtgatatatttgtgttattttttgttcaaacaattgaattcattcttagcaagaacaaaagtctatttgaaacatgtaggcatcttaggtagattaaatttttcattgtttcaagttttgacttttgtatttctgcacattagtgatccttgaagattaggcaaggccaagttcttttgacttttataattagtgtgtcggaatcccagtttttcctaccctagggtggactgtattttttacaattaactctgtgaagggtgactgggggtggactggtgaggagaggcttccagttaccagagagcctgtgacttactctctgtgcttttcctaggtcaccaattttcaaagaatttgagtataattaaatacacttcataataaactaggctgaacataatttaatctttccctgaaggtacttcagagtcttggagtgctttagggccatgatgagcatcaattatgttctcacggtgggtgtgcagaaggaggtagttaatagagttctgtttgatcaagtcctgggtgactggacatgtgttctgttatgattagcagttcagtgtccaggttttggaactgatgcttagtattaaattctcaggcaggagagaatggaatagagattgacctctttggctttgagaggctgaaagttgatgacgataattcacatgtacatggtatatatagcactttttagcttccaaagccctttcacataccttgtcttccattgcttgtttcttgtgatgttctggaaaggaagcaaggccgctggtatcccatttttacagatgaggacagtggagctcaggaagcttgagggacttgcctaagctcatacagtagatcaatggcggagaccactggacttcaaattcagtgctctttttagtatttcaaaggatactaaacatttgctcacatctctgatgttctttgtgctgtatgtgtagtaactcatttaatcctcacagtggccctgttagtaggtagatatcagttcttctggtactattacgattctcatcttcagagctgaggccactgagaggcacagagaagttagggcatgcactagtgagtggcggagctgaaatctgaacttagagctttggctccagagcccatgcactccaccattatgctacatggctactcagtgtacagatacactgagcttaagtagaggagaaagcttatctatccatatcttcccatctgcaaagacctctgcctgtatgggaggtctgggctcgttctgactaaggttttgaacccagatctgccaatttgagatcttgggcccattacttagcctgagcttcagtttccacatctctaaagtgaaaatatagaacatggaatgtacctgtaagaacacaatggaatacaggtaaagtgcccagcacactgcttattccttagccttcatgttttagaaagtggttgctattgtttttgttgttggtggtggcggtagtggtcttcttcttattattatttatatatttacaatggccaaaattatatgaaatgttttccaaaaattaggtatttgtacccttcatatgaatgtgtgtgttaattgggtataattgtctttcttgagtctttaaaatagacaaatcttttgattacatttgttaatattattgtacctacctatatctgacttgacttacaattttacttcattaaatacatagcaagtcatctgagaacccaaagtaatcatacagattacttgccatatagttaatttgtgactgtgatatggctgctaaggtagaggtttgaatttaaaagcacaaagaaaaatgtttacttcaatggttacaaatagattaatcatataaagtacatatttgcagagtctcgctcagtcgcccaggctggagtgcagtggcatgatctcggctcactgcaacctccgcctcccaggttcaagcaattctactgtctcagcctcctgagtagctgggactacaggtgcgtgccaccacgcccggtgtatttttagtagagatgaggtttcaccatattggccaggctggtctcgaactcctgatgtcaggtgatctgcccgcctcggcctcccaaagtgctgggattacaggcttgagccaccacacccggcctattctaaggcttgttctaaggctcacagatggcaccttctctgtgtatcctcacatggtggaagaggcaaagcagttcctgggggagttctttgataaaggtgctaattccattcaagagggcacctcccaagggctccactccctaatactatcacgtggggagttaggattcgacatgtgaattttggaggcacacagacattcaggccaaggcataaacagtgaccacttttgttctgtctgtccacacactgcctagagcttccatttatttcaactacatttgcttttttcttatttatctgttcagagtatcttctcagtggctatttatttaccaccctttaacatgttttcttgacattgtacttcagcctgtatatgctttgcaactcaggaactatgctggcttaactaatagtacctacttaacaggtgaaactgacagtaacagcttaataggtgctttccatttttaacatacctcagctttttataaatacaaaaaactctcaatcttttaatgtggttttaaattttaaacaggtcttctttcattttcctttacagaaaactgtaatactgcatatgcattttcaaactatgcatatttcttcttcattccatgtggaagtttttattcagcctttcagtaaattttacttagcttgtcccatggatgccgtaggtgtaaggaatatgatagtgaacaagacagacagagctcctcccctcagggagctttgccatgatacacgatgatgacaatgataaaaggagcaaataatgatttgggacctgattccaaagggatatttctgcgacacttacaatgaaattccaacctggcaccatctttttcactgcagaatgcatgaaggtggttgcatcatgtcatttcgacatgcatttaaatgtaatgaaaggcacaagtagtgattgcaaacactacaataagttgcttgttgactctcttactgtcttccttcttatctccctttcttcctttgtctcattctcagttttcagagcttagtcattatttcgtaatcctctcctaaaatgaaatctggggctctaaggacaggaggcacaggttgtgtttgaacagcatcatcgtgctttatgaaggggattggaggggagattctgccccacagtatggtcaggtctcgctccaggcagcactgactacattggtgctggttgggtaactgtggctcggcaggtcactctccctctttccacctccgttttctcattattagtagaagtcgaaatagcatggttttctaaggcctctgccaatctacaattctgtgattcatatgttcctaaacacttgagttactttttctcaataaatggaaatatattttccaatgaggctggaaatacattttccaattatcctctcccctggtttataacatatcatcaatgtgttgggacttctaacactgcttctgctgtaagcccatcaagaggttaattacctttgaagaatgaggaactgctggaaaagaactgtaaaaccttcaagagaactttggagttaatccctctggtaataggaatcaatgtcactcacacatctagttgccagtggaggaggaataacagcactgggccaagtagacttgaaggaaggcaggttgctgatagagtggagagctgaagattctgaatcaagctcatcatgactctcttcctcctctttgaggctacccaatcagagcaaaaacagtattttaaaaaacctcaactggatgagcctgatgcagtggtgtgctcatgcagtcccagccaaagggtcacttgagcagaggagttcaaggccaacttgggcaacatagtgagaccccgtctctaagacaaataataaacatcaaaattaaaattaaaaaaaacccaacccagtgttcccttcagaatcctgagtggtttgtttcatcttcctctattctggcttgtgtcatcttcctctcttgtaatggataaaaactccaaatgaagacaaaaatgaggaatttgtcaaaaaaattgaattgccaacaaaagccatctttggttgatcaaacggtacagacgtttcagttagacaagagggctaagtttctgagacccattgtacaggattattaatattattcatttttagccctcataataaggtattataaatgtcaagattgctaaaagaatacgtttttaaatgtcttcattataaaaaataagtatgtgaggtgatggacatattaatcagcttaatataatcattttatagtatatgtagctatatcaaaacatcacattataacccataactacatgcaattattatttgtcaattaaaaatacaaatctaggccaaggtgggaggatcccttgagcccaggagtttgacagcagcttgggcaacatagggagactccatctctacaaaaaaaaaaaaaagaaaaaaaaaagaaaaaaaaaggaaggaaaaaaaagaaaaaattgactgggtgtggtggctcttgcctgtagtctcagctgctcgggagctgaggtgggaggatcccatgggcccaggagtttgtggctgtagtgagctatgatcatgccactgcgctctagcctgagcaagagagtgataccctgtctcaaaagtaaaaacttacaacaatataaaaaataaaaatttaaattataaaaagccatcttctttcccactccttcccattttgatacaacagtcccagaccccagacttgctttcctcatgagtcatgcagactcaagtattgcagttccaaaacactgcctgactcaccagctccatccaaaagagtatgtattgtcttcatatgccagataggaaattcctgctgcatataggaaaagcagtgtgtttaaatacatggacacacacacacatacacacacacagagtacacatatacacatctgcatatacacgtacacatatgcgcacatattcatactatatatgtacatacacatgcaatacacatgtatacacaccacacacacacatacacacacatgcatctccaagtctatttccatgctttttttcagtaaagcacctagacaaaggagagagatgtctaatcaggttttggtggttgtcagggatatcataaatgagaatctcaagttactaaacttgatttcacaaaatagtttattggtagttttagaatggcattgcattttaggcagccccaattgtaaataagtgagccgggtaaaagcagattggatgtcacccagaatattttctggaaaggggacatacacaaaattctctctttgcacaattaccctgttttgggtttgcaatattatgttgagcaaggctggctattttccaccaacaggatgttacagcttgtcaaaagttattcaacctatagtgttaagcaggtacttcatcattactgaatttggttgatgctctatggagaaagccaaagttaggagttttgtctgtcattgaggtagagaccctcaactagggaagctttgaactgttcatccagctggtattctgtaccaccttgcctctggagttgagcttagaaccctacttccattttttctgtcacttcagggctgtttcaactattgtttcttcatttacttatatcaagtgtgttttctcaattcataagcatgggagaccccaagagacagatatcgcattagtccttttttgtttgtttagcaggaaggtttttaagtaaagctcctaaatgatatgtctcattctcatggaaattcatcaatattgttttactgtctcctatctggttactttttattttaggtaaccactgtgatacaatatacacaagtccctggatcatgaaaataaattgaagagctaatgttaatagtaagttctcaaccaggggttatgctggaacccaggatacataacccacaggagggccctccgtgaactcagttttcatggaattgtcccataccttcacaggtagaagcatggctatgttaaaagtggccaatgaaagtatagtttctttatgccttatactttgtttggtgaggatttctgccagaggtgtttgtttcctttagttttctggttgctatgattttatacagctttggtgacctctatgagtaccagataaagttaggtatgataaaggcacaaaaagaccgtagaagccatttgtattctaaatataaatatacagactaaatttgtatgcatttgtgtcttcattcttcacggtgctgtatcctccgtgtgtgtgtgtgtgtgtgtgtgtgtgtgtgtgtgtgtatttcttctttgattccaggctgcttatacgaaaatgctgattcatagtgtcactgtcttttctttttcctgcgaaattctaaatccgtttctaaactttttctacaactctgagtttaatctctctaaagtttttttttttccctcttgcggacacaaggcactttgctttgtttatgctaataaatgtcagactagcccccaaaaattagaagaaatgccagtaatttcaaagggctcttgagcatgattttttttcctgtttcttaatacattgtacttttcagagtttaagtttaggtgcatgtaggtggtattagaagattcttagattttattggtagcatccagacaatcttgtcatcacccgatatatatcacctctatgtggtagacccttgtggaaattttctcatcacgaaagtcgaaagtttaattttggagaggaagaggtttttcagatacattaaataggttttgctacaataaggtgagatggtactttcaattgagcatttctcatatactagcaagcagacagcttggcctcctggttgtaattacatgccaatggcttggtgctttttattttagaagttgagttcatcctgaattctctgagcatatggagtagtgcactctgattgttcccattaagattgtaattccatccaaggcttatagtgtcattgtaaacactagatggaattacagccccatgcacattttggaagactgcattattcattgaaatactttataaagttaaataattttgtaaatatgctccaagttcatgggacttagatagaaacataatcctggccacaaaggaggttctcagtaaatatttcttgtttatttgatggactttccttatatctttaaataaactgtatttttaaaaagtgtagagaggttatacttaaatatttgtaggactttaaaagatcttgccttgaaatgctcttacggtttcttgcttttcattgatggaaaaattgacttcccatatgaatatgttatttaatcttttctgtttctagcctagagagaaatactgagtagctcgagtggtcaagaatctttattttagggacatccgcatgtcctaagtaattcccttctatataaatatctcttttcggcataatgtgttgcatgccttcaaggtggaccactatgaggtgaataattacacaacgggaagcctggctgtctcgtggaatattggatggatggctttcttattggtcttaattaggacagtgttgttaagataattcactaattcacagtgcgttatcagatttgaaatgacctcttttttttatactacttcggaagtgtatgtataccttttaggaaagacctggaaggataagttgtatattttagtatctgatatggttttaaaatttaagactctgtgttatgtatgttttgggatgactataaataatctgtgtaacaaggtattaccaaaaaccttattgcctttgccaccatgcactgcaaaatatagtatcaggaagcgaaaagacaatgcattttgagtaatttttagaatttgcatttttgtgaattgacatgtatgtatggaggacttttcaaaaaaaacagaacttttcattaagaatattcggtattaagatattgttttaaatgtcagatatttttaaaatatatgaaaccatattaatcacgtattacttatactttttgtccctggaaatattccatttttaagaacagagataacaaataaatataccagtaaagctaaagtcagtgctttctgctcttaaaataatttattgaacgataaaatgaatgtctttgctttgtgaaattatatttttgtttaggacttgataatgcttagagaacattttagtttttacagtttaaagaatgaataatgactggttcctctgctccctgatttgtttccatgtagatagtacttcatttttattacctgtaaacatgtgttagctttatcaattaggctcaattgaatgaagcataaccccctgaaaggccttgccagtaaaataataatagtaataataatattcttttcttcagattctagcagggagtactgctggcttttatgtaagaagtcaactttaaaagtgtttttgtgtgcgtgtggtgtgggtgcagcagcaatattgtgtattcctttcaaatcaagatgcctcatagtctgtgggcgggggaactccctaagatgccctcactagttactcattcatttgttcctccccagaaagggaaaacccaatgctccacactccacttattctgaataatgggggcggggaggtggtggcgtgaggatgtcagtgtcattgggcaaaagccttcatttttaaagtttagcaaaatgcagttttattgctttatgatcagtgtgtattacaagctaatatacaaatggcattagtgatcaaagtgggatactgatgtggcaaaaatttacaatacacttaacagattgacctgacataacagtgaaagcatttgaattccttcccacatagtaagtaacaagtaatttctggagccagaagtgggagggtgtgtgtgtatgtgtgtgtgcatgtacgtatgtgtgtgtgtgtgtgttgtctgtagaagttaacaaatatgttagttcattgaccatttctttcgttgtcctaaagaaaatttcactcacttgtgcttctgatttgtttcccgtgaagtctcttatcactcttagaacatgaaggcgaattaatgaagaatccttaattcttcaaaaaaaaaaaaccagccctaatttaagaaaggagacatttaacttgctaataagatcctaaaattttataggttatataatacattcaaggaaattgaattatatattcattaagaatacattatctctattagcagagagtaaatgattgaggttttactgaacgctaaatgctcagaaagtaaatgcaaagaccatcactggttgagcacgctgggaactgggtggaagtcttaggcctgtcattaactgttgtgcggcctttggcaaataaccgaagttctctgagccttaggaaaatgaggaagttgggttatataagtggttttcaaatgtggcttcagaaaaccctggagagccactgcactccagcctgggcgacagagtgagacaggcctctgtggaattagccaagggtttgggtaaggggtggggctgagacctgagaatctttatgttacaacagctattaggcaatgtcagttcacaggaccactaaatcaaacaatccttcagaccacttccgactctcaagtttcaataagtccctagaaaacatcatccttggtccacaggaagcaatccaataaggaacttggtctcccataaagaatccaataaagaaaactttaaaatgagaggagggttatggatttgatcatctccaaggacccctgtcaagcaagtctaagatctttccaaaggagatctgagaaatatgtctgtatcccaagaaggtttgacaatagtccctgaagtttgggggatgacttctagatatccctgtgccttcaagcgtgatcatgggctggatttgttggccccatggtctgcctctgagtcacagacaaatgatgaaaaaaagaacaattttctgtcagcatgccagaccaagggaggggccaggagaagaaccgtgaaccatgaactgtgccactgctggaggcactgacagctccttggcaccagatgtgtgacctcaacccctgcagcttgggcacagataatatctcagggcaggggatgaggaatagaggaagaagggaaagttgcagggatcctggagtgttaatacccatggtggcggcagagcaatttgccaggaagaaaactctctggttaaccctccggcactagttgccaagcatgtttgtactagaatggagttcaaagttacaaacagagcactgtctgtttttaaggactcatatgaaaggtttgcttgtcctaagcctgaatccaagagtctgtctgtcataaacactttcaggtagcccaaaaatcccttcaatgtgatctccagaataggggaagacaaaggactcaggtcttcagctgtctgatgaggagtgagaaatttttctaatgaacatctctggcttatggatattaaggagagttcagtgtcaaaagtttctgcagcgtagttaacagaggtggaaagttgaaataaccttaaaggcactgaagctgagaaactgccctctttatcctaacagccacagttagttttggaacactgtccatggagaagctcagggctgtcaatttagaaagcagctgtgtgctggcccattgggcaccatctttctctcataggttgttctagtccaaggtgaagaaagctacattttgctctaagctagactgacatatggacttctagatttgaaccctaaacacaggaggaagtgattgattgtattacaaaaagaatcttctttggtaaataactatttttttttttaatggccagatgggagaaagcaaaagatgccttttcgtggtgttttggaaacctagatctcatcaactccctggttggttttggcggtcaaggctttttatgccagagcaactgtgagccaggtttctgaggttcttcctgacccatgttggtagcctcttaaaaataactgtcattccaagttcagctaaaatatataactcaacaaataaatacatataaagcatatgaatagaagcgggaaagtgaggattaacagactggagagtaagagtcttgccatgtaaaatactataaaacactcttaggaagtctcttgcttatgttattacttgtacagtaaatgtggagacctggatctcttcctcatggtcccttatttcttgttttcctgctgggaggtttcaagtagctgatcccttgcacatgtactttaaaacttcaattatatttgtcactggcttatcatgggcaatgtatgtgaatgtgactaagggtcctgataaattaaatgccacttttacatgttcctttctttttcttctattagtgttctttaggactttgaatgggaaatcctcaaacatgtaagtctatgtggcttcagaaaaccccagagaggccaggcgcggtggctcacacctgtaatcccagcactttgggaggccgaggcggacagatcacctgaggtcaggagttcgagacaagcctggccatcatggtgaaactgcatctttactaaaaatacaaaaattagctgggtgtggtggtgcacacctgtaatcccagctacttgggaggctgaggcacgagaatcacttgaacctgggaggtggaggttgcagtgagctgagattgcatcactgcactccagcctgggtgacagagtgagactccatctcaaaaaaaaaaagttctccccagtggcctctactgaattatccaagtgcttgggtagggggtgatgctgaggcctgggaatctttaataagaaagaagaagggaaattccttatgttggacccaacattgagtgtgttcagatacagatgttggcaggtatgggggcattcggaaggagaacagcggctaaccaagctaactgagactgagttcaagattcgcttctggttcagggggactttcgttttcaggctctaatacattcagaagagcaaatattggtactttaatcatgcatcttttccccctcaagttctgtatctgccacgtgtatattttatttggcatttaaatgcacagttcttataattgctgataaatagtctccattgcacattttgctggcactgtggcctcactgtaaatgctctctgtatgttcttgggaagttgcataatggcagttactctagtttactgtgcaatatgctcagtgactaatggcctaatcatgacttgaaaaatatataaacagttcaacagaagcagttgattcactgagctctttcatccagacaagggtgagctaatgggaataaaaaagacggaggtgtgcagcagcgtctttgatgtattgaagttagagcattcccacaaatcccatgcattattgctcattgatggcggatcctttttcatatgcatgaggcaggagtgccaaattatcgtcctaattggctctgacttggtattccttaatgttcgtgttacacttgttacaacttttttcctttcctctaaatactactgacagtaacagctttggagaggcaggctgtcacgtggccccatggcgtcaccctacactgcaggcttaagtgtggctctggtcctgtgctctggtttcttgggatagaattacagctgagactgtgcagtgcggacctgcctggtttacttcaggggcattgttgattgacacagattcttgttcccttgtcctcagtggcaccttttcttccaagaggaacagagatagagtcttacaacagccattaaatagaagatcctggggtctactggagcactgtcccattggtggggagaaataacaatcatcatcatcatgtctcccttcctttggaattgattaggtagctcctatattccacattcctctcacctgttgaccacacacaatttttggtcttgtagcttggccactcattttagctcaatcactggtttaatttttttaatgaaatcactcaatcgatagaggctaacctctcgtagatgtaataattccaaccattctcaaagaaataatgaagggtggaatattatgctttctaaaataatggaatttattttttctttatgcccacagctgtttagtcctaaagagggggaagaaagaatctttcgatcttttggcatgttccatgtcccgtattgatggtcatacttcagcttttttctggttgtttaagaattatgtggccaataggctgccttgtatataacagtgaaaaacacccattacttgtatttgtttcattttaaggtttaggcagttggagcataggacagtaactggtttcccttgttttctggaacctgccccttgctctctcttgggtgatgcctcacccctgccccagtgtcagagctgccctgggtccttcttcccttgaagggtctgatgaatgaaccacacagcttgttagtatctcagtttgttaatcctcccggaggaatgtatgtttcaaaaaagaagctgaaaagtataatggatgagaatttgctttggaactcagcacactgtagattagagaaggaaaagaaagaaaaggaaggaacagaaggacatgtttggggggtagggggcctttctggggcttctgaaagcaaatgttgtgataattagttacagtgtcccaaagatgcctgggtctacccctgaccctctacacaggccaattctgctcccaccagaaaaaaacaagagtacagagcaaagaggcagggcagcagcctctgatacctatttgaactttacacattctgatagaatttattatctgtattgaatatgggagactgtgggtaaaagacttcaagacagtgaaaaactaggaaagaaaaataaaggtgtattgggccttggcaaatttttgacacttacttgactatgtgctttaactttttgaaaaggcagataatatagcaatcacattaaatatttatctttaaaagaaattattttaaaaattactcttaatattaccacattatgaactcaataggagatcctacagttcctttaactttaacaacagtacatttgttaatattcattaaagttaaagaagcttactattacaacagaatgaagtaatacttgctggaaaacaccaatattttacttatctttatctaatccccccgtttaactgtagtgatacaatacttaattttaaaagaggaatggtttgaatgtacagacttttacatgtgttcttccattgagttctttcttgtagtctaacccaatagttatcacacttcagtgtacatgaaaagtgcagtaaaggattgtgcagtatacataaaatcctgtgtggagtgtcttgtgggaaagccaaaggattttcaaagttaattttgactatatatgacttttgcttaacttttgaacttaaccgcccacataaaaactcactccactatatttcccttctctttgcctccctacttctgtcccccctttctcccttttttccttcctcccttgtattcttccatccatccatccatccatccatccatccatccatccacccacccacctatccatctatctatcctcccatccacctatccacccacccatatatccatccatccatccatccatccatccatccatccatccacccactaactcatccatccatccatccacccacccatccatccatctattcatccttccacccatccgtccacccacccacccatccattcatctatccttccatccatctattcatccatccacccatccattcatccatctatctatttgtccatccatccaccctcccacctatccatccatctattcatccatccatccatcttttcttccatcactcctttctttttttttttttgagatggagtttcactcttgttgcccaggctggggtgcagtggcgtgatctcggcttaccgcaacctctgtctctcgagttcaagcgattctactgcctcagcctcccaagtagctgggattataggcatgctccaccacagccagctaattttgtatgtttttgtagagatggggtttcaccatgttggtcaggctggtctcgaactcctgacctcaggtgatccacccgcctcggcctcccaaagtgctgggattacaggcgtgagccaccgcacccagccccttcactcctttctttttctctttccctgccttccttttgataaattaacttaaacattttttttggtgaaattaatatggtgatgtctacttatatttaaatcagaaaattattagtatgctgaatattccaatctcttaggaatgataaaaatattctataaaggtcaatcttaattccacatcctatgttcctactcagctttctgtctctgatttctcatttttagctgggaacatcccagccaaaagacagccaggttctctgtgagcatagcatatcaaactaactgtaagaaaataacattttggcttaaaagccatcttctaatataagatagaataaaaatgataatgattggtatactatgtggcattgttagtaagaatttgaagtaagatttacctaaatcgctgaaaatattgaatagttggctgagactttagaattggtacaaacatgtacattttctcaaaatcaaaagaattaaaatagatatccaagaagtcagattatgaaaaaataagatagtcaacggaaatcctaaaagtaacttaaacattggcattggacatatttcatttgtatttctgccatagaagagttaagttaatgtgcatttttgccatgcaatggcaaaatgaagagacttttttttcccttctttttgctcttggtaaaattaagtggcaaagaaaagatagctctgaggttattgctagaattttgtgctaaaaacattttggctagagcagcaagtttttaggcaaacagcccctgataaaagttgcaagaaaaaaatctcattcgagtgcaccaaacacttttcagatgaccatttaatttttttaagttgcataaacaatttcaagtgcactgtaaatatagaaaatagggtatgatagttgacagaaacagaatgaattaagagcagtaatagaaaattgtaaacaattatatctgaatttcatcagttgtcttgcttacattcacaattagtcatcccgtgaaagacataggtgaacatttagctgcttaaaaaggaattagctgcttgaaaggacaaatgttcatgttaaatttcatgaagactaaccttcagcagacaacggcacaaatgtgtcagctttttctggtgtgaatgaagcaagatacaggcaaaacagatgagataaataggacttggaaaaaaaattctactatacaagttttgtatccccatctttttgctctttgtggagcacctactggaaaccactcctgacctaatgatgaggacacagagagaaaattcaataagcaatggcctgaaaaataatttttatctaagtattagataaacgcagtagcatatttgacttgtaaaaataacatggctaggctttgtatgcctccctgtcctcttacctacgtgggattttcaaatagcactgattctggggaggggaatcaaaaaatagaagactcccctctcccagagcacacgtaattaatgcctgtgttgcagctgggagctctctgccagcagagttctttgctcgtcatctctcagcgctcacccacattccccttgattcacaccgtattgtttgtttacatgtttgtctccctgactcaggttggaaatctttaaggacaaggacaacctcttgttcctttttacatttcccatggtgctttgctcgcagtggccactacagacatgattcattcattgttttaaaaaaagtgttaactagttaagtgaaaataaaatgaaacagcaaaatgagacaaacgcctagatctgaaaggctacaaaatacagcagagggttcagtggacataagaggaaaggaacacaatgatatccccaatcttgtgatggaatagaaaaaaaaaaagtgattggtgttgatgtaacacttttcttggccagttgaacattccagagtagaggtcagttttgtagttaaatctggtaggaagatgtttccaaccagaaggaatcatactaaaattattttatcacaacaagcagtccataaccgaaactttaatttgtgagttgggaatcaggataggaaacccaattttatattctttttataggaagaagaatccattccaccactcagactgctttcctctttcataatcgtggcatactctgccattgtttgtttattttccccacaactagatggagagtgcaaggaccatattttactcatgtgtatcctcagggcctagcacaaagtaggcactcagtaatgaagaagtaagatgtttcaatgtccctaacatttaaaaggatgtatgaaactagtgctaataccagaaagagttggttttcataggctgttaattgtgggttttgaaataatgtactactttgtacattgattttatacaactgtgttatatacttcagtaactttcaaggtaaaaagttagaggttattaaatctggcagggtcttaaaacctgagtctcagtccatgtaagagcattcttttgctcttcttgactagccatgtaaaagggtgaatgtaagttagtgaattatcttttagaaatcttcagttgtatatatatttttttcatcgaattgcaaactcactcacacttaccaatgtaatactaccctgttgatgagcattagtagccttatttgggtagccagattagagacacaggcttcatggtgttacctgccttgatgttttcattcataatgcagcatttgggaatgcagcatttttctatattggagacatgtatgatgatgtgtatgttccttccccataaccctgtccgcttctcctttggcagtgtcttgcatcacaattttattttatttttatttatttatttattttttgagaaagagtctcactccgtcacccaggctggagtgcagtggtgcaatcttggctcactgcagcctccacctcccaggttcaagtgattctcctgcctcagcctcccgagtcgctgggactacaggtatgcaccacaatgcctggctaattttttttatatattttttttagtagagatggggcttcaccatgtcagtcagactggtcttgaactcctgacctcaaatgatccgccagcctcagcctcccaaagtgctgggattacaggcgtgagccaccgcacctggcctccaattttaaatatatgtaggctccatctccacctctccctgaaaaaactttccctgctcctttcgccttcatgtgtgccataagttgactgccatcaggccaatatcattacatataaattccctccacccttcgttttaattttaaaatatctgaaagggggaaagggagaagattccctaatgagtatgttgtgtgattcaggaccttggctcttagatcctcagtcatgtgatattttcagattttatgggactatggtgcaattgaagaaaggcttttgacagaaaatgtgaaatgatgaagtcttagcacggactcatacggcagtatttgattgcgggttaatctccaaacgttgaaataaagtggatctgttaaaaagccattggttactttcagttgccaggggtgtgtatgctcacattcctggaagcacattctataaagtcaccaatctacaacacagacacccacctccccctagacttcagagagctctgctgggctgcagctttctaccaaaagagttgtgtgcctctgaatttcacatccaaccttggaagctgcagtctgtttaagatttcagaaagaatgggggctatgtttccagtttactgctttgttattttgaaattgaaagtctgagcagaattcagaactacacaaaacaggatcttttcacatgtttgtttaagtcatgttcttggcaaaaacttgctgaggaaatgatctgtttctctaggagcattgatttcttactccagtacagtggccatttcccaggatctcattccaaaccatctgttttgccatcagagccagcctttcagtgaatgatctctttggtctacactgtgctaaaccttctgattgaaaggatttttattaatgaaatctaggtaataaagttgcagtgaactttaggaagttctctgtaggcagggcgtggtggctcaagcctataatcccagcattttcggaggccaaggtgggcagatcatgaggtgaggagtttgagaccagcctagctaatacagtgaaaccccgtctctactaaaaatacaaaaaaaaaaaaaattagctgggcgtggtggtgggcgcctgtaatcccagctacttgggaggctgaggcaggagaatcgcttgaacccatgaggcggagcttgcagtgttgcagtgagccgagatcacaccactgcactccagcctggcaacagagcgagactccgtctcaaaaaaaaaaaaaaaaaaaaaaaagaaagttctctgtaacagtcaaatagcaagtgctgacctctgtcgcctctgtagcagcagtatggatgaattgtgagcttgttggctaggttgggctgcgggtcattgtggaaaagccatgtttcccttgcctgtggctgggaataagtatagtggggccattttaaaaaaaagtcctgtggttgaattctgagtttgagctgttttaaaatgtcaaacagactgaatccttgggagactcatttgaatgagaccagcagcaatgtaagaatatatatatatataaaacacgttagagcatttccatgtatgggagggaactgatggagagaacacagaccaccacattaactgccacatgctgtcaaccagtggatctcaactggggaccattttgccctctcaggacatttggcaatgtttggagacactttttgatcgtcccaaatgggaaaacaaggtagcaatactggcatctagtgagtagaggccagaaatgctgctgaacatcctgcaatggggctgggggcattggctcacacctgtaatcccagcactttaggaggtcgaggcaggaggatcgcctgagctcaggagtttgaggctgcagtgagctgtgatggcgtcactacactccagcctgggcagcagagtcaggggtctcttgaatgaatgaatgaatgaatgatttttaaaaatcaatcaatcaatcaatatcatatcctacaatgcaccaaacagtcctctgcctcaaccaaggatcatctggcccaaaatgttaatagtgctggagttgagaaaccctgccttagaccctttccttctcatagtttccaagctgataaatcagcctgccttgacaaaggtgaggaggtaagctgcaggcgtgagtgggaagagcaggataaggaaggaaacggagaaaagaggtagcagcattgcatgaaaataaactacccgggccatatcccatttgtgccaaattaatatttgggattctgtctttatgtgtttggtaaagccggaaagtatgtgggtggctggctgggccatggcctttgtgttagaggtgacctgagtttcttcaaagcacctgtgttagtttttcattgctgctgtaacaacttatcaggaactttgtggcttaaagcaactgtttttatctgacagttctgcaggtcagaaatccaatacaggtctcaccaggctgaaatcaaagtgtcagccaggctcattctctgtagggactctagagaataattcatatccttgccttttccgttttctttcttttcttttcttttttttttttttttggcgggggggaacggagtctcattctgtcgcccaggctggagtgcagtggcacatattggctcagtgccacctccgtctccaaggttcaagcaattctcctgcctcagcctcccaagtagctgggagtagcccagcaccatacccaactaaattttatatttttactagagtggggtttctccatgttggccaggctggtctcgaactctcgacctcaggcgatccacccgcctcggcctcccagagtgctgggatcacaggcatgaaccatcgtgcctggcccacctttttccattgtctagatgccattgtatttcttggctcctggccccttcccctatcttcaaagccatcaatgttgcatctctctgtgctgtgtttccatagttgaatcttcctctgacacttcttcctccttctcagacttttaaacttccttgcgattacattggacccacctgtatcatctccccatctccagatccttaatgtcatcacatctgtgaaatcgcttttaccacgaattcacagactgattctggggattaggacgtgggtatgtttgaaggtcccttgttgtgcctaccacagactccaaggcatttactagagccacattttgctgacttgagctagatgtagcaaaagaagtgttataaaaatgggtttttaaaaaagcctttttttttcctgtggtataattttagtgtttagaagtaatttttcttttaatgcagtatgacacagaaaacatttggaggatgttgaaaagtaattgtttaaattggcaaagacacatttcagtaagggagtaaacaagagggaaacgtgttggggggaaaggtgtggggaggaaactctagaccagaggccctaggacttgaatatacaacttagtcctgttgaaaattcagattcctgggccttaaagtatgttaaataggtcaggggtggggcccaggagttgtacttttaacgagcaccctcctgtgattcatttaacataaaaggtccttggctcacacttggagaaacactgctgtagaaactcaaatacctattttaaaacaaaggtacattttaatcatttagtttaaaatgaaatcattgcataatactgatgttagaggttagaataaacatgtacttaagttcttgatattcttgtcatttcagttacatgtcagggaatgtgatttgtgttttgacgtattcaaatccttgtcatattcaaccatattcgtattcaaaatatataatgattttgacccttgattgttcgaattaagactgtcatcttttctgtgtgattaactcttgtgttgatataaatatgcctttggcttactaatgttcagtaagaactaatgactcttgggaatgttaatagactctgtgagtccctttttaatcatttgtaaccaggctgtcattccatgtttgtttggaagcttagagataacatttatgaactttgtgacacatagtagttgctcaataaatgttaactgtagaaacacattgattagtttcacttcagaaatagacacttagagttcaaaattcccatctgcctagctcctgaggcccactttcttaccagaatctttcctgataccctctcctgcataaaatggttcctcttttgagactttgtagctcttttgtacttctcttattctgttacgttactgcaaaaaaaaaaaaaaagaaagaaaagaaaagtgccaattgtgtacatgctttcctccctgctggaatgtaaactttgtaaaggcatgatccatagcagatacttcttattacaaactacctggcagaatttctttctaaagaacctactcagtaagcctgttggtgaactgagcaacatttggacaattatggcatcatcttacaatttttcagctattggttttcacttgtttagaaatgtaaaactttgcaaggacttttataaaagcaaatttcagaatagttattcactaagcttttttatgctaatgatgtcatgctatcaaaaattagctagagtaaatggactgtaatgaggatggtttgtaatctagattatatgttccacatgtaacatcgaaatgaaatataaaattgagttgttggcatgtggttgtggtgagcagaagcagttattatacattacttggtaaaattcatattcatatcttgtcagtttacagtgagccagagattaaaaataacatttgtttctgttttagtaactgcttaaaaatatccaaaatcattttattttctttagcctgacttctagtagtgttttgaatatgtggcctttcaagcagtaatgaaatgcatcaatgcgacttggcagtgcctcacaggacatgcttctaggatcatttttaatgattaaaagtcaaattgagttctaaaaaactgacccaaaatatagatgagccaagtaaaaacggaaggaaatctgaataaaatcttggttcttggtcctctgcatgtatcctccacatctgttttctccagatctcttttttcttgcttgttgatagcacagaggaagatcgcagagagtaatgtactgtatatgtttcacatcccccttcctctttagtgatagtttggagagtatactgcagtcaccatggttttcagtttggagagtacaaggatcagatctgtattttctagagccagcttttgtggcattctggagaggtgattggagaaccatgagagcaggcagacatctgggtgagagggcacgaggggtgagtgacggcagagccagacttgctggagaggcagaaagggaaggattcaagtagcataaccaggaaatagaattgataggatttggtccctgctgacctgtggaataagggggaaggcagaggagttgattctagtatttctaagttgggccacttagtgatattggggtaccaggaacaggcttagtggacccacagaagtgaccagacccaggagtctctctgagcgcccaccctggcttctctgtgttggcttaccctttcttggttgggggtcatggggtggtcagcttcagtggtgtggtctgaggtgacaggtgctcaggagtgaggacagggagtagacatcaccaatgtgaatgtggaggtaggcaacaagagttattctagaactgacaaatttaatatattttgctgactgctgagttccatttggacaaatacctaatgcatttggggcttaaaacctagatgacgggttgaagggtacaacaaaccaccgtgatacatgtatacttatgtaacaaacctgcacgttctgcacatttgtcccagaacttaaagtaaaaaaaaaaaaaaaaaaaaaagattgttcagttcagttcagagagcaataggagcagtttgctattcaccaaatagggacatcaattctttactgattaatagcagtgattcagaaaactgccttttgtagtagagcacaccaagggggtctgccggatggaaaaagagaacagtgctttgtgaactataattgttgccataagtaaatacttaaaatacactaaaatggcaacatcaggaaacatgactaaggagtcagtgtacgccacgccctttcccccacctttgtggttgttgaaaatttccaccaagagtgatgtatacaaaaaagggtaagatcagggtgttaggtttcagaggaaggcaaaaacttgtgtgattctataaatggagcttacaaatggaaatgcaccattcaaggcagaaagtctatcacagtcattaggaataagcattagagtgattctcctttcttaacttctgcacagaagtttgatgtggtaaagaaacagtctgctcttagccatgttccttgaaaatacatgtcttcaattacttggtttgtctgagagaaaggagggtttggaggagaaggaaatgcctcgtgagtttgacatactatgggaggattgttgttattattgcttgatttacatgctctcattttatacaaagtgtacagcacaatttctcaaagagtaattatgatgccaagaaaatggggtggattctgggcttcctgcagtctgtcatccaaataataatattcattacaaagatccttacccaggaggccaaggtgggaggattgcttgaggccaggagttcaagaccagactgggcaacatagacccctatctcaaaataaaataaagtaaataaaataaaataaaataaaaaataaaataaaataataaaagctccataccagtttgtggcattcctactgaaaacagaggtatacgaaatgcttgaacagggcatggaactggaggtatggatgtcattaagaatggctgagaattttttgccaagagttagtatactatcctactttattctatttcagtttgcagtaggacagacctaattctcttccctgagaaagtcacaaataaactagcatggagcttctcagtgggcacccttggctgaactctatagactcctgttctctttaataatatctaaagcttctggttcaattacatggctaatatcttgactctcaagaccaaaaggcaagatgtttaaaaataaaatcaacgttaaaaacatgcctgtgttccatggacacaggaaggggaacatcacacactggggcctgttgtggggttgggggaggggggagggatagcattaggagatatacctaatgctaaatgacgagttaatggttgcagcacaccaacatggcacatgtgtacatatgtaacaaacctgcacattgtgcacatgtaccctaaaactttagtaataaaaacaaaaaaataagaaaacaaaaacaaaaaaaacatgccagtgttctttagtcctcactcaattagagaaaaatgagagcaagcatgatattttgtatctggcactatgtgcactgccttgagagatttctctagaaggttttaagaacatctgtcatctattaatagttacgaaagccgagactcacacaaatgaggcaacattacagggggtcagagagcacataggtaagcccaccttgatgggagtcctggcccgaggcactttggggaaagagtgagctgcagtggttatagaaagacaaatgtcttgagccgggcattgaaaaatgactaagaataatctagaaagtgttcagtatgtttttaacgattgtgggttagcagaaggaaagccatctgaggtgagagaaataataagcaaaggggacagaggtggatggtgaatcaactgacccaagggagttaagcgtttagaaagcacttcaaaaggataacactacatagctccttgccttactgtggtgccttagagatgactggcatttttgcagagcttgtttcataaatgtgctttcagaggaataaacaggggattcgggctgggctgaggataccttgaattttgtttacagaccatcattttgtttacagaacatcagtgctctatcctcatgtccttctaagaatcaaaagttttaacctcacagaatccagcgtgtggcttgtgagtgagactcctttttccatgtgataaccggtctgctttggggaggcaaaagaatcttaccgacacgtacatattttaggatgggctctgagccaattcatcaagccaactcctcactttgaaacaagaaagtgaagaggatgtttcatgattgtggaatacctgccagaggaagaatctaccgaagttcagtcaactattaattggaaaggaggcagcagactgaggagatagagaatctttgctctcaggtggatggaggttggagtcctcaatctgtcacttgtgggtacattatgtagctccttcacctccatttctttatttattagaaggcgggtaataaaagtgtccactgcctaggatggttctagggcttagaggagataatgaaactcaagggcttaacatgtgaatgttagctattatcattgcatgtgtccattaacacccaaagataaccagtgttgtttagtagttctttgcgtattttctttctaaatagataatgatttataatttacctagttacttcatgaattgatttcatgaaaaaggtctttctgaatctctttccatgtactttaaaagtttattcctttagttaaaagaaattttaactagattcttaaagcctagattggaagaaagtgtttgctaaaaaaaaagtcatggctgggtgcagtggctcacacctgtaatgccagcactttgggagaccgaggcgaacggatcacaaagtcaggagagcaagaccatcctggccaacatggtgaaactccgtctctactataaatgcaaaaagtaactgagtgtggtggcatgtgccagtaatcccagctactcgggaggctgaggcaggagaatcactggaaccagggagtcagaggttgcagtgagctgagatcacagtactacactccagcctggtgacacagctagactccaaaaaaaaagaaagaaagaaaagaaaagtcatgtatatatccagaagaaaggaaatcagtatattgaagagatacctgcactcccatgtttgttgcagctattcattatagccaagatatggaatcaatctaagtctccatcaatgaaggaatggataaagaaaataaggtacatatacacagtggaatattattcagccatacaaaagaatgaaattctgtcatttgtaacaacatggctggaactggaagacgttatgttaagtaaaataagccaggcacagaaagacaaatatcacatattctcactcatatgagggagctaagaaacatgacgtcatggagacagagagtagaatgatggttagcagaggatggaaagggtagtgaggagggaggaataaagagaggttggttagtggctataaaaatatagttagatagtaggaataagagctagtgttcagtagcacaatagggcaacaatagttaacaataacttattgtatatttcaaaataactagaggaatgaatttggaatgtccctaacaaaaagaaatgaagtgatgggtatcccaaataccttgatttgaccattacacattgtgtgcttgtatcaaaaaatcacatgtacccaataaatatgcacaacgatcatgtacccataaaaataaaacaaaattaaaaatgcacacttctcacagtttcttgcctagtagaatccaagtaaatacagttttccgcccacagataactcttccctctggtgccctcatggtttatctcatgttcttgaccacatgggttaatggtctttgttaggttgtactcagtgatccccaagaggacaaatggtgggaattatggaaattgaggccagaaggaaacctagagttctgtgcttttacttccagtagggatctgtggggtttagaatgtctgcctggtcagcagttctcactttgggaacccccccacccccacccaagaccttttctggagggacatctgtaagatcaagattatttttatggtaatactaagacattatttacctattccattcccattctcttccatgtgtacagcggagtttttcagaggctatatgatgtgtgatgatattgtgtaatgaaatgtgtcaacttttggaagatttgcataattcactgaactaatataattttccaaatgaccagggtatgatgttacaaaatcatgcatagctaaagatccatccaaagttcaagatagactaatgaattttaatataaaagaatacttagagtttatttctatgcttcagattccatggtgctgctcccctttaagaaactaccacttattgagttttggtatgatataaaaaaagaatatccacaattgctgaaactattggccacatcttctccacatacttcaaccaaacaacatatcacagaaaactgaattcagaggcacagaagagaatttaaccattttccattaagccaggcattaaagagagctgcaaaaatctaaatggatctcactcttgtcactaacttttttgttctgaaaaatataattattttttcataaagatgttatttcatgtagtatgcaatgggtatattagtatttctattaaatgaactaatgaatattttacatttttctcaattttgcttctaatatggtataatagttgttaaatatgatctacctaatgaaaagttccttggggtcctcaataaattttaggagtatagaggaaactttatactcttaaaatttattgaggacccaaggagcttttaagtgtgaggaccaaaagtgtgaggaccactggcctagtctggtcagtgtctacaccctgtgtccactggtttcacctttcttctggaaaaagtgttctgtggtaaaatatattttgggcctagatgagtgctttctcccctcatagatttacaatacacatgaacatatgagaccctccaaagtctttcccaaatttatcccaacctttaaaaacaaattatcccaacctttttttatcctccttttaattttggcacaacataatgttccacaatggaatataacatcctatggaacgtaccggctggtatatgatatgggctgccctctttccgttaacaaaaaaattaaaagcaagacattttccttcaaatccatactttatttagagagaggcctataaaattcacttgcgaatctgattgactttcttaaaaaaacatactcttcattcattgtattatgccattttgcttatactctttgaagctgtttctacttctgtttccaaatgcatatgtttttttaaagctctgttttagacatttttgtgtgttaattagtagcatctgctccatgtgtcataagacaaagtaatttcatccccacaaaattgtccaaattgcaggttaagtggtagcagcctagctgttgagctgttactactgtttggtatttttaaatggcaaaaaataccttcggtgatgcatcacatgcctttaataaaacacagtcactttgggtaacagaaagatttagaaatggcagtgggttttgttgtatttctttttatgattctttctttccagtgctttagtttccattggttgtgggtacaatcctaagagtcagaccaaaataaagaatattccatcagtatggatcaaaaacatgttcctggccggacatgatgggtcacacctgtaatcccagctacttgggaggctgagctgggaggactgcttgagttgaggagttcgaggttgccgtgagctatgatcacaccactacactccagcctaagtgacagagcaagaccctgtctctaaataaataaataaataaataaataaataaataaaaaattaaaaaacatgctcctggctgctgcgtgatgagcatcatcttcctaagacatgagactgatacttgcaccacccagcaccagtttcttcccggcacagtgccattctaaatttgtattgaggcaggagtgcagcgagaatttctttctccttctgtatttcacatgtctatgccacagaaagaatagaaacatcttaatttgttataataattatagggacaatagtcactgtattttatataattcaaaagttctttttaaaaaattttttggtcttgccggttcctactgaaacacttcgtacagtttgaatccttagtgactttctattgccaactgaaaattgattttttcctatattaaaaaaaaatccagccgggcacggtggctcctgcctgtaatcctagcacttcgggaggccgaggtgggtggatcacctgaggtcaggagttagagaccagcctgaccaacatggtgaaaccccgtctctactaaagattaattagccaggcatggtggtggacgcctgtaatcccagctgcttgggaggctgaggcaggagaatcgcttgaacccgggaggcagaggttgcagcgagccgacattgcaccattgcactacagcctgggcaacaagagcaaaactccatttcaaaaaaaaaaaaaaaaaaaatccaaacagaaaatactgtggctatcttattcagtatcttgttcttttccttaccactgagtagtttcagggaaaaccctttacaattgcaaaaagacattcagtttataggactatttattacagcgttggcaaatggtgctggaaattctctaatagttaaatgacgcaaattaaccagactgaaatggaagaaccatactgaggttgctcttcaaacagcaagaggctacctttctgttttctttgacaactgaatatagcttatgatatagttaaggtatcaaagatgcaagaattgtagagctatgtggcaggttaagaagcctgatgaatggccgggtgcagtggcccacgcctgtaatcccagcactttgggaggccgagaccagcagatcacctgaggtcaagagttcaagaccagcctggccaacatggtgaaatcctgtctctactaaaaatacaaaaaattagctgggcgtggtggcgtgtgcctgtaatcccagctacttgggaggctgaggcaggagaattgcttgaacctgagaggcagaggttgcagtgagctgagaccacaccattgtactccagcctgggcaacaagagcaaaactctatttcaaaaaaaaaaaaaagaagtttgatgaagatgcagatgcttcattgcttgtgcaaattgtgtgattttagcatattctacagtggaaagtcaaatttcaggcatgcacacctaaagtaggaaaaatggttcttaaaggggtagtgtgatgcagggattaagaacctggtttctggagtcagatggcctgagtttgagtcccacctctaccatgtatgtgtgctgttgaacaggtgatttaacttctttggggctcagtttctcccactgtaaaaagtcatgtaaagttcccagaagagtgtttcatacattgtaactgtagtagttatctactgctgtgtaagtaattactccaaatcttagtggcttaaaacaacaagtgtttattatctctcagtttttctaagtgtgaatcactgcatatcatagctgggtgtctctagctccaagtctttcatgaggttgtagtcaagttgttaacctgggctgacgtttcatctgaaggatagggtgggggcggtagggatctgcttccaaatccactcacatagatgctagcaggcctcagtgatatgccatgtgggcccttccacaggactgcatcacagcctggcagtcagcctcccccaggtgagtaacccagaagaggatgcaagatcccaagatggaagccaccatcttcatgtaacccagtcttggaaatgatctcccattacctttgccacagtctgtttgctagaattgagtcactaaatccagtccacactcaagaaggctttacaagggcatgaattccaagaggtgggatcactggaagccatcctgcaggctgcttataacagtaacttgtgctttaatttatatccccttatggtctattcctgacaatcagaccaaatgagcccttaaaatgtaaggcagatcatgatactactgcattaaaaattatctctggtcttcccattttacttaaaagtcggtatctttacaatggcctacaaggcctttcatgcttataaaattatttttctatattttgtaaaataatatatatgtataataaatgctatatatgtatatttgtataaacacatgtttatatgtttagttatatatctagaatttattttccatatggtgtaagatagcaatctctttcgaaacgaagagccaggtttcccagcactatttattgattacaatacccttttcctgggccaggtgcggtggctcacatctgtaatcccagcactttgggaggtcaaagcgggtgaatcacgaggtcaggagttcaagaccagcctggccaacatggtgaaatcccgtctccactaaaaatacaaaaattagctgggtgtggtggtgggcacctatgatcctagctacttgggagcctgaggcaggagaattgcttgaaaccagaaggcagaggttgcagtgagctgagatcactccactgcactccagcctgggtgaaagagcaaaactctgtctcaaaaaaaaaaaaaaaaaaaaaaaaccaaaacaaaataaacctcttttttccctgagttgatattctactgagaacctgtttgtctcttattatgcaatctgtgtctaattgttgcatttttgaataaagatatacttagtgggtctagtaaatcatataagatagttgtgtttgttatgattttatttgatttgaaacattcaaatacatgtaaaaacaaattataattgagaattaattatggcaaacatttaataagttcctttatttgatagattaggaactaattttatttaaaaggccgtgacttacatttaaaagtccaattagctacaacattaagactaaaaagtatatttcatgactcccaggtcactgtttataggttgttgatatcccatactttgctgctgctgctgttgcttataactgttcagaaaattttcaccaaaatgtctatcaaattggaaaaccctctggagtgagatcctttttaaaatatagccaactttcacatatgcaggcatatctgtgaatgccctaggcccctgtgctttctcttctgctttttgggcttttggccttatctttgcttatgataacttcaaatggtaaacaagaagggataggtgacagagattaaacccaagccagtttgttttgttgattattattaacggtattgataaagagtttgctgaaagagggaagcatattgaaattattgcttaaaaagaagtgtgtagaattttcagttgttttcttttgataagagttgcctcatagctgttgtagtatgtgcaaatgaaggtcagcgataaatcacagaatgaatcacttccaactccttcacatctacagatataagtaagaatggaaaatattgtcacttagatgagtccttattttttttttctgtatgaatagtataaaccttacttttctggacacctagctttggcagctggtgaaggttgttaaagtaacaaatgggaccattctgcctctcccagatcgattttgctgcaagatagttgaaaataatataatccagaaatgaatttattttcttatggcaaaaacaaaacagaaagagagtactatgaggaagtatcatgctactggtaaatttttcaaactaaaaccgcattacatttcattaaatgagtttatgtccattaagcgtcaatgagcatgagtggttgaacccagaatccagtcaaagtacatattaactttctgtatgactttaaaaagaggtatgtcaacctccctgggtcagcaggttcctttgcagaagacattggaatgaaacgtcaaggacctcttccaattatagaatacctcgagatatgaagttggtaacaaataagagaaatgcagcaagatatttttagttaaaaaagaaaagattgatacaagccagtaacttgcagtgaacttgtttaaatcctcctcctctctccaaattctgtttttaccaagccggtaaagtaaagacagtttgtcatgctttgaacttcctggcttatgttgatttctatcagtatgttgccttacacatttgagtgggagctgagttacataaaactaataaaatccttacaaccccattttctgtgggtactgatagcatccaaaaaataaaaaaggcttttgccattttcaggcagttgttcctccggctagatggaaaattgaatggcattatctcaactcacatgtttaaacattaacggagagacactttctcctcctcaaaagtttttagtgttcccaggaatttaaccacagatagacacaactcctcaaacgtcccgaaaaaaaggttgactattccataaagtaatagttacagaaggctttcaaggaattagttattcacacagtaagcttctgaggcatacgagcatatcctctttcttacaacttggtcacttgatccaatctttgatgatcaccgtgggacctttggagatttatggagtttagggttacaagtatgatgtggccaccatactcagggaactggatgacagtcagccgatgggttttcaacatagatgaggatgagctcataaaaggctaaaaaaggaggcagacacctttggaagactgtttctaggctctcaaatggccattgtcaaaaaacaaacagtggggtggatttgactaagcatcagaagatgctttaacaacagcctgtgacaagtgagcgttaaaagctcacaaggcagaaaggaacttttcagagtgaccttgtcagacgaggttctaatgtgtaggctttatcagctgctctgagtgggggtaaagaggcatgcatattttaaacattcatttcatattcagtgtgtaaagtaactactgcttttcagcttgggtggagaaagtatttatcaagaatcacacaagggaaacccatgcattacctacttatagggcaaaatggaaaatgttctctctcttatgctttatcttttttgttccatcttaatagctctttatttaaaaagtattcacatcagttgattagtctgagtctttcatttgaagcaaactttcttcactttctgcccttgatactgcacatcagtctttaatcacttagacgtactgaatttttctttattcacatctttcaatcggtaaacttgaaattttgcaagtgcattcccactggtgtacattctgattttcaagacctgctacctcccccagtgtcatgcttgttttttttttctttctttcttccttcccacaccccacctccagtattttagggcaccttatgtagataagcagtgagatggcttcatcctgataattaacatgcttgtttgaggttatgaaatatacatttgagaaaggccagggatttccccctgaatatccactaactgcttgaagtggcattttcattctgacttggtattttgttttgtttgactgcagcatactggagcatagtgaaagagtctattttgaagcttcaaacttagtgctgctgcagaccaggaacaagagagaaagagtggatttcagcctgcacggatggtcttgaaacacaaatggtttttggtaagtcatccaaaagacttgacatcttttagctttaaatgtcatcgggcatcacttcactggtgtaccagaacttcttcttcaagcgtattgctatttctctacatcctaaataacaggacatttgaaaaaatgttgtcctagtgacagagcactgagagagcaaccgcatttactttatgtgtttgtttctgaaacttgcagaatagtatgatctgaatagaatgtatttgtggttagaaaaaagaacaaaagcaaaaacaaagcaaacccaaacaactaaacacacaaacagcaaataaactacatctaccagatactccattttagctgaaaacataagggattaatcgcacgagaggaagtagattcaatttaatggcaagttttttgcgtcttgtgatcaaatacagtcatgtgccacataatgaagtttcagtcaacgacagatcacacgtattacagtggtcccataagattataatactgggctgggtgtggtggctcacgcctgtaatcccagcactttgggaggccgaggcgcgcggatcacgaggtcaggagattgagatcatcctggctaacgcggtgaaaccctgtctctactaagaatacaaaaaaaaaattagccgggtgtagtggcgggcgcttgtagtcccagctacttgggaggctgaggcagcagaatggcgtgaacctgggaggcagagcttgcagtgagccgagattgcaccactgcactccagcctgggcgacagagcgagactccatctcaaaaaaaaaaaaaaaaaaaagattataatactgtattttggttgtaccttttctatgtttagatgtgtttagaggcacaaatgcctaccattgtgttacagttgcctacagtattcactacagtagcatgccgtccaggtttgtagcctaggagcaataagctataccgtatagcgcaggcgtgtagtagggtgtaccatccaggcctgtgaaagtactctgtgatgttgcacagtgacaaagtcacctaacaatgcatttctcagagcatatccctgtcattaaatgatgcatgactattgtgatgggcaaggtgaaagatgatgggggtttccaagtcctgttcagcaaacatttactgagtaacttttaagtatacatgggcccttgaatgacagtcttagtctgggggttggaattcaaacactctaaactataaataaatgataaaaccattccagagcatacaccaacataatgtggacttccaggaattttttttttatcaaccccgttcatgatattacctggaagcagagtcctcaaattgaagcctaggtctgccccacctatcttggtcaccttggagaacttgctcatcatcttggaacgacttgcctttaaagatgtatgtgcctaactgatctccaaggtctcctgcaaatttataattcagttccctctagtgcaatgaattaaataattatccacttcagttcttgcccaacagaatttctgtgtaggcttggtggtcatttgcagaggggctcattgtatcaaccagtgtggaggaaaggagccaggtcctcggggggtccctcctggccccatttgcccatttgacagccagccctttggtcaaacaggactgtcagcatctgcagtaaataatttttttgttttttttttttttgagatggagtcttgctctgtcaccaggctggagtgcagtggcacagtctcagttcactgcaacctccacctcccaggttcaagcgattctcctgcctcaacctcccgagtagctgggactacagatgcgtgccaccatgcccagctaatttttgtatttttagtagagctggggtttcaccatgttagccaggatggtctcgatctcctcacctcaggtgatccgcctgcctcagcctcccaaagtgctgggattacagatgtgaaccactgcacccggcccgcagtaaataatttattcccttgcaacattaaaaaaaaatgtggcacagtgctttatgaatattatattcatttttatgtatttaattttaatttatttatttatttatttatttgagacggggtttctttctctttgttgcccaggctggactgcagtggtgcaatcgtagcttgtgctgggaccatatgagactgggactatcctggctgtcattcataaagtcttcactgaatttttaggacttcgctgactggtctctctttatgaacttctgtcacatttagggcctgcatcatataaaatgcactgctatgtgttgttctgttagtgtttgtcatcacgccatcaggggtacacacagcttcagggcaggaatcatcatcacagaccagtagccgagactacaggcacgcgccaccatgcctggctaatttttccatttttttgtagatacgaggtctcgctatgttgtccagactggtctggaactcctgggctccagcaatcatcctgccttggcctctcaaagtgctgggattacaggcatgcaccactgtgcctggcctgaatattatatccaaataagtgagataggcttcttttgaaatactgtcctttgtttttctttaggggatctgactttttccttctctgtgcttgccgtcattgtgttactggttaccggccagcctgttaaccctgtggatccccacactttgttttacgttgaatagcatttattattgttctttcttactaaacatcccctttctgaagcagagcttcagaaatgatgctcagatgtcactcttgttagcagctggctttctgccttcaagtgatgcattattggggtttcataacagcatttttttttctcttacaaatattaaattatgaagtgcaggaaaccacatgaatgtggtagaaagcaaatgcaaacacagtgttatctggaagtgctagttttgtgattctcctggtgacagtatccttcctgtaatcaacataggaaccctctttacctgtttgctggtggttttctatcctgtatcttcctctccatttatgctgtatgccatggccactttgtcatgctgaatcgggaggtttgattaagacagttgcttggggactatctctatcaaagttctgcctcaccacaaatcctggctgtcacttacaaagtcttccctgaatcctcaggacttcactgactggtctctctctctctctctttttttttttttttttttttttttaaggcagagtcttgggtctgttgctaggctggagtgcagtggcaatcttggctcactgcaaccttcgcctcccaggttcaagcaattctcttgcctcagcctcctgagtagctgggattacaggcatgcgccaccgtgcccagctaatttttctatttttagtagaaatggggtttcaccatgttggccaggatggtcttgatctcttgatctcatgatccatctgccttggccttccaaagtgctgagattacaggtgtaagccactgcgcccggccctgagcagtctctctttatgaacttctatcacatttagggcctgcttcttacagaatgtactgctgtgcattactctgtgagtgtttgccatcagcacaattgcacatgggttgcacatggcttcaaggcaggaatcaaatcacagaccagtgtttcccaagggtggtctaatcccagtacctcctgcttccgaatctcttggatatgtttattaaagttgcagattcagcaacaccaggcttatgaatcagaagttctggggatgtagaacccaggaaactcaccttagttaacttttgcacactgaggtttgagaataactatctgaaaataattgtgcatcctcctctttgcctcctctcccacagcaaagggtccaggtctgagcctatggtaggtgtccaggaaatatttgcttgttgacctaagcaacatcaagccatgagggttgcattccctcttcagttgccaagctttttcaggatgtgaggtcagcatattctctgaacctttagaaacccactttcttccaaatacgtaaagtgttcccctagggcagaggctcttttggaaatctttttttgtctctttatcttttgtaatcactaactctgttggtggtaatgacaggagcccctgactaagattgggatagtggggacatcagctatgaggagctgggctggagcagcaggctaggagaaagatctgaggataggaaccggactgtgctaaactagaagctttatccttggctcccaaagccacacctgctacccttggcagtttattctgagtggtatttctttcagctgttaggcctcgcaggttgtcagttttggtggcagaagagcggtcccgctgctgaaaaggatcaagtttagctctagtggacgcacatcaaagcacctacagtgcacagtggtggattcaggatttgaatccaatgttagcagactgcagtggtgacacttggccctctccttccgtccgcctcttgttccagcaagggcatgcctggtcttggatgatccaggagagatttgcagggcgttgctgcttctggtgcacctcctgaatgcccttgctggtggctccagccctggtagatggaatccaaacagaagaactcacagaagcttagctagcctagaaaggaaccagcgtggccatcaggacatttattagctgttaatctaaccactaccaaatgcattaacacattttttttgacaactttttctcttttatttggctgttgcttagttcagttttgcttggagaagttgtggcaatcctgaattcagtttgtgtgaaaaagcaagcaccttcaagcccagtgttggagaagtatcttctcccaggtctctattcagttttgactaaaggaggtttggcgagcagaaaggtattaccgagtggattcttctcaaattctcatctaagtgaaggaaaaaagcccagtttgctgaagccatgttaagggcacattaggcttttaatatgtgcttcatggagaccttactagattttcctctgcgtagttctttccatctgatgggagcgagggctgtttttgggttgcagaaggcaagagccaggttgtcagctacagaagagaaaggtgccattgtctgcataattgactttgagcctttgtctaaaaggatgtcaggtggaggagtaatgaggggcgagatttttaaaaaattatagagtacaggattttagcaaaatgccagatgttggcatttctgttttggaggtctttagtggtccatgtaaactatttccttgcaagtaaccatccatggtaggaaaacagaaaaaaatgattctaaaagagcatttgtctagttagaaactgtgtcacttgtatcgtttaccgtgaggcatccttgagaggtacatgatttccaaacagccacctaaatcataggtactgcttttggaacagatgtaaataggaaaagcgccagtccagtacccccactaaagaccatcgttagaaagctctcgcagtgctttccagcttagaggagtgtagttcccttcaggtacttaagccagtgttcggtaaagcagcacccaaaatgccttttgttaaatgtgttctaactcgttcctcttgctgatgctatcacaggctaatgattgtctaagtccttcagagaagctgtgtggttttgtatagctgtgagtaaaaccacacccattcaggaaatgcaatgtactttcttctaacaggcatcatcaaaacagatgctgatttacatggtaggtccccttctttagtgacaatttgagagctttgaagggaggcatttgccgtgcatcagaagaaatcagaattaaactggcacacgtgcacattgttggagtaaaaaggaaaagcagtgacctagagtttgttaccgcacatgctttccctgaaggcatctgcaccatcatgatgtcctcatcaactctgcacacacaactagtatttctgtctctttctcttcagagtttaagctcaatgatttccaacttcctcccacatgactccagctggatatcacataggtgtcttcaatttgaatctaaacctgactttgtcattgtcctacgtttatgggctccagggtcactagctcaccatttgttgatgctggacacctcctcttcctctgcttcatccctagctcatatgctggagttctgccttttttttttttttgagacagagtctctctctgtcacccacgctggagtgcagtggcaccatctcagcttactgcaacctctgcttcccaggttcaagggattctcctgcctcagcctcctgagtagcttggattacaggtgcgcaccaccacacctggctaattttttgtatttttggtagagatggggtttcaccatgttggtcaggttggtctcaaactcctgacctcatgatccgcctgcctaagcctcccaaagtgttgggattacaggcgtgagccactgcccccagtctgagtttggcctctttaatatgatagtttacccactcttctccactctcgggcccctgttctgttgcagaccttcagcatcacttgcctggactgctgcagtggcttccaagaagccccttgcttaaagtcttttctttctgtgttccatttattctactcttttgagaattctcatatgaaagaaagggtctgattgaattactcctacacttgaaaatccttggtagtatgtggaaatatggaaaagtactcataatctaatgtgttaaaagaaaaactttagacaaattaaatttaacagagtttaattcagcaaagaactatttgcaaatcaggcagctcctctctactcctttcctcccgaactagaatagattcagggcatttctgacatgctgttgtgtggttggagaggatttatagacagaaaaaggaaaacgacggacagaaaacagaagtgaggtacagaaacagccagattggtttcagctcagcgttcgccttatttgaacagggtttgaacgataggctgcctgtgattcgccgaaacccagagattggtacaagaataggttacagcctgtttacacatccaggtaggttacggttcactgcatgcggagaaacctttaggccaaacttaaaatatggaagaaggcagctttcggctaaacccaacaaatgttaagtataaaattcatatttcaaaattgtgcaaacacattgattacaaagcagtgacaaaaatctatgcctatccacaaaggctagaagtaaagaaaacaagaatgaaggtatttttaatattagggcaattcatgtgtgtgtgtgttttttaatactcctttggtagcaaatgaatatggtgaagtaaaatgaataattgaaaggattttgttagctttctgctcctgataaggtaaaatgtgaatttcactgcatggcctctaaggcccctaggaattccttatcaacttaccatttaaatctcatctcccgtgactcccatcccttccatctctccatataatatttgttttcttcttaaacatactatgtatataataaccatgcacctgtccctgttgtttcttctcgcatgagactcttgttctctgcctggtaaactcccactcattcgttgaggcctaattgaaattcctggccaagcatggtgtctcacatctgtaatgtcagcattttgagaggctgagggaagaggatttcttgagcccagaaagtttagactgcaccattccactccagcctgggcaacagatagagagctcgtctcaaggaaaaaaaaaaacaaaacagaaattatcctcttgctgtgttaccgctattatattgcaattttctgctcatatagctatcttggtaaatgattcatgaagacagaaattgacttatcttaaaccttgtattccaagtgttaagcccattcctgcatataatacagtttaataaatatttacaaaggtaagaagaaaggaaagagcccatttagaaatacagaaataatccttcaggtaagatattaaaaatgtttttggataagcttagtactaattactatttcataaaaattacaaaaatagatgtttttggttaaacagtttttacagtaatagttggattcagcctcacatcatttaaactaaactactggcgtatatctttggcattagaaaattctaacatcagatagaattgcttcagcttcactgtaagccatatttatgaagttactaaaaaccatttttttaaactgttttatgtcatgcataaccatgtcggccaaatcagaaatccaaataaatgacacatccagttctggccacattttgtgaatatctggtatttttttcttaagggaatttaaaaagactgggtaacattaaagggttgatgtaacattttcaattctgaaaggctactctgctctaggaatatacttgttactattttttttttcatttctaagaattctgtttggctaaaataccaaaagagaaaaaaataacttggcttaaataaaatgaaaagtcatctccaaaattaattcggctcctcaaaagttctttccaaaggaaggaataggatgctatttaatattacatgtcaaaaacaccactaaaaagaaaatcatcatttgtacgtgtgacaaggaattcagaatggaattttatgaaggctagtgtgtgaggcacgctgctcacatcttttaaaataatattttgatatcggggaagattatttaatactatatattattttatattatatatgtatgcatatgtgtatatacatatataaaatagagttttttcctattaatgctttagagtcaataagttgtaatggggaatttcagtttgagatttgtcattttttttgcatgatagccttgcccagccttcagttttcttgtttataaagtcatgccaaaaggtgaactgtcactggattaactaattaagaaattagtcagtcactaacatttattgattgaccactgattggaaacattaaatacccacatcattttttagcatttcatgtaagttgatccttgtctgttttgcagagtaaagaaccttagctgaatttcatttttgtctgtcctgatctttgcattcatttaaaaacctgacccttcagctgtttacaagatccatcatgaaatataccatggctaaggtgaatgtgcagactcccagtttccctttagctattctgttgcactagccatggggttgcaaacttttttggtgactgttacagttcattcatcaggaggtactgactatattttgttgcactttcatgagagccagggctcagaagcatcctaagtacctagtgacaaaaactcaggaaggcaattagactatgacgcttttcattacaacctaaggtgcctctcaatatagtaggtgcttatgttgaactgccctctgcagactgtatgtgtgggtccatgtggtgatattgtggctgtaccctctccaaggttgcctagtgttggctgtagcaggaaaggaagtgtctgtaagcaatagtagcttcaatgaggaaggatataaaagagaagtgaactagtcctgaaatcttaaggatctacatacagaccagagtaccttgatggatcccaaagttttattttattttattttgtttttgagatggagtttcgttcttgttgcccaggctggagtgcaatagcgcaatttcggctcactgcagcctccgcctcctgggttcaagagatcttctgcctcagcctcccaagtagctgggattacaggcacctgccactacacccagataatttttgtatttttagtagagagggggtctcaccgtattggccaggatggcctcaaactcctgacctcagatgatccacccgtctcagcctcccaaagtgctgggattacaggcgtgagccactgcgcccggccttattttatttttccagcattattgagttatgattgacaaaatttgtgtacaacacgatgctttgatatacatatatattgtgaaatgtttattatcatcaagttagttaacactttcatcacctcacatagttattttttcttgcatggtgagaacatttaagatttactgtctcagcaaatttcaagtgtacaaatatcattattaaccatagtcactgtgctgtatattcaatccccagatctcaaagatttaaaatctagccctgagacaactgattacagccaccatatgttttcttaggtagttcacaataaatagttataatgctgctgagaaacagtatgatgtgttgaaaagtgtaggttcttgaggcaaacttcctgggtttgaataccgaacttccacttaatggctgtgtaatgttgagcaagtgacttaatctctttgggtctcagtttatcaatccatgaaataagaaaaataaaacaggccaggcacggtggctcacgcctgtaatcccagcactttgggaggccatggtgggtggatcacaaggtcaggggttaagaccaccctggccaatatggtgaaaccccatctctactaaaaatataaaaattagccgggcgtggtggcaggtgcctgtagtcccagctacttgggcgtctgagacaggagaattgcttgaacctgggaggtggaggttgcagtgagccgagatggtgccactgcattccagcctgggtgacagagcgagacttcttctcaaaaaaaacaaaacaaacaaacaaacaaacaaaaaaacctaaatgagtcttgatgcacgtaaagctttcaaaaaatggtagctgttattatcataccactttcatggaatttcgttagttactcagtttgtggtaaaatttttccagtgtttattcttcatgccttcctacaaacttggtttaggaatttacactgttaggggaaacatgtaggtgaacccagctagggaaggcgaagcaatgctgtgggaacacaaaggagtgggatatttagtctgatttgggagtggtgaggacttggaggaagcatcagagctgacttggaagaatggctaggattccacctgacagagctgggagcaaggcattccacacgggagggcgtgtgcccaaaggtgtggagaagggagagtgcagagcagagcatatttgaggaaagctgtggaccagtttgagcccagggttaaggtgtgtgaggtggaacagtgggagactgggaggaagatagtctgatttaatgataatgatgataacggtgagtgtgaactattcactgagtggtgccatatatcagattctgtggttggggctttacataaattagctctgattacaactcccttcaacatagctatccacattttacagatgagaaaatgggattaattccattttttcttaagtggcggagagccactgaaggttgttgaataggagagggtcatgatcactcttagcaggaatttacttatctgctttttcacttccctggagtggtagacacgtcttttgttttgtttaagagacagagtcttgctctgtcacccaggctgagtacagtggtatcatcatagctcactgcatccttgacctcctgagcccaggtgatcctcccaccccaacttcccagagctctggaattagaggcatgtgccaccacacctggctcatttttaattttttttttgtagagatggattcttgctatgttacccaggctgttctggagccctgtgttccagcaattctcctgctttggcctctcagagtgctgggattatgggcatgtgccaccacacatagccttggagatacatcttgcaccatcctgggctccccagaggagtggtattagactgtcagtatggtgaatactccataaatactggtggagtctgttttcaaagcttccttaacaaaactctggaaacatgttttgtacaatttcctttttaaagaagaaataaactggttaagttactgagcaactcctttttgcctgtgcatgtttcatctcatttgatccccataggaaatcttaaaggtagagagtgtaatttttgcatttcaattatatgttattaatattataatggatgaggtcactgggactgaagaaagtaatgctgcttggagatggtaaagctgggattcaatctgtggctccctcacccttggtctgtagtcggccaccacccctccctctattgaacctctcttttattgctgttttccagtctccactaagtatttcttccactggtttaagtccacgttgctaagcaagtacacagttgcttttaaggaaacgaaagccccacaaggacccagtctactttgcagaggttaaatggaaatagattattttcaataatctgtcctcaggaccagaattcttctaaatgatgctgctggcagctggccatctctgggagcccatcagacaaaccacttgtaggagcccagcatcctgcattgggtcagaatgcaaagtcaactaactcttcacagtagatgcagtttgggcgtgagtacctagcaggaaccctagatatttggggcaagcactttgcttcttccatctggtggaacccacgtttattatctaaaagacacatggcaacaggcaatgcagtgtttgcttccaaagacagcctggaatttggaatgacatttagtgaaaggggaaagttcaatttcagctatcaaaggtcatggccagtgaacctacaagcacatattatgtaaatttggcccaaatctgtatttattagcttgaacagttttggagtggttatctgctctacaaaaatgatctaccgttaagagtctcaaaaatatcaagtctgcttgatgcatttaaatcaggaagcgtaaatatttggcatccatgctagtgctgattttcagaggctttgctcacctgcagctgtgctcactttgcgaaaatggacatggtgacctctactttcctggtgagtggccacgtcagtatcatcccttcccgttcctggcaccactctcacccactttggagagccagcatagagcagcacgctgtgtctcagggaccaggctatccatcagataccctactctgaaagtgtccttaatttgatttttaaaatatatataaatatatagtgtgtgtgtatacacacacacacacacacacacaccataaaatttaccataaatttaccattttaacctttttttttttttttttgaaacggagtcttgctctgtcgccaggctggagtgcagtggcatgatctcagctcactgcagcctccgcctcctgggttcaagcaattctcctgcctcggcctcccgagtagctgggactacaggcgcatgccgccacgcccagggaatttttgtatttttagtagagatggggtttcaccatgttggccaggatggtctcgatctcttgacctcgtgatctgcccgcctcagcctcccaaagtgctggggcgtgagccaccacacctggcccagtttaaccatttttaagtgtacaattcagtggcattatgtacatttccagtgtagtgcaatcatctccactatccatttccagaactttttcatcatcccgaacagaagctctgcattcattagacaataacactccattctctcctcccagcccctggtaacctctattgtacactgtgtctctatgaagtttcttattttagggaccacatggaatcatacaatatttgtccttttatgtctggcccataatttaatttttaataacagtgtttcaaatatactgttcttttccaaagtatttgttatcaatactttattatgtcagtaattatcaataagttctcattctaatttcagaaactgggttgtattggaatatgggcatagagaagatacagatttttttttcttcttaataactgaagagaataacatttatcaaacaaacgatcgaactctttctgagacatagtttcatgtgcctctttggagttgatttcccctcactttattttaactcctatttggcccgaattcttctcagaatttctgcaagcaggctcatagtcctgcgttcttctcttctctttttttttttttttttttttggcagggtctcactcttgtctcccaggctggagtgcagtggtgcaatctcagctcactgcagcctcgacctccgggcctcaagtgatcttcctgcctcagcctcccaagtagctgagattacatgtgtgcacgacaacacctggctaatttttgtattttttgtagagacgaggtttcatcatgttgcccaggcttgtcttaaactcctgggctcaagcagtctacccgtcttggcctctcaaagtgctggaattacaggcgtgagccaccgcagctggccaggcttacatttctgtagtgcctgttaggaagagttcagaattttttagacacaggcatagctcagagatattgtgtcttttttttttttttttgagttgggagtcttgctttgttgccaggctggagtgcagtggcacgatctctgctcactgcaagctccgcctcctgggttcaagcctcccaagtagctgggactataggtgcctgccaccatgcccagctaatttttgtatttttagtagagatggggtttcaccatattggtgaggctggtctcgaactcctgaccccaggtgatccacccacctcagcctcccaaagtgctgggattacaggcatgagccactgtgcctggacactcagagatattttgggttcacttatagaccacagcagtaaagcaagtattgcaatacagcaaatcacacaaattttttggttttccagtgcatataagttatgtttacaccatactatagtctattaattatccaataacattttgtctaaacaaaagtacataccttaattttaaaatgctttattgctaaaaactgttaacgatcatcttcattgaaccataatcgttttgttggtaaagggtctttacgttgatggctgctgactgatttagggaggtggttgctgaaagctggggtggcggtggcaatttcttaaaattagacaacaatgacgtttgccacatttattgactcttcctttcatgaaagatttctctgtagtatgcaccattgtttgagagcattttacccatagtagaactttcaaagttagagtcagtcctctcaaacctgtcactgcatcaattaagtttatgtaatatttcaaatcctttgttgtcattttaacagtgttcacagtatcttcatcaggagtagattacatctcatgaaaccactggtttttttgtttgtttgtttgtttgttttgagacggagtctcgttctgtcacccaggctggagtgcagtggcgcgatctcggctcactgcaacctccacctcccaggttcaaacaattctcctgcctcagcctcctgagtagctgggactacaggtgcgcaccaccacgctgggctaattttttgtatttttagtagagatgggtttcacaatgttagctgtgttagccaggatggcctctatctccggaccttgtgattcccctgcctcggcctcccaaagtgctgagattacaagcgtgagccactgtgcccggccatgaaaccactttctttgctcctccatagaggcaactcctcatctgctgaagtttgatcatgagattgcagcaatcaattcagtcacattttcaggctccatttctaattctggttctcttgctgtttccacctcatctgcagttccttcctccaccgaagtcttgaaaccctcaagtcatccatgggggttggaatcaacttcttccaaactgatgttcatgttgatattttgacctcttcccatgaatcaaatgttcttaatgacatctacaatggtgaatcctttccaggaggttttcaatttacttttcccagatccatcagaggaattactttctgtggcaatgatagccttacagaatgtatttcttaaataagaagacttgaaaataaaaattactccttgatccatgggttgcagaatgggtgttgtgttagcaggcgtgaaaacgacatgaatctccttgtatatttccatcagagctcttagatgagtgacgaagtgcattgtcaataagcagtaatattttgaaaggaatctttttctgagcaattaagtctcaacagtgggcttaaagtatttagtaacccaatgtgctttcatccaggctttgttgttccatttctatagcactggcagagtagattcagcataattattagggctctaggatttttggaatggtaaatgagcattggcttcaactaaagtcactagctgcatttgcccgtaacaagagagtcagcctctcctttgaagctttgtagtcaagcattgacttctcctctctagctatgaaagtcttaaatggcattttcttccaatagaaggctgctttgcctacgttgaaaaatctgtagtcaccttcatcaatgatcttagttaaattttctggataacctgctgcagcttctacatcagcatttggagaagatttctttccttaaatctcacgaaccaacttctgctagcttcaaacttttcttctccaagttcctcacctctctcagccttcatagaagtgaagagagttagggccttgatctggattaggctttggcttaagggaatgtatggctggtttgcttttctattcagaccactctaactttgtccatatcagcaacaaggctgtttcactttcttaccattgatgagttcactggagtagcacttttaattttcttcaagaacttttccttagcattcacagcttggctaacccttcagtcacaagaagcctggcttttgacatatgtcagctttcaacatgccttcctcgctaagcttaatcatttctagttttcttatttaaattgagaggtatgtgactcactcttcctttcacttgaatgcttagcggctattttagggttattaattggcctaatttcaatattcttttttttttttcttttttgagacagagtctcgctctgtcacccaggcttgagtgcagtggcacgatctctgcttactgcaagctccgcctcccgggttcacgccattctcctgcctcagcctcccgaatagctgagactacaggcacccgccactacgtccggctaactttttgtatttttagtagagattgagtttcaccatgttagccaggatggtcttgatctcctgaactcgtgatctgcccaccttggcctcccaaagtgctgggattacaggcgtgagcccccgtgcctggccaacttcaatattcttgtgtctgaggaaacaaggaggcccgagaggagggagagagaacagccagtctttgtagcagtcagaacacacatgacatttactgattaagttcattaccttatatggggtgtgtggttcatggtgaacaaaacaattataatagtaacgtcaaagagcactgatctcagatcaccataacagatataacagcgcaaaagtttgaaatactgtattaccgaaatgtggcagaggctcaacatgagcacatgctgttggagaggtgatgctggtggagttgcttgacacggggttgccacagaacttcaatttgaaaaaaaaatgcagtatctgcaaaggacaacaaagtgaaatgcaataaaatgagatgcgcctgttgcatctttcaactgatgtgtcctttcttttcattaaaaaaaaataacgttctgtccatctgcctctgtccaacaacaggcagtcacatgtgatgcctactgttggagaattggtgaatcataggcctccacttctggtgctattactcagagaagaagtatttctttctgcatagaaggaaacattgtaattttactgcagcaatgaaattgtagtagaggtgaacataattcttctatttacatctttaatgagccacaattaaaagtagtgagttggcatgtcagagtgaatgtgttattttcagatttctgttagaacaatggctgctgctggttgaagctgcacttccctggccccttggagctccaaaagccttaagaaagaaacccaggggccgggcgcaatggctcaggcctgtaatcccagcaccttgggaagctgaggcaggcgaatcacctgaggttgggagttcaagaaccagcctgaccaacatggagaaaccccatctctactaaaaatacaaaattagccgggtgtggtggggcatgcctgtaatcccagctacttaggcggctgaggcaggagaatcgcttgaacctaggaggtggaggttgcggtgagcctgtgtctggagttggttccttccgataggtttgtggtcttgctgacttcaagaatggagccacggaccttcacagtgagtgttacagctcttaaagatggtagggacccaaagagcgagcagtagcaagatttattgtgaggagcgaaagaacaaaccttccacagcgtggaaggggacccgagcgggttgtctctgctggctggcgtggccagcttttattcccttatttgtccctgcccatgtcctgctgattggtccattctacagagcactgattggtccattttacagagtgctgattggtccattttacaaacctcaagctagctacagagcgctgattggtgtgtttttacagagcactcattggtgcattttacaatccccttgtaagacagaaaagttctccaagtccccactcgacccaagaagtccagctggcttcacctctcaataccacttctgcatttaattatagccaccgactagctgcactatgatattaatctgggctacttgcttaggaacctgcagatgggtttccataagctagacattgctgcctgataaatgactgtgggatacaggttttcctgatgaggtagtaaagccacatattggaattcatttaacagctcgacaacataatttgtaaacatttctatttagtcacgtgtactcagcaaaaatgtatactaaagtgtttaccatatacttggcattgaagggaattataatgaaatatgttgatcttggtcatttataggtgttcccaccactgtgatgtgtgcatgcattgtgggccaggaggttttatctggaagctagtgacacttcagcgtcaaggcgtctcgctcctgcaggccctttgtaagaccctgtacctaattttatgttgataattttgtgcagtttttttttttttttttttttttgaggcagcgtctagctctgtcatccaggctggattgcagtgttgtgatcttggctcactgcagcctcaacctcccaggctcaagtgatcctcccacctgagccttctgagtagctgtgagcagatacatatgccaccatgctcagctaatttttgtatttttttgtagagatgggggtctcactatgttgcccagttttgtcttgaactcctgggctcaagcgatcctccacttcagcctcccaaagttctgggattacaggcgtgagtgaccatggctggcctttgagatcttttcttaaagaccctaacaccccatacacactcctctaccccttgactagttttataaactgcagacctcacagactggatccacccctgattatgaatatgtttaaactgtgcatatgtatgcattaattaaaacatatttatttctctttcatactagtatgtgaaattccaaaaaatctgctagcccacaaattaggaaaattaaagggctatgcctacctctgccagctgtttccaaggaaatttatatcttggacatttggcagataataatatcatgtttgactgatagtgatcatgtcctaaatttcccaaactgatgagtcacaatcgtgattcacatatttctgggaatcgccccccaacaacttgcgatttgcctggcgtagctgtagtatatcagagttttttaggtgtttagcagaactgaactatatagcttcttgtcccatgccaattcaagaaaattaatttaatagctattttatgaaacattttttcctaactcgacatggatattttaaggtgattttccctgctaagaattcacttgttataggtgactctaattggagaaacagctgttgacttctagtgtgctcaattagtttctttcttcctttttctttttttattttattttatttattttttattatactttaagttctagggtacatgtgcacaatgtgcaggtttgttacatatgtatacatgtatcatgttggtgtgctgcacccattaactcatcatttacattaggtatatctcctaaagctttccctcccccctccccccactccatgacaggccccggtgtgcgatgttccccttcctgtgaccaagtgttctcattgttcaattcccacctatgagtgagaacatgcggtgtttggttttttgtccttgcgataatttgctgagaatgatggtttccagcttcatccatgtcccaacaaaggacatgaactcatccttttttatggctacatagtattccatggtgtatatgtgccacattttcttaatccagtctatcattgatggacatttgggttggttccaagtctttgctattgtgaatagtgccgcaataaacatacgtgcgcatgtgcctttatagcagcatgatttataatcctttgggtatatccccagtaatgggatggctgggtcaaatggtatttctagttctagatccttgaggaatcgccacactgtcttccacaatggttgaactagtttgcaggcccaccaacagtgtaaaagtgttcctatttctccactttcttcctttttcaaagagttcctttattattcccaggccgtcgttaggtgtaaaagctaatttagtttagattattttttaaagtgcacctggcattcaagctatgacatttcctgttgaaacagcactgctatgacctgggaagaaaagatcccaagaaaatataactgaggaatcaaatatttgtctgtataaaaggtttcatattaattcatgataccatttattagtcacttaccttttatgttagtagccataaggaggtgtgatggcatagactattcagggcgaatgacagttgtcatgggcagaaggtgcccatgcatcaggcagagcagggtgaccacaaagtggggagtggccaaatatactttgtcctactcaagacatgagggcctgtcccagtggcttgcttgagaacaaagctcatcctgatgactcagcagccacagtgaagggctgcctgggggctgggggagaaacaagtaggcagatgaggtccagttggaaactaaattgctttgggaggaggagagtggtcacacaatgtaggtttcagttccggctgcactgctaattttgtaaccttgggaaagttaccaacctctctggaatctcagtttcctcccctatgaagaagaaagcagtagcccagatcatccttggaggttccttcccttcagctgtgacattttgcatttgaaagagtaagagaagtcacaggaccatgggaaaggaaaacagaaatgatgtaagggaggcaggtcatggggagggtggtcaggaacacaggttggaagtgcccgtggtgtcaattcaggtgttcggtgatctccacgggcgagtgacttttattgggagaactgtgcactgcctgaggttagggttgtgctctggggaaaccggaaccttgaaaacaccttgtagggagccgcgtttcccttgcacggactgtgctgcctgtgcttccccagcacagtgggcgtcgtcgctttgtgtttgtgctggctgctgtgcggggttgcctgcctccccagcccacacctgctcagccttcctccactcatgttttcaggatgcttttggatgcttctggctacagtggattttccttctccttctgaagcccttttgaaattatttctctgcagattcagacatatttatttatctggtcaatgtcctgcctaaagaatcagataacgactgtgtttttgcctgaactcacacatatgaatgagcttttgtaagcggcagcagcagtgtaggtttagttggagctgtctgagcccttgtcaggttgctacttagttgtttagttagctctcgttgaacttctgtcacatcctcagtttctgggcagtgtgtaagaagagctccttctctctagaccagtggtccctaacctttttggcaccagggactggtttcatggaagacagtttttccacagactagggtggagcgggggatggttttgggatgattcaaatgcatttatattcattgtgcactttatttatattattatgttgtaatatataatgaaataattatgcaactcaccataatgtagaatcagtgagatccttgagcttgttttcctgcaacaaaacggtcccatctaggggtgatgggagacagtgacagatcatcaggcattagattctcataaagagggtgcaacctacatccctcacatgtgcagttcacaatagggttcacgctcctatgagaatctcatgccgttgctgacctgacaggaggcagagctcaggtggtaatttgaacaatggggagtggctgtaaatacagatgaagctttgctcattcgcctactgctcacctcctgttgtgcaggaggtctgtagcccaggggttgggaacccctgctctagagcttaataatcaactggtggagaccagtgcaattgtaaacaaaagtgacaaaacgatagtaataatgccaatggtaatgaaagctacagacattttcagagtgctgtgtctccaagtactgagctgagcactctgcactcatgaaatatgtatcctcctcacacacacacacgcaaaataaatgtttaatggaatattgatcaggaaaaaaacaaccagtaagcaaagtattaatacatgctacaacatagatgaacctcaaaacatcatgtgaattgagagaccacatacttcaatttcatttatatgaaaggtccagaatagacaaatccatagagacagaagttagtttgggggttgcagaggccggaggtgggagaggaatgcagagtgactgctaatgtacacagggtttcttttttggagaagaaaatctaaaattagattgtgatgttggttttacaaaacagtgactatactaaaaaacatttgagttatacacttgagttatatgtaaattaaatcttaataaagctgtttttttaaaaataaatgtttaattctcagaaacaaccctatgaggtagggagtattatcctcctacagatgagaaaaccgaggcccagaaaagaggagaacctgctcaagattacatataaggcatatgtaggattaactttttcattacagagaaatccatggtagtgcttgctaagtaaatgctaaatctattgattgcatggatgccagaactagatggggttagtttagatggattaagggaggaagtggtttaaactgtgttttctaagaagaaagagtagtgattgtataaagaagacaaaagggcatttcaagctggagataattgcttgtgagagttaaacatcaagaaaccagacatctaataggtttgttcaactggagtgaagaatagcctttcatatgacaggtaggtaatcagaagcaagtgaatttagagttatattgttagctgtagtgcgggcttgctgtaattagtagcaggccgacaccttgtaacatctctctggagtgtaaagacatatttctaacagaaatgtgttagtctgcaaagcaaataaggtgcaagcgtaaatgtcctttttccttggactgtctttaccgaatgacatgagcttcacacccttgccttgagctgtcactatcattgcttcactttctattaattagctcggagccttggttctatagtcaacttgaaactgctctggacatatttgctctaatcctcctggacaacctgtgagatgtgccttttcctacacttctgccttgccctggcagccacatgacacactctcgcaaggcaggaacctcagggaggggaggtggcggtgtctgttggcaagtactcagctccctttgaggctgcagatagtaggcattggttaagagtttaaacttgggcaagaactggaagcaaattgggaggacctggaattgtgggtgcttggggaaaaacattacaatgaggactcatatgggtcgtgtggtcatgtttgtttcaagggctttcccttccaaaactggaaaagaaaactgataaaacaaacattgggtggcatttttttctaggcttgtcaatgggtgacttgtttgccgaattaattaaataattaattaattaccttgtttataatcttccttgttttgaaaagatttatggcagtgccttaaatctgtaaatctacccaacaagagaatcttatgaagtaaacaagttaacaggtgaaacatgcctccttttaaatgtttctttataacaaaatgaccatatatcaataacagactgtaacaatgcgtagcaaatgtatttatgtttctcatctattttccactttcaaaaatgtgcttttcccttaaactccaaattgtcttaacaatttcacattttcatttctttcttttcttttttttttttttgaggcggagttttgctcttgttgcccaggctagagagcaatgacgtgatcttggctcactgcaacctccacctcccaggttcaagcgattctcctgtctcagcctcccaagtagctgggattacaggcgcatgccaccacacccggctaatttttttgtgttattagtagcgacgaggtctcgaactccagacctcaggtgatccattcacctctgcctcctaaagtgctgggactacagatgtgagcctggcccaatttcacattttctaggttctgtagaggttcatgtttgtggcatggtaattcttgttttttgcattttttttttcttaacccccctcctggcttttggagcactataaacttagcactggtggggccacatcttgacagcgagacccttacagcccccaaccccgcatcccagtggggcttcatgatctggccctgctgtgctggtggcatggccccctcggggcttaagtgattctgggtcattgacaagaatcttgcctgtgtgaattcaaatcaaaactttggagagcaaagattcagtgttttccttctgcctaacaatctcatggaaagcacagtggtacctagcatttagctcatgtgttcatttagcaggctctaagtcatcttgtcacatgtcatcctcatgtcagctctgtgtggtgttgtcgacccacgagcaaacgttgcaaggtcccctttagggtgacaaggctgattcaggatgtgtctcactgccccaggaaggatgcctctaacatgcggaacatggtgccagtggctgaggggattagttggggaagaagagtgaatagggaaaggaggttgttacatgatccacccctcactggccagagaggaaaaggaaggcatctcattaagagcattagctgtagcctctcatttaaacctcctcactaccccatgaagtaagcattattgcttttgttttacaggtggtgtgagacaaaagtgaaggaatgagactaattaataataagaatccatgccccaccatagctacgatgcagtggagcatggattctaaaccagctctaacatcacatgccctattttcgagcactagtggcttatttctgagctcttctcttcctctttcctgttgatgcttgagttttagttatatcatggcaaattgaaaaattcttcaaaaaacatacagaggaaataaagtggtgggatctgaaacaaaactcttattgattagccattctaatgaagatttgtggctgagatgggagttttgcaatcaccttgggatttcagaaccctgcttttaataattagaactaaagaagggagagtcctatagaagtgtgggtcataaaaccaaggatgtgaatgaggagtggcaagacaggtatcctggagactttatttcagtgagacttctggggcagagttgggactgatgggggacaagtcagctttggaatgatacagaatttttggctgtgacacctgtgtgattttagtgctttgcaccatatcaagagctgagcagagtgtggcaccaatattcaagggactcaaggggcaaatataggtgtcagtgagtgaaagcagatagcgagatttgcaatgcagtgtccaggagtgtccatctttctagacccatttctacttataagatcactgcataccctgtgaaacattatattcatgaagccacagagtttgagccactgtgtttacgctgcaagtggaaggagagtgggcatggagtcagaaagactcaagttcaaatccagcctccataatttatcgtctttaagaccctgggaaagttgacctaagcctctgttttctcagctttaaaacatgaataataatcctgcctcacaggactgctgcacatacggcagtcagcgcagtgccaggcacacacgagtgtcttattagttattattattatcaacaaagagcataggtgatccttcttatcatgattataaaaactgtggcttaccaatgaaagggtccttcataagccaacaaagagacatccctgaaattttcactatagcagaaatgcaaattattactgggtacatttctggcagacacatgagccatttacataatgaaacctctctaatattatttctattaatagcaatacttctgagtatcaatctgaccattttgtatttagaatcattctctctgtgaacagattccttttattgccatgtcgtcttaatatcttctgacaagtatcattatctctttgctgcatattctaatgtttatgattgcatgagttttaaagtgttcatttactacctgagaacctccattttaataatgcattgctttaatgttggtgtttgggaggtaaggttgttgcttattttctcagatgccgattcacagttgagcagatgatgacttgcaggaggctctcttgacctgtcatgctctgatatcatcaatgcattggagtggtcacttctgttagcttttcctccatgaatcccctgttgatcagcccactaagtgactcagcatatgtctgtgcacacctttggaccacattatcatccactcacttaggcccttgaatttttttatgggtatgtgggctatattgctaagtgataaggctggttctgtaaatggacctcgcaacttcagcataacaacggtatggctagtgtcctcctctaggagggactccccttgagggcagatacaggtttttcctgtttgcctcaagagagtcatacaatgcagaagtgcccaagtgaatgttgggtgaatcagtgagtgtaagagggcacccaagggaatgcccacagttggaaggaagttgcctgagaggaggagtcctcagacccattctagctttgtgattctgcccgtacagacatgatttatatgacaggaaaaacatggcaggcccttgggaagcattttcatcttaacctttataatatctaataaatgggcaagatgttaaaaaaaattgccctttccagaagaaggttatacagactctaagaaggcaacattaagaaatttttgaatttttttttttttgagatggagttttgcttttgttgcccaggctggagtgcagtggtgtgatctcggctcactgcaacctctgcctcctgggttcaagcgattctcctgcctcagcctcccaagtagctgggattacaggcgcacaccaccacgtccagctagttttttgtatttttagtagagacagggtttcatcatgttggccaggatggtctcgaactcctgacctcaggggatccacccacttcagcctcccaaagtgcagggattacaggcatgagccaccttgcctggccgaaatatatatatttttaaaaaggttattttcatcccagcactttgaaaggccaaggtgggcagatcacaaagtcaggagttagagaccagccttgcaaacatggtgaaaccccatctctactaaaaaatacaaaaacaattagctgggctggtggcgagtgcctgtaatcccagctacgcgggaggctgaggcaggagaattgcttgaacctgggaggcgaaggttgcagtgagccgagattgcaccactatgctccagcctgggtgacagagcatgactctgcctcagggggaggcggggagaaggttactttcaaccccatgaaaaagtgagcaaaggacatgaacagacacttttcaaaagaagacatatggccaataagaatatgaaaagcagctcaatatcgctggtcattagagcaacgcaaatcaaaagcacaatgagatactatctcataccagtcagaatggctgttgttaaaaagtcaaaaaataaccagttggatgctgatgaggttgcggagaaagggaacacttatacactgttggtgagtgtacaaattagttcagccattgtggaaggcagtgtggcaattctgcaaagagctaaaagcagaactaccattcgacccagcaatcccattactgggtatctacccagaggaatataaatcattctaccataaatttagacacatgcacgcaaatgttcattgcagcactattcacagtagcaaagacacagaatcaacctaaatgcccatcaatgacagattggacaaaaaaaatgtggtacatattaccatggaatactatgcagccataaaaaaggaatgagatcatgtcttttgcaggagtatggaaggagctggaggccattatccttagcaaactatcacaggaacaaaaaactaaatactgcatgttctcacttacaagtgggagctaaatgatgagaactcatggacacaaagaagggaacagcagacactgggtcctacttgagggtagagggtggaggaggaagaggagcagaaaaaacaattattgggtactaggcttagtatctgggtgacgaaaccatctgtacaacaaacccccatggcatgagtttatctatttaataaacctgcacatgtacccctgaacctaaaataaaagcttaagaaataggttattttaaagactatcctaatgcatttgtttgtgtgtgaaatatggttttgctaattagtattctttattgccagtaaaagtaactcactagagggagcttctaagaaacggggattttgatgagggcacgtggatatcccatggattttagggacgggcacggctgggccttggggaaacaaaacaaaacaaacaaataaaccaaaaatcaaaaccaaaaattcacattgaatttggagtttgggtcatattgtatgaacaggactgcttccacctgcattaataggcaaattccagaatactgggtgctgaatgaacagtccagtatggatctgtacggaggctgtaccaaggattggtgtctgtttatttttatttgtgctgctattgaagattttctaatcattagtgctaatattgcaggagaaaataattaatgaaggtgtctactgttctattgtagtaatttctgtttgcagggctcattaacatctttgatcagaatgagcagctcttttctggttggaatagatgaaaattatacaatgtatggagccattcttcaccttgtccttgtttcttcttcatgttgcttcgacttattgctcacaagttgacctcccccttagagctggggtggtccagcagggctgcgttgtgatgtgtattccttttgtgataggagacttgctgagagaggatcctgtttttttgtttgtttgtttgctttgagatggagtcttgctctgccacccaggctggagtgcagtggcatgatctcagctcactgcagcctctgcctcccaggttcaagcgattctcctgcctcagcctcccgagtagctagtatgacaggcgtgagccaccacacccggctaatgtttgtatttttagtagagatgggatttcaccatgttggccaggcaggtctcaaactcctgacctcgtgacccgcccacctcggcctcccaaagtgctgggattacaagtgtgagccaccgcgcctggccgaggaccctgtctttaatgggatgttgggtgatatgtatgaaatggttcaagaagcagatgggaagtgtttgggaggcctactgccagtggctcagtgtagccagggaaaaacagacacacctctgtgccatctctcacatcttagaaggtaacattgagtttgctgcatagaaccatacagttctaggtcacctgaaactcagagctcatgtgatctaaacttctatatttaaaggaggaaagagactcagagaagtaaaaatggcttgaccaagaagtcagactggaaccagaagtggacatatggactcctcattcctgttccagtaccgttgctgccagttcacattgtctttctaaaatagccatttatagggccacagctccatctcaaacaagggcttagtatctgtcagtttgcgaggtctaccataacaaagtaacccagactgagtggcttaaacagcacaaacttattttcttatgattctagagacagtaagtttgaaatgaaagtgtcaggaaagttggttccttctgaagtccttctccttggcttgcagatggccatcttccccctgtgtcctctcgtgggcttccctccaagtctgtgtcccagtctcctgttacaaggacaccagtcatagtggaatagggccctttcatatgaccttattttgttttaattacctctcaaaaggtccaatttccaaatacagttatattctgagaaactggaagttagggcttcaacacatgaattttgagtggttgtggggggaaaaaattcagccagtaacagtatccataagttaacttgattcattagttgattaagtatgattaaaccagctgggcgcagtggctcatgcctgtaatctcagtactttgggaggccgaggtgggtgggcacatcatctgaggtcaggagttcgtgaacagcctggccaacatggtgaaaccccgtctctactaaaaaaacaaaaattagctgggcatggtggtgcgtgcctgtaatcccagctgcttgggaggctgaggcaggagaatcacttgaacctgggaggcagagaggttgcagtgagctaagatcacatgcaccactgcactccagcctgggcaacagaggaagaccctgactcaaaaacaagaaataaagtaaataaataaatattattaaactagattatattggttaccaagtctttacatgaccattttaatagccttttcagatgttaactttgcaataatatgcagccagctaattgaaaattctagtgccataaatgtttttaattgcttactatgtgtcaggcgttgtactaggcactggggaaaactgtaaataaaagagacccagttccttcctttttttcaggttgcagtctatcaggaaaggcagacatttaaaaagggtcttgtgaggactgttatgaaacaggaagtacgagtgccatttctataccttagtacaatcactcgttttaattcacatcttccatggtggcaagtttgcctcagtgtcagccggtcaattgccactcaaggggatcagaacatttatgtatctggaatgcttggtacctagagttctgaagatcactattctcattccaaatatgttttttcattgccagaatgctcactcagtgactggattagttatgtgtactctgcatttttcgaagaggggaaagctgctatttttatcatctagtagcattctgatgactccttgataacatggttactatacggaaccccatctgtttctctgctgggaccacatcttagtcatatttttgtccctaatgtctggcatcgtgcctggcatttagtaggtcttcagtaaatatttgctgaataaatgtatgctgattgaaaaattgcctgctattatcagctctctgtgcatgataaatgccttgcctctccaaagcgattgtaagcttctgagcaggaacaccatggtcacacatggtctgtctaactcagcgccttgtaaataataggaatgccatccctaaatccctagccccctccaggatggcctgtcttccttgcatctgggactgttgaagattcttaatgatggaaaaatcatatacaggttattgcatagacatacattaaaaaatgtagttcgttcagtgtatccctagtgggcctatggccataaattaacttgctcccagggtaggtagtactctcttcttcacttctgctgtaatcacagctgccttcattatagaatcatagagaagtgaattaaggtgaactttgaaagaaggaagagatgcagctcacttgatcgatgtgggagtgggagtgggaagatttttctaggcataaggatggcatcaaagaggcttggctgtttttccattcccagtaatcgttgacagttttttatttaacatttaaaaaagtgtcctccgaaccttaggctgttcaaaaacaagtatttcatggtagagattacgtcaaatgataagcgatgcattctgcgatcagtggcagaaacaaaggttgaagctgcagtttgatgagaatttaaacatacagaagtcaaaaaattcaggagttgaagttaaactgcaagtgtgactcagtcccctcgggcatatggtagtagcattttctgaattgtggcatattcagttaaatttaagcccttgtttttgcagagtcgttgtgtcaaggttgcaatgtgagcagtaactttagactttcacaattttttatattctcacccacagtatgtgctgttatagcatttgtgcactgaaatttggtatagcttataaaaataaaaaaatggtgcaatgctcaatctatggtgcagaatgtatatgattatgaaggaataacccttctgtttgcttgaacccgacctaatactgaaacaaaacaccgccacttttgcttttaagtaaataaataaaccatacattgtggcaaaaggcatacactataaaattgaccgtcttcaccatcaagtgtacattcagtggtattaactgaattcacattgttgtacaactgtcaccaccatccatctccagaactcttttttttttttttttttcttgagacaaagtctcgctctcatcccccaggctggagtgtgatggtgtgatctcagttcactgcaacctctgcttcctgggttcaagtgatcctcctgccccagcctcccaagtagctgggattacaggaacctgccacgacgcctggctaatttctgtatttttagtagagacagggtttcaccatgttggccaggttggtctcaaactcctgacctcaggtgatctgcccacctcggcctcccaaagtgctgggattacaggtgcgagccaccacgcccaacccagaactctttttattttgcaaaattgaaattctacccattaaatagcaactcttcttttcccttctcccccaagcccttggcaactgcttttccatttctatgacaatgtctactctagatacctcatagagggtgaatcatacagtatttgtccttttatgactggcttatttcacttagctgctatattattaataccagctttctggggatataattcacaaactgcagaattgaatggtttttagtctattcacatcggatatgtttttgaagagacagtaaaaccaatccttttttccttagttctcagacacacacatgcttcttatctggcaagtcccgttataaaaatgccatgaactaaatgggaacagaagattgggggaaatatctagattattcttagtttggttcagattaattgagatagccagaatatttttgtaagcatgtttgctttaatttaaatgtcttcattttgcttcctggagccagcaatatgtgattacttattgttgttcttatggggtattgtttgcttgcgtagttgattgtgatgagttggctagaaatttaacagaatggaaatttcttcaagtctggatttgttcaaagaacagtttgaaattgaccaaagcgatagatggaactgacacttgacttatttgagatctggagttcccagtaatgaatattttggtccaagtttgaaaaatggcatttcatgtttatgtactgctgataggaatattcattggtacaaccatttagaaagacagttaggtattatccagttaacaaaaacaaatgtgtataccctgtgactcagcaattttccttctaggtgtttcctagagacttctgtactgtataccacgagacatggaggctctccagcacagctttatttgtgttaataatggtttaaaaaaataaacccaaactacttgaatgtttattaaagtgaaataaacaaattatgatatgatcaaatgacagaacacaatacaacaatgaaagtgaatgatctaaaactatataggagcaatatagatacatttcagtaacctgatatgaagccaaaaaagttacgttgcagaaaaattcaaaatatgaatgattatttttgtaaaatttcaaaagtatgcatcattaaacaagtaaagtggaatttcaccctgagacagttaaaaaaaaaaggctagaagcttagaaagacatggattagaactcgtttttctctgttctgagagtacatgtggaaatgaaagctaccagctatttctgccattttaaatgctcatatgaaatttctaagtaccctgcatagtaagtctttaaaatatcacatacacactactggcaggctaaaaaccaacagaaagatggctgggtaaaaagaaatcatgcatgcagaacactcttacttttaaaaatttacattcctgaaatagaatttttggagagaagcttttcttgaatgatgttagattgaaggatataactaaaaatagaactgcagtctttaataaatgaaaattagtcaagattctaattagtacttcctgtgttcgatactaattttgtcagttcatttctttacttaatgtgggctgtacctattcgcacatcccttgtactctttgcttgtttggttatcgttatgagaccaccaccaaccaccaccaccaccaccatggtcatcatcatcatcaccatctcctagagcacatggttttatgagccctgagctaagctccttaccgtttaatgcaaacatgttcctccctcagggtctttgcattactctaaaataacaccctcatcagtttttatccccttcaccggtttaatttttccttattgcacttacacatacttgtttgtctttctcatttcactaaaatttgagagtgatgttaagtctgtggaagcagagcccatgcttacatctgtcacttgtgtatttccagtgtttaaaactgggcctgtcacacctagaagctcactgatcataatcagtgatcatcaagtgaatgaatgcctgaattagcccaacaactctttgaggtagttattgctgttactattctacagatttttaaaaatggtggcactcagatagattaaactactcgcccacatttacccagcttgtgggtggtggaggctagaattcaaagccagtgtgcctgacaccaaagcctgttgtcttaactactccacttttctgcctatcatctgctgctagttctcagtgactttttatttatttatttttgcatagagcatcttttcttcttttcgggctatcaactcatcatttgtttaattctttgttttttgtttttgagatggaatctcgctctgtctcccaggctggagtgcagtggcacgatcttggctcactgcaacctccattgcctcccgggttcaagcctcagcctccctagtagctgggattacaggtgtgcaccaccacacccagctaatttttgtatttttagtagagacggcattctccatgttggccagggtggtcttgaactcctgacctcaggtgatccacctgccttggcctcccaaagtgttgggattacaggcatgagccgccgggcctggccttgtttaattctctgtatgcacctttttgataaatagttgtgtctccttttagggctatttctgttttgcatatacaaagactttactcatatttcaggttcagccaatttcagcctcttgcagctaacgcccttgccgtgtttagtgctattgtctgggctctgagactgaagcaggtctgtgagagcagccgacaaggtgtcaagaaggaaggatgcaataacccactgagctgcgttatctcctaaatgcatgtgtctttatgccattgctaatggcatctaatgaccttgggctccgaacaggtgctgccttgtaatctgcgctcatttgtctctttctacactgctagatttactgaaataacatgaacagggaaagcaaatgctttcatggatgccaggaatgctttatttatcttttaattttctttcatttgtttcgggatgtagaagcccactttggagttgaaataaaacaactaatgttcagagctgaggttgtcaccctttttagtaggacctcagatctagaaagggccccagagagttctcctttgcttatagaggagagtgtagtcctgtgggaccacatgtggtgctggccagcggagtaggtgggggtcctagaacttatgcagcctgactccctttctggggctccttctgaaacccagtggcatcctccttggcactttgcacacccagctgtaaatacacctgtgccatggagggctaaagccttttgggggggcatatatgggccaactgatgatcaacaacctctgttttcttagatcatctagcttctttatataacgtacctcttcgacttgggttgaccaaactcagatgatctccttaaagatgcatattaaagattgccccaatttcttaggatcctaggatatgagaatcttcatctctctctctctgtctgtgtgtgtatgtgtgtgtgagagagagagagacagagaaatttgtcctaaggaaacaaccagagatgttgaaaaaagatatatatgttcaagaagtccagcacagcatcactaaacgatagcacaatatctggagaattgaatgctagataaatagattatggttggaaattatagttatgttaaatattcacatattctgtgtgtgtgtgtgtgtgtgtgtgtgtgtgtgtgtgtgtttgagagacagagagagagagagagaatatgtatgtgaatatttaacattttgtgtttacagcctttgaagactactgcttttcctctagcatagaaataagatcaaggtttctcctactgtaaaagtttggttgaggggggttattgttttaaaatcaaaataatactaatatataatgagctcttattatggtccagatgctgtactaagtgctttacatacatgtaaaattcaattgccacagcagcccaacagcatagtgttattagccccatttgacagaacaggaagttgaggctcagagaggataagcaacttgcccaaggtggcagatcttaaagtgatagagctatgttttttttttttctttttttttttcccttagagacggagtctcattatgttgctcaggctggcctccaactcctgggctcaagcgatccttgcccctcagcctcctgtgtagctgggactatagtgcatgttgccacgcatggctatagagctatgatttgaatccaagcagtctgactccagggcatgccccagaaattgtttattgtttccctgatcacagaagggatgtatatattcatttagaaaaactggaaatacagaaaagaatgcagagcagatcacgcatacgataaatatgaacatttttagtgtctctagtcatatagattttttaactgggatcatgctgatttactgtttgtgagctagctgcctgatatttaccaggggtctgtatattgtaaacatgctgctgtgtgattttcaagcccacacagtgtgatcttagggcctatcgtaagttttacatcactcatagatactgtaatttccatccataatctatttatctagcatttaattttccagatattgtgctatcgtttagtgatgctgtgctggacttcttgaacatatatatcttttttcaacatctctggttgtttccttaggataaatttccagaactagagctggtggctcaaatagtaaggccctttataaggcttttgatatgtgttattaaattactcttcttgagcacttgccaaccatgacaaagaacgttcatgtgtctgcactctggacaacactaagtactgtaattaaaaaaaaaagaaacaaacaaaaactctgccaatttgataagttaaaaattatatcttgttttaatttgctttttttagtgtagtttcaagtgagggtggatattttccttatgtttctctgttttttacatttcttttttaaattggccattcgtgttcattgcttatttttgtcttagaaagtttttccttttactcacaattacatgtatttattttgtattaaggatattaactctttgtttaatggtattggaaatatttttcccactttgatattttcctttgaattttacttacgttgatttttatttacaaaatcaaaatatctgtgtagtcaagcatattaataattttcaaaaagtgttttgctttttttttttcccacagttgaatcctttttttttttttttttgagacggagtctcgctctgccacccaggctgcagtgcagtggcacgatcttggctcactgcaacctccgcctcccgggttcaagcgattctcctgcttcagcctccagactacaggtgtgtaccaccacgtccagctaatttcttgtatttttagtagagatggggtttcgccatgttggccaggctggtcacgaactcgtgacctcaggtgatccatctgcctcggcctcccaaagtgctgggattacaggcatgagccaccacaccctgcctgaattcttttgttttgtttgttttactttaagttctgggatacacgtgcagaacttgcaggtttgttacataggtatacatgtgccatagtggtttgctgtacctatcaacctgtcatctaggttttaagccctgcatgcattcggtatttgtcttaacactcttcctccccttgtccctccctccgacaggccccggtgtgtgatgttcccctctctgtgtccatgtgttctcaatgttaaactcccacttatgagtgagaacatgcggtgtttggttttctgttcctgggttagtttgctgagaatgatggtttccagcttcatccatgtccctgtaaaggacatgatctcattcttttttatggctgcaatttttttttaatttttttttttgcttttatacctagaaaagccttccattcactagggtcagataactatttacccacaatttattgtagttctttattatctcatagtttatatttatcgtttattttgatgtgcgatcttagacatgaggattcaatgaacttttgtcaaatattagatcagttgttctcacattatgtatttattagtcttttgccccactgagaggagacatcatctttattaagtactaataaaaactaaatgtttttagaaacatgagtatatttcttttttttttttttttgagacagagtttctctctattgcccaggcaggagtgcagcggcgtgatctcggctcactgcaagctccgcctcacgggttcaggccattctcctgcctcagcctcccgagtagctgggactgcaggcgcccgccaccacgcccggctaatttttgtgtgtgtttttagtagagacggggtttcactgtgttagccaggatggtctcgatctcctgacctcgtgatccgcatttctaagccttatattctgttatcttgatatttgttttttttctattttgcttttgattctatgagtttagaagattttaatataattagattctttcatatattttttttcagcatttattagctatttttagtctatttattctttcatgtgtacatagactaatttagtcagattttaaaacatcttttcaaaataaaatttaatttaatagattagatatcaattcagagagaatggaagtctttactgaactcttgtaatttttgatccatgcacaatgtttttcctttagttttttagtaatgcattttctgtttttatagaatctgagcagttcttgttttctttagagattttacagtgttggttataattgtgcacttaatctttattttccttatacagtagtccccccgatcaactgggggcatgttccatacccctggtggattcctgaaactgccagttagtaccaaaccctatatagattgtgttttttcctgtacgtacacaccatgataaaattcaatgtataaattagagattaacaacaataactaataatcaaataaaatacttatataaaaatatactataataaaagttatgtggatgtgatctctctcagtctccaaatatcttcttgtactgtactcgcctattttcagacagcaaattgaccaataaataaaaccatggaaagcaaaaccgtggctatggggagactactgtataagggaaattttcacctgattatcattgcgttttaggaaaactattagtatgtctatgtaagtgtgtgtggaggggtatatgtatatcttctagtaactgaccattatatataattattaatatataatatatataattttatattatacattatataatatattttatataaatatataaaatattttatatatagtatataatatattataaaatatattatatactatatataaaatatattatatatattttttgagacacagtctccttctgtcacccaggctggagtgcagtggcatgatctcagctccctgcagcctctgcctcccaggttcaagtgattcttctgtctcagcctcccaagtatctgggattacaggtgtgtaccaccacacctggctaatttttgtatttttagtagagacagggtttcaccatgttagccaggctggtctcaaacccctgacctcaggtgagccacccaccttggcctcccaaaatgctgggattacagatatgagccactgtgcctggtcaactgaccataatattgatctcagttctagagtctttcagctaattcccttagatattctaagtagacaataacatttccaataatgataattttgtctcctgtattttaatatttttaacttttatttcttctacagcatcctgatggtatgccaaataataatggaagagcagatacaaatacacttgactttattcctgaatttaatttttttttttcttgagacagagtcttgctctgtcacccaggctggagtgcagtggcgcacgatcttggctcattgcaacctctgcctcccaggctcaagtgattctccggccacagactcccaaatatctgggattacaggcatgcaacaccatgcctggctaatttttgtatttttagtagagacggagtttcaccatgttcaccaggctggtctcaaactcctgacctcaagtgatccacccgctcagcctcccaaagtgctggggttacaggcatgagccaccgcatgcagcctgaatttaatcattgactcttgtttttaacttttaatataatattggctactggtttgtggtaggtatcttttactgtggcaaatacatagtattctattctaattttcaaccctctttcccacagaatatttaagagaaaacctttttggccgctttgataatgataatttttgtctattgaatggtgatgctgtgattttcaggatgtatgtatcatggaaactggtagagaaagaaagaactgagatcatgctgaagtatactggggcccaccaagaggtagagctgagtgcaccaattgtcaccaaaatggcaacccgtaaaagagaaccattcttaagaaagagtcatgtaccatcaagcggggatttccagaagcctctgatagtaacagttctcccttccattcctttcctctctactttcaagatgcgatgatgacaaaaagactgacttgtcaaaaaaaccatgaaattccatacaaatgggcaagctgacatatagcagcttcggaaatttccacaatcgctcctctgagttgcctcaaggagaagaaaagtgagagaaaggaagggtacctttgcccccattaaggcacatgtagcatcctggaagctttgaaattacctgtccccaaagttattagaattatgtcattttttggttgttatattatgaaagcctccccacccctaaaagtttgtctataataatttttttgatcaggatttttacttcttaaattaatattaaagcattttaatgtttctagaaaatttgtcatttgtatttatattattttattttatttcattttattttatcaagacagggtcttgctctgttgcccaggctggagtgcagtggcacacgatcttggctcattgcaacctctgcctcccaggctcaagtgattctccggcctcagactcccaagtatctgggattacaggcatgcaacaccacgcctggctaatttttgtatttttagtagagacggagtttcaccatgttcgccaggctggtctcaaactcctgacctcaagtgatccacccgcttcagcctcccaaagtgctggggttacaggcatgagccaccgcatgtggcctgaatttaatcattgactcttgtttttaacttttaatataatattggctactggtttgtggtagatatcttttactgtggcaaatacatagtattctattctaattttcaaccctctttcccacagaatatttaagagaaaacctttttggccgctttgataatgataatttttgtctattgaatggtgatgctgtgattttcaggatgtatgtatcatggaaactggtagagaaagaaagaactgagatcatgctgaagtacactggggcccaccaagaggtagagctgagtgcaccaattgtcaccaaaatggcaacccataaaagagaaccattcttaagaaagagtcatgtaccatcaagcggggatttccagaagcctctgatagtaacagttctcccttccattcccttcctctctactctcaagatgcgatgatgacaaaaagactgacttgtcaaaaaaaccatgaaattccatacaaatgggcaagctgacatatagcagcttcggaaatttccacaatcgctcctctgagttgcctcaaggagaagaaaagtgagagaaaggaagggtacctttgcccccattaaggcacatgtagcatcctggaagctttgaaattacctgtccccaaagttattagaattatgtcattttttggttgttatattatgaaagcctccccacccctaaaagtttgtctataataatttttttgatcaggatttttacttcttaaattaatattaaagcattttaatgtttctagaaaatttgtcatttctatttatattattttattttatcaagacagggtcttgctctgttgcccaggctggagtgcagtggtgcagtcatagctcactgcaaccttgaacccctgggctcaagcaatcctcccgcctcagcctcccaagtagctgggactgcaggtgcatgccactatgcctggctctttttcttttttaacttttttgtagagatggggtctcactatattgctcaggctggtctcaaactcctgccttgagcaatcctgcctcagcctcccaaagcatggggattacaggtgtgagccaccggacctgaccatttctatattcaaaattttgttaacacagtcaaatattacatattttaaaaatttaaaacattctcaatatttgtgaatttattccacttcttatttttaatttggtttgttctctgaaacttaagattagctagcagtaagtcaatcttatttttgtatatattttaaaacattttgtatatattttaaaatatatgcaaaaataagatagacttactgctagctaattaatagccttttaaaataattttttttttttttttttttttttgagacggagtctcgctctgtcgcccaggccggactgcggactgcagtggcacaatctcggctcactgcaagctccgcttcccgggttcacgccattctcctgcctcagcctcccgagtggctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccaaaataatttttatctcacatttggatagttttatgtgcttttcctttatattgcttttcttaggtttatttccctttctttttttttttttttaagacagagtctctctctgtcaccaggctggagtgcagtggtgcactctcggctcactgcaacctccaccttacgggttcaagtgattctcctgcctcagcctcccaagtagctgggactacaggtgcgtgccaccatgcccagctaatttttgtatttttagtacagatggagttttgccatgttggccaggatggtctcaatctcttgacctcgtgatctgcctgcccgacctcccaaagtgctgggattacaaaggtgtgagccaccgtgtcccacccccttttctaatttattgagttgatcttttatttttaatttttcttaatgataaaaatactaaagatatttgcctctgactgtaagctgcctacactttgatacataattttctcattatctttattgtctcagtctgtgattccataatttattatcttttatactctacacctatttagaagaattctttttgaatgtacaagttaatttgaattgtttacacttctgtctattaatgagttttgttgcattgtggtcacagaatattgaaaggtagtaaaatttattttatgttccaatacaggattcatttttgttaatgttccatgagcccctgtatagaagatgcatgctctaattaaatctaatcaggcttatcttgtcatcagatctgccatatttatgattttatcctacttctctatatctttattaaattttcatctgctggccgggcgcggtggctcacacctgtaatcccagcactttgggaggctgaggcaggcgcatcatgaggtcaggagatcgagaccgtcctgactaacatggtgaaaccccgtctctactaaaaatacaaaaaattagccgggtgtggtggcgggcacctgtagtcccagctactcgaaaggctgaggcaggagaatggcatgaacccaggaggcggagcttgcagtgagccgagatggagccactgcactccagaatgggcaacagagtgagactctgtctcaaaaaaaaaaaaaaaaaaaaaaaaaaaatttcatctgcttatttttccaaggactgaatgcagtggggtagactttaacattattgcatgtctctcaatctctgttttattttctttatatatttccatgctctactatcttgacacatacaattttgacttaattctttggaatgtatctcttgtcagtaaaaatttcacccctgttgaatgctttagatatgtaatactgattttgtattaacagttgtaaaactgtcacttctaaatgtgcagtttcctggtattcctttgccccaatcttcttgtaacttttatgggtttcttgcagatagtctaagggcattcttaatttatgacaccatctgagattcttttgcttttcaaaacgaattaatacctgtcttcaatgttgatacgcttattctaatttttgtcatctttttattcttttggttttatgattccttgatatttccctcattttccattttgtgtgatatgatttactgtctgtaatactcataccttatatttaatcttctagttgtcttcttaaatttgactaaatatgacctatatttctgtatgagcaaagtgaggaagctggctgaccatacctcctccctgtataagataagattaacacattttattctcctttggaattctccttttcttttttaaagttagatatagacatatagatgttttgatccagtttatgattacttttaaatattatgtaacttttcttaataaggattatctatatctgtgttcctttttataacgatattcagttgtttgttatatgctctccttatatgtgtatatatttttctctagagacagggtcttgctctgtggtgcagcctggagtgcactggtgggatcataactcgctgcagccttgacctcctggctctaaaggatcccccacctcagcctcctaagtagctgggactacaggcacacagccccacgcctggctaactttattttttttttttttttttatagatgacgtctcgatgtgttgtcccgggtggttttaaactcttggcctcaagcaatcctcccacctcggcctcccaaagttctgggattacagggatgagcccctgtgctgggcctgaatccatattgtgaactgttttaaagcacaactaccccttttctttattgtttaaaattaaatttttgattgattagggagcttcttcaaatatattctatgaaatacattgtgtttttgttgctccttgggatccaagaatgccttttttattttttaactctcataccttagtaggaaagttggttagtttggaatttttgtatcagaaccctttgccattagagctgtgtagttgttttatttcttctattgtcagaaatctgattttttttccaccttggtgacctggttacctgtatttcttttcctcctcactgaatgcttatgagttgttttgacctcaaaagttgcaccagaaggtaaataaatagatggaagttttctttaatttattaatttatattaatatttatatcagttttcatttttttcttcttgtatagagtgagtttttggttggttggttggttggttggttggtttactctgtatttcttcagtttagaaaaattttctttcattatttctttaataattgcttctgtggtatttactttgactatgcatcaatcatgctatctctatgttggcttcctactttgtctcctgtatccattagcatctatctgatttgtttatacttttcatcttttttccagtgccttttgggagactttttcaggtttgttcttcacttgctggtttgatgctccaaaggctgtttttccttttcattgcatcgaatgtagttttaaataatactttggaaaatcagtcattgaaaaaaaatcctaatttttttttgtaagttggtgtttctttttgttttcatttacttgtcattcacgcctaagtctgggtctcctccccttctttttcctcctccttcttcaaaggtgcaaatcacatcttgtctgaaacttgtttctatttccagtagtaaatattttttgaaatcgtcttcttcctttatttcttggatgtttcttgttttgttaaccaagtccttataagcccaatgttgccagttttgggtctgctcatcattgaatgatgggagggctagcccgccctggaaattgttctcaaataatctctgtaccattagggaaaggttggactcctttcctcggtcttaagctgaaggctttgttcttaaaaatgtactagaccaggtgtgtttttcagcagctgcacaaatttgtagggagctggagccacagggcaatctctattggggttcttccttgcatggttgctgcttggcaatgggtgaagccatcgtgcaagagacagtggttctcattctgaacttctccctgaccctagcttcactccaagccccctttgtagcagaggatgcatttttctggcatcagagtcctgctatgtagagagacatctcacatcccaccagatggccatgggcatggaggacttatgcttggttctcttcttagtgccttccgaatgtgaatgccctggacaccagacactatctggtttgctagcctgctctcacctccagcgttcagtccattttaggaagatttctaaccagtgctctgtcagaatctcttcttgtttcttctcacagtgctgtgccaccttttcaagaaagagaatcccaacacacatttctgattcagccttttatgtgatgctttctctggtctatctaacaaaatgtcttaatgttaaaaatgctgggtgccctccttttttttcagcactggtgtagacttccccccatctttatatttgtgggaaatggatgttcagattgatgacgtgctctaaagacagagaggggaaatttacaaaacacaaatggagaggaatgtgaattttacaaaagtatttatggagttctctaaataatgaactccctcaggacacttagcacaccaagtaatgtaaaaagttaggcttacacgtagattgtcagacacacagcttttgtatattgtaagctacacctgtatccctgtaatggtccccaggagtatcacgctgcatggtccaattaggtacagaagaactctcaagtagcagccagtcactttgcctgtaataatgtttatgattcagagtggtgcccaattcaccctttgcacttttcccagtggcatttggcagctggggcctggttattcagcagattattgcttctccccagaagcttttgtgatccttgcaggcgctctcctactagggagagaagaatgccaacatattttaaggaaacaaagaataatagtgtcacacgtctttgaataagagtgaaaaaatagttctccccacatccaaacacagtgtagtcaaaattaagaagatagaaatcaagtgtgcatgggcagagggtaggtcataggcttaatgaacccagaagagctttatttattgacttctattttatcccttctcactggtccagctgcaatgattgtcaacaaaggtgacttagaaaaagagagaccttggagagagacagaaagagagagagctggataggcagacagatgtagagcaggtttgtttgcttggcagaacatccaagtcgcagatggttctagaacagaggtaatattgccagggttgcgtggaacagatctggactaaagctgaggcttgcaggtaaagccagtggctcccactccaatgtcattcagcacatagcaatttcagctggagatctgtttatagcataaaacagacactgcagacttttttctccatgagactttaatgtttcatttactaacaagattatatatgggaagtggatgtcataagaagactgtagaatcctattgtctcaccaccgattgaggggcctttgtctatagaccaagcacgtctttttcctcggatgccttgggcatttcagaccatgcccaaaaagatatgttgtgacctgcagacctgtggttgaccatattaggatctgtgatcaatttcttagagattttgggcataaaaaatgagcaaagagccatctttaggaatttggggatatgcttgacccaaggtatttttgttttctactaacacattttgatgtaaagcaagaagtggttttcaacagttgaccatggttgcctagagagatgggtacatattcatgtattttgacctatcagatggaaacaggcttcactcttagaacttccctttggatttcccacccaccccagacactgacattccattttgaagttacacatgaatataacactgacacattgggacatgctttccaagctcaattaccatgcagcgcaatatcaattaagtggatcatgaaacatgtgtctgattgtctcacttgcataatttacattttttgacaacacttaattctcccttatatgtccaggtttcctattttgtgatgcacataattgcagaacttgggagctagaatggaccttggagaggtcccttacgccaaccctttcacttcacagatgtagaaactgaggcttagagagggtataactttcccaaggccacaaaggactagtttacagcagagctgggcttatataacagggctgcctggccggacgcggtggctcatgcctgtaatcccaacactttgggaggccaaggcgggtggatcacctgaggtcaggagttttaaactggtgaaaccccatctctactaaaaatacaaaacattagctgggcatgttggcgcatgcctgtaatcccagctacttgggaggctgaggcaggagaatcgcttgaacccgggaggcagaggttgcagtgagccaagatcgcaccattgtactccagcctgcgcaataagagcaaaagtccgtctcaaaaacaaacaaacaacacacacacacacacacacaactcatggaactgtatactttcccccaaaattcaatttagggccgggcgtgatggctcatgcttgtaatcccagcacttcgggaggctgaggcgggcggatcacgaggtcaggagatcaagaccgtcctggctaacacggcgaaaccccatctctactaaaaatacaaaaaattagccaggtttggtggcaggcgcctgtagtcccagctacttgggaggctgaggcaggagaatcacttgaacccaggagtcggaggtcacagtgagccgagatcgcaccaccggactccagcctgggcgacagagcaagactgtgtctcaaaaaataaaaataaaaaaaaaaacccacaaacaaaaaaaccacaaacaaacgaacaaacaaacaaaacagggctgcccattatcccctgcatggctccagagctattcttaagatcctctgcactttggatcttaagataacattagatttcatagtatccatgaaataacttagacctggtcttggaaatacgtttcaccatccaggtacccatcacatgtgttcgcaggtgaggctttcttagcagcactatgtaaggagacatagtaaagaaatatttattgaatactgaatattgattgagcctatgtcctgtgctaggtgttctaaatatagaaccttatctcatcccataactctttgagttaattgtcattctttttgtttgtttgtttttgagacagggtctcgctctgtctccagagtgacacactgtactccaggctggagtgcagtggcgtgattgtacctcacagcagccttgaactcctgggttcaagcgatccccccacctcatcctcctgagtatctggactatatgtacgtgccaccacacctggctaattttttaaacattatttgtaaagttagggtctcacatgtttcccaggctggtcttgaactcctgggctcaagtgatcctcccatctcagcctcccaaagtgctgggattataggcatgagacactacacctggtcagtatcgttatcttggccattttacggttaagggaatatagacccggcaagtttctatagcttgttccagaccacatagctagtaagctttgaggctcatcctagggtcactgcttgaataacctgcatttttctactgtaccatatgtattctcctgctaatcttcttactgagagagatggtagttcttctaagtatcatatgatccaaaagttgcttaaccaagagctccagcatctgaatccctgagcatacctcttcccccatgcatcatacctgtttcccattctctttgaataattttgaattgtgagcaaatgttcttacaaaataaagaagagagtgtgtccctgcagcattgtctaagtgcagaggatcttaagaatagctctggagccttgcagggctcatgggcagccctgttatataagcccagctctgctgtaaactagtcctcttgtggccttgggaaagtcataccctctttaagcctcggtgtctacatctgtgaagtgaaagcgttggcgtaagggatctcctcaaggtccattctagctcccaagttctgcaattacacgcatcacaaaatagggagcctgaacatataaaggagaatttagtgttgtcataaaatgtaacttatacaagtgagtcaatcggatacgtagttcatgatccactaaattgatactgtgctgcatagtaattgggcattagtggaagcagttcacgtaaaagactataatttgtattacttttacaccattgcaacactttttattgttcctcagtccttgatttgttttctaatgtctctagtgtgtttaacactttctcttgttatgatatgcaccatacatgtgcatgtaatataattcacatatataacatgaaaacatctgattcccacatctaacagtcagacttccgttttcctcttttccaaaatccaggtggtcagctgggtgcagtggcttgagtgtgtatttccagcactttgtgaagccaaagtgggaggattgcttagggcaggagtttgagactagcctgggcaacatagtgaggcctcatctctacattttttttttttaatcagccaggcatggtgatgtgtgcctgtggtcccggctactcagaaggctgaagtgggaggatcacctggttccaggaggctgaggctgcagtgagctctgattgtaccactgcactctagcctgggcaacaaagcaagcctgtctaaaaaaaaaaaaaaaaaagaagagaaacaaaatccagttgtctgaagaggaacaacttcttcctgagacattttctttatttcttttaattttgttttcttttttttagatacagggtctctctccatcacccaggctggagagcagtgatacaattgtggttcattgcagcctcgaactcctgggctcaagcaatggtcctaccacctcagtcagttgagtagctggaactatagatgtgcaccacgtgccacgataatttttgtttttttttttttttttgagacagagttttgctgtgttgcccaggctggtcttgaattcctgggctcaagtggtcttccctccttggccttccaaagtgctgaggttacaggtgtgtgccatgtgcctggcctgttcctctttatctctttgtattgagaggttcttgagaagcatttccatctgctttccatcgttttctcccatgtgcagacttggttaaaagaccttgaggaatcccccctttacgaagccttatccatgagaggacaagataaggagacccttggtttgtggattcagcttccatggtcattcccatcagttcccaccacttctaggagagatagtatcactcgatgctgacctggaaaatcctggtagagacccaggaactcataggactcggtccccacaccctcatgccagtacctgtgtgacggagaggcgcccctttgcatggggtgctgcacaatgccttcgtcaatcttctgccactgtcctcatccccaccccagcctgctcacctcttcccctgtaccccacagccaccaggccagtttcacctggtggaacacttcccccacttcacctgctgtgcctcacctacttcctcctgcctgttctggtgaagcctcccgcgtcttttcttgtggtaatgctcttttctgcctctctaaacttctgccagtgtttttgtatttgatttttgaaattcaactcagacctccaaatgaggcctaagtcaagcctagcttttggcgagctcaccccatttatggtgggggcctgcctggtcacctgctcgtcttaaaacctgcctttccttatggaactgtgttttcaatgaggttctggccgctaagcactcaaggctgtgtacactcaactgttgggctgttggaggtctccccatgagaactttattacagaatggagtatggagcctggaaagggaaggtggcccagtgaggaatggtactgcattctcagtctctgggtgagttgaggcaggggaccagaaggagaggagggaggagtgggaaaggcttaaagcctcttggaaggagaaaagccaggggaaaggagaatggtaactgggaaatgggctaacctcagacctgcctttagcggacgcctggctcgagggcccaagacctcaagctctcagaaactggtaagaatcatgctgtcccaggtcccagtgaggtgactctaggtaggaggcccttagcagaggtggctgggtcaatcccagtcggctgcttttatcttttattttatcggcacttagaaagaaagtatggtgctccttctgagagggctctttaacattgcaatgggccaatcactttatatcattatctcataattattatattacattacattatattatgataattcctgttttgtaaatgagtagccgaagctcagttacatagcctgtccatggtcacagtggaacatgaacccagtttgtgatgtcaaagcatttctatctttatggcaagccttcataggaagcaaaagaagcttgcaaaagtaggagacgttaccttatcctctttccccgttcagaatttgggctgcggccaggctcagtggctcacgcctgtaatctcagcactttgggaggccgaagcgggtggttcatgaggtcaagagatcaagaccattctggccaacacggtgaaaccccatctgtactaaaaatacaaaaattagcagggcatggtggcctgcgcctgtagtcccagctacttgggaggctgaggcaagagacttgcttgaacccaggaggcgaaggttgcagtgagccaagatcatgccactgcactccagcctgggtcacagagcgagactccatctaaaaaaaaaaaaaaagaattttggctgctcactgatgttagaatttaaaagaaagtaaagtgatgcttcaattaaaaaaattaaaagcttaaaaaaattaaaagctttaaagtatggattttttttggtgggcggagcaaaaacagtgactgaagtgtattcatattgaaacactgtggtgtttcactggtgttcaagttgacagggcaggggtgggaaagaattacggagtagaaacccctggggcccaatggggaggcacctagagggcctaaggggaaggatcctacagatgaacttgaccttctttatgattttgcggaagacaactctgcttatctttcctctgggaccagtaaaatagctgttgggggcagatgctttgctgatgcttagtatacaaaagacagcttatatgggggcaatattaattttcttaagtcccttggcatggattctgaaaactttaagatttatgatttgagaaccctgactctaaaatacgtgagaattttctgcttgcaaaatagattacgcttgcacaaaatacgcttgcacaaaatcttctacttgtatttctactctggattgttgaaacaaattgattttttcttttttgagacaaagtctcactctgtcatccaggctggaatgcagtggtgcaatcttggctcactgcaagctccgcctcctgggttcacgccattttcctgcctcagcctcccgagtagctgggactacaggtgcccgccaccacacccaactaatattttttgtattttttagtagagatggggtttcaccgtgttagccaggatggtctcgatctcctgacctcatggtccgcccgcctcggcctcactaagtgctgggattacaggcgtgagccactgcgcacagctgaaataaatagattttaagtggctggctggctctcagattgcatcctgttagaaagtcagaatagaaaatagatgcattttagcagtgttggaagaataaactcaaagtcccctggaaatcctggaccccacccacctcttaccaagtatccagcaggaaccttcttccttactattgttataatacattctagccccagtaatttgttccacgtatctcattagagtgaagatagcaacatacttaaataagaatttcatttttcagttttagcttttgatgtaggctaaatgctctgtgtcacataacttagactacctacatgcctcatacactgataccctattttgaaattacacatgaatttaacactgccacgttgggacgtgctttctaaagttacctatgaaataacttagatccggtcttggaaacaccttttaccagctaggtacccatcacatagcttagtaggtgatggtggggtccttcgtttttttgactacccgtataatttcaggagcaagcctaattgttatgcctcctttgttattacctcccctagcctagataacatgccttccaaattgtattgagagtacacaggaagacaactgcagcaggcaaccagctctaacaactgcgtcattttctaagaatcaaaggaattacttgagtttctagttctggctttggcttgccagacatataccttaccccagcgaggtaaatgattcaatcatttgggaatgattgaagttgctgcctaattcataacttataggtgattaaacttgtaaagtattttgaggctgtttctttcattcatttattccaaacaaacatttgttgttgaatgggtagtgactttgattttaaaacactatacagacataaaatagtggcagcttgtagatagcaattttttaatttgctgtccttaaggaatttcgttaccaaatcctcacgaatcttgaaccttagaagaataatcctttcctttgttggagttttaaatttagaataatcagacaatagtgaagcattctgttcaaagcattccttttaggctacccatttattatacgctgctcttaagaggagatgaatttgattagcattgaacattcagtcagtgtttttgcatagctaatatcacggagaaattttcaaaaaaagttatgcctgctatttaacattattatacagtcaacttttaattatctgtattaatggaatgtaatcagtgatgtgttgctccaaaatcatttcctttggctttgagaagcaccggatgatgcttttattggtttgtggttttgcttagatagtattaaaattgtgccacatgtgtgcacatagctcatcttagggaggaagtagcccaaaagtatactgggggctagggaaaggtcaactggaatttttaaacctaccacagatacatatacaatggatgaccccaagattattcatcttaattattaaataaaaaacaatggccaagaattatataatggcagctgtgtaagaaaaaagacgcaatgaaccacatgtgagatttccatgtaggacacacattgtttcccacctttcccttttgaaatttcctgaaagtgaaacactctcataacactacagcagtgaacactgttagatttagtgatcctccaaatgcattttgctggtgctccaaataggcctcttgggggaacagaaggaacagaagggctgatgtcttgacatgttaatgtttctagataatgtcacctttaggtgtgatagctgttactgtttattattttttaaataaccctcttgttcccattcattcaagttaagctttttttttttttttgagacggagtttcactctgtcaccaggctggagtgcagtggcgcgatctctgctcactgcaacctctgactccctggttcaagctgttctcctgtctcaccctcctgagtagctgggattacaggcacgtgccaccatacccagctaatttttgtatttttagtagagacaaggtttcagcatgttggccaggatggtttcgatcttctgacctcatgatccgctcgcctcagcctcccaaaatgctgggattacaggtgtgagccaccatgcccggcctaagcttgttttttttttaatgaataacaatgatagaaggaaatctttggagggtttatcttcttagtagcggcctttcaaatttcaaaagtcttctcagtgcacaaatctgtttttgcatgaggctgctatagggccagcacttttagtcctctgtggcctgttcacctgagtgagtggtgacatttcttggttcataccttggaaggcaatgatggctggccctttagagtgaggtgaaggaagactgatccctgggtgtggaggtactgatgcataggaaaagaaaacatctttggtgacaccattgggtgtcagatcagtttttggcaagttggcaggaaagtctccaaatcagtggggtctggctgggcaccagcaagttggaagctgcattagttccttctgctggcatgtccccctgtcatctggccatagcctcatctgctcctactaccttgcaggtgcccttggggtaaagctgtccagatgcacatgaacccctcctcttttcagctggacaccaagccaggaaaaggagaggtgtgactttttgacggaggccagtttctatgtcagcagccttgccagtgaacactgcaaaatggtgtcagcctgcagcctttttgtgcactggagcagagctcccctcaccacatttgtgaaacaggttctgtcatggggcccaggtgtccttttctcctgccacccccactccagcttgctggccgccttatcattccacaccaggaagccagcatccttgagttgtccttacttcttatgacctgctgtgtagaaagagaggggaaaaccagtgtccgagtggctgctgtgggtgtggtctgggccgcgtagttttatatacgtaacaaccttctgagacaagcgttagtgactccttttacagcggatgaacttgagggtcaagccagtaaataatttcctcaaagtgacagagctggaaagtggtaaagttaggatcaatactcggctttgattttaaaatatgcatatgcatatattttggagatctggatataccacttccaaagtagcatattatactgaaatttcaaaagagaaaacatctttaaacaaaaggaaataactcttaattatggagtttcaggtatcaatgtgttgctggagggctgtgatcttaaaagcatgtcacattggcaacccgttccggcaggttgtgacaagctatgtagcatgcatgaaagcatcattcattttttaaaaaatgtcttcaccatttatttctttaattttttgttttaactttttatatttataggcaataattatgtatatttatggggtacagtgtgatgtttttataatgcatacattataacaagattcaatcaagctagttaatatattcatcacctcaccagtttatcattttgtgtgtgtgtaagaacattaaaaatctgtgttagcaatttacttcattcttaatggcagactcagcttctttttttttttaaatcctagactgttggcttctccttccagcagtgttgtaggactcagctgcctttctttgctgtccctggccagagatgtgtgcactcctggtctcctaataaaactttagcctatgctgggagccatggatttggcagcactgcctttagcatttaggaatatgtttctccttacatcaagaatagttttaggccaggcatggtggctcacgcctgcaaatcccagcaccttgggaggccgaggcgggtggatcacctgaggtcgggagtttgagatcagcctaaccaacatggtgaaaccccgtctcgactgaaaatacaaaaaaatagccaagtgtggtggcatgtgcctggaagcccagctactggggaggcagaggcaggagaatcgctagaatctgagaggtagaggctgcagtgagccaagattgcgccactgcactccagcctgggtgacagagcaagactctgtctcaaaaaaaaaaaaaaaatagatttatgctgcttgttgaggaccagcagtattctcaaccatgtgaggcattcttcgaacatgtgaagcagcattttcctggatgggcatttctgccataattgtgggcagaaaaaggtgtggtccacatatgcccaacagggccaaggggcaagggtgagcatgtacctatgtcttataccccggagattcttgcggctgacgaggttcccttacaaagcccaaaggaattctcctccttccaccggaggtgtttataacctctaatttgctcaccatgcttctagtggaaggagtaggagctcaatcccctgggaggctgcggcagagccagagcaggctggtgacccagagcagtggcactcccctctgagtgcatgatgcagatggagcaggagggggatgcaggtgggacaccctgcgccctgcaggtgagtgcacagccagcgagacacccaatcagggagcaggaaggctgtccctgtggcagcaggtaaaagagagagtcgctgagatgaaattcgtgggtgtgtgcttcagcttgtttgaacagctcctgtgcaagatcttatagtaaatgctgagcttctttgtgctctgtgcctgtcggtggaaggcatagcccttgatgaagatttctccttctacccatcttgcctttggaaagggctcccctttgacaaatgctgctgtagtatttgatgcagcctccatgaggtgctttgggtgggaagtggattctgacctcatttcccagaggaatttgaagtggaggggaaggactaattggtccctcattaaggacttacaatgaagtacagtatttctcctgaaaggataatctaagtcactggataaaatgcccaacacacttttaacgtgacataggaatccaaagtcatttttaaatcaaagatttttgtagttgtggagaatggctgtgttttaatgggatctttacatatcagcattacaaagggctccttcaaatgtgatgattttaatgtttttgctggggtttcacctgaggttccaaatacatatttccctatcatatttgcaggcatccagcacccgattttagatatgcaaatcagctcactttgtttaccaggctttggataggggagaaaaggaggtctgaggctgggcacggtggccacacctgttatccagcactttgggaggccaagatgagaggattgcttgaggccaggagttcaagatcagctttggcaagatagagacctcgtctttacaaaaaataagtaaaaattagccaagcatggaggcgtgcatctgtagtcccagctcctctggaggctgaggcaggaggattgcttgagcccaggagttagaggctgcagtgagctatgatcgtgccattgcacagcctgggtgacagagctagattcagtctctgaaaaataaaaaaacaaaataacggggctgcaaaagcttccttgacgaagaaggaaagtctctcgctcctgtttaacactgcctggctgggttccagctcactagcttaaaacgagaaggcaccaccactgtgattaaaataaggccctacttaattaaaacagtgtgagaatttaataagaggcataagacttcactgatagtcaccaaaaaatctcaaaaaggtgacttaacaggcattaatagcatatgttgcttgtttactctctgtcaacattccgttttccagagacatccttcgtacaggtgaaagtctctcattcctccctctcccctcactgcctgcctttcagccatttccttgctttttgtagttaaccagtaagaaagagaccataatggagaaagaacacactgactgtgtttcacagactgttgccctcatctccacttgtgttaaagaaggtaaattagttcccctccagattaacttcagcgtcagctgtggtgctttcctgacacttcttaacatttgaacagtaccacattctgtccgttttatcgttgtctcttctcataccctgtatttgccaattctgtactcatgcccagacagatctataggtatatgtaggaggatgatgaagaacgggccgattcgtagctcaccctttgagccaggaccaaaggtttgggagtcttaggctctgaccttattcttttggagaggaaagaatcattttcctttaagcctaagtctggcaaaatctaattacaaagtttttcgattttgctattttaaaataaaagctaagccttccccccatctaatcagccctctcttcctctgcttctaatagtgaaggaaataaagaagtctctcaatttcacaagcttgaggtacttatatttgtacatgatttcctgttctaagtgggtggttttggcccctggcacttcatgtacgctagggcatttttggacacttttggtatccaccttgcttaagaattgaatgactaggaaagaaggtcatggggagtcttcaaattattaaccctcagtccaatctaagtcattagttaatgccatgtttgaaggtggtaaagtaaccgtcatcttacgaagtaactctcgtttgttatgcttagtgctgaacaaagtataaactcaccaatgtgagagacagggacaggatgcttatttctttatggatatttagaatttgagcctgtaggctgggcacggtggctcacgcctgtaatcccagcactttgggaggccgaggcaggcggatcacgaggtcaagagatccagaccgtcctggccaacatagtgaaacctcgtctcttctaaaaatacaaaaattaggtgggggtggtggtgcgcacctgtagtcccagatactcgggaggctgaggcaggagaatcacttgaacccaggaggtggaggctgtagtgagccgagatcgtgccactgcactccagcctggcgacagaatgagactccgtctcaaaaaataaataaataaaaaaaaaaaaaggaaaaaaaggaatttgagcctgtaacaccaacttcagcacaaatagatctctttcttgattctgaaatgatttatcagttttaaaaaatggtggggtgcactgctggtgggagtgtaggttgatatagtcatttgggaaagcaatttggcactattgtttaacagtgaatattcatagacccattcctaggcaataacccagggaaacttatgctgatgggtattgttcctaatggacacagcattgtttctaatagaaaaaaaaacgaagctgaaaaaattttaaaggtcgtcaacagacatatatatatatattagtctaatatatgacaattagactaatatatatattaattagactaatatatattagcttctatccctgtagactaatatatattagtctaatatataataattgaactaatatgtataatttgactaatatgtatattagcttctatctctatagacatatattagtctaatatataataattagactaatatgtataataattggactaatatatgtattagcttctatctctccagactaatatatatatatattagtctattgagaacctttatatatatatatatatatatatgcacacacacatatacacgtacatacatacatatatataattttttgcttcacagaatggaatattatacagcagtgaatatgaaggaactatagtagctacctgtaacaacatggctaaatcttagaaacaatattgtgtgaaaaaaactagtcacaaaagactatatacagtatgatagtattataaagtttaaaatcaagcacaattaaactatgtattttagagagtgatagatagaaaatttaagatagtggttacccctggagagaaggcaggaggatggcttagggaaatagcaaataggtagatggatcaaaatacccctaaatgtctagttctcaaatagggtggtcggtgtatgcctgttcattttattcttatgcttcacaggttacgtacatgttagtgcattcttttgtgggttacaaacattgcatgatagaaatatttttaaagtgatagcatgtcagaattatggcttgttttttccatctctatttcctaacattctctttccatagtccccagggagggggcttgagatcacacaggagtaattagaaggtctgcttctgacagtgtcgctccttgagtggtggaggttttagggggaggctgacagtaactactgagtggaattgagaggtgaagccagctggacttcctgggtcgagtggggacttggagaacttttctgtcttccaagggtattataaaatgcagcagtcagtgctctgtagctagcaagaggtttgtaaaatgcaccaatcagtgctctgtaaaaatgcaccagtcagtgctctgtagctagcaagagatttgtaaaatgcaccaatcagtactttgtaaaatggaccaatcagcagggttctaaaagtaaccaatcatggggaggattgagaaaagggcgttctgataggacagaaacaggacatggacgggaaaaataatggaataaaagctgccccccccaaccccccacccccacccgcaccagccaccagtgcaacctgctcagattcttttccagctgtggaagctttgttctttcactctttatgataaatcttgctgctgttcagtcttttgggtctgtgccatctttaagagctgtaacagtcaccgcaaaggttagcggctccattcttgaagtcagcgagaccacgaacccaccagaaggaaccaactccagacacagaatcagctaggagacgtgggtgctttctgtatagtgcttcctaccaaaagcctagaaaatcttggggcgtggagaaaagaaaatccatcaagtaaaggcttgatcacctcttggaaaacccatattcattgtcccaacagtgactaatacgtctaactgtgggcctgggtaggatattatgagaaacctgttcttttggtgcccacctttcttttctgagcaacacgtggtcttctgagtgaggcaggagtccggcatatgcgtgatgatgtaatatgttaggcagccaggccctcaccttttcaaaggttcgatcttgaaaaatcaaaggtggatatgtgagaaataagcccatataggaataagaatgacaatggaagtggaaaatgtaagttgggactgatgttctgctgctttgagtactgaaattctctgctgctcggattcatcatcactgaagtgctggccagtactgggaggggggcagagctctcccgggagtcgtcgcttattctgaaacagctgagcagaataatgagtgacaggctggtggtggggaggttgagtcttactccggatttccattaaatgagtgcatggaatcaatagctaactgaacatttgtctttagaacacccaggggcccctggggaatttggtattttcagtctaattctcagacaggaaaatgcgcagcatgactattttttaaaatagtttcaacatcttttatgtaatgctgatgcatctggaagtgaaaacgctaagagtttcatttcactaaaaaatggattttttttggctttaacctttaagttgaaatcacaattagtggccttttcaccatagtcataagagtatcaaagtgtgtgtattcacccacacatcaaaccagtgtttactgagagtatattctgtgcaaagaattgtgcagtttgttatgaaaaatacagagacctcgctggggcccctaaggagctcatagtctagaaagggagacagatcattacacggcagggaaaatacaatatgtatgggagcatgtcacaaaggaagtgacatcgagctgaatcttaaaggaagagcaatgcttgaatgaatgaggacatccctgattgaaggaccagcataatgaacaaagaattttgccttatattactaagattccatcagatgttatgacgcaaacataagcatcatggtaatgaaattaatagtaaatttaaataaaaatgatcaaattaagacttttttggttttgtctattctaccttctcattttaattatgttgcaaagaaccatatacttagggtaaactggtcaatagctgtggccatggaatagaattataattcaatttaaaaggagtttaatagtctcatggtaaatgaataggttacagctgggcactgtggctcacacctgtagtcccagttctttgggaggcctaggtgggaagattgctggagaccagtagtttgagtccagcctgggcgacatagcaagaccctgtctctactaaaaaattaaaaaaatagttgggcgcagtggctcacgcctgtaatcacagcactttgggagaccacatgctggtcgagaccatcctggccaacatggagaaaccccatctctactaaaaatacaaaattagctggacgtggtggtgcatgcctgtaatcccagctactcaggaggctgaggcaggataattgcttgaacctggaaggcggaggttatggtgagtggagattgcgccattgcactccagcctgggcaacaggagtgaaactatgtttcaaaaaaaaaaaaaaattaaaaaattagccaggcatggtggcgtgtgcctgtagtcccagctacccaggaggctgaggtgagaggaccacctgagcccgagaggttgaggctgaagtgagctgtcatcacaccactgcactccaacctgggaaacagagtgagaacttgtctcaaagaaaaaaaaaaaagaatgttatgaatttagtatttttatacttcccctacaactctagtatctctgaggaaaagcctcaatcagaaaaatgatttgctttggggttttatcttttatcagtgataaatgtgaattgagaatagaaatctcaaaatgcaataatgatagtactttatatttcagtaggacttaatatataaaactctaatatgcattatttaaatttggccaatatgcaagagaaaagcaacatagggcagaattatgagtttgcttcgtaaaataactattaccagttcattctgttcaactatgtactggtagcatttgtaaacaattcattcttattttttttccaaagtgcattgcaaaatagtcttgcctgtattttcctgtttgcagtctatttcattaaatttctgcaattctaaattagaatagcatctaatagaccacatatgaaatgtgcttgctattaattcagacattttatggcatattcattagtcaaatccttagtatttatttatgaagtcacattactctgtccagtaattaacagaagtggatgaatatgcatctctaattttttttttagcaaaagaaatagcttacagtaagtatttataattacgtcagctcaatgtttacagcacttgaatggcgatatgtgtagtttctgtcatttagacttcatagataatttttgtacagaaatgctttgttgttgatgctttgcttccttcacacatatatcacagattaccgaaacaatcattagtccttcagttgcaacggataagactcttctttatccttaattttctgagctcctttctaggcattttatgttcttacacagatgctaatgctaattaatgctttaatatgaaagatactggcaaataaaactgttacattttacccataagttgtaaattcagcttagttgccctaacaatactgatagtgataatggctgtacaattaatatttatggagtgcttccagtatactgagctctgtgctaaacattttacttatgtagcttagttaactctcgtaacaaccctgtgaggtaggtgttattagcccgtttcacagatgaatttgtaatcattatgccttaccacatttaataataacattctctattaatcgtatatttcagatgcccagctctggaactttgcagtatgaaacgtgtgtgtatgtgtgtgatgtatatataatatataagtatgtatatataatatataaatgtagattatataatatatatgtgtgcgtgtatatacacacatttcttttttttgttgttgttaatttatgtgccacgctgctgtacgaaactctggggtactatgatgaggggatacctctttcttgcctttaagggacttaggttgtggtgggagagatggacttggttaaggaacaagtacaggaaaatatgataattgctttaatagggataggtacaggggttgtagaaaaatgagagaaaagggcccccacttcccagaaggtgtcagggagtttttcacagagaagcgtccccagccctgagacttgaagactgagtgagtttgaaaagatgatgtgtggggggaacagaagagagaagggtgtggagatgagggaaacaagatggggtcagggagctacagggagggacttggaggtgctgagggtcaagtgcagcaggaggagagacccggctggctggggtcagagctcaaggagccttgcatgttacccaaaggaatgtagatgtcatactctgtgtgctggaaaacgatttacagatgaatccaatcaacactaattaaatcagtatgattaagggatgaccttcctttcttcctaccttcctccctcccttcctccttccctccttctttggctcatttattcactcagaagattttattgagtgcccataatgtgcaaagctttccattgaatcccaaagatgaaaggaggggtgagagtggacacagttctccctttctggagtttattgattcgtgggggaaaacaagcattaatcaatgaatcaaccaaaaaatgtaaaagttacaaaatgactactataaccagggagggtcattctatacaagtgtgtcctaggaggtggtgacctggctgaggaagtctcccttgagaagaggactgagctgagagctgaaggagaaaagaatacaaggtcatttgatagaaggggtgggtgatttgaggagaagtcttagcaaggaggaagtcatgtgcaaaggctttaaggcctgggaaagcaaggtccttttaaggaattgaaagtaagccagccatgctgtagtgcaagttggaagagaatgcaggttttgggggccatgtttagaaatggaaagccactgcaatgccttaggcaggagccaaggaaggtagtagggtggcagggtggacgcggggagacgtgttagggggccagggaaagagtccagatgagccagggtggtgccggagaggagcggagggagttgaggagtatggctgcatggttgaatatggggcataatttgggagaggaagacgtcagagtgatgttgatgccatcactgagctaggaaacgtaggtgaggcagaatctattctgcttagatttccagaaaacattaggggatagatgaggatgacatcacaatggaatttaagctatttaagctcaaggttggccttgaaaaatgagtaggaattttctttttttttttttttagacagagttccgctgttgatgcccaggctgtagtgcaatggcacgatctcagcttactgcaacctctgcctcccaggttcaagcgattctcctgcctcagcctcccgggtcactgggattacaggcgcccaccaccatgcctggctagtttttttttttagtatagatggggtttcaccatgttggccaggctggtctcgaactcctgacctcaggtgatcctcccgccttggccccccaaagtgctggatttacaggcatgagccactgtgtccagctgaaaaatgagtaggaattttctaaatggcaaggagaggcaaagcatgttaatcaaagggagtgtcatatgcaaaggcagaggcataacaaaaatagtgcaaataaatgcctacacatatacaaaaggagagttattgtgggacccatacataattttgttgatttcttgatatgctcatatccattttgtgttgcagtgattctaagatctgtattagtatgtagactttgtgaacaggtaaacatgtttaagaattttttaagacatggctgtattagatatcgaaattcctctcttcattttcatatctttactttggaattcatatatgccttttgatgttatcatctgacttgtttctaatgaaatttagccgcttaggcaggacgtggattttaggtttctgcttagtgttttggcatctggatttgggattacttagcatttttaatttactaaaataaccaccaacttacactcagttgaaatatgaacatgtcggtttcacttgagcttgggaattaaaatcaaagtacagtcaaatccaaaacaaataatagtaattttaagactaggtgacataaccctctgggaaaaatgaggtgatagtgatttgatactttttttttttttgagacagagtcttgctttgtcaccaggctggagtgcagtggcatgatctcagctcactgcaaactctgccttccggttcaagtgattctcctgcctcagcttcctgagtagctgggattacgggcacgcaccaccatgcgtggctaatttttgtatttttagtagagatggggttacaccatgttggccaggatggtctcgatctcctgacctcatgatccgcccacctcagcctcccaaagtgctgggattacaggcatgagccaccatgccccagccccgatatgttttaatactaactacagaagtgttggtagaaagatcagccttgaagagatggtatagtactagaatcctaagcatgacctctgtgaactgttggcttaagtactggctttaacatccgttggctgtatttactgtcagttttcttgtcaataatgcagaggtaaacatgattcctggccacctcacagactgcagtggagtggggcaatgtgtgtaaagcccttagcacatggcccagaacatagtaaatgtttaatcaatgttcgtgatgaccttggccatcactgacatcatgtcttaactgagttattaacaaagaggcatgtgtagtttcaaaagtgaaagtgaggccggaatggtaaatacatgcactgaatttgcataattttgtggctagaaggagtcttagagaaagagagcatcaaattcagcaatgtttctgacattttctatgaagaactgactgcttgttatttcttagaaatcttagaatcattgagcagggaaggaggggcaggaacgggattattttgatagtggtgtcctcaaggggaggagatggggtgggaagcaacccctggccagaacccactcatccctggggatagggacctgctgtgtctctgcctgctgagtttttgacattctgatttaaaaaccttgtgtgtgtgtgtgtgtgtgtgtgcgcatgcttgcgtgtgtgcatgtgtgtgtgagagattatgcaatatgatgtttcccgtttctgtgacttcagcgaatgtgaatgaagaccacagaagcagcctaactcagtgagaatattgtttttataattacaggtctaggcgttttacactgagattctccactgccaccctttctactcaagcaaaatcttcgtgaaaagatctgctgcaaggaactgatagcttatggttctccattgtgatgaaagcacatggtacaggtaaacatctccaaaagctttaaaggaaaataattatcattgagttgtaaagtccccaagatagtggtgggggtgtatacatatctggtcacacaaacatacacacacaacatacacatgtctattcatgtagactccattttttcctactgtctcttttataaaaatggaacccttgcttttttatgggaaaggaaataacttctacttattttgaggtcactagttaggatagatgacaaggcattgctgataattctgaaggcatttataaatttatagatttataaattcacttagagagacaaacatcaaatggtagtagagattgtagaagtagtagagattattaagagtattgttcctcttaacaatataattctgaacatctttcatagcaacagatatttttctaccgtatagttattaatgattagtataccattgagtaaacattctaaaatttatttaatttatatcccttctaactggacagttagccgtttctaatttttttgcctttttattttcttgagatagggtctcactctgtcacccaggctggagtgcagtggcatgattttggctcattgcagcttccacctccaaggctcaagtgatcctcccacctcagcctcccaagtattaatagctgggactacaggtgcacatcaccatgcctggctaacttttgtattttttttttttatatagtgatgaggttttgccatgttgcccaggctggtctcaaactcgtgacctcaagcagtcttcccacctcagcctcccaaagtgttgggattacaggcgtgatccaccacacccagacattttattgctttcatgatgccaaaaatattcttatagctctgtattagttcccattacaaattatttccttaggctaatttcttagcagcatactggtaaatgtaagagttttcaagttttacggcttttggtaacttgttgccaaattactttcagtaaagtcataccagtttgtatttccagaggcagtttatgagagcgtctacttaatacagttttccaatgctgagaattttgaaaacaaaaagagttttttgctgactgattatgcaaaatggtgtttccatgtattttgggttttgggggtggggggggtcatttgtaagtcaagtaaattgtactgttttgtagaaccttcctccattagacagcagcatccttgaaacttaccagatttcgacatttcagaaataatattaaatccagaaggagtagaagggtcctagggaattttaagttcttcctttctggccaagtatttttagacaactatgaaatcactagatacaatcatttttcagtggaaagcataatttttcatttcttaaaaagagcaaaaaggtatttaataaaaaaattttattagatatgtatctgaagttatactgctcattagtttaaaaatatgtatgtgcctatatatgtatgtgtgtgtgtatatatatatatgtgtatatgtgtgtgtgtgtgtgtgtgtgtgtgtgtatatatatatatatatatatgtccaatatcgggaacatgattaaatataactatgttagtgccatatgatggaaaagctgtagataagattgcaagcttcaggctgcctgggctcaaattccagctctgctgttttcttgaagtgtgacattgggcaagttactttgcatgtaaaattcggataataatagtacccttctcccttgggtgttgctgcaaataatatatatgaaatgtttaaaatcgttaaaactcctatttcaggagtatttaatcatttgagaaaatgatcaatatagaagtaaacaaatgtagggtattggcatgaaccatagtataatcctaatcttccaaaattactttgcctctctttcctccctcttttcatcctcctctagtatctacaaaaagggtttagcatacttctgaatggatttaatttgtattagtggagtaatcccagtcctggagagacttcctgattcaagttttcaagtcagagacccatttttcacagagctttgaaaccatggctgtctggatcacctggctgggggcacccttggagcagccgttgggtgagagcagagcttccttcccagccagggctgcctagctcctgtggtacagcaagtgccttgggcacagagtccctcaccgtctggcaccatatgtgagctgccctagttggctcatctcttcccgtcattactaaataagcttcatttcactaaataaatgaaagagaaggtagatgaagagacccccccgccacacccagctcttaggaaacgcatgctttatcctacagatgcatgaaggggaaggctgtaggtttgtgaatctcttgaccctttggctccatcgtaacgttgaaaagtgaaaggaaaagtggtcaaagaatcatttggcatgaaggagacaaacacagaacgacgtgtacggcttcagcctctgcctttcactggttaccctgctatgagcttgtgtatgtagacgctgcattcgttttggccctaatttctggtctaatttgaacagctctgtatttctcagcagaagaggaatatctgaattcctaattaagacatgttagcttaagaatacctccttaatgtgtcataaatcattcccctgtgactatgaggatgaataagaaaacaaaacttggatttatacacacatgtatattatttcaacaaaattaataagttcatagagggagagaggacaacaaatgtgttagcaaatataggtcaggaaaagagttcataatgttctgccagattctgatgaggcacctcatgagtgtaggtagaaggcctcaagtaacggtagtgggaatggtaataacactaccatatggaacatttggtatttgaatagcacttagcttcctcccaaactacaaaatcaataaagactcagagaggaagaaaggattctcttgctgtggatcactggctggtgtgcagaaatgcagacgtgttggttgtcaagggcttaccagaataaatttctctagggagacaggagagtgggaaatacttaaccatattaattgtgctgtgacctcagatctgtggtcagcagtttttggttgtttccatatactgcacatggttgcccacaccatttttgcattcatgtacaagacctatctgcaagaccaggcagaatcattgttgaaatcttagttcgcaaagtcccatggggactttggggtgtcttaggattttgccagcacaaagttaaagcacaacttttgaattgtgagaaactgagacaaggtctttaattttaatcccattcagtcattcctcactcatttattaatttagcaaaggcctttttaggggcagctatgtcccagtatagggctgggcattgaagataatggaggaaaacaagattgacaaaagactggccctaatggagtttacagttctcagggagatacagtcaacaccatcataactggtttgggggaacaggggagatgaactggaccattctaaaaggaggcaagaggtgcatctgaaattggaaactggagaaaccaggggagacagacctgttgatctggaaggcatagaacagaaagaaccagagaatagtcagggactgacaatgaggttgtgattgttgacagccggaccaggccaggaaatgaagaaggtaaggagagaagcgtactgtctaacacccctcgaatgcacagttgctagggccagtaaagatcatcgggctactcatctctcaatttaggtaatgtaaatgatgcatcttattgacaatccatatccttaagaaattgtgaaatgagtcttttactttttataactctacaaacatgttagaaagatggatgtcaccgtgtctttatcacagtatggtgatttttcttaaccacccaaaggaagaatcgaggtgcaccagaacacgtgtaccttgttctcttattaaccatatcctttttcttactttacccactataattcacctcagagagtgagattaattatataattaatcctaccttttgtgcacatgcataattaactttatttagttcactttaaacagattttaggttccagatctaaataatagcccctccatttgtcacatcttgacctctttactatttggtacccttccactcagcattgtttgtgggattgtggttcttcttaccttcctccctccattcctgggtgcttttagtggtctcttaaataacaggctctgctcagagatttcttttatctccttaggccttgacctgcatttggtaaaggctgcatttttagcttcggatttactgtctttgacgaacctttttctctattgtatccctccctggtcagctgctctcttcgggccctcaaacatccaccacgtactctacccagatgttttcttctttctttaacatgtccagttgagttgcccatatcatcccctactccccatccacacacccacccagcacacacacacacacacacacgcgcgcacacacacacacacacacacacacacacagtgcattctcgaacatggggtcttttccccttcaggcaccgtatgtaacccaccccgcccctcagctcttaggaaatgtttcctttatcctacagaaacacaaaaagaaaaactgtagggttgtgagtccctctcaacccttcgactacatctatatcataaggttgaaaatgaaatgaaaaaggttgaaatgtacatttctaaggttaagaaaatcctactgatattaagtatttaaaacacagacttccccaaaatttatctttcagcataaatatgcccttcccttttctcccacccttccttcaatctgtagatagcctccataattcatagccagtttgggtaaaggcattattttgagacatttaatgatttttttaggaaaagcgaaaaaatgtagggtcaaagattcaagagtatattgtgttttatatgtaggcgtagcttttaaactattttggatactttaaagttttaaaataacttaccaggcttctttatgaagcattttattctttgaaagttttataaataatatgatttctggtgtcagtatggaaacattcacatagttgtaataactctcatgaaataaggtagactattccatcatctgtgtttactcttaaaacacattagaaaatggttgatatcaaagcttacaattttgtctttcttattgctaccctaaagcagactgctgcacagaccttcccctgctacactaatgctgctttcaatgttggcaaaccatactactcaaagtgcgggcaaaactcgaggtagaaatccaactttcatacagctttatcaaaatgacagtattctatggtacttttcaaatcactatttttttctcttagaggttatcaaatgaaatgaagcatttaaatatgttttctaaattcaggaatgtgagataggagagcttttgacattataggattcagcggtggaagagaaaatgaacatccagttccctttctccctaactcaagatctgtgctccctgaatatcattagtgcttctcatttcatcagtgttcaaatagtgaatcattcattcactgattgttgaaacaactgttataagatttggaaataatatacagaacatcttggaagtactttttttttattagcaagaagcagctatatgccaaaagtattaagaaggatcatctcttcagaataagtgagaagtatatcactggtaattttttagatttttgctgaatgttttagtaaaatttgggaaggtagtttttttttgagttggcaattatatgctgtccctcttgttttctcttccaaaataatcattcttctctctctctctctctctaaaatgggagccacagagccactgtcagaattgtatacatataaacctgagaacattgcctggcctggcacatagtcaatgctcaataaacatttcttgctactgtatctactgtgttctgttccccctctgttcaacaccctgtattttttcctggtggagattttcctgagtacctaaacaaataaacatagccaaacaaaacaagaattcagtgctgatgccgtgtgctttagaagctgggtctgtgcttgacttgactgacggagatgtgatactctgagtgtgtctgcagataaagccaaattcaaaattcaagtgaaacgcccttggacttgggaatgaatcggcgggtggggggggggggctttgaccaaggtactcagtgaccctgtgcttccaagttctccatctgtaacatgagtggtttgctctcagaggtttcttccacctctaaaaattaccatcattttgcaaccttgatgctttaagactttgaagtccctgtggaaaagaacctatgaaaagcggtcactgtttctgttttccccgtgcattttagtggctgcatagagtgttttttggtgtgtgtcttccatcttgctcaggtggagctaatgacctccttctccaggatagacaataaaacaaaccaaaacaaaaacactctgttcatgcacaaaggcaaccctcttccagatgcttaaccccttaaatgagtatttcgatgacacagagggatcatcacttcacttgccactgaaatacagccatctctggagtgaaatttggcagctgggaagtagtcaagctgcagtacttatatgacagtttggggaaaaggagtgagacagaaatagcagattccaaaataatcccattaaaacagcagggaaagtggaattgggcaataagatgggaggatggtttgccccaaagtctgactgtcctgtttagacaatgcggacttcagccccagaagctctaacttgtgtcactgctggaatatagtgaccacagtcaagaatcccctacacacaccccaaaaaggggggcttatctaatgtcccattgatctatcgtcttgtgatttttttttttttctctttttcctgctactctagttatcaggctgtgctggcacataaatggatctgtctttttaaagctacctcttccttttgccccctgcataagatagtgttgtaggtaagcatgttataacatcagaaagtactcagctgagaaggagtgatgttaaagcaccctttgggctggctctggaaggatgaactgactgaccagaaaggaaaactcttctgtttaattccaggatcttgggaataacagtgacagagaaagaagattcgagaagtagatgtggttgagtacaaatgtagaactcttcagattttctggaatggggtagccattgtgataaatattaggatatgagcgtggaagtcgtagtggataaatttgaaagctactcagcaatatgtgcagcaacagtttttaaaaagcaaaaggaagatttgtcaacatagttagaaatcctcagatcctcagataatggaacatcatatctctcaaaaggaagattccagggaataaagaaagcagatgataagggaacctgggcattttagtttaaccagaaaatagaacgttaccaaaaaatttagagattaaagagtcagtttcatttagaagcacataaaatgtttatgtaatgagcagaatttatagagtctactattataaaatagaaccaaaaatgaattcaagaaaaatgtaataaaattaatgtagtgggagaaaatgaaatacaatatcagaaattctagttttgaatctcagttctgcaacttatcagctttgtgaccttagggaaatcactcaaaatctgagggttttttccgcatctctataaaatagaaataattataatatctgtctcacaggggtattgtgatgatcaaatgagataatgcattgaaaatgttttgtaaattgtagagccctctacatatgctatttctataactctgcaatttcttatggcatggagtgagctctcagagacagtaatcacatgtggaaatagcttagagaagcagtcatatcagaggcaaaatctattgtataaaaatttaaaaattcatatgaattattttttctgcttctcatttttctggctcagaaattcttctatgtttacagaatttttccaaaaatattctggtaagccctgtaacagaattgtccactctctgttaagcggtaaaccacatgattttttttccttttttttttttttttttgagacagagtcttgctctgttgcccaagctggagtgcaatggcacgatctcggctcactgcaacctctgcctcccaggttcaagcaatccttttgcctcagcttcccaagtagctgggactacaggtgtgcgccactgcacctggctaatttttgtatttttagtagagatggggtttcactatgttggctaggctggtctcgaactcctggcctcaggtgatccaccctcctcggcctcccaaagggctgggattgcaggcatgagccaccgtgcccggccaaaccacaagattttatagtaaatattgcctgtgagtaaaccttgaataacaacattaaagcagaagactgctatcttgtgtcatttgataatcctaatttagggaggtctgggcagagaaaagcggggtgtgtctgtggtctggggacaagagtaatgtaagtagcatgccacatgatgaagactgaaacggagacagtgaagcacggtaaatctttactgagtgtgggctggtgtgctgaagttccctttatgcatcagcccatctgtctcattagcttctctcttaatcacaggctccatgaagtgtctacttgtctttttttagctttttatgtcaatctcctataaaagcaaaaggaagtcaactggcctttatgctgtttgtgtatactccatgcatgctcggggtggggccagctgtatttataaatgcatgctaacatgggggttactctgtgtgcataagagcttatttgtatgtgcattcatgaatatgtgtacatttgggcagatacacaaagacacaacacatatgtgcctctgctgtatgctctcttacatggaaaagacacattgacattaattagaaaaggtgatatgaaacagtgaaagtaaaattcctttcggcagtatttactattgtaattaaagtgcatgatgtaacattatatgtgcaggagaatttgcttattcatcctttagaacaatagtaggagttacatattaacaggtttaagtgtcaataagtgtctgaatacagattctctattgtgtgcagttcttgtaataaggcagtgtattttccttgtgtctttgcttgcttggaattgaaaatgctttggatgaagaatgttgcagagtgtaatttgtggcagaaaatatgcccccactgtttgtttattattcctgaggacatttgctgggctgaactatcatatgtagaaaagaacagctttgtttggaaaatactgtaagagcagtacaagaaaattgaattaagtaaagagacttagggagtccatctttctctgatgatattccttatttgctcttcattattccctgtgaaggaataaaaacgatgaaattggatttgaagactggattaagacaaatgacttttcagatttttttttttttaccttagctgtttccaattttcctagaaaagcacatagtcactatataaagagtctgagtttattgcattaaatcttcctaaatagtgtgcccttgaggtttgatgtggggaattagtttagaagattcaggggcttggagtacctgctaactgtgtgatggcgtgtgtctctagaaattttatatgcccattgatttttatagagcaagcagtacaatagaagggaagcaggatgctgcttggtcttaaggaagtctttcctgcctaccaattgccacacccctttttctccaggtagagttgactatgttttcttctgggccattgctgtacttgcctaatacttttaataaggacttgcaaatgtgcctgtaggtctcttctaactaggctgtaaaccactcggacagaggaattgttttatttcttgtaactctaacacctaacacaaggccctcaagataacctgtcaaatgaatgaacagatgagctgaatacccgctgtgtgcctgttcttgtcttaagacatgagggacaacctgtaacacaggacacaatgtggctgtgtctgctctgaaatggtagaatatctagctacagcttagaataactgggtaaggaaataaatgctggattataacccaaagaataaaatatccaacgagtccaatgaataaataaataagggaaaaggaatgactcttccctgcagcagaatttcagttaataaacaaacgaggaaggaagcagtatgaaaacatcattagaactcatagtaagaattgccacgagaaagtcccaccgatggatgcattagatgggcagatgtggattagatggattagaatgagcgggcaaaagtatatgcagaaacaggaaattcgtagaattttaaaatatccctaccccaaacatttagtaattacaaggagaaaaataaaagtttacggtgaagaatcctggcagacatcaccttaactgagtgatcaaggttaatgtcaccagtgatacatattgacatcgtgtgtcccactgagaagggcgtgtcatctctgatatcctccctgaaaaggcataatctcactctaatcaagaaaaaaatagcaaactcaaatggaaggacattcgaaaaaataactgacccctccccttaaaattgtcaaggtctttaaggataaggaaggattcaggaactgtcacagattagcagaaactaagaaatatgaccacataaaattctaagtatgatcctgaaacaggaaaaaaaaaaaaaaagcctgtttggtgcaaaaactggtgaaatcctaatacaccctacggtttgttgagtagtcgtgacccaggttaactttctagttttgatcgtggttctatggctttgtaagctgttaatatagggggaaactgggtggaaggtacaagggagctctgtactatttttgccgctttctgtaaatctaaaattatcttcaaaaaaacctagttgacacttaggtaggccgaggtgggcagatcacttgaggtcaggagatcgagaccagactggccaacatggtgaaaccccatctctactgaaaatacaaaaattaggccgggtgcggtggctcatgcctgtaatcccaacactttgggaggccgaggcgggcggatcacctgaggtcgggagttcgagaccaccctgagcaacatggagaaaccccgtttctactaaaaatacaaataaaattagctgggcatggtggcgcatgcctgtaatcccagctactcaagaggctgaggcaggagaagcacttgaaccccggaggcagaggttgcagtgagccgagatcgcgccactgcatgccagcctgggcgacagagcgagactccgtctcaaataaataaataaataaataatacaaaaattagctaggcatggtggtgtgtacctgtaatcccagctacttgggaggctgaggcaagagaattgcttgaacctggaaggcagaggttgcagtgagctgagatccggccactgcactccagcctgggtgacagagtgagactccatcaaaaaacaaaacaaaacaaaaaatctagttcagggcacaataccaatccacaggaagcaattatagagcaatccatgacaacagacaactgagaatttgtaatggggtgccagtgtcaggttcagaagaggaatgagaaatggctggggattggagtcttcaggaagagcttcctatgagaagcaaagcctgacagggaccttaacaggatgtgtagtgatgatgggtggaggaaactgaggggtcattgtaggcacagtggcagcagggacaaaagcatgaggaagggacacagatggcctgcatgggatatgttggaggggccagcggagttatatgtgcattgctggagattggtatgaaagagaatttgacagctgtggggataacagagctaaaggatcactaagacctggcggaggaatgtgaagttaatgcaggaggtgacacagagttcccagttcttgtttatggaaggggctcagtgagtttgtgtgtatatatctgaaaccggtgacaatgtatgtagggtggccagagttgggagaaacaggggacaggcgagtcaggaattaaagataggtaatgggagcctattcgtttgagggtgttgggaggatggcaggaaaggaaaagggggcaacatattcaaaggtatttgaagggataaaataatataacttagtaattgttggatttggagaatggagaggaaggagtcaaagatgatttctgggtcatatttactggacaggtactattggtgtccataactgaaataatccattcagcagatatttgcatgcctacatcgaggaataatgtattctaggtgaggaaggaggattaaaaagaatgtcaacacagcatctgcttacgctggaatgtgggccagaaagcctgtggcttaggctagactgaatgaatggccaggtcagcctacttaaggagtccctgccctccacataaaaagaagggaaagattgccctactctgttcctagcagtagccatgaacagtgttagaagatctttcaaactgacacttctgtcctcttgataaaaatgtcaggtctactgttggaccatactcataaaaactctgttaaatcaccattctacttaggaaaaggccattcatgccccacttaactctgccaagatagaggatgctgtgttcccaaggtaccaaaactgaaagttaaaatgccataaaagtatactgaactttatagaagaaaaaacagaaaaagtgtatgcatgcttaaacctcaaactcttgatcttcaggtaccatgtcttttcaacgtagataatatcacctagtgagcacaccctgaagtcatgctctggctggctttgctgtgttctttttgttttctcttgggcttgtgtctcactctgtgttgggtaggaaagggtttctgtagcctttatacccttgttttcatcacttatttcacgaatttccacttattactcaagaataaccatatttttttatctctatgacaagctgaaaacctccctgtcagcaattatagcctgttagccctcacagagtcagtcttggggaggtatggccttgcggttcaggggcagaaccgtaggtgtattcacctgtggaagacttagacatacacatttgattatgggtggcagtaatcagatttatgttttgaaggtcttcgaagatctccgtccctttctcagtcaacattatacatcattgtttcttaacagttgagtccttataccttttttggtatcagtcggtcattaggccaagtaaacattttattgacaataggcaactgaggagaaaattaaccctttttatagttaattgtaagtggaagttgcttgatattcttaaaaatatgaaattgtggaagttctggttctagtctgagaattgagcattgagcatcacctttacaacatgtagacttaaacttcaaatacctttatgatgctgagaactccccatggaataggaaccggccatggcatatctaaaacatgacttacatagcattgcacgatataatatgaatgcatgtttttttgtagaatttagaaagaggctgaacgtgatggctcacccctgcaatcccagcactttggggggctgaggtggaaggatcacttgaagccacgagtttgagaccagcctggacagcgtagtgagaccctatctctacaaaaaaaatttaaaacttagctgagcatggtggcatgagcctgtagtcctagctacttgggaggcttatgtaggaggatcacttgagtctaggagtttgaggctgcagtgagctgtgatcgcaccactacactccagcctgggtgacagaacaagtctttgtctctttaagttttttttttttaattagctgagtgtaatgttgtgagtctgtagtcctagctgctcaggaggctgaggtgggaggattgcttgagcccaggagttcaaggttacagtgagctatgattgcaccactgcacaccagtctgggtggcaaagtgagaccctgtctctagaaaaataaaataaaagaaaataatgtataaaagaatgacatcttttgtagagcggacattggaaatggcagaatactccatgaagtagcctctagattccctttatgggcttgctgtggaagcacatatgttcacattggcagaataaagactctttttatgtccttttaaactaatgtattgacttcagtattttttttatagggaacatatttcaaaattgtaatggtagtcaatggttctatgtaaaaatactttgtctttccacagacccatatataccagccaggtcaccttcattctcagagtgcctgatgagtagagtgcattcaatacaatagctgtcttgtttttttagcagcagaagtgggagtcacatgctgaactcgggaaccattttgaatttattctcatagcaattgcaaggtaaaggcaggcagaatccttgctgtgtaaccctcaacagagctccataaggattgggaaatcaggccatgctttgtcaaagagagggtgcacacaggcatcaaacaggtcacttctcttaattcttaggccaccacacaggaagcacataattatttaatccctggatctttctagagatgcaacaaagtgatgagggtggacagctccagaaaatcgctgtgcaaggagcaagggtagaaagctagggttttggattagacagactccatttcaaattacatcttaacttagtttttattgtaccctctaacaacttatgaataaaataaggggaatatatagagagttaggcgtggggaatggttacaacttatttctcttcttcactttcatctgtctttcttcagtctcttctcccctcttccattaaaggtaaactgaataaatgaatagtgaatgaatgaagtgagcaagctgttttcaacaaagttcacttggtgccacttccatggatttagttataaaagtgatatgatcctagttatcttaggcagaatacatatttctgtgaccctaatctacgtgggtcctacttgaaacctggaaatgataggaaaaaccttcttgggaaggagaaaaatgaccaataaaaaaattctgaattatacttatagatgaagccctggtgaacccagagccctgttgactcacaaggacactcaaagtaagattagtgattcaacacattcacttcttcagtttcccaaatagattagaaggaataagagggctttcttgggttaaacttactaaccacagtgaaggaaggagaaaacctataaaaacttgaagtattataaaatctcagcggtgtgaggccatttcgtttgaggacaaacaaacctagtggattgtccagggcaggtgaatgtaaaggacatttcctgagatgcaacaaagagatgatggtacaatgggcaaggatgttgcaataacaagcaaccccaactcttcagggtggaacacagtagaagttcctttttgatggtgttacggataacttggggtgttctgcagttggagagggcgtctgtatggtggtgattccctgacccagggtccttgtatcgcaaggctcagacattccctcagtgttgggagaccctaaggatcttctgcacctggcagaagagagaagtggggaagcgagagagtgagcagtctcctgggaggtttgttggtgaaattggcatataccacttccttccatgttcccttgaccagaatttagtcatgtggacatagtcaactgcaggtaaagtggagaattgtcagcctgtatgtcaaggagtacagggaaactgttttttcaacaactaaccagtttctgccacaactggataccttcctgacgtcatctttactcccatcccagccccacccgagatttggccatgagtaccctgtaatttgcagggcattatatctctgtctcaggaacagcaggagaccactgagtcaatcggaactgttttttttttttttttttctgagacggagtctcactctgtcgcccaggctggagtgcagtggtgtgagcttggctcactacagcctccacctcctgggttcaagcgattctcctgtcttagcctccccagtagctaggattacaaggctcacaccaccatgcccagctaaattttttattttttatttttagcagagacgaggtttcaccatgttggtcaggctggtctcgaactcctgacctcaggtgatccgcccaccttggcctcccaaagtgctgggattacaggcgtgagccaccaccacgccaggccaggactcttcatcttttaaaccacccgggtctgaactgacagtcccttatgttatcttcatgggaagaagagcaggcagtcatgtgtggctccccatgaaaaggcaaggaaccttctagatactgccgctagaaaccaggtgtgggatagaagccctgcctttgatctatacctgttggtcaggaacctgcttctactttacttcattcatctgcacttcttaggagctgggtcctgttcttgtttaccattactaaattacggggaaattcctgaaattatccagtcctcccagatggttcattctttgtgtgtatacccagagcttggtcatgtccccattcctctctctcaagattagatctgctgtcaaaacctagaaacaagtctttactgaactgaactctttattagcctttgattgccagataactggacttgggaaggggagtttgggaaaaagggttaactatattaaatttttttggtgctctcttatatgggctgggatgaagcatttagacagtgggagaagtataggagaggcagacagatgccagaaaaaaaaaactttggttgtttccaggtaccgaaaaagaaagttcatttgtaagtcacccacctcctcatgatttcttcacctcctgtcccctgctcatggtactagagtttgtctatattataagctctatagctctttttgccttcctgcaaaactaagcactatttataacactgtttctctgagaaaatgtgtttggagtttcaaataaatgacttacaaatgaactttctgtatacaactcattcatacattgagaactgcctgtaccgggcatgtaacctggagataacttttatctctgctttatcaatatgggcttgtcaggttgacttatgtgtacttctctctgccttcgttttgatgatagcctctctcttaaaatttaatactctctttatgtttggagaaacattccctttggcagcgtttcaaatattcttgcgaattggaatagtgattttattttatctcccaatgtatctttaataggattcatggctatgaaaatcttttgcacagtccgcctataaattgtagaaaaattgagaactatttaaaagaagggggcgcagaaataatccttttctagtattactctgggttgtcagatatctttgcaatataattactgtgttggtttttaaaggttaaaagagctctgacgtttataattctcttttgtgtgtgtgttctacacatataaggggaaaatctaacacatggaaggaaaatactttagttaacataaaggtcctgagcattttatggtttttcaatacagagacataattcatggattttatatttgcttttacagatatctggtgaatcagttatttgctctgtggaaccaatttgcagtttacacaccttgtttatttctaagctgtgtgcatgggtaatgtgtgcacaaaaatactcttgctgacattagattgtaaagtaaaaaggcggaacactggtcctggagatatgccttctcagggaacttactatccatatacaagtaaaaatttctcattgttagcagagcagctgacagaatatgatcacaaatgttgctgatgctgttctgttaggaggtagaaatagaatgcctaggactatgcaagcttgtcagagttagattgtcagggtgatgtgcttccatattaaaaagaatactttgttcccccctcacacatgcacccttgcagtggaaagaaacatttatttcagaataagcgcaagttattctgacttgcactcacaggctcagactttgatgccagtgtagttaaaatttagtgaataccagtcatgtttaatggtctttcccttctgtttaaaacagtactgcagcccatgcaagaaacatttccctttaattttatgcattttgtggtatcttttgatggtttttctctactgtcaaaactgtgagaataatttcaatggcatgttttttctgccatcttcagttggcagtcatatccccccagattgtcctcatagattccagatcacctttatgtttaatcttcattaattgacaagtacctttgaaagggttttgcaaaaattgaactgcaaagctgtgatttaatacaaggaaggctacatcagtgtgaaagaaagcactttatgaactgtagagtactatttaaaggtgaggcattataattaaatatgctcaggttgttactgagcattgaatgccaaagcatatgaaagacaacttacgatgccaggagtttgagactagcctaggcaacacagtgaggacccacctctacaaaatgtttttgttgttgttgttgttgttgttgtttttgagacggagtctcactctgttgcccaggctggagtgcagtggtgtgatctcggctcactgcaacctttgcctcccagattcaagcgattctcctgcctcagcctcccgagtagctgagattacaggaacccaccaccatgcccggctaatttttttttgtatttttagtagagacggggtttcacagtgttcgccaggatggtcttgatctcctgacctcgtgatccgcccgccgtggcctcccaaagtgctgggattacagtcgtgagccaccgcgcccagcctgtttgtttgtttgtttgtttgttttttaattggccaggcatggtgagatgtgcttatagtccagctactctggaggctgaggcgggaggatcgcttgagcccaggagtttgagattacagcaatgttatgagagtagctagaagttacaccaatgctgcaggagtttgggggaatccagagttgtaaaatgccaacaaaaattattaattaaggggatctcttagccgtctctttgaccctacaaaaaacatggtggtactgagttttttagcctcacccaagcaaaaacagaatagggcattgtatttcttatatctggatgcaaaaacatgaaatgttaattgtagattataagtcattaagtgtcacggatttatgttttatgacaagttggagtttacagatttctaggctatttttttcacatagagatacatgaaagctttattcttgttattcaacgtaaatcttttataatctgctctcaatttccagtatcctgaaaaatcctttttctctcttttttgagacccttccctccccctaccatccagagtcatgcagttaacagttctgatagtgcttggattcatttgtagattgtacataccaaatggagctggcacctcttcatggaaattggacccagtgggctattttacacttgccggatgtgctttcctcagtagaagtttatattttatagctgatactccattgaccatagtaacctgttataaaacatgatgttttatcatttgttctgtgtcttcagggctgaacattttatggagagactttattaacatttaaagagactttattaaccctagatattaacatggtttacctggaaattttttgagcaatgttttcatttgattcctggaatgttcaaatagcaaaggcagtttctgttggtgtgcatgtgtgtgtttgtggttaaaagccagcattacccagagaccttctggttcatgtggaaattattattattactatgattattgttatttttgcaaatgaataaattgtcattctgatttttttaacctcaacgttcctttaaaaacactgttgatttttatggagaaggttgatttcctggaagtaataatatgatgttagagattactttttaggcaatattttggcatgtttatcagataaatcaaacatcaaataaatagattatggggaatgatttttcagtaatctctttttgcagtttcttccctaaacaaaatgatgtggcctattaggtggattggtttggaggacaattgcttacagggaccctgtccttatggtgtggagaagcagaaaaaactcacagtactccagagtagcccccttattctttttcataaacttcaaactaggtatgaaagacctgtccactttaaagctttcgcctgtgaagataaagcagagattgatttttaaccactatgctcatatggggaaacagaatgcaggagctaagatttaaagaagcagatgggaagaagagaaataacctcctctggcatccacctggaaatgtctcctgagaaagaggatggacatcttctgatattcataagtcaaggaactgcttgaattctgtattccgtgtacagtattctacctatcaagaccctcacccagggaagaaagtcttgtttattcaggagatggggagcaggaggcattgaggactgcatagcttatttaaattaaaaaaaaaagtgcaatgaattgctttttagtgtatttacagagctgtgcagctatcaccacaataaattttagaacattttcatcacccctaaaggaaatcccatacccatcagcaatcacttcccattttcccccaatcctctaccctcagctcctggcaaccacgaagctgtttctctatatatagatttgcttgttctagacattccatataaatagaatcatgcaatatgcggacttctgtgactgacttctttcacttagcataatgctttcaaggatcatccacatttcagcatacatcagtcattcatttcttgttatgatggaataatgtaacattgtatggctataccttattttgtttattcatttatcagttgatggacatttgggttgtctccactctttcactattatgaacagtgctgctatgaacattcctttccaagtttttgtgtagacatagtttcatttctctgtgcagcctacttttaggtagttacaaattaagattgtaagtgatttttttttcattttacacatttgttcgcttcacgatggcctcctctctcttcttacctatctcactctcccaaaaatgatttttcttgagaacatagttgtagaagggtaagaatatcaaccaacttttgctaagtatgaatgcccaggcgctctgctaagcatcatgtatgtgttacaatgtttctcactttatagacgggggctgaggtttagagaggctgctaagcctggaggtcattcagctgaaaaggtagaagagctgggatttggacccacatcctgtttactcagcaaggtccatgctgtctgttgactccctcatgatatgatcccagatcatacacctgttgaaatcttagagaattctctttctattcgtgagcttctcccaattgtatcctaaaaagtaaggaatataaatcagatgctccgtcctaagcccttggacctggagcgggcatttgtgttccccgttgacaaaaagatgatgaaatacttcctctgtgtctgagtgcagcggcgtcatggaccggtgttaagtttaacctgacccttctctctgccctgcagttgcttcatctcctcaccttaagacttcacctttccttcatttcagcttcccagagatactgccacaccccggacctgtgtatcaacttgaaccctcacaccccccaacttggacctttctaaatcttaaaatctcagactctgtagttctctctgggcatagcctcctgacccccttgctttccctctcttcctcagaactcagttgtctccttattgtgagccctgactcatcccccactcttggtcactatagccactttcttcaggctccgtattcctgccccctaaccagcctagacctcatggcttgaaagtttaactgtgcatgcccaatagcttagtgccatgcattcctttccaggcaccaatcctgcatgatccccatcacctgcacagctgcttagaggcccccaaacccaactgatgggtcctgatgtaaattcttactgttaatctgaggagagtcatcattgcttttctagtgggctcatagtcacatttcttatgggatctattccaaacttttccagtctcttcaaaacttaccctcaccctcactttggtagaggaccatttattcatcttgcttttttaaaatcttgaagaatccaggcatgaatccttctactctctttttccctttaattctgtccgttgctcctgtctcacagttgcagacaagtgttgcatgctgtgctcacgcatcccagaggagcaagaagacctcccactccgcaaggctccaagacccctcgttttctggatccctctctaccctgacttctctgaggctttgtcacctaggttatctccctctcctgcttgatctttcattatcttcatcttaaccaaaaccttctcttcagtctatgaatgtgcctagtggtgtggcctgtcttttaaaaactaaaggagcccttattttgaccttgttctcctcaggcaatttccatttctctattctttctttaacctcaacatgttttgaaaacatagtctgtgttctattcatccagattattaccacccactgaagtcttagtcaccagttcttctctgtcatccaagcactggaaacttctcggcccaatgtcttcactggcctaagatggactcaaactagtaagcttttattcagtggttactcctagacctctgggctgtatttcctacggtggctgctgccagccatttcatttcttttcttttctttttcttttgtttcttttcttttctttttcctttcctttcctttcctttcctctcctctcctctcctctcctctcctctccttttctttcttttcttttcttctccttccccttccccattccccttctttcttctttcttcttcttctttttttttttttttgagacaagatctagctctgttgcccaggctggagtacagtggggtgatcttggctcactgcaacctctgcctcccgggctcaagtgatcttcccatctcagcctcccaaatagctgggactacaggtgcaggccaccacacctggctaatttttgtattttttgtagaggcagggttttgctgtgttgcccaggctggtctccaactctgagctcaagcaatccgcctgcctcggcctcccaaagtgctgggattacaggtgtgagccactgcatcagcctatttgtttctgaaaacactctttatctgcctttattttctcttaccctctactgctctgatcatttcttctttatgtcttccttcttttgtcccttttcgtacttattcttaaaagtagattctgcctaagtgtgtataaccacttttcttccttgtttacatcttccaggtcctgagggagtgttgtgacttggttacagcctaccttcctaaccttactcattgcagcccaggcttccccataattatatacatgttcctctcacacctcaagctcccttggttttctgcttctgttgcatctctggtttctttcacctaggatcatcctcctgcctcccctctctgcatttctatatattcttttccaggaccacatcaaattctgtgttctccttatgacataatctcaaatgaccccaggaagttatcttttttttggtccacatttttaatgggacctttcttacttttacttggttttcaaattatttgttgaaacacatttcttttaaactatgtactcatgagacagtatattgagaatttaacccctgtccttaaacacagtaaatattgtgtcaatgtttgctaaatgaaaggagtgaaaagtatggctctatgggaacttgttggtgaatgtcccatttttatttaccaatgaagaaaagcaaaacttagcaaaatgtatctgtggagaggtgggtgggagagggttgttgtatagtctgaaccaaaataattaactcctgtaattgcaaaaatattatcattgctcagtgcaccattttgcagttaatcagatagttttagggaaatattaaatgattctcaagcttggaaaatagcaatgagtgttatggcatcactatacagcccagaatgaactcatggatcctccaatctcttgtatcagatatactgcatactggatacccaaggcatcagggattcagagaaatttttccgaaggtcatctgggtaggaagcctgacttttatagaatatttcataaaattctttttattttatttttcaatagtttctctacattgtatacaaagcacactaattactcactcccattgtctccactaattacatcactcccattttgttctcctatgaacaaagaagaaaggaacaagaggttgttttttcattttgaagaggcaaggttgatatgtttgactaaaataaagttgggattacctgtgaatttcagccagctttgccctccggtccatcaggtggacagtggaaaattgactgtgatgctaaaaatggtcataattgggggaaagtaagctttaccacctcttttgtgatgctgaatgtgtcttcaagggaatcaaaaaagttgtgcttgacaggcaaggtgaaaaacccagggatttgctacaagaatctctgcaggagtggtagaatgagaagcttcattggagtctgggacattttagtgttgctggcccattaccctgaacactcttctaacctcctccaagacgggtgtctgagaggagctgggccctgcagaccaattctagtcttctctctccacccctgccccctttagaacaagcatattaaaggaatgtctgatgagctcactatagtctttgtcaggacattttattttttatttttttatttttatttttgaggtggagtttcgctcttgctatccaaactggagtgcaatggtgtgatctcggtgcactgcaacctccgcctccccgtttaaacgattctcctgcctcagcctcccgagtagctgggattacaagcacctgccaccatgcccagcaaatttttgtatttttagtagagacggggtttcaccatgttggccaggctggtctccagctcctgtcaggacatttttacagctgttttcgttctaaccctaactgatgaccattggaagacctaaaaattcagctacgcagaataagtaaaattggtctttttctttgcatcctgaggataaatctaaacaaacccctctcgttggcatatctccagctacaacagagggcaaatttgaatggattatgaagattgaattatccacttggtcttggaggtggtcccgtctcctgtgatggtggggtggggaggcggtgcagacatgtgtacaggaagcttagccaaatgcctctatttgggaaaagttgaaatcagtttcctgggcagtcaattttgagggtttaaaaaactttattttttttttattaaacatactaaaaataacaaagctatccaaaattagaccacgtactttgctccttttatatttcagtgtccttggtatgcttggtttcttttctttctttttgaagcattaatattgttttgaattgctagatatacagaaggtacgatagatgtacaaggaaaaataagcatctctcttatttctgtgtctaagtcacttgaattctcacctagaagcaagtaccattatcattttcttgtgagtccttttaaggatattttatgattatataagcaaaaatataggttttttaaaacaatgtttacaccccatacactattctgccctttacctcttttcacctaacagtgtgtcctggaaaacctttcttatcggaacatagaacagccttattcttttttagtatctaaatagtattcgattgtatgattttgccataaagtattcagtcccacattgatggactttttttttttttttggttgtttccagtcacttgctactatgaacaatgcttcagtgaacaactctctataaatagcatgttgtatgtcagcaaggatctctggaggagaaattactaaaggggaattgttggatcaaaaggaatatgcagttttaattttggtaaaccttgccaaattgccctccaatttggcattcgtcctattgtatgttcctgctagcactgtttgagtgtgcttttctccacagacgatgtttttaaacttcacgatctttgccaatctgagaggtgaaaactactatattctagtagctttaatatgggtttctgttattatagtggtggttgaatatactttcatatgtttaaaagccgttcctattttcttttctgggaaatgtatattcatcctcgttgcccatttttctactacgtttttggtttatcctgtgaattgacttttttttttaggagcatgtaacagctaaaaagattagtccttttgtcttatgctattttagtttaaatttttccgtttgtcttttgactttatgttttcttcatgcagggttttaaaaaattaaagtcatcttatttatcagatttttattttttggcttttaatttttttacatacttaggtctcttctacgcagtaattataatttttaaattgtctcgtattttttattagtattttaaaaataatagttttggccaggcacaatggttcatgcctgtaatcccagcactttgggaggccaaggcgagagcatcacttgaggccaggagttagagaccagtctggacaacacagggagaccctgtttttacataataataataataaatagccaaacatggtggcgcacgcctgtttgtactcgggaggctgaggtggaaggattgtttgagcccaggagtttgagactgcagtgagttatggtcgtgctactacactccagcctgggtgacagagtgagaccctgtctctaaaagaaaataaaaattaaaaaggttttattgagatatgattcatatatcgtaaaacttaccttttttttttcttttttttttttttttttgacacaggatctcgctctgtcacccaggctggagtgcagtggtgcagtcacagcttactgcaacctggaactcctgggctcaagcagcctcctgccttagccttctaaagtgctaggattacaggtgtgagccactgtgcccagccacaatgcagtcttttaataaatgggtttttaatctattcatagaattatacaatcatcatcaaaacctaattttacattttcattactccaaaaagaaaacctttacccattaagcacccactcccccatttcctctaccttctggcccctggtatccacttaatctatgttttatctctatggatttgcctgtcctagacatctcatataaatggaaccatataatgtgtggccttacacaactgacttttccacttagcgtaatgttttcaaggttctttctcatatttttatgctttcattttttacgttcaaatctttggtcaccttgggatttattttagtgcaggatgtgaattagggatctatatttttttaggtggccgtccaattattggaagtccttcctcccactaaagtgcagtgacacccatatcattcactgaagtccagtattcatttggatcgacctcttttctgttgaccttgctaagtattcctgtgcccatgcacactgttttactttctaaggctttataatatttttaatatcggtatggtattcttttcttatttctttttatatcattgttatggccattctttcctgtttatttttccataggaacttcagaattagctttctaatttgtatttttgacatcatataagtttatagataaatatagaaagaattattctcttgatattgactttctattcaagaagaagatagacctttgcagttgttcctatctcctcctctgtccctcagtagtatttaacattcttctttatgtagatttgttttttttttttttttttttgaaatggggtttcactctgtttcccaggctaaagtgcagtggcacaatcttggctcactgaaacctctggctcccaggttcaagcgattcttgtgccttagcctccccagtaactgggactacaggtgtctgccaccacacctggctaatttttttgtatttttagtagagacggcgttttaccatgtttggttaggctggtctcgaactcctgacctcaagtgatctgcccacctcgccctcccaaagtgctggaataataggcctgagccactgcacccagccctctttatgtagatcttgcatatagtcctccttcagtttatccctaggcattttatatttttgttgttatttaaatatgggatacctttttactggttgtcctttagaaaggttattgatttttgtatattcttttgtttcagttaccctacagaattctctaattaataagttgttcaattgacttgctcagatcatagcatttataaataataatttttctgcctgttataatttttatatcccttatttatttctcttatgcagttaaattggctaagtttaacagatcagtgttaaataacagagatgatggtagacatcctcatgttgttcctatttttaatgggatgcttctcatgttcccccattaacagtgagcctgcctttggggtggagcctgtttattgtccatttggcgtttgtagggcttttataatgagtagaaaacgttttggaaatgctgaatctgacggaattatttgcagaaaggtaaagtatgctgtgttagttctcccgcagtgataaaatagtagtctgatttttcttaccagcattgacaggagtttatgagtgggaagtctgtgctataaaggaagaaggcagcaattgtattttaatctcatgctatttttcttttgccaacgaagtaaaaagactaagaagctataggaatatgtagtaaaggcttttgctaagagagaaaaggaagaaaggtggaagaatgggatggaagaaacgagataaaagtatacctcattttcctcagcgtccccccagatcaagtcacctgataaaccaaatattactagggtagtttttttccccaaaatattattaccaaaaaatgacacaaaacactaattgtcaaccaaaatgataaagagtctccgaaaaggcttgcaagaaaatagtgaaatattttatcatttgtaagcaaaagataataatacagagttccaaatactgagaaaccacaagaggaaaaagaatgcctattgaaacatgtttatatgttgattctttttgatggtgccattaaagaaaaaagaatgttttgatctcttgcaaagaaagccaaactagagaggtattttatgagctaaccccaaacctgacattactctagtaataaataccaggacaggctgtcccttgcattagcagaactggaaaacaaaacaaaagacagtaacaattgaggctttgatgcttgttggaaacatctaacatacagagttagtgtgttgtggtcataaacaaaaggagtttaggctgactccataaattagggaaactgatgcgtcctgttgcttgggacacactacacaattatctgcatgacaggcaggaaagaaagcactggaaggcaaacagactgcagaacaatgtggccacccagttggttttagacacacacacccctggcctgcagaggtgtctatttgacagccggtctcatgtcaaaactttcttttatgtgattttccgattgtaggaaccactgggctctgggtgggtgtcttaggcgagtctgccttagtgttgagtttgacatatggtagcattgttaggtggtgtgtttaggagaagccaaccagggcctcagagccaaaagcatggagctcactggctgtgtgaacttgaccaagctactgaacttttctgagcctagtttgtcatctgcaagtaatgcctacagttcacggcttttgtatgtacttatgagatgttgtacatctagcacctcacatggggcttgtagagagcagttgctcaggcagtgtttgtaagtggagcacaggaagcaagggatggaaagagtatcacatcaggaccaaggatgaaggagtgtttgtaggaaagacctccgagatgatggttgagatggattatgtacaataaacaggaagcatgttcttgggaagtgcttctaagcatagaagggcagcattttcaaaggcatgggtgtggaggaatctttgaaacccagggaactgtagtagagcatggctcagtcccagggtatgagatggggagtttcactcattgagacaggacagatgagccagcgtgggattgagtggggactcgtgtatcctgttcagactatagtcacgatgatggagagtcgttaaaggctgtagacatggccaggcatagtggctcatgcttgtaatctcagcactttgggaggctgaggcgggtgcatcacctgaggtcaggagttcgagaccagcctagccaacatggtgaaaccctatctctactaaaaatacaaaaaaattagccgggcgtggtggcatgtgcctgtaatcccagcactttgggacgctgaggtgggtgcatcacctgaggtcaggagttcgagactagcctggccaacatggtgaaaccccatctctactaaaaatacaaaaaaattagccgggcgtggtggcgggcgcctgtaatctcagctactcaggaggctgaggcaggagaattgcttgaatctgggagctggaggttgcagtgagccaagaccgcaccattgcactccagcctgggcgacaagaaccaaactccatctcaaaaaataaaaaagctgtagacatgagggacagcatttcatttgcattttggaaatgtgacagtaatgtctctcgggtgggtttagagattggggaggaaatgagctctggcccagggtaatgatttcttccatattttccacaaatcttagcacagggctaaacgcatagtagatttttagggaaaacctcttgatggccttgaacaaaagttattgttttgccaggatcatcttttccatgaatcacttgttataccattagtagattattcttgtgtggagttgatcattttagcccccaaattatttttgtccctcgattacatcatcttaaacgattgtgtgttgtggcatagacatatcctaatctacttacaatttatggtgcaagtatctgtgtcataaaagatatcttcttctttaaaatatgctagcctagcactccatgaaaatggagactcacagtgctgccctgtccttcaaagatgtttatgtacaaagggataactgttcccacccctaaatgctttaggctttgcctatactgcctttcaaagctttccctattttaagattttttgaggccccttggatctctggaaggagaaagctataatagcttttggtttctgattgtctttaagcagagaaaactcacagtctcatttaggggcgtgacacattcctagtagggatggtcagtcccaggcaatagctgtggccatgggctgttgagggccatggtgagggcccatgcggtaacagacagtggtatgcatgctggactggggtgagtaaatagccattattcagaaccacggattctattttcaatcagtctgtcaactgatatttttgagagtctgccatgtaccaagcagagtgctaagttctgaagatactaaggtagacaagataaaaatggcccctacccacatggcactacattatagttattataggagagtggatagaacatatctagtcaattaccgtgcactgagaaaggtactgtgagacggaaatacaaagtatggtggaagcatcctggagtgacaactgaccctcacttggaaggccatgcaggacttccatgagggtcaagagtttcctgaacccggacaggagcaagatctaccttagagaggtttggggtgaaataacgccatgaaagggatagtctttaatctagaaggaaaaatggagtattacacatttgtaataagtgttcgagatagcctttgagtcatacagtatttggaatgtatgcttggctgtcagtgatcttataagacccaaaccacagttttctttatgctgtgtcctggcgctgccaatggccagctggaagggccatggcagggtagccacgtagagaggccacctcctagaggcgcatagcctgaacgaaagcggaatttgaacaacacctccgaaaagattggaaagtcatggtatctgtgcgattgcccacaaggaggtctcctgaagtcgaagccctttggttctctggcgttttaatgatttgctattctgtcatcggaaatacgtggagcagccacatccttagacagaagaggcccagccacgttgctctggagtagaatttagtatgagtgtgagtggaagttaaacagatgtggaagcgcagagtgcagctgaacatcattgacatggaccagcaggtaaacagacttcaaggtgatacacccccgtaaggcaatgttctggccagctccgccagtcaaggctgtacagcggatagtaattatttctgtcacagcgaagatagatgctggatgtgggcagatgggggtagacttgtgaaaagtgtgagtatctttgagtatcttttataaatttagtgagtggagtggcaacccacctacacttctaatttttgctgttggaagctatgtccagaaaagagaagagaaatttctctacctgataaattacaccttattcaaaacacactgtgtgaatgaaggtgctgcttcgtcttctctctgctaacgtaacgttgtgcacaatattttttcttttgaagcagcagaaggacattttaatagaaaaatacctttactcctgttaaaggagtatcttggagttcttcacctgtctttatgggggacactccccactacatggcttcataaggatttagggatgacttgctcattagacatagagtgagctggttagaaagacaagtgtgagttggggtacagtggcatagaatgtttaaaatattgagcaatttaggatccttattctggactttaattgtttctagagccagcctctccacgtgtgagtagcatctttgagtggcaagaaaaccattctgggttgtcattgagagcatgtgtccttggagagtgccttagcagtacctcctgtgtcctcccacgacacatatccacctatgcacacgtccaccatcctatacgcacacaggtgcatcttgcagtttcacagcccgagcacagccagagagaaatgactaacatagacttgatttttcgatttaaagacgctcctctttttgctcttcctcttgaatatgacttttcttttccttattttcagtgttttcaagggaaatgtcaaattttcagacccgtaacttctgctagaatcacagaccattagggactgtagagatctaacatgcccagctggaagcgccacagcaggatagctgtgtagagacgtgcagcaggcattcagaaaaacagatctgcatcttggaaagagaggtcagggctcgacttgtggatttcagagtcactcacttagaagcagtagacatagtacacatctaatgaaagcattcccctgctcggaaatcttcagaagtccctcagattttacagaatcaactcaaattactcagcaagacctttgacaccctccaccatgtaacctcttctttcctcctctcccacttctgtctccccacacacatacacctccaaccgcaatggtctcttgaacatattagcacacgtttcttcccactttttctcaagctgttttatttctttagcattagctcagattccacttccttctggaatctttctttcatgaattcagatcgtgaaagaccaaagggaatgttggggcctgtcatgaattagaaaatatattctctgttttcaccaatcacaagtcttgtatgacttgcctagaatagcttcctttatgtgttctaagggatatgggagcccgtctagactggcctccttcacagcgctgggatccgttctgcaaacccatcacagaaatacatgtggcttcttcctgcagtaaaatatgtaggaacttatccaagatttttctttttattcttcatttatgttattttatctccagtgttatgtctccaaggatgttaggttgaattatcccctctgaaaagccatactagtttttgaattaggatgcagtgattctaacttcaggtccactgtcaactcattagtttatttaggcaagttgcataacctctgccttaatttatcatctgtaaaatggggctaggagtaactcatgatttttataaggaaaaataagacctgaagttaaaacattttggaaaatgttttcaaatatggaatacaaacatgaggtgatattattgctaccatattgcttatagtcaagaaaaaaacttaatcctttttgataatctaatacagactgtgtcatactatatgttgcaaaaaatgtatagaacttgacattcgaagagatgagtattttggctctgtggtttattagctgtgtgtccatggctgacttacctaacctttttgagcttcagtttcttttctataaattgggaataattatgttactatttattagggttgttaagtaattatattctgcaactattatgcatgaaaggcacttttaaaactacagaagagcatagtcaacagtaaccatcatggtctcacttatggcctaataattatgcctactgtagaaatagatcaaaatgtatttggattcccttttctaggataccctctcagattgtcccaaatatacaagggatgaaagaagaaggaacaagtgtgggctgaatatgcagaagaggatggaaagttgacaggagcatgtggttggaagaggccatgttgacatgcagattgtgtgatagccacattgccagagctgagagggtgcaggagggaaggcaagagggaagccttggtatccatgtaaaaccagtgaccacttgctagggtgtgtccataagcattgcatgcctattctttttttttttttttttttgtattttatttatttattttactttaagttctggggtacatatgtagaacatgcaggtctgttgcataggtatacatgtgttctggtggtttgctgcacctattaacctgtcatctaggttccctcccctccccaccccagtccccaacagaccccggtgtgtgttgttccccttcctgtgtccatgtgttctcatttttcaactcccacttatgagtgagaatggcatgcctattcctttttttttttttttttttttgagacagagtttcgctcttgttgcccaggctggagtgcaatggtgcgatctcggctcaccacaatctttgctcctgagttcaagttattctactgcctgagcctcctgagtagctgggattacgggcatgcacctccatgccctgctaattttgcatttttagtagagacggggtttcaccatgttggtcaggctggtctcgaactcccagcctcaggtgatccgcccatctctgcctcccaaagtgctgggattacaggcgtaagccgctgcacctggccagcatgcctattcttgaatgtgccctttaagcagtagtggacaacctggggcatcggtggtatcctctgtgggacaacagacacctatatgggagctggttccgcttccctcacttatggctttttacagccatgtgccgcataacgacatttgggtcaacagtgggtcacatatatcatgatagtcccataagattataatgaagctgaagaatttttatcgcctagtaatgttgtagccattgtaatgtcctagtgcaactcattactcatatgtttgctgtgatgctgcaaccctactgtgctgccagtcatgtaagagtagagcacatgcaattcggtacagcacataatgcttgataatggtaataaacaactgttattggtttatgcacttactatactatacttttgatcattgttttagactgtatttcttctacttatttaaaaaaaaaaaagttaactgcaaaccaacttcaggcaggtccttccatagatgtgtaagaagaaggcactgttgtcataggagatgacaggtccatgtgtgttattgccctgaagacctctcagtgggacaagatgtggaggtagaggtgatatgaatgatcctgaccctgtataggcctagactaatgcgtgtttgtttcttagtattttattttgtttgctatttatgtatttatttatttattgagacagccttactttgtcgcccaggctggagtgcagtggtgcaatctctgctcactgcaacctctgcctcctgggttcaagccattctcctgcctcagcctcctgagtagctgggattacaggcatgcaccaccacgccggctaatttttgtatttttagcagagacggagttttactctgttggtcaggctggtctcaaactcctggcctcaagcaatccacccgcctcggcctcccaaagtgctgggattacaggtgtgcaccactgctcctgccttagtattgttttaaaaaaaaaagtttaaaattttttaaaaatgaaaatagaaaaatgtttattgaataaagatataaaagaagaaaatattttcgtacaactttaaagtggatgatgttttaagctaagtattattacaagagtcgaaaagttttaaataatgtgtttataaagtaaaaaagttacagtaagctaagtttaatttattattgaagaaagaaatttcaaaaataaatttggtgcagcctaagtgtatacagtgtttataaagtctgcagtagtgtacagtaatgtcctaggccttcacattcgctcaccacccactcactgactcacccagagcaacttccaatcctgcaagctccattcatgggaagtgccctatacaggtgtaccatattttatcttttctgcttcattttgactgtatcttttctatatttaggtatgtttgaatgcacaaatacttaccattgtaatacatttgcctgcagtattcagtacagtatcatgcagtgtaggtttgtagccgggaagcaatacattgtaccatgtagcctagatgtgtagtaggctgtcccatctaggtttgtgtgagtagactctacgatgttcacacaacagaatcacgtgaagatgcatttctcagagcatagcccaccgctacccaacacatgcctgtaggtgaggatgaggaggtatctgtgttaaactgtgtcccccaccaaaatgttgacaggctaaacctcccagtgtccatgaacaatggctttatttggaaggagattttgcatatgaccaagttcagatgaggttattagagtgggctctaatctgatatgactcatctccttgtaaaaaggggaaacttgggctcagagatagcctccctctgaggctattaccgtgtaaagactggagttatgctgcccaaagccaagaaacaccaaagatatccggaaagccaccagaagctgggagaggggcatggaacagattctcctttgcacctcctggaaggaaccagccctgcagacaccttgatctcggatttctagcctccaggactgtaagacaatgcatttctattgttgaagccccccagtctgtggtactgtgttattgcaaccccaggaaactaacacaggcaggtagaccatccacacacaccaccgcttctctctgacgcctggtgcacagcttgggtcttgtggtgagactccacatggtaggcatttgctggcggtggatgttaaaaatgacaagatttcctctggtttgacttttgaaagcaggtgcattgaaagccaaatctcagggtttggggttggtttagaatgggatttctgaaacattctaattgtctcattgccatcacctccccaaatactgtatctttatgtgcatttggaaggaaaaggagtgcaattgaacagtatatttccgtctgttaggcaaaaccttttatttgcttcttatttttccaggcttggacactttcgtgagaatatttgcagttctgttgtaagtccacttcggtcagggatttggcaagtccacaacaaagagagggaatgtttcttttcccttttcccactttccttgggcttgcctgttctttctctgaaagatgctagaacttccccaaggggagggcctgcctttttcctccttgggaaatgttgatttatattatatgaaacatttgtttttcatagaaacttccatttcagcatgttgaaatagttggttctaatttttatgtgaaaaataaataaacttgtcgtggcaatactctcagggtacagttacataataactatgtatgcctccccaccactcattaacataggagatctcacctcacggaagtcatctcatagtctaagctttatggcttctaacagcttttacgaaactccatgaaaataccttaaacataactgttacaagttgaaagtcaaccctttttataagtatgtcagaagtaattatatcttgtagtagcaatttcatatctctacttatagttgggacaattaaggctcagaaaaatggcaaagctgagattaaaattcaggattttctgatttctagccaatgtcatgctcattttctgtgttaattttatggctcagggtccagttaaaaacgtctgaagggagtggtaagtacaagagagatgggagttgggggtggggcttgaaggagagcacacctggccccaggtgacaagactgggctccagccctgcctcatcacagttggacatgatggccctgggtcatttgacttttgaggacctcaggaaaatgagggagcttaaaaaattctatggttcctaatgaaatacttagggatgaaattacagttctgggatttgcttgaagacacaatcagccatggtttgtcactgttgatgctgagtaatggatatttggtgttctattgtgagtctttggtacatgtttggaattttccatgaaaaaaccttctgcttctaaaatgcacaccttgattcttcccatcgccctcctactggctggtcctgtgcagctcactcatttctcaggaacagcagcagactcactactctgaaggaaagaaagccctttgctttggtctgttcctaatgtacatattattagagacttttccgacaccctccccattttttatttcttaacagctaatacgatagctgtgctttcataataaattcaaaagctgctctctatttctcaccagtttgaattgtagaaaagagtacaaaagattagagtactttaaaataaatctcagctaattatacatacaactgcattcactaaatgtgaatattttcaggctttctttgctaccaagtgccacctgctcatgatttaaatgggcacaaatttagttccattaaacaaaatgcagcaactcttctcctatagcgcaaactcctttaggtcctattttgaaactgagaagctaattccagtgttctcttgttagctctcggtccatgtcaaccaccccacaaggttgtttacttgaatagtttgcagccttgctttaaaagttctagtaggcaaataggtttgttgatgatgaagtggtttgtgttttataagagtccttatggtctagatggcatttgaacttgtggttccagtgattaccaggaccctgaattgaagaatacatgctgtggccttttcagctcaggaaactttttactttctattgccaaaaaaaaaaaagacaagaaatccttcctcaaaatgttatgtgttcttagcccatacaactgtctccccagaagtcactggactcaaacctccactttgctacttgaacatattaaggtcatttaaggagaattcattcatctcctattaatctggaacattcatgatcgctgtaagaccaaagaggacattttggggggtaataagaaagttaaagctgccttcaaatcaaacgtgaattatgaaactcttttccaagaagcttctattagtggcctcatcagctatgtttcaagaaaggaagttgaaaaaaaatcccacaacatggaatgcgtatttgccatgctcttagaaaaatggtttccttgcgaagactcctttgtctctacatacctggacctgaagaccttggtgttgttttataaccctggaagcctggctgtgatcatctattaaggaaggagaaggaagctgcttatctgtcctgaaagtcttatttctactcatcttctcgcctccttccacaccacctccccacctacacacacccttgccctaaattcctttccattttgtcctttcgaaaactcctccctcccttagaaaagctaaaaataatggtaatactttccagtgatcctcccttattaggatctcagatgcaagctgcaggcaaggaggaaagcctgcatggtcgctgctgctcacatctgcatggttacaaatcgtggctcactccagctctcatcttagatgttcatcctcacttgaatcccagtgccataacacgccaacgcgcctggaaaacacctgctgtctataggttgcaagcaccccacagcatcccagatgtagggtcatagactcagagaattgaatacacacccaaatcctctagctgtcattagggggagtttcacatgattgtagctacacccaggattttaagcccccaaaagttatttaggaaggattgcaggctcattcttgtgttcttaggagggtcccgacctgcggataaagacctagaggaagggggaggccttgaggcggagtcccccaagcagagccccaacttgtgtgtgatcctgcgccacaacttggccagccggcctggacagctggctctggttactgtgggaacaatgcaaggaaggccgttgtcacattcctctgaggtcaaaggcacaaccttcgtcacacactcagtccctgctggcaaagagaaagacgaggagcgtggaatcggagacctggagcatgcgagggacttgagaaattcaccaactcccttgttttactgattaggaaactgaggtgcagaggagagctatgacttgctcaggatggcacacccaggactggaattttctcttcatggtccaataccctgatgttcctctcatcatctccagtacttcagacttgatagtaaaaaaggattcttgataacattattatattttgttatgttttcccatgctgcaatcgagtctttaggttcgaagtgacaaccctgttacttttgttgcgagacccttgagtactcccaggacaaatctagccaacaaatagcatctttagtgaccctatgggaagtcattggcttctagccctaaacccagaggttagagttaatttttaagtgctcgcctttaactcaagcatgaagctctaaaagcatcaagtagtaatgcttgaaaacatctaaattcctctgagccctaggcatgcttaaactctctctctctctttttttttttttttttttttaggaaaatagctgaaatggtagtggttagaacacatgcaaacagaattactgaataaaattggtcacgtatcccctggtttaaggcatatttaggagttcaattcacatgtaattgatcattcttttttctcttggcatactttcctgtaagagtcttatgtgccctgcctttagcatatgtgcaagccgataaaggatgttcatttaaaatttttactattttaaaaatacacacagagggggaaaagacttgtcttatccccaaatgaaaagaattagaaataatacttttgcctgtaaacttctatcagttttcctgtcatgggaaagggaaccataaattactttttataaggaaagtggtggtgctagggccacatgtcccctcccgcacagaatgagaggtggtggtggctgcgggacggtgggaaggaatgagcgggacccaggccagagctcagctccctgggctttgcttgtctcgcattttgtaaactcaaatgtcccatcattcccaaaggccatttgtggacatgctgtgattttatgcatcaccttctggaaagaatgtgttccgttccctgtgaacttatccaggttgatacagtagttccccccaccccccatcttcggtgtcattttctgctgtttcaattacccacagtcaagcgtggtacaaaaacaggtgagtgccatgcaataagatattttgagagagagagagagacaccacattcacataacttttagtacagtataatgttatgattgttctattttattattagtttttgttgttaatctcttactgtgacttatttataaattaaactctatcatgggtgtatatgtataggaaaaaacatagtagatatacataaaggtactattcatggttttaggcgtccactggggtcttggaacagatcctccatggatgggaggacaactgtcttttgaatgtgtcagacacaattgtggcatttcttagtgtctttttcctactcgttagttgtatttggctgctgcaaacaccttgggctcccaagtagttgggaatgtggaaagctacatactttccctctagagagagccccagtgtgaaaaactaagatagccgtgtgtttgctgatccttgggacgagccagggaagggctccgggagcactgtgtgaattaaggctgtcaagaccaaagtaacataggagggagaagatgaaaatgcagcagcacgtctcttaatgtgatcgtttctctttccccttactgaagcatagtgctctctgctatttgaagagcgcaatttagatttatattaaggaatgaataaataggatgcggtgatgaaatctcatctggagtgaatgcagattgtggatgctaatgaccgtgtggctgtgcagagaacccattggaagcctgggcgcttctccctcctctgttcacccactaggcactcaagagcaactcaggcagtggggaaaaggttatctttttttaatgtctctcagtgttgcatcttgccttatagcgccttaaagcacttgacaagccttcaagtaattcttggtggtggcgttttcccccagaaggccttaagagatggttttaatagatacacctatcaatttattcccaacttgagcattttgctgtcttgcatcatttgacatcaccagaaagtcctttggttacttctgtagttcacattgtactttctgtcctttgagttttgggtgctcaggggcaagatgtcagaaatcctgagttttagttgtgccactgcgtagctttgaccaagtcactttacgttagcaggatacaatttccgtgttcattaaatgaggagactggactgaaagctcttagaggcctcctctagctcagacgttctgtaacactcagggctttctgcctcctctgatttggcggtgtcaggatacaggtccaagtgcggcactgtgccttgcaaaattgctctctctccctggccagcttttccaccactgtggaatgaagtctgccgcctggaagaatcccagatttctcaaaggcgtccagttctagggagcagcgtgcaaagcccttgagcacactttgacttcttctgccctggctggtgatgaaaaaccaggtcaccagaggttgccctgtttccagtgatcagccctcgggactgaaaaaggaacaaatacagaagagctccaaagaaagaaacagaaagagacgctcaagctgggaagctaagaacaggtccctctgctggggtggaaggagaaagaatcttaatcctctgccttcccccatgggtcagagtcgtaaatgggtgagacttgaaggtgtggttggtcaccctctctcaaagtttcagggctgggtcaggtgtcctagtagtgttgcgtggtgcagtagtgagtccccagcctgcattctgcaaagccccagaggctccccataaactttgaggctgtgggctgccctcagcctctattgaccggggcagcggggcagcttctccttcagctctgtgatattctgaggctatgtaaaatagttttcttagaaaggtcctgtggttaaaaaaaattttttttaaaccactggtttagttacgatgagctcatattcaaagcaatatgaccttagacaagtcatttgattttcccaaacctcattttccttatttcaaaacaagtttagtcatatattctcagcctgtctcccacagcaatttaaggattaattagagtcagttattcataccttcactctatgaacacggtattgaacacctttcagtagaaggctctgttgggagaggaactcataagtaaatacatgagacagccattccaagcagagggaaaaagcatgtgcaaatattttgtaaactgtaaaacacaacacaaacctaacattatgtaatattgctgttcttaaccaggcagtttaatatagtgactctagagcctaactccttggctttgaatcccaactgcagccatttatcagtgtgacttcaggcactttacctaccctcttgtgcctcagtactccaatctgtacaatgggaataataatagaactcatctcactgggctgttgggagagctgaatcagttccgggcgcagtggctcatgcctgtaatcccagcactctgggaggctgaggtgggtggatcacctgaggtcaggagttcgagaccatcctggccaacatggtgaaacccgtctctactaaaaatataaaaaattagccaggcgtggtggcacgcgcctgtagtcccagctacttgggaggctgaggcaggggaatcacttgaacccaggaggcggaggttgcattgagccgagatcatgctactgcactccagcctggtgacagaacaagattccgtctccaaaaataattataataataattaagagactgacacagagtaagcactctataatgtttattattggtgatttcaccaatgcactgtgaaattctgtttcttgattctcagcattgcagtcccctgtcattgcacttccagttttctcttccccagaagatgcatcccgtgttcgagcggaaaggcaagggaaacatcatgtcaagaaaagagttccgaacagtactctgtttctgtggcatggatcctctttcctctccttttctcctttttttgaggttggattggcactcctctcagacttaaacaaaggctttgctttgcagagaggatctttctgccttcggtgtgtcatctgcctctaagggtgtaatttgtttctgatgcatgcagggtgcccccttgagaaggctttgttgatgttgtgcagaggtgtcctgtattgatcggtgatagaactgttctatagtgggtgaatgaggtaattgtcatcaggttactctagtcggtgaccttgaggctgatccgatgactaagccacagaggtggatccctggttatagaatgtccttgtttaaaggtaaatcggtgtgagagtgactaatagttttaaagaaatgatggcaagcaaatggcatgccctttggtgagagacacagtctatatcaataagctctgaggccacccatatctgggtgagatattggggctgattttcaagggttcctttatctctctgctcctctcttatctcttttcattagattccaattctccataacttccatgaccgtgtataatacagtcactgccatgactgtgtataatatcgtcagtgtgaagttcagagcaaaatacataggcctctgagctagttggctgggtttcttttttcttttttaaaaaattcagcagtggggtgggacagagctgaagatgaaaagatgcttgatacaagagaagagagaaagcaagcgtcatgataaaatctgcatgcaaaaaaacccttgttataaaatgaaaagtggaatgaatcattagctatacatttaagctggatcaacacattagccctgtgattaagagtttctaaaacctacctgccagcatccctgctgttgctgaactggtcctttctgcatgggaatgggtagaagtctaaatgaacagacttagagtgggttggcaggtgaaggatagtgggggtaagtagtgaggagaggataggttagaatagttattttgggctgggcgcagtgactcatgcctgtaatcccagcactttgggaggccgaggcaggtggatcacctgaggtcaggagttcgagaccatcctggacaacatggtgaaaccctgtctctactgaaaaaacaagaattagccaggtgtggtggctcatgcctgtagtcccagctacttgggaggctgaggcgagaggattgcttgaacctgggaggcgtaggttgcagtgagccgagatagtgccattgcactccatcctgggtgacagagcgagactatctcaatcgcaaggacaaaaaaccaaacaccccatgttctcactcataggtgggaattgaacaatgagaacacatggacacaggaaggggaacatcacacaccggggcctgttgtggggtggggggaggggggaaggatagcattaggagatatacctaatgttaaatgacaagttaatgggtgcagcacgccaacctggcacatctatacatatgtaacaaacctgcatgttgtgcacatgtaccctaaaacttaaagtataattaaaaacaaaaaaaagattaaaaaaataaaaagaacaattattttggaatcattgaataacagtcagctctttgtatgttggtcaataaaagcaaacacctataatactgctctaagtgctttgtgctatattaaccctttaatcctcacaacttttgttatgtaaattttatatctgaaaacagtgaggttaagtgatttgcccaaggtcatttaaacccagatattggctctgccccggtgcccttaacacttatagcctctcactgtcctgggtggtgaaggtcttgagggcaaagagagaaaggaaattcctattttcagtggacatatttcttgtgccggtggaaggaatttaattattacaaggggtttcatcaagtgcactaatctgggaagttgccagcaagctgacctgggtttaagtgattctcctgctttgacctcccaagtagctgagattacaggcatctgccaccatgcctggctaatttttgtatttttagtagagatggggtatcaccatgatggccaggctggtctcaaactcctgacctcaggtgatccgcccaccttggcctcccaaagtgctggtattacaggtgtgagccaccgcacctggccaagacaccttttttagcttccaaatcgaagtctgtttttgcctgtatcatggttgtatttcagttagaacatcatttctttttttttttctttttttctttttttcttttttttgagacagagtttcactcttgttgcccagactggagtgcagtggtgcagtctcggctcactgcaacctctacctcctgggttcaagcgattctcctgccccagcctgccgactagcagggattacaggcacctgccaccacgtccagctaattttgcgtctttttagtagtgacagtgtttcactgtgctgaccaagcccatcttgaactcttgacctcaggtgatccatctgccccagcctcccaaagtgctgggattacatgcgtgagccaccgcgcccggccagaacatcccaatacataggcagccacttatgcactagagtccttctcggagggtgagcagagttggctctccctgtcggtggcatcacgttggcagaatacacacacttttatcctgtggcggttggcgaggccattgatttgctgcgtagaatagcaaggaaatactctagacaggtttaacatttgttattgctaatgaatttgtcaagcatcggaattcagggacggttgatgcacacttaaaatgctctgaaatagattttaccttttataaaagataataataatctcatgtttgaatcacaagaggtacgttttccttaaatcttttaattaactcctatttcaagaaaaacctcttatcaaaaaaaaaaaaaagattttacatttcctaaggccaagtaagagttgaaggtagaatgagtaaataaccaagtttatggaaattgtaaaataaatacatgtgttataaatgtgctatttaatgaaaatgtgtattgactagagcaataatgatgtatctttgaccatgataagtaccagtgctgaaatccatccaagccacaaaaatgattggagggtccatgtggaatataaagctctgcagagtctagagctcatatcctatatggctttttgctaattaataaacattggccttttgtctattatttaatagcctaattgcattgcacattgcagtagcacattgcaatagcacattggcaaaagtgctgcctttcactgctaaggggggcagttttctgtaaaagaggttaaaaggagaaatcagaagcctaatttttgttaaatgagatgtcccccaaaagtcagatacatgcatatttgggctaaataaatctttcctgggaaactcttctatgactgggcagagttgttcacgagagactttccccccaacattttattaggaaaaattgcaaacatacaagtaaattgtaagaattgtacagtgaacacccataaacttgccacctagattttgcaaataatattttgctatatttgctttgtcaggtatcaagccatctgtccatcctgcagtccatcatgttttagttgatgcccttcaagactagttattgtgtatcattactcaatcaaaataaaatattggctttagttcttgcttttaggtaaattttattttattttattattactattattattattattgttgagacagggtctcactctgtcgcccaggttggagtgcagtggtacgatctcagctcactgcagactggaccttcggggcttaagcaatcctcccatcttagccccctgagtagctgggactacaggcataggctaccacatccagctaatttggtttttggtttttggtttttttttggtagagtcagggttttgccaggctggtgtcaaacttctgggctcaagtgatccaccctctttggccccacaaagtgctgggattacaggcgtgagccaaccatgcctggccagaaaaacccaaattgagggacagtccacaaaatgattagtctgtactccttaaaattggcagattgtcacttttatcacatcatatgtgacctatcatgggctgttgatcttgatgacctcagccgaggttgtgtcagggtttgtcaactttaaagttactctttgtacacagacacactcacacacacccttttccatactgtactactcgttggaaggaagtcactgtgcacagcccacacttaaggggtgggcagttacgctctacctttacaagggcagaacatctgcatgaattatttagaactcctttgctcaagagatgcgtgttttcttcctcttttaaaatttatttatatcaatatgaactcatgggtgtttattttattctttaggttctaatccagtactatgttgtttattttgttgctctggttgttttagttctggccattggcagctctttgagaaatattaggaatattgtctcttgtcccccttttatatgcccccatcactgtggggtattgatttatctatttagcattttcccactttctgatactacaagatgctccatgctcatcttggatattccctgtcacagtactagaatcagccatttctccaaagacccctggtttgttttattggagaatggtgttaggaactaagttctgggtgctggggcttgcagaaattttatgcccaacacatattagctccccctcttccttttgtgggagtttggtgtgtgcagtagtgagtgccctgtgaaatcttcatgctacagattgactttagtccctcactgatcctagttcacttcaggaggagcctagctcactgtggcagactagacagaaggcagcccagccagtcaactcaacagatttcatttattcagctcaatccaagtcagacttggtgctgtgcttattcctgtgggcagatgccctgccctcacagacccctgccctctagaatcaaatgacaggacagtaacagagaagtgctgtagaaaatcagaatacagaagggctggtgcgacctagcctaagagcattcaaagaaagctgtttatacaagagcagacttaggaaggtttattccagatgaggaggctagaagcaaagacatggaagtgggaacagatagtctcttaaatatctatggataagaagaaagccgaaaataatgaaggactttgcttcttgggtttattttaggtaggaagtagggtttactgatcttggtgggatgaggaaatggaccagtggtgtagtggagccagcttgcacttttatgagccaagtgttaaatgttcagaaatttggggagcatgttgacatcatgttattaccttgaaattggccatggtgggagtgtttacactacagaagtctgcaaatgctacacatcaggggtcctctctcccctcccacttttattaaacatttctgcacacaccactggcttcagctgtctaaatatctagtatgtacccttaccctgaatttatttttttttcctctagtagtctttttcaggtacacatttttatttggtgctttgaattctctaacaaaactgtcaaaaaatggttacagtagagatgtgtgcccctgattgaaaactgcattttactgcatattggttaaaactcttaacggtcagaaaattttttggttaactgggttatttgggaccctctaatggccattctcaataactgagttggaaaagtgcatgattcaaatgtactaaaccattacccagccttctactttattttggcagcatggggaaacctgttgtcacctgaaggtagtcatcagtgtcatatatatgtggtcataggatttatggttgggctggcttggaggtatcttctgattcttaccaagaatataggaaaaaacgatatcattttctttcagctgagaaaccatgactcaacgttattctgcttgtagtaggcaatgcaaccctgtatcagtttgacttttgcaaggatgatacctgagtaatccagggaatagtgctatgcaaatagggacagtttccatgaagtcacctcttgtgcatggtatatggtgttaagtgttatgccgaattagactcagagcagcttacatttcaaacgagtcacctaaaagcagttatatgcgtgacgaaggagaatggttagggaaagaagaagacttctcttactcataactggagattgtgagttttcactgtgatcctgaaagataggttggctttgccttaattacagggatttcttttacctctttgccctttcctatgtccctccatcaggtatggtaaattttcctagcttttgttcctattagtgactttactcctgatccactgccaaattgggtctctgaggttgtaaaactcagaaaaggatattgcaagcattctggccatattacaaatctcatgtgagagctcactctgaatcaaaggagctctcacattcttttttagtccaagtgattcctagatgtggaagccgatttcctggaacactcaaacgaggtcacagttcatcagctgcctcccataaaccaaccctctcaagtttcaactctcatttgaaacttcttgggatatcttgatccaaacagatcacctgaaaagctcccttataaggtcaagtgatcacaggggtcttcttcttcttcttctttttattgtgataaaattcatcatttttcccatttttaagtgtacagttcagtggcattaagtacattcacattatattgcagtcatcaccacgatccatcttcagaacgttttcatcttcccaaagcaaaactgcatatccatgttgtagcatgtgtcagaatctccttcctctttagggctgaataatattgcacatatgtatcacattttgtatctattcatccattgatggacacttaggttgcttccactttaggttattgtgaattatgtggctatgaacactggtatacaaatatctgttcaagtgcctcctttcagtttttttgggtatatacctagaagtggaattggtgaatcatgtagtattttttaaattttttgaggaaccatcatggtatttttcacagcagctgtaccattttgcatttctatcagtaatgtacacagagttccaatttgtccacatccttgccaacatttgttattttcttgttttgggggttgttttttttgttgttaatcagagccatcttaatgtgagtgaaatggtatgtcattgtggttttgatttgcattttcctaatgattagtgatgttgagtgtcttttcgtgtgcttaatggtcatttgcatattttctttgaagaaatgtcaattcaagtcctttgcccattttttaatcaaggtatttgttttttgttgttgctcaagagtcttcttgcatgcctagatagtacactacttcaagaggctatttagcatttatctggggttccatggggcagcctgttccctttgcacatatgtaatgcagagatgaatatgtagagacttaccactggaaaactgcacctggaattctcagatttgcccatatctgcttatcatggacgaggttcagtggtggatgctgcagaatataccaccgactgcttttggctactgtgtgacattgtcatctaacttttcactaagaaaaataatctctttagaggaaaggaaggaagttgagagtccatcttataatttttcagtgtaataatattctagaccaggtattgacaaactggaccatgggccaaatatcaccccagcctgtttctgtaaattaagttttattggaacaccgacatgcctgtttgtatgagtatcttcaattgctgcttttgcacgacaatgacagattgagtagttgcaatggagatgtctggcccacacagcctaaagcatttgctccctggtcctttatagaaaaagtttgccaacctttggctgttctaggtgtttaagaaatactatttttagaaccgtatatataatgtagtgatgttgactgcaagctattcactttgaaaacaataaagcttatgtagtagatattactgttttaagtatttactgaataagatagacccctgttacattactgcttttaagtatttactgaattccaattttgtgtccagagctgtgttctttgcctttgttttttgattggggcaatggctttcatgtccttagcaccactggggctgttaccagatgtgaccaaaaggtttctaacatgggtagcactttttttttttttttttttgagacacagtttcgctcttgtttcccaggctggagtgcaatggcatgatctcggctcactgcaacctccacatcccaggttcaagcaattctcctgcctcagcctcctgagtagctgagattacaggtgtctgccaccacgcccagctcatttttgtatatttagtagagacagggtttcgccatgttggccaggctggtcttgaacttctgacctcaggtgatccactggcctcggcctcccaaagtgttaggattacaggtgtgagccactgcgtcctgcctgggttgcactttttaaagtcacagaatctgaattctgcctttcctctgtgatatttcctattcgtactaaactttggtgaagtagctctgatctttagctgtggtgagaggagttatggaagagggacctgccccgaaacgtagaccacaggcaacttgctgcctggcaccctaaagatggtttcctgcttctcttcccctctatctccaggtcagagatgcagctttgctaaggcagtgattgccaatttgggaattttgagatactgtggatgtgctgattgttttgtacaaattctcttcaataccttgaccatgtatacagtaaacttatgctagctgttagaggacttattaaggtgtatggacactgtctttgaagagtttatatggtatgttttggcagttgaagagtattaagcattgacttaaaaaattatgtataataagcattgagataatgggaaagaaatgctacacatacacacacacgcatacccacccgtgaacacagacacccaggaaatcataaaacctgattgacttctatgtgtggatgttttctttttttattcatttaacttatattttaagttcagatgtacgtgtgcaggttcgttatataggtaaacttgtgtcatgggggtttgttttacagattattttgtcaccaggtactaagcctagtaaccattagttatttttcccgatcttctttgtcctcccacctccaccctccagtagattccagtgtagatgttctcttaagtaaaacgatggggtagtcgttttgtacagtccaaataagattccgacaatggatgaatctgctaagaggttaccttttgctccagatacaatatttatctaaaaggaaaatgaacccttaacccttccatggaatcgtactgcttcactaactttttgagtgaagtgatgggcattgatacagtattgaaaactttcaggcccttttctttactttttgacaatttgaccttttttcacccctgaaatatagcaatcagtatttctcttctggatctggttctacaacctacgttgattttaattactttccttgaaaaccattctcaaaatactctctgccccttacattttaagctttaatgttgaaaatagagctttggtaagagtctccttgaaaatgattttcttcagccaatatcagaggagtatttccttatttttatatttatatgttttaattccttaagaacagatatctaccaaatttcatggtatagatttataatcatcttttcaattttagacaaattttggaattcagatgttgctctttgaaatgctggtgacttctccaacttggggacattcacggactcaataagcatgccttttatttatgattctctgaggattcattcatttctgcatattttgaatgtctgctacacagagataaatgatgtaaaatccaggctatcagagctgggtcacaatttagtggagaagatgagtacgacaaaaatttaccatggagtgtgaaaagtgctcctcatagagacatgtacatcatgccatagtaagtttagggaatttggaaactcacttaagtcctaactcaatttaaattgtgttagactgtggataaatttatccgacgagaaacacataataatatgtatctactctgaggtaataaatgaaaaaagttggataaaataaaatacatctgttataaccaatggcccccagcaaggccagtgctcttgagccattattattcctgcacattctttgtgtttgggttattaacattgcgcttaggtcagatgagcgggtgttcaatctgccacactttgataactaaagtaaaatgctgatggagatcatttaagactgtctctatgctgttgattgcatgcttgtggctcataatcagaatgatgcaaagtaattgttagactgacttgccaaggctacattttgtgtcgttgccactgtcagcactttggtcccgctgtgctgcctgaagaacgcttgcctggcacctgttgggcactaatacacaactttccactgaatgtcatgggtaacttttgttctcatatcctcgcttgctatcttcacaaaaaaaaaaaaaaaacaaaaaaccctgacaaagatttttttttttttgacagagtcttgatgtgttgtccaggctggagtgcagtggcacagtctcagcttactgcaacctccacctcccaggtttaagcaattctcctgcctcagcctcccaagtagctgggattacaggcacacaccgccatgcccagctaatttctgtatttttagtagagatggggtttcaccatgttgcccaggctggtctcgaactcctgacctcaggtgatccacctccctcggcttcccaaagtgctgagattacaggtgtgagccactgtgcccggctgcaagtgcttattttttgtttgtcagaatgcttatgtattgagactttaatctctcgtgcatgttgccagggagctcatcttttctctttgaccgtgaaacccagacaaacctagctttgtcacttactggtgaccttggttaggttacttttcttgagccttattttcctcatctgtacaatgaggccaataaaacctattttacagagattttgtcaggattaaagataatagataaaaatgtgtccatacaaattagccactcagcaaatggttgtggcaaatattaaggaatttaatacttactcaggatgatacaatacaacgacaagacaacatttccaaaagttagtccgaaaatataatgataacgtaactgtggaacatgtagtatcagcacggttttactgggcaagtcatgtttaccagagacacacaattggatttggatgttaaaatctaaaccgcatggttttatggctagatctggaatacatgatatgttatgggccctcccatgtataccttcagaggatatggagctacctttggaagcaatgtatgatttagtgtttttctttttttttttttttttgagagggagtctcactctgttgcccaggttggagtgcagtggtgcgatctcagctatctgcaacctccacctcccgggttaaagagattctgctgcctcagcctcccgagtagctgggattacaggcgtgcaccaggacacctggctaatttttgtatttttagtagagacggggttttgccatgttgcccaggcttgtcttgaactcctgacctcaagtgatcttcctgccttggcctccgaaagtgctgggattacaggcatgagccacagcacccagcagatttagtcttgatggtgtaaaaaagccattgtatagcacacaacacagcctgaccatctaatgctcactcatgtaaaagcggtgaccacgagagagttgggcaaagcaaaaactctgtccctataagaagtgcattgttagatctggaaacatctcaccaggtcctgaattgtactatgaaaagagatttgttaaaagtagctcagttcatattccatgatattgcaaatgcctagagtgaattgtcaaagaaatgctctctctgactccatccactgctgacatttaaggtctgtgttcttagttcccaacattgattctatttcacatggtcaaaatgtaatagacatgttttttctaagagcatgacccccaccacaaattaccactccccttaaaaattgcatcggctggaccagggatgaagcatttagggagcatttgttgtaagggactgtcacctgccattggttatggaccttggtttcacagatcagactctgtgttgctctactttgcatctccgcctttgatctcgctgggattttgcagccagtatctatctcctttggcatttctttgctgctgctatgtgttctttctccctctgctgctctctgccagccccatctcctgcctgattcatggagcagtgttggatacttagaaaaggttaactgcattcgtgtctccatggctggagacacgatttccacacactctgcccattgcggggatatgctcacttccccagcctcccctcaaaagtgagattttcctggaatgtcactagtcgcggggggaggtatggcacccttaattgagggcaaggatgtgtcatgtgacttcagcaaatcctatcacatatatttttaccaaaccaaccattctctttgagaaggaacttagattagaaatattaacactgaatgaatattttaatttttgataccttctaaagaaatatggtaagtcctgattttttttttttttttttaggttttcaccttcaaatagtgatttaatttctaggatcactcaagatcatacagttttttcagttaactttcctctgtatcattaagtaactctaccatgattgggctgaaacaaggacatttgcttgacttcagacttagcgatttaatacttgatctagccatccctattcacccattatcccgagtctttaaaattgagtcctttttcgatatgttgaacacccactgaatattcttttttttttttttttgagatgaagttttgctcttgttgcccaggctggagtgcagtggtgcattctcgactcactgcagcttccacctcccgggttcaagtgatcctcctgcctcagcctcccgagtagctgggattacaggcacctgccaccaagcccagctaatttttgtatttttagtagagacagggtttcaccattttggccaggctggtcttgacctcctgacctcaggtaatccacccgccttggcctcccaaagtgctgggattacaggcgtgagccaccgcgtccggccacctactgaatattctaatgtgtgattctattccctgtggtatatgtgttagtttgtgttcttctatgctacacccactcaaaccaaaacaactttttgctgttaaggctttttatatttattcagcctgcctttctcaatcttgaaaaatgtagaagaaaaagaaccacatgctaccacaatatgtagtcacttcttataaacttgggacactttggtagactctgtaaattcaacaaataaatatgtattggttcattccttcaatgtaatactctttcagtcctcaaatgttatgatgttgatacatctattgatgttaaaggaggttttcaatataattaataagtaaaaaaaatgagacagcaaaatactatgaatactatcatagtacattataaatagattgtatgtatgtatatatatatatatatatatatagatttatttctatatgtatgtgtacaatatactctgtatacttgggcataggagagagtctggggtcatataaccagactgttaatagtgattattagtgggacttctgtggatttgtattacttgggtttttctatttatctaattattatacagtgaacagttttattttgttctcatttgtctcatccactttttttgactgcatagtcctgtaatttttttttaatttttaatttttttgtgggtacataggtgtgtatatgtatggggtacatgagatgttttgatacagacatgtaaaataaacacatcatgaagaatggggtatccatccactcaagcatttatccattacaacaaacactccagttatactctttattttaaaatgtacagttattattgactatagtcactctgttgtgctatcaaatagtagatcttatttattctaactactttttttgtacccattaaccatccccacctcccctccagccccctactacccttcccagcctttggtagccatcctcctactctctgtgtccatgagttcagtaggtttgatttttgaatcccacagataagtgagaacatgctaagtttgtctttctgtgcctggcttttttcacttaacataatgatctctcgttccatccatgttgttgcaaatgactggatctcattcttttttatggctgaataatattccattgtgtgtatatactatactttctttatccattcatctgttggtagacatttagattgcttccaaatcttagctattgtaaacagtgctgtaacaaacagaggaagtgcagatttttcctcaatatactgatttcctttcttttgagtatatacccagtcgtgggatttctggatcatatggcaacttgtctcatttacttgtgaggggtgaggaaaaagggaatacagtacaggtactcacattctggtaatttttgttgttgttgttgttgtttttgttttgctcttgttgcccaggctggagtacagtggcatgatcttggctcactgcaacttctgcctcccgagttcaagcaattttcctgcctcagcttcccaaatagctgggattacaggtgcatgccaccatgcccggctaattttgtatttttagtagagatggggttttaccatggtggccaggctggtcttgaactcctgacttcaggtgatccacctggcttggcctcccaaagtgctgggattataggagtgagccaccacgcccagtcacattctggcaaattattaagtcaccaaagtctctcctgtgtctttcctccattgttacagatatatgaacatgttgtgtgccaaatggtgataatgcctttttgttttattcagtctcttctgtgtaccaagcgccacactaaaaactagaaacattctatgaagtcgatattgttattgccattatacaaatgaggaaagggttcagagagtttaagtaactggaaccacacagctcctctgtgactcagctgaggctcagactgaggtctgactttgaaatcagttttcgtggtctcaagaattcgtactgtagacgtctcgtctgttgttaggatgaaaaggtcaatgcgtgtgagtggattataaagtgttgctttaaaacgaagaagatactcagagattttgccagtatctaccatttttcaatgtttgcatggctttctggcagtttttttcaattggagcataacctttgtctttgcagccccacctagcctaggatagtctgactgcatagtaagtgtcatgttaaacacttgtgggctgctctgtgggacttggaggagtgcccttcagattctgaggaactgagtctgggaatcttcctgcaggctggtgggccatcctgaaaaagctctatcctgccctggtggccggccacatgccgtccacgtcctctgatgaaaagggcgggaaagctgtggccttccacagctcatagaatgaatcccaaagatgctggaatcctgggaaacttgcccacagaacatcaggagctggaatagctttgcctcacagcctctcttaaacctgcaaaggcgtctttaaaatagtctctggagattattgttgagttggatcttgaacttagttccttgtgtggtgtagattaaatagtctgttgccgtcgctcccttatctccctttctttcaggcttcctctgtccaacattcacatcatctctgttctttcccacactttgtttggcccgtcagtatctcagacactgtggcttcctcacgggattactcagtcagcctgatatgtggcctccagcgcccctctgccaagtccacattcccatatgagcctaattacatacagatcactgcagggagtgaagctgtgggtataccattttgggaaagagcaaagtgcaggaatggggtactttggttatttattaagacttcttcacagcctggcaatgtagcaaaactccatctccgcaaataaagaaaaaacacaacattttaatccaggtgtggtggcacatgcctgtagtcccagctacttggcggctaaggcaggagtttgagtctaggagttggaggctgcagtgagctatgatggcatccccatccacggtcactgaattcccccatgagagggactttggagggaggatcccagggtctgagctcagctctgccactcacagccatgtgcacgtgagcaagtggctcagtcccctgggcctcagggtttccagctataaaatgggcacggatctatgacaaacccgggtaacaaagcaagaccctatctcaaaaaaataaaacacggctgggtacgatggctcaaacctgtaatcccaacactttgggaggctgaggtggaaggagcgcttgaggccaggagttcaagaccagcctgggcaacatagtgagaccccatctctacagaaacattacttcaaaaaaatacaaaaaaagacttcttcaataagcatcatggtgggcatggaggacatgacattttaagaaaggcacctaaaaaattgatttcttgggcaccacaatatggactccttgtcacaaggaccatacatctcatgataaatgaatcatgcctgtgattgttctctacatattgattgttcaaagctctgcttttaaaattcatatagtcagccaaataatcacgcatctattgttcttcagacatttattgtgcacctaataaaggccaaagtgctaggggctggaatttcttatcacctctaggcctgctcatttggactgatttagagaatggagttattaatttttttaaaaaatctttttttctattccagttttccaaagaaattagaccattttcttcgtgagaaagaaatcgacgtgctgttttcatagggtgagtgatcctttgaatctttcatgtatttttacccacatcaaaatattatccaattactatgatgcaccaagaaaaagtgtgtgacagcatgcactctctagttttctcctgcttggaaccaaggtatttttcctattctttgactctcctcatcactgggtcctttggagaggatggtttcccttgtagatttttctgcgatttcttttttgccgttcacatgctttgcctcgtgcgaggtcatcattgttgctattaccttgtccagctcacagaaaggaagtttctttccctcagcaactggtgcacagagatacagctgtaggcaagggggaaccatccagtttcaagtgactgtgatgtcttttgaattccatgaccaagaataacaggatatgagcaccagatgagacctgagagcttgtctggcaaaggccctatgtacagatggggcatctgaggcccagaggctcacatcacctttatggggcttcatggagagtagcagagctaggattttgatactggtgtgtttggctcctagctgcatgatgtttgccctgcacaagtctggttttggaatctgcagattctttttgaggctgtagagttataggtagtttaacttaatgtggtcttggtaatctaataatgatcacccctaaggcaagggtcaagactgatactgatagactatttgactttctcataatcctagttggctactaagtaaaggggttggcagagtgagtgcacccagaacacttctgttatggatgtcatctgagaaagcttattttcttctgcgccctttccaaaccactgcatctgcaatgccacgttgtcatgtgctgagacttggtggtacatctgctttgcagctagaagtcatggtacacctgcaggtgtgtgcagtccagctgcagacccacacacccgactcgcggttgtctgcacctgcagaagaatggctaacagggttcctatattgaagtacaaatctgaccttcatagagacttttgagaaacatttattcttttattttatttgtttatttatttactttgagacggatctccctctgtcgcccaggctggagtgcagtggcacgatctcggctcactgcaagctccgcctcccgggttcacgccattctcctgcctcagcctcctgagtagctgggactacaggtgcctgccaccatgcctggctaattttttgtatttttagtagagatgggtttcactgtgttaccaaggatggtctccatctcctgacctcgtgatccgcctcggcctcccaaagtgctgggattacaggcgtgagccaccgcgcccggccccatttattcgttttttttaaagttatgttggtttttacataagagtgcagttgtgcaataagatggagagaagttaagaatatgattctcagttagaatcccagaaggtaaacttgactgtgtgtgtggtttgtttgtttgtttgtttgtttttttagacatcctaggttaaatctggcttcaaattgtgttcatttaggttggtgaactaagtgcacttatttccaaaacatttcatctcacctagggagtggtcaaagggtagtattaagagcttgtgtttattattttatccaacttgtcagcttaatcactttgtcttcttccctaactagagtcattattgcggaacttgatcatctccttatgtacatacagacgtaattggtgtctaccaacatactgaatggaatgtagaacatagattgctgatttgtgagggatcatctgctgagttaccctaacattgatcgctcctgtccacagagctgggtctacacgagttagcattcattagaactgtgaaggtttccattttcctgtcttatctgagaaaagcccaaaaagtttattctcagagcacaccacagtacaatgtgggtcactgacacctgttgctctctggggactgtaaaggtctctttagagtcaagagattaattagactaaaagaagggggcaattaagggccttgagaaagtgaagaaatgtccatttccatgcttacatcataggattctttgggtaaagaataaactggtagagaagggtctgaggcaagaaatggtgaaggaatgaaagaaggactgcctgaacccatgtagaccacttgtggctactttggtttccttctggggtcatgagcactttgatgttgacattcaagagggcatcaaattattatccaaaatattacaagccgtaatttttttattttaccaaatgagaaaaaactaaacacagatagaagccatgagtatttttctccctaaaaagaagctcagaagctggcccccacatgcatatataccttgtaaaacgtgagtccctgggctcagtttcatggtatgcaatggggctgggtcttgggaacaatgctgctgttgtttctaagctcaaacagcactcaccatcaatggtatctctttaagggaaatccagggaaatgctcttgccagcgctgtgattttatttgctagaggccaggtggcaatgacatgcattggttccatagcaacgtgactgtgctgccagaaaacatataatgactgtgacagccagtgtatcctgggcaggatgagggcagccctgataccctcttttatttcccaccttatcctctcttgcctttcccctcctggggcctgtgatatgcggagaatgtggttttcgtaatggttactatctactcttgctattaacacttgcctcctgtctcggtccatcttggaacttgatgagagacaaggcaatgcctgtaggagtgttctgcaggcctctgaatgggtcagcagggttggcagcacctgcctgtcttagcaattgaaaggaggtggagagtctgtgcttttcatcctccctgtgtgtggcacagcggctctgtcagaatgacctggtggggagggtacttcctgggcatcgtggtcagctgctcctggctgaaatgtgtgggtagtgacatggagcaatgtgaaatccagggaaacagagtgctcatttaatatgctgcagattgaggagacacctaccagtggagcctgcaatgccaggcccagtaggactgcacagagaaatgcaatacccatttctcatcttctgggagctcttaccagagaggcagtttctaattgcagtttctctactgatgtgtggttggggctttcacatttctctaatgtttcctcatctatataatccttgatgaaagaattgtaagaactcttagttccaacggatactttttttcccctctgaactcctgaagcatttttaaaaatctttaccatccatttgacattgctcttgtatttccttttttcatatatattgctttgggggcctgagtgttttctaggtcgaggctaagcccttcaaggatacgaaacatgtatcttcttcttcctcttaaaaaaatttctctaatgctcacaactgagttctgcagatagtaaccatgacattaatatttgttcacgacaacgttatattctcactccatctcccaaggaaattgtgaggcaagtgtgtaaatatattgaaaatgttgttcagttcttcaaagaaaagataaactcaagaaattattttcctaatgtggtttttttaatgcagatataaagtcacaaggtaagaatatctaaaggcttcatatttcctcatcttcctctttctggctactgaccatagcatatacccctgggttttatactggcaccaaaatcatcctttttcccacctcactcccaatattcactgtattgaatttgtctttgggatcagacttctcagtctagcgttttggactattaagtaagagatttgagggatttttccattaagatgacagatagattaggtttgatagattaggatagtgattcctaatttggttttgaggtctgtttaggggagggaaggtttttatcttatggaaacttttatcttacaagagttctcttcccgtcccaagttctgagcccactgagaaataagacaagagtattgaggcagacgggggccagaatgcaactatgtgactgagggcaatgagctaacttgacacctgcctgttccccagtctagcctggtcgcaggccacctgcaggaaagttttgagtctacaggcacctgtctgtgtgaagagggaaggagaaagaggcccaaatccctgctaaccctgctcaaaattatatagattcaccctatccaaggagggggcataggccacgttggctttagccccagccgggttactcattccacacccttggggaagaaaaggttggagcaagaggtcagagggcataagggaaatcctcccccatagaaagctggggtggggcgtggcgtttccttcctgctctggccatatttctgctccctgcaccccatcaggcctacccgcccccagctcactcaagccttcttacctgttgttttcttcgtggcgcttgggcttctgcatccgactgctggtttattgttagtctcctctattagaattagctcagtggaagcaaaagccttgtcggtctcatggactgcatgtatcccagtatttaaaactgtgccaagcacataggaggcatttgatcaatatttgttgaatgaataaacacatagatgttgtttgatgcctctgctcacactctttaattacctggacatccctggtgccctgtcttgtctggcaagtctgtaggagctagttcagcaatcgtggtctcttcttgctctgtatgtagctcatcagttggcagtagttggcatgtgtgcatgtgtgtgctctcatgtaggtgagtgtgcatgtgtgtatctttgtatgcatgtgtgtgcacctacatacctgtatccttttgtgcatatgtatttgtatgtacttgtgttctctctctctctggctctgtaatacttcacttatttgtttacatatcttttacccttactagattgcaaatgcttgaagaactggggaacctgttaatcattcttgttcctctaatatctgccatgtagtaggtgctcagtatatgataatattagcattctaagcacttacaacatgcccagtactgctttattttaaaatttaaaataacttttatgtatcttgcatatattaacttgtgtaattctcacaacaaccttacaagatacattttaaactcgttttgtgggaaaggaaactggggacatgaagaggtcaagtggctggcccacagtctcacagctagcctgactccatagctttttttctctgctacctctcagaaactgactactgtatttgtgtgaatgaacaaatgactgaatgagaattttagaagcccagaccaaaatcattaaatagacctaaagacattagggtcaacacaaataagtaaaaatgatgagccatggttgacacagaatcaaggccatggctaagataaattcacagatgaatagctaatgccttcttgtagccattgcacttaattcctgatgatccatgcctgcatggtggtattggttaatgcaaatgaataattgttattacgtattgggaattatttcctagtgggaaaatatcaagtcatcagttatgagttaagcagctactgcttgcgaggctcacaactaaattttggggaaaatgatgagaggaaggaaaatgtgagttggagggtgaaaaggtaagccctgaaagtacaagccaaggtcactgtcttcaagaggctcttgtctcattaagtggcaaggagtgagtaaaagtgacattaaggcaattaaaagatactgagggcagtaaatataaagcctagcacaaggcattgttagacatgattcattaccaaatggtaataatagagaaaataaaagctattgtattagtcaggataggataagcttttgttgcagaaaggtcaaccctaaactttcagtagcttagcaaaataaaagtttatttctcattcatacagtgaccgctgtggatgcagtatctctccaggacaactgtcctccatgcataactccatgatgcagtctgctttgatctttttatccagccatctaggggcctctttcatgatcactggaagagagaaaaattggaaaattgcaccagcaattcaatgcttcaaagctttggcctagaagggacacttgtcacctgctatgtcctaagcatggcttttagctttttgtataactcccaacgtcccagtcctctcacacagcacacagtaggtgctcgataacgtgtagggtaaaagaatgaatgaacttaagaatgcattgtgacttgctcctgatggtgttgtagcagtaatatacctggcagcccccaaagcccaggcttggaacagtcagatctggctcaaaaatatttactaaaattaaaagagcattaataaaaataacaacatagttaacattaattagctatggtgatgggacaatcataaggacacgggcaaattaaactcaatttagcaggtggctaaacttacgctaaagccccggcctgccagacattggccttgtcttagacacatcactgtctaacagtccagagctcaactcacagttcacaagtcatctggtcccatcttgtctttctgaccttgttcctcctgaatgagatggagatcattaggcttgttaaaaattaagaagctttattaaggcaaagttaacctgtctgggatgcttccatgattccatcccaggtgtatggaccaccctataccatccccctcctgcatccgcttctctcatgctttcatctttcatctggggtcctggtgaacagaccacaattcagctccagatcaacgaagaggggcttccagacaggggccacgcatatgctgaggaaaacacagcaatctaacatgtaaagtaagtgggaagctccgtgtaggactcaacacggagaatggacagctcatagagagaaagggggagactgccttggacagggagataggggtcacaccacatgtgtcagaccaaagaatggggacccctcaaccacattcgctacgtgtgtattatgtggtgaagagaaacctgcctgcgaggaggactgagtcccagccactgacagattcccaggacacggtgcttcttgttggtttgtggtttgggggtggtagtggtagggagggaggagtggtcactgtgtaaatgggcagtgctgtggggaggggtcctgaactgggggttggcagtcactggagatttttcaacaagttggggatgtgaagaaccatgttttagtgagatgagctttacagctgtgtccatatcccgtgagatggtggagaaaaaagagactggggtcccagagggaaggcagttgcaggcgtaaggagataaggttttgagaactactgtgggcgtgttacaaagggaccgatgtggaggacactacaaagaaagagttgaacaaactgagcaactgggtattagaaacaatgaaaggaatggagtcagagataacccaatttttgagcctaggtggctaccgaaggtgtcctgtgttgtactttatggatattattattattaattattattattattattattttgagacagagcctcgctctgtcgccaggctggagtgcagtggcgtgatctcggctcactgcaacctctgcctcccgggttcaagtgattcacctgcctcagcctcccaagtagctgggattacagcctcccaccaccacgcctggctaattttttgtatttttagtagagatggggtttcaccatgttggccaggctggtctcgatctcttgacctcgtgatctgcccaccttggcctcccaaagtgccgtggatattattttaataacagtgtcatcccatgagatagagagcctgtggcagaacccagggattgcctgggacccagatatgcccacgtgagtatctgagttgccttaaccccacctcccttccttcgagccctccctccccaaggtttaggatcaaatcttaaatcagcagcaaaactgccaggctgaaatttcatctccatcctggccctctagtggagataaaatggtttgaatgtgggcgagaaagtaaaacggaatgtgtggttgctgagtctagctgttgataagagagggttcaccatccacccatgagaactgtctctctcctgctggtgtgcctcgctctcagacgcagcctccctatggctctgggacatgaggggtaatgtcttgccggttggtaaaattcttgcaagctgacagtctttttttgtttttcttttttttaagctccacaaggctactgcacattgcgttcttgctctttgtgatccaacaagagggagtcagttttgatttgggagaaaggaggaagaaagctgtttgatgggcgagaggaggcatgtattgattgcattcccgttttgctttctggggctggctggtcatgtcactcttcatagctgcctggctctagtggtagaagagagtctaatgagagacgctacggctgtgtgcagcttgcacacagcaactcttcagctccaaggaatcagagtgagctcctgagctccctgggattcagaggtgcctcagccccaaatctttttcccctgcatttaggctagaacaggaaagatgctactgggagagaagagaattcctgacatcttgcctttcttgtctgctttctgcttgggtctgtggagcagccacctctgggcagaggtgcaggaagtgtgacagaacaggaaagctttaaagtcactgtctccctccctcccatgccctaggctacccttgctggtcagaacctcctgcttactctggtggacagacacctgagttgctgctcttgatgaagtttctcccacttcttcaaaccagcaaggcataggaccccacttggcttggaagacacgtgacgctcttgatcatttcagtcccttttacatccccataatatcaccgtggcctgttagattgatttgtgagtaagattccttgcaaatagcaagatgatcggaagcctctatcttttccgggggaggtgcatatttaaacagacagcctaagctatttatagattgtaatgtattgtgttacagggaaaaggtggaagtcaacagtaatgttctgttccccatttcctatagtttcaagcatattttcttgctagtcctagagactttaaacatttagaatctccagtgatatctatattcttttgatgtactttgtgtagaaactcaagcacgagcaggcttcagagtcagctaaccaaagaatcttggggcttttgatcactttccattagcacaaacagtgatctctgccctgttgtatattgtttgaaaggacatttgctgtttaatgaagataaacatgttgctgggtttttaatatgtcttctcaactcaggagctgaaaaatgcatacatgagattagttctgttggcgtagaagggattctgcgtgccccaaacattttcctagccgttggctgaacttttgaaatgtgctttgcactgcaagaacagatactgaacagatattttacttagaaagccttctgtttcaatggtgattcccaggggccactcaaccacatcttactaaataatatttggtcaaaagagaaacgtgagtgcaagaaggacacatgatcacagccactaacaaattcctagaaagtgctgcttgttgtcatttctggttaggaggtgatggtgatggcaggtagagggtctaagccattctcctgtctctcttttaaagtacattcttctgttgctgtagctcctggcattggctgtcaccctcacttgcaggagggagggaatgactgtttgttgctgttggtgtctgaaaatctgtgggcagaacttttagaaaaagcagaccacagagcctgctatatattttgttcagcccattctatttctcttcactttttaaccgattgcgacaaaaaaaggggcctgccttctaaacttgtctttatctttaaaagagaataccttttataaatgcttagaacttggagatgctgttgtttttatttagtatttgaaaagctaagtatgctgacactgtcctgggagtgcaggcccctcattgagagagaacagtaaacacagcaatgactttgcttttaatttgaaatgcgttactcttcttagagctgaggggtgatttgagatgttcctgttttcacattcagctatttcctggttctgtgatcataataaattccatagctccaaaacattagagcaaattgtgtcttctgtaggagttatttacggatactcaaacaaatggtgctttctgaggaagaagaactgtgtatgaaaactatgtggtaaagcctttcatatctgccgtggtggcagaacttctgaggagctggctttgagggtaatgatatctttatcaccctgacgctgaatggaggcggggaggcctttgtgtgttctgttgccaactaacacctggctgcctcagggcatcctgcctggtaattgaacccatgagtatgtacaaagattagagggaccgtttgaggagaaagatgggggctggagaggcaaggttagtcttgccattataagcttaggtgcagaaggaagccaagctacctggaaggccacctcgtggcaaagacacccactaaggcagggcggtggcctgggactgaccatcaatcacttcccgctcattctcctcagaactgaggactgttgtcttcagtcttccccagcctcgcttatcttcctcctgcttcctgaaggaaatatccttttgcaatgggtggactatcaacttgaatttttagcaagcaggctggagaagtttttggaagttttggagacatggctggtcttgaattcctgggctcaagcaatcctctcactttggcttcccaaagtgctaggattacaggtatgagaagtttttggaggtttcggacttgttgctaggttgattctgagggagaaaagacctctgttattcagaaggttgtggacttctgaagaatggaaatcgggcaccctgaaggaaacatatgtcaatcctagtcctggagctagcatggctcaagtttattcccttaaatgtctattgtgttaaaacataaaaagagtttagatatacttccacatctttgcagttgttagctctctggacatttataaagggaaaggaagagtgaagcagagccccattaattcccatgcatggtgtctgctgtttgaatcctggaaatcaggatgattttattcacatgttaatgccctctagtggctagtgaggtgccctctaagcaggactttccccagcttccaccccttcctctccctaactaaattaagcacccactttacagtagttgagtatgtgtcatatcaagtctgtattttcttactaagattcatctaccacgtgggaaaaaaaaaatcaaaagctttgttacagttcaaagaacgtagtgctgttgctacatcaagtgaggataaatcttccatctgtagcaatctgtattataagtctactggatgtgacagaaaactctttaaaactttgatgcacatattttcacagccaaccgatttcattaaagtgggagaagtgtactattggcaagcagtttttctgctgacttcccacccttaaatagacaagctttataaaaagacaaaatcttcccagatctatttggttggccaaggtgacatttgtcttcctccctcagaaggttggtaaaattaaccttctgctttctgtatacctttactgtatttttatttctatttatttatttatttatgagacagggcctcactctgtcacccaggctggagtgcagtggtgcactcacagctcattgcagcctcaacctcctggggttcaagcagtcctcccaccttagcctcccaagtagcttgggactacaggtgtgtgccaccatgcccagctaatttttgtatttttggtagagatggggtttcactgtgctcctctggttggtcttgaactcctggactcaagtgattctcccacctctgcctcccacagtgctaggtataagccactgtgcctggccctagttttatataggtaaagcattagtcactcacaatgatctttgaatgagttatgtaagttatgtttggtttctcctactttgttttcctagtcagttcaaccagtcaagtatgagatgagtggctgctgtgagcttgatcaagtgggtcggaatcccctgggaatattgttaaaatgcaggttctgatcctgtcggtctgagatagggcctgagatgctgctggtcccaggaagacactttgaggaacaagttgctaggtgatgcagaagacagaagccatatttgattttcaaaaatcctatgatctgaaaaggaactaggagaagtatacaaataagtatggcataagacagaaggtgataaactgtatataaaagtaaaaacacgcttcagagggttaaagatagaagtgatcacttctgattgggaagatcaggccaatttccacagagaaggtgatttgggaatgggattttagtttgcaacagggattgcggggaggcgtgcgagggccattgagaccagagacgcagattctggaaagtgaagagtacgttctggaacaaggggccacccgtatgcctgtgatggggaaaagtgggagataacagttgggaaggtaagtggaagccatattgtagactgtcagacagtctgggatggaaactctggacttaattcaggaagcgaagaggaaccagcaacaagagattttgaaacgagaaagaagattgaaactgcagtttagaaagattcatctggcatgtatatgtaggatagacgggagtggggagtgacagcccattccaagagaaggagtagtagataggacagatagcatgattactcttagcaatggggaaaatagagactagatgcgatacagagagagaaggatcagaaggtgtccaggggctgtcagagtttcagtcctgaatggctacagaattaccataaataggacagtcagaatgagctatcgaatgcttttgaatggaaaaatgacctgaatgagtgcacaaatgtcacctccaagaggccttccttgtccatcctatctaacatagtatgccggtcttcttaccctgctttgctattttcatgacactttttactgtgacattaaaaggatggcaagaaaaacagggaggccaggtaagaaacctgtagttgacaggatagaaaatgacagtggcttgggcttgaatggtggcagtggcatcagagagaggtagctgggttcaagatacagcctgatagtatccagtatattctcgttgtgcatccagtctcagctgtttgtgtcttgcaaaactctgtacccattagacaataaattcccccttcccccttccccctccctcctggtaatcaccattctactttctgcctctatgaatttgactgctctagggacctcctatgagtagaatcacacagggtttgtccttttgtgactttttgtttagcataatgtcctcaaggtcatccatgttgtaacatgtgtcagaatttctttttttaaggctgatgaatattccactcttgtatatatcacattttgtttattcattcatctgtccataaacacttgggttgtttccaccttttggttactgtgaataatgctgctatgaatgtgggtgtacaaatttgaggttctcctttcagttcttttgggtatatacctggaaatggaattgctggatcacgtggcaattctatttttaaattttttatgaactgctgtatcgttttccacagtggctgcaccactttgcatttctaccaacagtgcacaagggttccagtttctctatgtcctcaccaacagttgttattttctggttaaaaaaatgtatttgatagtagccatcctaataggttggaggtttgagacctttttttaggggatatttcagatagacagttgagtcttcaggcctgcagctcaagaagtctgggcctgcattataccatagaagttcatatttatgccatcctttatcctttcaatgaattttttggccagtttgtctataagcatttaaggatttagagatttctattaaaccatcagatttgtgcttaaattatttaatctcaaagacattttaaataatatatacattaatttagacatactgctttcttccactttcatattatatgaaataattttacttacaacttttatctactatatcagtatcttcctcacgttttgaactacatggcaggtcatgtagtatcgttttccaaagcacatcatcttgacgttcatctactctgtgtttgatgctattaccagaaatttcatcctaagccgcaagtgcccattcctatattcgttggttacatttgttgagaccccattggccaaaaaaagacatatagccaagcccacagttaatgtgagcatggctatagggaggcatcctacattggggaccattattgtcacaatatcctaaaccatattattaagagatgtttttcttcattcttcctgtgagtgtattttgatgaactctgcaacttaaccacttactgtgttgcttttaaaagtaatctttaaaatgcttttttatttatagtgacatccagtgcttgcaactaggaaagtcatacttccaagaataattactagtcaaatttgttttcttccattaaaaaacaaaaggaaaaacagttctgttaggtggctgttatataaacatgccaaactagcatttatcaaggtagttttaaggtaatatgtcttccataaagactactttatttaagagaccaatagatacaataaactttgtaagaactcaaaaattaagggtacttaggcttttctgagggctttctttggagaaaaattaccttatattatattaccttttattcaggcatacataataattgtaaatttggctttggagacttcagtcaaagaaagagcttctatacaggaaaagcccttaaacactaatatagtgattgagcccattgctcataaatgtttgctaagaaaaatacttgtctggcgtattcaaaggtcagtctttcctagaggcatgaggaacgtttcagagttccttcggacattgcagtgctgtggctggatgatgccacttacccatctatttatccatttatttattcattaacttcaaacaccttctatagtgcagagaatttctaaataccatatattagaaaatctttattttatgagtttggctgacaagggtaggaataacaacagatattaaaccaaaaagttttgcattactgaaaaaattggacaaattcatattaaaagttcctaaccaaaaatctcacagatatgatgcagtaattgaaatccatcatattctaaggcttaaagcatgatgatctgcttctacagtgataatttgggtaagaaggacagtgttctaaaaaagcagccttaatatataacacggaggagtatatgtattttggtcaccggccatttgtctgtccatccatccatctgtccattcatccatccagctgtacatacatccctacatcctttggtttatttcagtggtgtcaactcattacatggcgttgaatgatgttatcaataatcattggcatgccctttactcccttagggtagaagagaattaggtaaaaggtagtactgaaaaaatgttttcccctcttgctgcaaagttataagcttttgtttcctaatcaggcccactagaccacattttgccagtgagcctccactgaaacaaataatgataatgttcatttcacatctttgacctgggaattgcagagtgatttaccaacattaactcatcaattctcctaacacttctgaacaagacattataatatatcattgaattcatcatgtaaatggattctgtgttttccagagaatttcaatatcctggccaccaattacatagggagtgaggagaaaaattaaaacaaaaattacccttttctgaactactgtcttgtggcctgatctccatcagaatgtcttattttctggaaattttaaaagggggaggtcagaggagacatcagctttgcttatgtaaaactattaaataaaatcatactagagaaaaatcattagaaaatgaccatttcccttaaaccactttcttcatttgactcattgcttaataaaatgatgaacttgaaacgatgctgcctgctccatgtcacccaaatgatgagtcacatcatgtgaacaaatggaaataaatcaccagcgaaaaggccaaacttctgtgctaccctagaaatattttctatttttccagggcttccaatgatcttccattcctgtttaactcagcttatagtaagccctgatgccaagattttctgagttccctgccaaaaccatgatgctctcagcctgggcctctcttctaggagggaagacactgccctccagatgaagtgaaaaggagaatcacaaaaagaggattattccttatgggaggaaatgggacacgtgctgcttattgtaacatcattcgccattcgttgggtatatggaggcttttatgagaaagcagaggtttttataactcatttactctggcaagtgaagcaacactaaaattacttaagtgtttaaaagatagacgcatagtagtttatgttctcagtcatcttattactgagaccctaatttgctttcgttaaactgtcggttctccctgagagtgctattgttatcggagcctcataaccgtgtacacgggtcagtgatggtacaatatttccggaaatttaagtcctccataagtagtcaattgcaggttgttttaaggaacaaagactgcttttccagcaagcctggcttgtgttcctattaaggccccttcttttttattgcaaggggaaatttcaaaatctcattgctgtatttaactttctattttagtaggctgccagtgcacttaaccttccatataaagcttatatgcgtttatgcgttctttcccttattaactttttaaggtttgggatgtcagcctgacctaatgatagaatatgcaaaaatagtcctgataccagcaccctgagcccacctaataagggacctttttcatactgtttacttatttctgagtaacagaaagtctgatggtttggtgctggctggttaaattcaacacatggtaagcttgcctgttagtgaagaaggttgagatttgggctgccggtatgttttcttctttcaggcaaggactgagtggcttccccatgtgtgcctaggtgtccagctgaccacagctgagagggataagcagggattgtgtccagctgagtttgggcccctcactcagtggcctacgttcctcggagggtgtgtgtaattagctgctgagtagtagaaggcagtagccatgatcccagttggaaaatagaagtagagctaaagctaaaaaaaaaaaaaaaaaggaaacaggagagctgattgcaggaggaggaggaggtgggctcttgctattttctagagcctgaaccaaccatgcaaagtagaatagcaggtgttgcagctctttcccccaggaggactcctgagcctcgtaagaaggtcagagagctggttgaatgttggtgcaggaagcacgtcaggaacagcttaacactggtttaattttcatttcccctgtgttattttacacatgaggggagtctgaggctgagcgccgtggagaggtctttgtggggagcagttcacgtcagatccaggcctggtcacctcctggcctcatcccattcacctgagtgacttgtcacccttttcaagtccttttccttctttgctttttgcttctccaagtgtgagattggcaatgtgatcattatatgaaaaacatttaaaattaaaaacgattctgtgcaaatatgaaatagataccagttttctttgatttctgtagtgtcactgatgataatatgcactgtagattaaatgattagtttctgggggtgggggtgctaccactcttttatgtaccaatcatatataaaataagtcctgagttcagaaatgttaaaatgacaaaaatcacatggttgtcatatataagctatgtgtgttgtatacaggctgtttgacacacaggccctgttctttacaaggcatgctttctggaagcccaaaccagtcccaggagtgaaagctggctcctagcaatacatgcgagtaggagtcagtgagggcttaggaaaattatccaggaaattcattttgagcagcccaaactgctagctagtagctaagctagtaggcaggagtttcattgaccacatgtctcaaccacatttaccacatttcttgctaaagatgccctaagtggggctgaaaggcacaagatatatagcaggtgggggcaagggggaagtgaagaacctgggtaccccacaccctagatcattcaattacatttttaagaattttttaaatgtacgtatgttaaaaagtttcagttttgcaaaatgaagagtttggggggtggatggtggtaatggttgtgcatcattgtgaacgtacttaatgccactgactgtatagttaaaaatgtttaagatggtacattttatatttgtgtagtttaccacaatttttagaagtatatatgtaatatatatgtatatttacataaatatttttccctagtttgatgaaagtatattgtcatgtcatccactcacccatccatctttattcattcattcaacaaatatttatgaagccactgttaggtcaacatctgtgttccaagctggaatataactatgaatacattttctgtgcttgtgttactctgaggttagtttaagtgaaagccatatgaacaataattaccagccagcgtggtgagccaaaaatgaatgtgtatgtggagttaagactgtgtccagctgtgcagagttgtggggtgtcttggcatctgtcaaagagaagatggacataaagagatcacctgccaagggacagcatggacaaagcacagggaacaaacagcatggtgcagtgtgtgcagggaacagtcagtactccattggtggtaacttgtcatgaggccaggagcaaaccatagagggtctcataggccatgttaaggagtacagactcctcagctcggtggaggtcagaccacattctccagtagcctgaggatttctcagtctcccaacctctgccctgtgaacctctgtggggctgccttcagaagtacttggtggtgatggatgaggagtaggaggaaccgataaaactagatagtgtaagtagcctcaattttatttatcttgtgtattagatttctatataagattttgtttgaaggcagagttctggcttttaaaaaacacatttgaaaatcattgctgttggcaatgaggaatcataaaaaattattatagttggtgacgattagcttagtgttttaaaaatcaatattctgcattcaaagcaataaaccttctttctccatttctgaacctcacctcacagtactttgcacatactaagcattcaatgaaatgttcagtgggaattgttttagggctatgacttagggatattttcattatactactgtcataagggtccacttaaatagaatgttgcccagtaactcaaaaggaatttgtagaaatataaactatataacttgccttttattctcacttttctttgtgtgcgattggactgtaataattattttttctgagttttcttgtctatttctgagacatcaggttttataatttgatgctttggacctggttgacaattccgattctgtatgtaggattgaactttgtgggaaatagcagttaattgtattttttaatgcttaaaatgatattctgggcaagttttgtttctttacggtctatagccagaatcctactgtttttcaatttgtttaaatgcaacagcttatacagcatatgtacatgttcagttgaagataaaggatatcattatttttagcctattacaaagaaaaccacattttctcttaaatgtcttgatataaagtaatttgaacacaatttctgcacaaatcattttcaagagattggctgtcaagtgtatttttttaagtagcactttcataagaaccaatgaaactttgcaaatttagatagattctaagcctgaaatgtggttgaagatgtcagtttttaaacagcactttgagaagtagttaacttaaaagtatagcaattcagagcatactgagaatgattttgaagagtaaagtcttgatacactgaaaagaaagttgacagattcactacaattaggagacaaggaggtacaactcccacttgtgaaaacttttctcatctaaccaacttctaatacttgcctaagaaaatcttcagcaaatccttactcctttgcagctcctaaatctattgtatagaattcttccagtttcctaatagatgctggcgaggctgtggagaaataggaatgcttttatgctgttgggggactgtaaattagttcaaccattgtggaagacagtgtggcgattcctcaaggatctagaaccagaaataccatttgacccagcaatcccgttactggttatatacccaaaggattataaatcattctgttataaagacacatgcacacatatgtttactgcagcagtatttacaatagtaaagactggaaaccaacccaaatgcccatcaatgatagactggataaagaaaatgtggtaaatatacaccatggaatactatgcagccataaaaaagaatgagctcatgtcctttacagggacatggatgaagctggaagcctcattctcagcaaactaacacaggaacagaaaaccaaacaccgcatgttctcactcatagtaggagttgaataatgagaacacatggacacagggaggggaacatcacacaccagggcctatcggtgagtggggggcaaggggagggagagaattaggacaaatacctaatgcatgaggggcttaaaacctagatgatgggttgataggtgcagcaaaccaccatggcacatgtatacctatgtaacaaacctgcatgttctgcacatgtatcccagaacttaaagtaaaatttaaaaatattttaaaaataaagaattcttccagtttccttatggcataataatggaaacagaataataacatgacaaccctcctttccttgttttaaggaaaagtaagttgttaggcctgtgaacaatggcagaactgaaatggagtcttcactcaagccttgtgtgtgattgtgtgtatgcatgtgtgcatgcgtgcatatgtgcacactcacgcacatgcacaaacctacacatttgagtgcaccagtttaaaataagagaaaaaagtgacatgaaactcacttcccaatttctaccatcattaataatacattttaccaattctgatttgttctactattgtgtcaaggctagttaatgtgccccatgcattggcagacaagatgatattatgtggaaattgtgtcttgtctattataagaacctgaatatttaagtatgggagatttttgcctgatattcttcagtcttgtcactcactactgattaagctttgtaatctatatatgggcattagatgaatccataaatgaatgaattggtagtttcctcaatgttttttttttttttttttttttatcataatgaagatatttcatgaccttttaccagtcttatcacatcttggaaagaattactacatctctgaaaaccctacccaggtaccttcttgtagttgggccatatgtttctcaattcagatatacccttgaggtccactttccttaggtggacatacacttatgtacactcacacacccacatgcatacaatatagagaaagaaaggtaaatagtaaccgacagaggtagtgcctgctattctcttcagcgagttgttatcccctcgtcccattccacaagatgggtgccacattgaagatgcaaccaaattacatgcccacactcacagtggttggcccttttgaaattactgggagattataatgatacagactgtggggttgaaacaattgtattaaaatcaattttctgccacttccaagttctgtgatctagggctgtcgcttaattaatctctcagagtttgtttcctcgtgtgtcatatgggaacaataaacttactttcacacggttgttgagaagagtgaatgataactgatacaagaaattcaagttttgttagttttaatcggacatcataagacttttaaaatcatgtaaatgtacatccctaattgcttgcaagtggtgcaaggtgacaagaggagccacctttgtgggaggagtaggtggcaacctctgatgacttcaggacagtgactctccaccttggctgcatagtagaatcacttggggagctttccaaaattctattgcctgagccataccccagaccagttaagtaaggatctctgtgggtggaacccagacattagtactttctaaatctctctgggtggtcacaatgtgtagccaagttggagaactgatgctttagggggatttaaaagtcttcactccttgcattggctgaattgatgatagccagaattctacaacctacactgtattctttttgcttaagataaacagagtcttaggtatcatgccaaaagtctattatttctcttggttatacacgatttggcatgaattagtttattaagttttctccaaagagccaatcttaatgggtgggtgtcgggcttggaaagagaacagaggtctgtggatatctgaagacaggggctgttcactagaggggcacaaacacagaggcaaatgcaacccaaagtcagcaatttcaagctactgttgcttttgaaaattagttcttgcaaaagcaccacctcaagaggtggttggcttccctgaaagctcagcatcatggctctggtgggtcatcattcatgaaaacttgctgcatctttaaaatgtgggatgaggaaaaacatttaaatagtggctgaatacagtcatagtgtaaccaaaagccagaaaattaatttttaaaataatgtatatttttaaagttttgttttttcaagagaaaagactaaaatcacttcatactcaaaatctctcttacctcttttcaacaattggtgctgagacaatggaaaaagtcacctgggacacatgccagagaaagaagttgaacccttacctcacaccatatacaaaaatgaactaaaaatggatcaataccctaaatgtaggaactgaaactataaaacttttaaatgaaaacaggagtaaatcttcatgaccatggatttggcaatagattcttagatgtgacaccaaaagcacaaacaacaaaagaaaaaaatagatgcattggacttcatcagtatcaaagcctttgtgaaccaaagggcactgtcaagaaagtcaaaagacagcccacagaatgggagaaaatatttgcaagtcagtatctcataagggtctagtttctggaatatataaagaactcttacaattcaaagagaaaaagactaacaacccagtttaaagatggacaaaggcattggatagagatttctccaaagaagatatataaatagccaataagcttatgaaaagatgtccaacatcattagtgtttaggggaatgcaaatcaaaaccacaatgagataccactttattatggtcacccattatgatggccataatttttttaaaaaaggaaaataacaagtgttggcaagcttgtggaaaaaatggtaatcttcctacctggctggtgggaatgtagtatggtgcaatcactatagaaaacaatttggcaagtcctcaaatagctaaatacagaattaacatatgactcagtagttctgctcttaggtatacactgaagagatttgcaaacaggtattcaaacaaaaacatgtacatgaatgttcatagcagcatgattcatagtagcccaaatatggaatcatcccaaatgtccatcaactgacgaataaataacaaaatgtggtatagcctacaatagagtattattgaaccaaaacaagaatgaagtactggtacatgttacaatatgaatgagccttgaaaacattatgccaagagaaagcagccagacacaaaaggccacatattgtatgattcagtttatacacaacatccagaatagacaactccttagagtcagaaagtagattagtctttgccaggggctgagaggagtgggggacagggagtgactgtttcatggataagggggatgatgacaatcttctggaattagatagtgatgatggttgttcaacatgtggatggagtaaaagccactgacttacacactttaaaaacagttaaaatgctgaattttgttttatgtgaattttatcttcattaaaaaatacccctttgaccccatctcttctctaatcctgcacatatagccttaaaccagtcattttaccctttgtgattccattttcatcttattctgttttttcctctaatgttcaacttctgcaaagagacatctacactggtcttcatttcctttccagcccttccattcatcactccagattctacacctgacctggaaaggtctgtgttaactcaaacagaagcttgggcacctcttccttactagaagggcattccagtgattgacattagaaatcaagttcccagcatggccctgccaccaggctggactcgtccattgcactgtcaccaaggaatgttaagtcttggaaacagatggaggaacttgcacggcgtttcccagcaggcacaggcgattcctgcaaacttaggagagtgaaagtcacacgaacaagaatgtaaatttgtgtgagaagacgtgatgctgttactagcagagttaaagtgcttttaactttggataatggatagtctgctctgattgcctcgaaggtggatctccaagcccacagaacggtctaaaagtggaaggaagctgtattaatcatttatttaattttctttctttctctctttttctgctggggtcagcaggaatgggaatcttttttttttttctttttacatcagtcttattatgattatgattatactgaaagacctggatgggaggaatgctgcaatctgaattaaaaatagcattttctgtcctcccacacacaacacttgagtgctctgaatgccttttataaatgcagactttctgcctggctagataaaagaagctgtcacttcatttccataacgaagtcattcccgggagaattccattgttttagcaatagaatttttgtaaaaggcctcttattttgcctgaaaaaggtaacaaaaatgaacttttgagagcttattcgacaaaacaattaagcagtgaagagagattttctccttttttgatatattaggagttgtaagtgtgagaatcccctgagccatgatactaggataaacccctaaatctgcaagatgaaggaggaggggagaaatcctgttattctttctcctaatagaaatggggatatgctcttccccgagaatatgtgtcctagagccaagtgacacatagatgatgctaattctaaagagttttaaatatttagtcttaaagagaggtaggaaacttgtagaatgctcatggtgtaaagaaattccttggggtttttaatgaaacgcgatcatcaggtattttaactgagtttcaggactcttaagacaaaccacggctgcatcttgccagcgtcctttactcataaaatagtagttgatatttttctttatttgcattgaaattgcagcaagtggagtacagggtccttcatgatgcagtgtgacctgtagcgagctcagacaggcctgtggacatgtggtcacactcagcacccctctcctgtgtttccccatccctccacacgatggatctgtgctccaaatatggtatcaaatcttcagcgccacattcatagaaagaaagaataattgtatttcttgttacttacccggccctgcgtaacccacatcaaagtatacctgtctttggtgtttcaacaggtaatccctagatataatgccaagtggcatttctgctacatggtattcacagttaagaccattgaaatcccagttttaagctagaatgcttttatgaagcctcctccaaaaaaagagaagttttcaatagcacctttgtcttgcaatactttgttctgattgagtcagaaaattgtaatatttaaacaaggaggcagttactcggaatagtattaaaaaaggagtttaaagtatggagttgttgtatctgttggcttttaatttagtaaaacaagtagaccaaaaagaaaatgagtgctgttgacgtaatattattatggaaagttctgtgggggcaaacattatgcaaaagtagttaaatctggcactgattttgaatttcagaaaataattctgttgtttttgagctttgaatggcttttactaatataccaataataactttttttttttttttgagagagagagagagagtctcactctgtcacccaggctagagtgcagtggcatgatctcggctcactgcaacctccgcttcctgggttcaagtgattctcctgcctcagcctcgtgagtagctgggactacaggcgcctgccaccatacctggctcatttttgtatttttagtagagacagggtttcaccatgttggccaggctggtcttgaactcctgacctcaaatgatccacctgccttggcctcccaaagtacagggattataggcgtaagccaccacgcctagccccaatactaattttttaaagcatgatttgatgtcccagctgtagccatgcaattttgcatggtagtagttcataaaaagaaaaggaagttgtggctttgataggatgcttccaaggtcgtgtttttaatacttttggtaaattctgttacttgtgtctgttcaaaaggacagaggttgggagatgcatatgtggattctgtctcttcattttatcttcactccccgtttggtactttgtgaagtcaggccaaataaaatagttgaagatactatcatataactctcaatattatggcaaaaagagaatgagaggaaaatatttagctatttcttttttaggatttttactaattgtgttattaaaaaggagcaaatagagcaggaactgaaacagacttaaagtcagaggactggactgcacacattagcatcttgcagaccttagctgctcatgatttataaatgcttcagaaattatcaaagcatgaggcacaggctgtgtttcagccttccccattttcaccaagcacttctgcaacacctaaacactgaccttttcaagcaggcatgaataaaactctcctctgggcagaaggtgcgtgatgactcatggcaaccagaaaggggatgtgtaactcgggatgtggagtctctgggcttctagacccagacctccctgtcttctggcccactgttctttctgttgtgctacagcaatacctgaaggacctgcgtgttgaacaaataaggccaggaataagttgtcaataggagcacatgacatcttgtctttaaaatactaatttcctgagacgtcgttctacagctgctcagcacagattgggtatttatcatctatatgttcaacttacattttattttcattttattcttgatatgcagacatacttttctccaatgtataattatatttcatagcaaactttgcactacgtccataaggagatgtaacctgcatacaaatacacacagcagcagtctctgtatgaataaatccttacctttatgtgataagccatgctaatgataagaagcagtgacatggatcaacatgaaatataatttttttaaaaaacctttgaggatagacatttttccagcatatttatctctgataatgtgttctttaggccggtactaattttggattttattccttgaacacaaaccagttaatatacacagagaatattctgagtgcatgctaggtatccaaggactgccagtttgtaagaaattttacaatggataactcccataaatgatcaaatgttgactgaacagggaacgcatgatattgtgaataaatcatattcttcagaataccttgagttttggcctacctcccacgctgacctccctccaactcttcttgaggtctaactggactctcagtccagccctgcactggagatgcctctcagtccagccctgcactggagatgcctctcagtccagccctgcactggagatgcctctccatgggaaaggggtgtttttggcccagtttgcctgccacttaagctccttggtgggcagggtggagacagggctctgcaccctgctgggctgagtgtgctcattcagaggaagcatttctgaactctgcaattgccagcagccctggcagcttctctttattcctcagaaaggaaatacaaagagttacctttagttctgagttggaaaaagaggctgttgtggaacatttcattgagggactgcacagtttccttagagacttatgtgatgatttttctccaagtcacccaaaagggtgttcttccatttgaacacctgtcctcttccatggaggacagagactcaaagacatataacgtcttcaagtataatgtaatataataccatgttatcaatcagttaatcaacaaatattgatcaaagagttatcatttgcgaaagccccgtgaagcttacaaaaagaagacagacataaaccctacctttacggaagttaccacattccacttggggagatgacacctattgtaggataaggaataaaatggttagtaacataaggaaaatgaattttaaaaccataggcattcacatgcaaaaacaaaacaaccaaaaaaaaaaaaaaaaaaacttctgattgagaaagttgtagaataagaggataaaagagttgtagaaaaagtgggatttgagctggtcttgggaggtctggcttacattttgacacgtggagtagaaatgcgggctctcagagaggaagtgagaagctcactgtggctgcttcagtgtgcatgaggggagaagtagaaatgaagttggaaaagcatgctggggccagattgtgaagatcttcagcatcaaataaagaatttcgaagatgttcagtaagctgtaggaaccaatgaaggtatggatggcacggggaagttgtgttatatctactttaggaagttcgatccaacagggatgactcaaatggtttagagagagaaagcattgacaagaagaccaatgagcaggctgctgtgagaggaattcagtctgagctagcatggggcggtgaagatagaaagggtgcagaattggtaggacttggaaaccgatggaatgtgggagaaagagtagaagatgatgatgctgtcagcttccatcagaaattaaagaggaggagctgggtttggagcaagggactgggaaagtttgaaataaacataatttgtttccactgcatatatccaggagtttgtagggggagataccagggaccaggatacagatttaagaacgataaacagtagaaggaaatcattatagaaagtgaatagaactgagcagatagccttaggaaatctgtcccctagagttagaaagaacagagagagcaaaaaactgcagaggggccataaggagtaatataaggaacccaagaaagtaccatctcagagaaattaagaatatttgtttattttggttacaatagacaaattaaactcaaagtgattcaagcaaaaaaaaaaagaaatgtattgtattatatgtggattggttttctattgctgtatgacaaactacaaatatagtgacttaaacaacacctatttatttttttttgtgtgtgcatcttttctttttttattttttatgttattattattatactttaggttttagggtacatgtgcacaatgtgcaggttagttacatatgtatacatgtgccatgctggtgtgctgcacccattaactcgtcatctagcattaggtatatctcctaatgctatccctccccgctccccccaccccactacagtccccagagtgtgatgttccccttcctgtgtccatgtgttctcattgttcaattcccacctataacaatacctatttattatctcacagtttctggaggtgcgaagtccaggcatggcttagttgaattatctgttggaggtccgaagtccaggcatggcttagctgaattatctgttcagggtttcataagactgaaattgaggtgtcaacagggctgccttattatctggagctcatggtcctttttcaagctcacatggttttttgtatttagtttcttgtggtcgtaggaccaaggtcccgttccattgctggctgtgagctgggggccactctcaggtcctggcattcaccttcagttccttgccatatgacttgcctcctccatcaacatgtcctctctcactttgaatctcattcctggtaaagccccatcccttttagggttctcttaattagatcaggctcaccaagataatctctctattttaaggttggttgactttggacctcacttatatttgcaaaatcccttcacaacagcagaaccttgattactgtcccactgactaactgggaagaggtgtgtgtctggcaggggacatggcaatcttgtgggctacgttagaatttggtctatcataatataactaaaaattccagggatcaggccgggcgccatggctcacacctgtaatcccggcactttgggaggctgaggcaggtggatcacttgaggccaggagttcaagaccagcctgtcttgaacatggccaacatggtgaaaccctgtctctactaaaaataccaaaaattagccgggcgtagtggctggtgcctgcagtcccagctactcaggaggctgagacaggagaattgcttgaacctgggaggcagaggttgcagtgagctgagattgcgccattgcactccagcctgggcaacaagagcgaaaccttgtatcaaaaaaaaaaaaaaaaaaaaaaaataataataataataataattagccaggtgtggtggcatatgcctataatcccagctactcgggaggctgagtcaggagtattgcttgaactcggagtcagaggttgcagtgagtgagaccgtgccactgctctgtctgggtgatggagcaagacttcgtctcaaaaaaaaaaaaaaaaaaaaaaaaatccagggatccgtctaacttctggcatggctaaatccaagggactttactgtcatcaggactcagattttctgtctttcagcttttctctgtactgggaagcttccttctccagtgggctttctgtaagaggtggctaaagaaaccagctgttagtagcatcatgctcccgtggtctcactaggaaagagtgtgttgctcctcttagttccaggtagtctgagagaggcctttgattggcttgccttgggtacatgcctacccctaggccagtcactgtggctggagggttgttgtattacgattgcccagacctgggtcatatgtccatcttccaggccaatgtgtgaagtcatcccagcccagataacagccaaggggagagatcattccagaaaagatgctgttcaggcaaaaatgctagtctactaaataaaaggaaaagaaaatggaaggaactattactagtgaactgtatcagacattgttagagaagttaagaggaggactcagcaaaggtcactgcatttagaaggcaggaaaccattcttgacctttggaggagaaggaaggttactaacacagagaaaagtggtggaaatcaagctccagagttttaagatgtaggcggtgaaatactggcattgaatgtatagtacaactgtttgttggtaaacagaagagagaggacagccatttgggactgtattagggtatggataaattcttttaggaatagcagtgactgagtatgcttggagtgtgagaaatttccagtagagaggaaaaagactgaagggaagttgggagcagagttgaccccagcaggatctggaaccagtaggaggagaatggattcagactccaagtagagaggccacacacagtgtaataacctgggtaatatagtgtgtgaagttttttgttgtttggtttttggtttttttttttttttttggtcatttgtcgcttctttgaaatagacaggtatcattgctttcaatgtagctatcaaatggtgattaaatgtactcaaaagatcctcagcatctctctggccctgtaattgacagaaacatttaaccttagagaagtggttctcaaagtctggtccctggaccagcagtatcagcatcacctgggaacttgtcagaaatacaaattatctgaccccaccccaagcctactgaatcagaaattctacagatgggtcttagcattctctgatttaacaagaccctctagccatttctattcgtttctttcctttttttgagtcggagtcttgttctttcgcccaggctggggtacagtggcgtgatcatagtgcattgcagccttgaactcctgagctcaagccaccttcctgcctcagcctcccaaagtgctgggattacaggtgtgagccactgcacctggccttctccagccatttctgatgctgcttcaagtttgaatatcactgcctcagaggtctgcatctcccctccacatgccatgaaggtttccttaatagtggctttgagaagctatgagagctagtgatgtaagctgctggtgatgaggaaatgggggagtttgtaaatcttgaaaggagatgacaactgttcaaattccactaatgacttaagatgtaatggattggaagaacagaatagaaaggctaagttgtaatttaattttttttgagtttgtggagggctgacacatgatgatgataggcatcatcagactttcaagtccctggaagacagagaaaggtgaaatgggcttaaagcatagctgtagactggtgattcttttggagtaagggttaagtcctagaacaggttttggatatggatcatttaagttaaatccaggctcttccactagatgctgttaggaggttgcaaaagaagggcatggcaaggtttctttcatcagagagcttagaaactttttgagccttcaagacttaaataaatccagtggagtataaaaagacagtataacaaagtgctgaactgaaaaggaccttgggtcagaatgtgtggtagagactgtaagtgctgtgggcagtcaggggaaggagaaattggcattgtgtcattttctcctctaggcagaggatgaaactgacagcctggcgtaatttcccaggtccgatggcaagatattggacaccttggcttcaggaagtgctttttcttgttctctctctcctttctgagtgtgtcaaagttgccaggtcaaagtgaaggtttatactctgagactttgaatgtggaatattgttaatatttttgtttgtataagaagcttgtaggataaattacattttatcttggacattttaaatggaaagagactcaaatagaagtttggcatatttgtttcagacaggctttcagacttactccattcatggggagaacatgaatgagcctgttggatgatgctttaatgttgtaggatgaagaaagcaaactactgattttccttagtggaagaattaagttgagccagatgtgggatgatagggaagaagaaaacacttcagatgaacatgacatttccactgcttttaatttctttgcaccttgcttgcggctcatgtgggtaagtaaacagaccactgaaccaagaaccaagagagaaggttgacggaacactgttaacggtgggcataaaagctgtttaagtccaagagagaaatagtaaaaataccgtaatcatcaaggggaagccagaaatctggtacctgatccaaggtcctaaagatgtttttcagaagtctacaagtaatgtgatctgttttcagtcctttttgggggagggttttcttaacttcagctgtggcatgcaggtgtcaacaagagagcttccttttacttcactgtgataacggagtgacttggggtgcattagagagcagggtcattatttgctgtcacatcaagaataatacctgcatcaggggtgttcctctcaccgaaattaatcacagagaaggtgtgtgttgctctgatggcctagcagtcagaaagatgaatcatctcttatttcaaggtatggagaacagttgtgtcactcatttctttttcaaggagactcagttgaaatggcaaaataaaaaagagagaaataacagaacacagttgtacatcactagatcagttcgtataatacagactgtttcctctacctggaaacctgatgcctggctaacttctgctcatttttgactttcctgttcgaatgttagttttgtaagagaagccttcctgagaccctccttctaagtgaggtacccccatcatgactacaaatcacaatgttcatttttccttcatattgcctatccagttttcaaattttatgcatctcctaaaactcatataattatttaattctgtccctcttgaggcagtgagctccttgggtgcagggtcctgggctattttgtttaccatgtattccccagttgaacacagagcctggtggatttagcaagtaccaagtaaaattgtatcaagcgaatgatttaattaatgagaaagcacttggtaaactgtattcattatgaaagtgatggttaattatgtgagtagcagacacctcctttctctcttctgtcccaattttgtctctccattttttattagttctttattttgagatatacttgtcagtgtgttaccaattccaaatctaagatttgttattattcattcttgcctttttttagagataaaggaccactcttttttgttttttttcctcagaaatgctattaatgacacccacaatgctaatactacaactgttttttctgtgcatgctcatgatttgaaaggaaaaacatgactggcctttgtcgatgatgtatttgggaagcaacaagattctagtgtagcacttaaattctgtttcttgtcatcctcaaagctgctaatacaagttcctttgcctcaagtgtgcttctcaaaagtatacaaggcgaaataagttgatagtatcgttccaggagaagctgttcctgggtcagccttgaaagggggaaaaaaatcaagaaatccaggtgtggaaaatattaatgatcaggatatgaataagtcttttcattaaaagcaacagcaaataaacaaaaagttatccaatccttttccagcagggcctcgctgtgccactctggtgggtgtaagtgttgtcttcggtgggcggaaatggcagacagccaagtggaaaatttcacagtgtcgcaaacattcagtgcacgaaacgctgcaaaccagcaatctgagggagccgtgtaccaaataaccacgctcctgcatgtgccctactgcccaccttacactctttctcctagcttcctgcgtgatgccttcactttctttttcccggagattccagattcttcgtttctgttcctattctttcctgaaactcagcacagtagggcatgcagacgtttggatgctcccgggatagttgatgattggtgccttaccagtgctggcttttgtattctggctccagagctcaggaacaggcttatgaccaccaacaacgctttgcattaacatagtggatttcttctcgggaactgtgtgtgctttgcaagaatgatcttcttgatcttctccatgacccagtaagatatgacagtggcagaaggtgctagtccttgcctccttttgcagaagagtaaagccaagtggcctgttttgaggcttttgcaagtttgcatctcagctaagattgtgtctgaagtctcccagaaatggcttcaactttggggtgaggagaggctggctgtaccatgttgtgttctttttgggaaaagagcaagaacattgaacttcttttttaagaaaatggtctttggtgaactatcaattcgtctaattggtcgtgagactgtatttgttcagataacaagtgatttgatgatgtgtttacctttttctttttcttctgttctatttccatgctaggtatttctcacttctctgtgaaaggaagaaagaacacgcctgagcccaagagccctcaggagccctccagagcctgtgggaagtctccatggtgaagtataggctgaggctacctgtgaacagtacgcagtgaatgttgtaagttaacaaccaagaacaatatgtgtagtggcttgccttgtaggattcatgaatcacttgatgtaaccgagccaggtgttgaaggggtattagcatgagctctaggtgatcgtccaattaatttctttttttaattggaagggaatttaattttttaagggaagaggtcctgtttgtatttgctggaacttgcctttctctcggcttctatggcatgctgcaaactatctacttcaggaataaaaggatggaatacagtgattctttcattgtaggaacaccttttctactggtacagtcaaatagtatcagatttagagcagcccctttaaactgggctgttgcagttcttttaggttggtgagtagggggtaaaattctccaggctaaggattagcaatcagagtttccatccagcaattattcttctgtatgtgcagttgatgaaaatgacatttttctctctggcttgtaaaatcttgaggtatgcaagttacaagcagttatgtttggtgcttcccttacttaaaatgagctgatttactggttttgatcagttactggcttgggattttgagattagtaaagtttgttcccacatgtcacctgatggccgccttgcatgagaagttttagtgtcaggtaatggaagagatgacatagtgtgacttcagggagcccttccactaggaaataatgcaaaggtgctcagccctcctactttctagagaatttaccttgttgctggactgtgtcacaaaacacagttaggagattttgaccaggaaagaaaatagctacatgaaacccaggatggcctatgaatacctctgaggacgagaagatattatcttcaaattttaggaaatgacaagccaatttcttctaggtttttgttgttgtttttgtgtatatataaatacatatatttctgtaatatatatgtatactcttgtttatgtatgtgtgtgcgtgtacacacacacacacacacacacacacacacacacacacacacacatatatatttaggtttccagcttcttaactcagccagaaaacttttttgaacatgtattacctattttttttgcagttgcctacaagatttgtaaagagcaaagtgtagcatatatcagggagaaaagtattgacaaggaaaaaaaatgttcctaatttttttggtttcatagatttctaaacatttgtattaaaatatgcatatgtatccatatcatctcctcagggttaaataatcagtaatattaatatgagcttattaaattcaaattttcccagtgcttcattgaaagcagacagtgggagacactgaagcttcattgtgtttccattctgtacacgttgggtctagtggaaatcagtcagcctggaatcagctgacctgaatcctattcctactgttgagatcaagtacactggcaaccttgggcaagtcgcgagcccccataaaacaatattttgcaagtctgtgtattgcttcatactaccttattttcatttttttctttttaattgaggtggtgccttactctgtcacccaggctggagtgcaatggcaagatctcgattcactgcaacctctgcctcccaagctcaagtgaccctcccacctcagccttcagagtagctgggaccacaggtgcacaccaccatgcctggctaattttttgtatttttggtagagacagagtttcaccatgttgctcaggctggtcttgaactactgagctcaagtgatcctcccgcctctgcttcccaaaatgttttgattacaggcatgagccaccatccccagcccatactacctttttattaagcaatcagcatcttggtttagggtcctcataaggggaagagcattgtgaaagcactattttacttatttttttaaaaaaaaccttattgtaaaagtttctgtcactatcaaggaataattgtgggccatgttagatttgggtactccagttacagtgtgttttactagaaatcattttcccaatcaggtaactgttagaatgcacttctggtggtattttttaaagcatttttatcctaggaaacaagtgtcttatgtaaaactgctttaggtttcaggctctatttaaataactcatgcagttaccataatcaagatagcttttgtttcaaatctagtgggggttttttgttgttgttttaaccgttgctttgaactgttcatgtgacaccctgtcagacctcaaagattgagtgaggttttcaaaggacttctgaagtgtacactttaagatgccacatggcagacttgaagtaattttaaaatccttctgtaaatggagtgtgttgagagagcaaggaaataccaaattctagtgaactctttgtgcatgctaagtactttcttttcaaaaccgcatttgcttggtaggggcagtggggggttcctagttttcttagtaaactgtgatgttggtaacctttcattatctgggcacatgtttacaacactggttttctgtcttcctgggtttagtgtcctgcatgccccaaagcctgtgccatggagaactgttgcagtagagaaggcaggcaattttcaaagaatgcatgtttgcacataaacagggtctaggagtgggtgtataaatgtgtgagtgataatcacagcagccattggaagtagtggttcccatgctcagcagtccttgcagatgttactcctggcattcattcctgtgcatgtcccattaactgcctctcaaatctgccaccacttgccagcagatggcctttgcccctgaagatgtttcagactggctgtaagggctggggggaggggggatcttgtacaagaagagaatgatgctgacactgaactcagagttagcagacctggattttatgcacaatgctgttgttagccatataaccttgggtcctctctaccatggggactcattttatgatggacaacttgagaaaattgagttaaatcacctccagtggtggtttttaccctaagtgtctcaagttgcataaagtatcagccttagatgaggccaattgaacgtttattttaccttcttgggttcctaaaaatcaatgatttggcactacctcatttacaactgtttttaaaacattgagcacagtcttagggttaaaagaaaaaaagagttattacatctttcactaccatgaaaccctttccacaagaccctcctgggcaccatatgacaattcaaaggtatttatttgagactgtccttagactatagctttagctgtttaaatttagggtccacactcattggtccttttgaaaataaacaggaacgatttttgaacttgagttttctaaaaccacctctgtgctcaaatattggttagagtctaagcaaggagaaagtgatccatatttcattcctaagcttctctgcttccttaagtaggaattcttgagttaccttatcaaagcagccttccctgatctacataaaatagcatccaccccatccctctcagtcctctagccttctgtgtttttcttttaagcaccttacatattatatatttatttgttaatcatcagtctcctcaactagtctgcaagctctgcaaaaggagggatggtattcttatccttattctcattcttattcttccctggtgaatgaatagtacctaaaatactgcttgttcccataatgggcagtcagtaaatattcattgagtgaatgcctaaatgacattcactaagtgaatgcctctcatgtgtgggcctgagccattaggaaaaggaacatacatgctgttctgatgagaatgcttgaatctgatagcagtttaagggtgtggggaagggatggagagtctagactattttccttagaagtggatacttgatgtgtataaagaaatgtgaggagggaacaatttgtgtaaaaaaaaaaaaattctagacctatcagtagagtttggggattttctaatactttttttaaaagtctgcactgtctgtatttcctctccttttccatttgagtggtttgctttgtcacttgtttgtgagcatcctgccctggctttctgtgaacggcggtggttttgtctcttatcatcacatcatttcatcactgcttacgttcatatttcttttcaaagtagggatgggcctgaagtgctgtatctccctagaaaggggctgactgaataacacttcattctagtgcacaccttagaatgaaaaaatggtgtgctggtacaaatgaaacccatttaatgtctctgtggtgtgtgatgggaagttcacaaaagctttcttagggaggcattgtgctagttagcttttgaggacagcaataataaaggtttctggaattttgtgtgtctatggactcccttttcagaataactgctctgagtgcaggcattactttattcctaggaagaaatggagagactaaaataaatacctctgtacctgtgtaaacagcattatgctgtctgtgtaagtcttaaaaaatgggagctgaatttctcttactctgaatctccagactaagagaattgcacacacacgcacactctaataagagcaatctgggaatttccctctgtgtctgtcagtttgtaccttttagatttgccatctgtgataccaaattctccagcgttacaaaaaaaaaatctgaagtagataagagggtcaggagagaaggggagattccaccacttttggacaagtgagggagaacaatctcctttttcttaaatccttgcttgtaatgctcctgcagattgacctacagattgtaaaggcagagaggttatgactgagctcattccatccaagtgcactggggatagcttcaagtcttctagagttttctctttcacccatttctctctcttcctcagacttccttgaatggcttctgattgacagcttcactagttcctggccattgcccctggtgtgttatttgggatgggcacctttggcagggtctttgcaggagtcactgcttctaagaagtggtgtcagagctacctcctgaggcaactgacaaagcgtagcccatcccaggcacaccctttcccctcagcaccttcttcctcaagtactcagctcctcctctcagcatcttggagaggaggaggaaaatgcaaagaacacccagacgttgtggaaggaaaaaagttcatggatcttttacaacatttgtgttctatggggtgaaacaacatcaacagcctggtcaggctgctttgtaactgaatagtgccaaggtaaaatgcttttgtgtcctctttaagtttagagttcactcaattacatgatatttattaaaagagtgttgtgtgccaggatgttcttgagtctatcagggatccagggctgagtaatctgtacttactgccctttgagactctaggaaggtgctatgggaaggatgtacttggtggcggagtcaggtgtaccgaaagggacgatgggtaagagttgtcagcgctggaatttcagggaagacatctaaattgagccttcaagcagaggtggaatttcaacccaatatatatgtgtatttagagaagacaaaggatgctttgagaagagactaggaatagtattttatgtactacttctgtgtctgggcatgtgagagctcagagccagagctttccttccatcagaaattgtttggtttgaacactgacaaaaacatagcatgaggatttgtagcacatggccaccaggccaccattttcttcaggatcattttagatatttttttttttttttttttttttgcagatgaagtctcttgctgtgttgcccaggctggagggcagtggcacgatcttaactcactgcaacctccaccttctgggttcaagcgattctcctgcctcagcctcccaagtagctgggattacaggtgtgcctcacaatgcccggctaatttttgtattttttgtagagacaaggtttcaccatgttggccaggctgatctcaaactcttgagctcaagtgatctgcccacctcggcttcccaaaatgctgggattataggcatcagccactacgcctggcacattttggatctttatatgtaaaagttgaagcaagaacttgggatgcctaaagaatgatgcctcccagcattagtaagggcagtgtttccaactgaactttgtacagaaaaacccaaacaaaactaaagatgtattttttaggtggtataaattcgaagtgctcaatgttcaagaatccacaataaagaagggcagggatgactgaatagtgataagaactagttgacattgtttagtcatagaacccaaacaaaatctattggttcttaacaacacataaattactccttaggactaatgtaaacagacaaatagaaaggtaacttcattttttaattatctaaatttttcacttttgtaaaagaatcatattataccataaaaatattaaccatgtctccaacttaaattcatgttaaatttccagtggtagctatgtaataaattattgctaagtagaattgtagactgaaagaattaatccatcttctataaatcctgaagattatgttaaccttttccagacacctaaacaagtatgttacatgattcagaaaaagtcatttttgacaagtataaaatgattttgaggtgtgatagcaaattagctgtttcaaacctatgttagagaaattaagttttcagagcaatttttttttgtatttgtgcttatattcctgaaacaacttgcttaaggagagtctccttaaatggaaacataaatggtatacaaatggctatcctctatcataatcttttatttccaaaactcagacaggtttttatcatcatgctctttggactcttaaccatcttcttctacttttaaattctacttctttctcaatacatttttaaacagcatcttgtgatcatttcccagtcttgagtgcctggcactgggaggtgacctgcccacattgctgtcagaattcgctgctggacccctgcacaggtcccaggctgttggttacgtgtttcaatctgcacatcagccatcctcaccagccttcctttgtgcatctggaaataaaaatgctcttgataaaatggttttctaaagtttccattaggttgctcttcatttcatttttcctttcttcttcccaagcctttgtggcttgcatagaattgaaaaaaaaaatgtaatttctccagggctaaaatccaagactttgataggcagtcttaatgcatggggctcctacgagttgctacccgttataagcattgtaaaactcaccctgcagaacaaagagaactgggcacaaagattattctcttcttcaaccatggcaagccctagttttccggtttcctttgccttttccttctttgatctctaaaagaaggtagaagagtagaacgctattgttcagaaaggagaaagctattgcttgtccaaacagattgttttttccttctgtttggcaacctcaatggctctacctgtttctggctgtcatacttcggcttgtgaacagccttcctccctaattttcaggaaactaacaaattaaaggtgcaaatgtcaggtggttactacatatctactggctcacataattcaaaacagagtcatgcagctcctatctaaagctagttccttgccccttctcagtcactaccacatcaagcacaaatgtagatgaaagggtagtgtgtcaaggtgagagctgcccactgggtagtgttactcggtcacttgctataggggacagattagctgccaatcagtatctcatcactgtcattggcgtttataatccaggttcctagccccactggtgatctatttctgtgcctccgcagtgacgccagttgtcctagcaacgtgctggctggcacttcgttaaaggcaagtaagggagtggtggtggaagagggtggcctcgagagggtcagaagggagttggcagtcaccttgctcaaagaggattttccatttccctcatctgggcaggcctccaggaggaaaacgtcacttactaagtgtatcatgggagtgtcacttactaaggatcatggaccacatggtctttctggtacagatagaatcccacggagaataacaaatgaattaatgggtagtccaggcagaatgtggggactgccgggccaagatgttaggcgatctcaaagcatctgatggtatcagtttttcttgtgaattaggttaatgttttgcttgtttatcagcactggcatgcagagttggagacatgagtagatgtttgggaggaatcagaggtcaagggaggcagaaggaagggaaacaccatgacagtccctcttggccccttttcctgttgacaggtctggcctgaaagccatccagtgtaacgagagccttcttactgagctctggtaatttatccatgcacccagccttgaagaggaatatggctcactttgtaatcttcttaattgctctcctctcattatgccacattgaattggcactaaatgactttttctgccattttccgatttggatccaaagaacatagaaatactgtggattgtatcttaaagtccctgtccaaagtggccttgcctagatgaaatctaaaatggacagtcaagtgacattggcagagctgggggcttccctccatggccacttctctgtggaagcccctaggcaatgggtttgggtgacattttctcctgagagtgcttcgtctgtgtggccctggagatgccaagacatttttcacgaagaaagagactcaaggtgggtctttgcaaggaaatggggaacaagggagactgatgaaagggtgtccccagagcattgaagacccacagatgacaggaagtatgacgtatgcattgttgcctttcccttcacgactaaaagagtttttgtagtctcaatgaccgttgtcatttgttccactgaatgaccacactcaagtcgagataattgcatgaaactgtgtgcttatgatgggaaagacatttagggtgtaactgaccatttctagcacgttttgtatactcaacagaaggtatattcactccttctaccatagctgaaataagggctggtagtgaagatctgggactggaattgaaagaaataatttttggaaaaagaaaaactccaagggtagctgttggcactttcagagcatcccatattttcaggatgttttgtatgagataaagtaaatcagttttgtttgacagggtgtagtgtgcccagccaggtcattattttaaattgacaaaatgatttaaatgatagaagacattgtatattcctgaaacaataaatacctattaagtacattttgatacagtggagaagtacagtttttgttttttgtttttttttttggattattatataactgttaattcaacacttagtgtttaaatactcatcattctttatagtgcacaggtcataaagatagttctctcatatgaataagaaatacaactaatgtgaatggcattaaagttagaagcttcaaattcttctctgggtttgatggttgcttttttagaagaaatttggtaaagtagatgatagaccagttaggtttcatgaacttcgtgcttcatattcttttcttttcacaacctagctagatacacagtaaataactggaagcatactagagtagaaagaacccttcttcctgaataagttgtcgttgatcacaggggtaggcgttaatcaaaatattaatgactaggccaggcacagtaattccagcactttgggaagccaaggcgggtggatcacctgaggtcaggagttcaagaccagcctggccaacatggtgaaaccttatctctactaaaaatatatataaaattagctgggcatggtggtgcatgcctgtagtcccagctactcgggaggctgaggcaggagaatcacttggacccgggaggtggaggttgcagtgagccaagatcatgccactgcactccagtctgggtaacagagtgagactccatctcaaaaaaaaaaaaaaaagtaatgactaaggagaagatagggacaccttgggctctgtccagtagcaggaacctcaggctaagaagggacacctgggttctcttcccatccctgcccttttagaccagtggcaagctactctctatctgggtgcctctatttccttatcttccaaaggaagatcattatcactgccacttaacagcatcagatttaaagtattagttcatataagagactctttgaatcacatttgggttcagatttcagacctgccacccagtagctgtgtgtcctttgggaaattgcccaacttctctgagccttatttacttcatctataaagaaggtctgaccacacctaccctgatgacctgttaagagagttaaatgcgataaagtctgttaagtttttagcccagtgattgctccctaataactgtggcagccatgatgctgttatgataaatttcacacaacaaaatctatcatgatgcgttgctgaagtgaacaggtgagcagttgcaacttgctcatctctttgttgtagagacatttctgctataataggagttgtcattaactgtcattgtcattacactgacagtgaattcggttatgtattgttaagaccttctgcttccttgacatgtatatagtagaataattatgacagtgaaggtgacacatttgtcagaattatccatgtgcatatgctgagggcccttggaattttaggtgaattttatagtattagtcaaactgaaaggcacagtgagtttggaaactataatagtctcatctataaaaggagtagggagattcccaaaggctgttgatatgagtagaactctgaaaaagtaaaacattaaaatacattttgatgtggttaccgtgtctaggtggtgataggtaaaaacagtctagtctaattctttgaaatttaggatagaagaaagcctgaagatggatatctacattcttgtatcttctttcagcaaatatttacagaaagagagagagagtgtgtgtgtgtgtgtgtgtgtgtgtgtgtatgcacacacatatgctacaggctaggcacctacagtagttaaaggagctttcagtcactggggaaagaaatgagaaaacaggcaattcctttacaccatgaccagctctctcctaatggtacccacaggttgccatggatgcagaccagcatggcatcttctgggatcagggaagctttcatcctcagacttgaatgaggagtagatgttaaccagaaaacaaagtggatgtatcagttagcatatactgtgtaacaagccatcccaacagttaagggccaagaccacaatcttatgattgtgggtcacctggactattttagtctgggccagcttggctgggactggttaatccagcatggtctcactcacatagctactagaaggctggtttgcctgagagatgggtgatcttcagctgggacagcttgtctctgcttcaggtggcctctcatcctccagtagactagtctgagcttcttcactttgcaggctaagggttcccaaaagcagcaagaaagggcaagccccagtgcatgagtgcttttcaagctctgcttcaagatgcttgctaatttccctttaaccaaagcaaattacttaatttgttcagttcaaaggatggggaaactccagctctagtcacatgaggacaacatgagcaaagctcaaaggtaagagagaacatggcatgttggaagacagcaagtagtttggagtggctggagtcaggcatatgtgaagtctcatgaagaaaaagccagatcataaagtgtcttttcagtaagttctgctgaggagtttagagtttatcttgaagacaggggagtggtcattgaaagagtttaagcaggatgttgacatgatcaatgagatgtgtagagacatggttaggtggtagaagcctaaaaacactcgttagcctagacaattcaggaagtttccaaagagatgacccagggatagcataggagaagatggaaggacttgactgagaggtggctcaaagctgacgtgtactttcagaacaatgtgaccagaaaagaggttggaggcccttcaaggtagagcagaaaagacagaggctcaggtcatcagcaatatccgtatgaatctggtgggagaactccaccagtgttcctcacctcgctcctttgtgggatcctgccagactccaatgtccttgggttctaaataaacacctaccaaggggctgagtcaaagagattccagtctctggaagtgtcttcttgtcattgtcatcacccagccaaagactcttttccttccaacatgtttttccctttgacctcaaaataaacaatgtgttctaaaggctctggggcactctcaaaatgcttctctgacctcggataggaccatgcttacccattaatttccagatctgaccttttcactacacctttaagcataactctttcaaaaggcaaaaatagaaatgactgtttcatttcaccaaattcaagtcgccaagagtgagaacgtgtggttttcaccggtacgtttggggaccagtttgttgtcactgaaactgcctgatatcgggtcggagtggctgggtatttttcagtccttggggttataactcaaatgttggaagtggtatcttttataggtaaaattgagggaggggagcatcaaaatgtgtgcgatgcagataataatttgccaagttttctaatttttttcattaaaaaagaacatacagaagagtctacaagtagggcaggcagccttcattcctatgctcttttccttgagggacaccttccctaaccaaataattgaaaataaatgggaattgtgggaacagaggaagacaagaaggaaaactaaaaacccaggacctaatcttccaggggcaggcaggccacttttgtagctcagattctgaccttttctccaatcaaagagttcgaacagactgactgattggagtgctctgtcagcattaaactcaatgcagggttctgctctggcacctttaggggtggtggtttagaccctctgcgtgccatgtcttatcaccagcactgctaactgaatgggatgcattttcaaagacaggagagggtttgaaaaaccccagggcatgctcggagcctgcaggcatttgtttgctgctgagaaccatggcaagcatttttgacatttttatcagagtcttagttaaacaattatgtggaggactgataaagaagtgtgtgataggagacttcataatttaaagtgcccaaatttggtgagctttatactcatgtgaaatggaaatgaaaacatggcatgttttggaattcctgattctgcttatttgctttaatagcagatcattgcataaacactgactcattgcattctatactgaaaggaagatatggtttgctgtgttcaatctggtctggcttccagaacacagtatagaacaagtgccagaagaagggatgagctcagctttataggtgactggagagatacccaattccatgttttgtgctgtacaaacacatgaccttacatgaagttttgcataaaatattgaaacaatacatttctctttataaatatgtatgtaatctgttctagagtgtatggagtagacagtaaaaaaaaatagaatcttcttatttttggaagtggggtgaagacgcaggtgtgcatatgctgccacctgcgtgttatttcactgagttttgtcaggttcttttcttactcatctgcactttgtatgttaccttaagcgctgtaaccattctaagctgccagggacatgggtatgcaatcaaagtcaacactgtgattaaaaccacctcctgttgtttacctttttagaaattttaataatacagtcaagtctgaaagagcagaacttttctcaaagctacacacttggttgcctcttcttgattaatgcatgggggtggtcactgtaacctaaggtctgacagatggtgcggagattgatgaagttaaggcctgttaggtattccgagtgtcttataaagaaaaataggctaccttaattcaaattgttgttgctcttccaaccttctcttatgtaaactccctgtatattacaatgacagactctctctctttctgtctcacacacacacacacacacacacgcatgcatgcacacatacgcacactcctgacatgctctactgaaagctgcccagctacagagaggtgcgaatctaatccagggcacatggctgctttgcatttcactggctgtctagtgtcactctatgatataggcataaggtcatgactgtgagctatcattgtcacttatcttaatattaaaacccctctgatccaatctgtctgccttatctattacatcattcacatatctagattcttcaaacttaactactcattgcagcaaactcaggaatgccgagctctaaggcatctccatttacttcgttcatctcaatctcaaattactaaccatagttcagtttcaggatgacactgaaaattcaaaattacttcctgtgattaacttacattgtgatggttgggaattatttcgcagaagacctgttcatcttctgatgaagcccttttcaagttttgaattgtgtgtgtgtgtgtgtgtgtgtgtgtgtgttttaattgccagaagtctttcagatagcagggagattattggaatgagaaagcaaagcttgtatgaaaacttgtggcaaaaggtcatctgtgctgtgggggaaatttcaaagtaggcgcagtttgtttccagtggttcctgcctgtcctttcagtggctggtcactctctgttccctttccagacgaatctttcccctcttccaaatgcctcacatcagtctaggtaccttggttggcctgtggagaaaaacagtcttgttgagacactcacattaagctgatagagaccttggctaggataattgcatttttcaaaggctaagggttggaaggatttaatttttctcttaattattttttatagagatgaagtctcactatgttgcccaggctggactcacactccctggcctcaagtgatcctcctgtcttgacctcccaaagtgctgaaattacaagcatggcctgaatttttttaatggtgatttcagctgatcccaggggagatcttttgggtgtcatttttcaaacagattaggaagcaagcagctgtctacctaatcagtctaaactacccattctgacttctgtccaataactttccatataaaatagctaacataataataatcagataactttgcatgtaagtttcaaagctatggtatagttcaccaacataattttccagttttttttattatagtaaagtacacataacataaaatttactgtcttagccatttttaagtgtatagttgtacattcatattgatgtgaagccatctccattgtcttgtcttcacacctctttttttctggcaaaactgaatctagacccataaaatactaatgctctaccctccaccctagcccccggcagccaccattctacttgctgtctattattttgactactgtaagtggctcatataagtggaatcatgtagtatttgtccttttgtgcctggctcatttcactgagcataatgtccttcaggtctgtctgtgctatagcatgtcagaatttccttcctttttagactgaataatattctgttgtatgtgtagaccacatttagcttatccttcatctatcagtgggcacttgggttgcttccacctttagtttattgttaataatgctgctatggatatgagtgtgcaaatatctctttgaaactctttgaaaccattcatcaactctctctttttcttttttttttttttgagacagagttttgctcttgttgcccaggctggagtgcagtggtgtgatctcggctcaaaacctctgcctcccaggttcaagcaattctgttgcctcagcctcccaagtagctgggattacaggtgcccgccaccacaccaggctaattttgtatttttagtagggtcagggttttgccatgttggtcaggctggtctcaaattcctgacctcaggtgatctgcctgcctcggcctcccaaagcactgggattacaggcatgagccaccgcacccagtcttcaccaactctctttcacgtctttattagatacaagtgtttgaagaagccttgcatctacccactttgaaccttttttcatgatagaactgtaggtagactttctgcctagtagtgttatttgaagcatcctttctgctgacctctttcctgaggcctgaaatgctactaatagtagttcagtcctcaagtatcaagcaaagccatcagctagttttctattaaaatgcaaatgatcctggggcagaggccacagataagatattagcaccttggtgtgaatttgtttaattagatcctatcttagaagctttctttaaccccttgcctagttcttcactaattgctccctgataaggtcttgcattattactgcaagtatcacactgtattaaacttatttatatttttgcttctcctgatagaatagaagcttcttaagggcaagactcttgtataattgctgttggtttttcaggccctaatagaatgtcacagacaactttcaataagctactcactcattctttcatgcattcattcattcatttcactcatttattcatcaagcatttattgggtgcccacggtgtaagtgcattttaaaactctgcctttctagaaggtttggacagccaagggccagctctgttgcacagttttggcagattttagaaaccttaaaatctaacttcctgtatttttaggtgcagggacttggtccagatgagtggatcaacctctgaaatagttttctatcacagtcctaccttttttttttttctgcttctattcagaagaagcatcgatctaagtaagtttgtgttctgttcaaaagtaaggtgatgtttcaatgtatattctcaagcatctgaaaacttctctagttgctctaaatctcaatatttccaatatcagccatgtacagtttttaaatgcttgcattctcttaggacattgttaacaatctgcttagaaaggggagtgacttttgcctcttttggctaatttgctttgcattgatttgtaactgtgtacttcagtatataccagcaactcctagcccagggatagcatatactcgcttactggttccagtgactgttcattcatcccacagtggcttccctggaaacaagttactctgataacaatttgatggtacttccctttataaggtaataaccagtccgggccaggcatggtggctcacgcctgtaatcccagcactttaggaggccgaggcgggcagatcacgatgtcaggaaatcaagaccatcctgactaacacagtgaaaccccgtctctactaaaaatacaaaaaccaaattagccacgcgtggtggcatgcgcctgtagtcccagctactcaggaggctgaggcgggagaatggcgtgaacctgggaagtggagcttgcagtgagccaagatcgtgccactgcactccagcctgggcgacagagtgagactccgtctcaaaataaaataaaataaaaataaaaataataataaaaaccagtcctaaaccaaattcttactttagtctctagcctcagagtttattagttcttagtaatgttactatgaaggcaaataggagacaaattattattctggtttttattgttactgccactgcaattcctatgattattgctataattccctatttaataggtaaacaagttacaacatattcgatggtcactagatagaaatagaaatggaatgtctttaccaagagaatatccgtgttttacagagaacaggaaacaagtactaaatggaatcttcagacaatcttttggtcttcttgtaggcagtggttcagcttttttacctactaaaattttggacagggttgttaacaggcaatacagtttaaaatgaactgttttaagttttcctttctgactttttcatactcctacattaatgcaataggattgaaggctacaacaatgataattgcaatatgctgaaataatgaactacagtaaatagctatagtgaatgtatgcccatagaaaagaatggaaaacaaatggcttttgattaaaggtacttattgtaacagatttcaaggtgaaattgttagttcagaaaagatggtagatagagtctttaaaaatactgtcactgggatgcgtgttcttctataatgctccctccatcccccacccgaagaaacacacactcctccctcctctgcatgtaaagcagtagttttgacaaataaaaccaaacagtaaaacctgacactggtgattggaccgtgcgtccctctggtttgtggatgaggagcatatctccgtgatagaataaccacgcttcatgctaactcccggccacatcgctgcatcctcttcatacataatttgcatcatggggtgtttctgcatatgttgtgcattttgatgttatttttagctacaatttttaaaacaataacatttttttaaatagactaatcaagaaagcgcctccagagtcaagaaaacaagtgctggggatgtgtgggtgggggtctgtctccccgcccagggcatttccctttgctgctgttgttactactccttccattactttttgtgactttagctttttgaaatttccattcctttgttttcccttgtgcatcaggatgtggctgttgaagtcatttatgttatgcgaggctgcaccacagtcatttaatgcaaacactggcttttgtgtaaggcactgactattctaccctcagcgaggaagacgttattggaaacttgagttatgagatggaaagaacattaatcctttcattgaaaacattagtcttttacatggattctctgtaatagcttgaagagaaattaaggaaatacaaactagtaatattaaaaatctgccatgtcattattatctacctgcccatagatgttcaccaccgttagcatttgagtgtgttttcttccagaagattttctatggatatatatatatacaaataaatacatgtagctttacagaaatagaatcgtgcttgatctacttttccgaaatttcttctctcacattgcaaaagttgtgaatgtctttccatctgaattattacagattttcaaaatatttttctggctactgacttttccagtatatgaatgtaagagtgaaagttcttcgatttcaccagttggatatgcccccttttctcttttctgccaatatcaattgtactgccctcttgcgctatcctaaatatgatcagatgagaattctgaaagagaagaaatctaggaaccctacttgatagagagttatcctcttgggttccctcctgacatttaggcctttttttttttttttttttttttttttttttttgagatggggtctgactctgtcacccagactggagtgcagtggcgcaatctcggctcactgcaatctctgcccccgcctgggtacaagcgattctcctgcctcagcctccctagtagctgggattacaggcacctgccactgcgcccagctaatttttgtatttttagtagagatggggtttcactgtgttagccaggatgttctcgatctcctgaccttgtggtccacccgccttggcctcccaaagtgctgggattacaggcatgagccaccgcgcctggccacatttagtacttttaagaagttattcctcttccatctcagcttcctggacacagttcgctatgacttttcttggaaattatgcattcccttagaatccttgtattttctgtttactttccctcaaagcaaggactcatgacctcacctgtagtgggcctccccatctctcatgtctttatgtggcccggacttagcagagacacctcttggtacatcattttgattgcatcatgagctttcccagagtctggagtgactctgtctttcagatttcattttaacctcctaatcacaggctatctttgatgcacctatctttacctccagttcttctgctaaagaactggaggcttgtggctcttgtcttccggtcaaacatgatgctctgctgactactcttccccatgcattcatcccaccccagaccctgcccttgccctcatccccatctgaatcattgcatcctcctagttcttggccaaaaaactggctctcctctagcccttcaaaccttgcctgggagtcatctttatggcaccttccctgattttttgttttgttttgttttgtttttggaaatggaatttcactcttgtcacccaggctggagtgcagtggcacgatcttggctcacggcaacctccgtctcctgggttcaagcaattctcctgcctcagcctcccaagtagctgggactacagacacctgccaccatgcccagctaatttttctatttttagtagagacggggtttcaccatgttggccaggctggtctcctgccctttggtgatcaacctgccttggcctcccaaagtgctgggattacaggcatcagctaccacacccagccgttgcaccttgcctgattaattccacttggctctagctagtatctggaaggacacctgggaggaacacttcaaacagctgtcagtgcagtgttgttgttgtttttgttttttaattaataggcttttttatagaacagttttaggtttacagaaaaattgatttgaaagtacaaagagttcctatattcctagcctccccgacccctgacaaacagtgtccctactgctaacatcttgcatcttacatttgttgaaattgaactaatatggatacattattattaactaaagtctatagttcatgttagagttcattcttcctgttgtacattctgtgtttgacaaatagatgacatgtgtcctaacaactctttgtgctctgcttatttgttcctcccaatccccaaaacccctgatttttttttttttttttactatccctgtagctttgccttttccaaaatgtcataaagttggaatcatacagtatgtacccttttcacattggcttctttcatgtggcaatatgcgtgtaagtttcctctatgtctttttgtgtctggagttggttcctaccggtgggtttatggtctcgctgacttcaagaatggagctgcggaccttcatggtgagtgttacagctcttaaagatggcatggacccaaagagtgagcagtagcaaggtttattgtgaagagcaaaaggacaaagcttccacagcgtggaaggggacccaagtgggttgctgctgctggctgtggtggccagcttttattcccttatttgtccctgcccatgttccatttctgttctgtcagagtgccctttttttcaatcctccctgcgattggctacctttagaatcctgctgattgatgcattttacagagcactaattggtgcgttttacagagcacttattggtgcattttacaaagtgctgattggtgcattttacgaacctcttgtaagacaggaaagttcctgattggtgcattttacatcctcttgtaagacaggaaagttcctcaagtccctacttgacccaggaagtccagctggcctcacctctcaatcccccctctaaacaggacaccccagctgctgttgggaactgggtgatgactgctctagctacttcctgctggataggggtgaagaaggggccctgcagttgtagtgccctccagaggggaacactctaggccaaagggctggtgggtcagtccaggggtccttggtagaagttgtgagttgagctcatttggggttccatttgtaagaccatctgtagcttgatggtatcgatcctggaggaaacaaatttgacaaagaggttaaaaacacagggcccgaaggtgagtaatagcaagatggctgtcatgggacgtagaaaggggagaaaccatgttgcccaactctagaggttggtataagagtttgaaaggcattgtctgatttcagaagccttttcctgtaactgctgggcagcatcttgtactatccctgagtggttagtgtaaaaacaacagtcttctcctaagaaggtgcagagtcttcctttctcagcagtgaggaggtctaggccttggcggttttggatattcactactgccaaagagtctatttgggattgcagagtaaggatagattttgttatttcttgcaaactgtcttgagaaatcctttgagagtgtgtggtagtaggataatgaagtagataaactggctattctggttcctgtagcagtggctattcttaaccgtataagtaggggtattagttgtatggccctgtactgacggacctgagctttgaggggcactgatagggtctgatttcctgcggtaatgttaatgttgggacttaggaagactaaggtacaggtgcctgtccagttagtggggaggcagatgtaagttgaagttccacataagaatatgccttggctgggtagacagaactggttgtgtatgttaaaaaggtgtgtgagtttgttgttttcattttcccatactcctagagtacttgccaaggtagtctggtgagtggctggaaaggggtgttgggagcaaactgagtgactccctgtgctctattttcccattggagaaaaaactgttttgtatctactaggaaccattcaagagagtgattgaaagagaggatgagaaggtattccttagtggtgggggtgctgctgcagggggtccaggggtgaatagtcatacagggagtatgtttgccattacaaaacctggactgtttgttaagcagggaggaggtgatgatttttgggggccctgagaagcggacaagccatctgaatagagcggtttgggtgccttggaagttactatgatcatttggggcttgaagttggagagtgtaattacactgatgggatagtaggtgccccaggggcaggcctgataacaggttgcgttggatgcataacggggcttggaaagttaagatggtattcacggttacagggcttttcattgctcatgtaataggtgaggttggaaatgtaagagcgtaaaagctggattgcatgtaaaaaaggttgatgtgattaggatttttgtcccggcaggagctacagtatatagtcctgctgcaaagagaatggttagtatactgcttaataatgtgatgaaactgtaaaaggattccattaaaggggcaaggagtggtgttaaagattatgtaggttttcacttatcctttttaaataggaaagagtttttccttaggatcagctataggggcctttttagtctgggatgtttccttctgaaataggagacacaaatcttccaatggttcacaggtttatcgaggctggtctggctgatcttgggactcctgagctgatggtcctacaggttcttcagggggtgtccaaagtttaactcgcatgtagtgaatccaagattccactcctgccaccttaactgcagtgggggtagagaggattactgagtatggtccttcccacaaggaatccatagatgaggaggaagaggggagggacttgaccaacagtaaatctcctggttggaacaactctgttcccttgtctctgtgacatcctttgggtaggtttttaacgttttgttggtattttgccaaagaagttatatctttgaccaacttggccgtttcctgatcaagtaggaggtcatttgtgagaaaaggtcatccatacagcacttcatatggactgagccccattttgtgaggagaattttggattctcaacaaggccatgggcaagagagtaggccatgggagatgagtttcttgtgttcgtttccttaagtgcctcttgagtgtttcgtttgccttctcagccttccctgaggattgtggcctccaggcacagtgaaagtgatattgtatccctagtgccctggaaattccctgagttaccgtggctttaagagccggaccattgtcgttttgtaagctttggggaagcccaaatctgggaattatttcatgagttagtactttaaccacttcctgagccttctccgtcttgcaggggaaggcttctatccaatttggttggtcaacacagaccaacaagtattgaaatccccttgacttaggcatatgggtgaagtctaactgccagtcctctccaggatagtgacctattctttgttccccaaaaggggccttacgatggaccaagagatttttcctttggcacacctcacaggctttgactacttgttggatggtctggaggagatatggccccataaatagggatttggccatttgatgagtgttctcaaacccatgtgaaaagtttggcagggggtcttaagtattttccactggctggcttcggatatgagtacctttccctcttctgccgttaaccaccccaaggggagaaaactatgcccccgtgaaagtccccattctgtttcgatcagggagtactggggcttaatctcttggagggggttgttccataccatgggtccttccataggtatttctaatgggaggttctgcctggcagcaattttggcctcagcatctgcccagtggtttccttctgccttttctccttcacctttttgatggcttcagcagtgtaacactgccacctccttgggtttttgcactgtgtgcaataactccataatttccttgtggtatttaatgggggttcccccagaggttaggaactccctttctttccatattgcagcatgggcatgtaggattagataagcatacttgctatctgtatacacatttattcttttttcctttcccggttctaaggcttgggtaagttctgctaactaggcgctggtccgtggggggaagagacttactttcaagtactgttacatcactaactatggcataacctgcccttcatatcccattctccacaaatgaacttccatcggtatataggttaaggtcaggattagctaagggtacttctaagagatcctgttgggaagcataagtctgggctacaatttgttggcagtcatactcgattggttctccatcctctgggagaaaagtagcagggttgagggctgcacacgtgtgtatttcaagcaccagtccctgaatgagtagcgcctggtacctgagtaggtggttttctgatagccataaatttcctttggcacctggtatgccatttacatcatgagtagtctagatggtgagatcctttccttgtattattttgatagcctctgacactaagatagccactgccacaactacccgtaaacagtgaggccagccttttgctactacatcaatttccttacttaggttgtggggttccttccttactggttgtggggttgtcctacaagtctgagtaaggactccaagagctattcccgctctctctgtgaggtataaagagaagttttgtcctggggaaggcttaagtcttgagtttgtactagggcctgctttaaggttttgaaggctgtttctgcctctggttcccattctactagatgaatatttgccctctcggtctccttgattagagtatagagtggcctggccatctcgctgtatccggggatccatagtcggtaaaagccagtgatcccaaggaacccccacaactgttttaatgtgttagggcaaggacaagccagtataggctgtatttgttctttgctgagggccctggttcctctggctaggattaggcttagatatttgacttgttgtaggcagagctgggccttcgatttagatgccttgtacccttgattagctagaaagttcaagagatctagagtagcctgctggcatgaagcttccgaactggtagccaaaagtaaatcatccacatactgaaggaccagcatgcctggacttgagaagtggcctagatcttgggacagtgcctgaccaaacagatgagggctatccctaaacccttgaggcaagaccgtccatgtaagttgggttttgtggtctgtgggatcctcaaaggcaaagagaaactgggagtccaagtgcagaggaacgcagaaggcagcatccttgaggtccagaacagtgaaaccattctgcttcctttggtatttgagagagcagggtataggggttgggtacaaccggatatagaggaattacttcctcactgatgagtctaggatcttgcactagtctccactgacgattcagtttttgtactcctagaattggggtgttgcaggggctactgcattttcttactaagcctcgaacttttaaatgtataacaatatcctgtaatcctttatgagcttcaggccttaagagatattgcctttgataaggaaaagtggtggggtcttatagcctgatttggactgggtgggcattttttgcctttccgaattgtccttccaatgcccagacttcagggttgattccctcctcaagtaggggacaacaaatgggtaacttgttccccatattcatatagttaatggctccagctttggctaatatgtccctccctaataagggtgtggggctttcaggcataagaaaagcatgtgaaaagagcaaagtctcccaattacaactgaggaggtgggagaaatacctggttacaggctgtcccaggattccttggatggtaatggatcttgaggacagctgtctggggcaggagattaacactgagaaggccatgccagtgtccaggaggaagtcaatttcctggccctcaatggctaaacttgcccagggctcagtgagggtgatgacatgagctggtgcttgcaccaggcaccctcagtcctgttgttggatcatctggttgggggcttctggcccggagaacctttgtcctctggggcagtaccccgtctagtgattgccttggcatagtggacatgggtgagggagtagcttgtttcttgttggacagtcttttttaaggtgtccttgcaaaccacactgataacaagccctactgggtgattggcctgctccattttctgtcctctctgaaccaccaaggtttgtttgtctgagggccatgactgaggctgcggcctttctcttatctcgcttttccttttctgcctgttcctcttggttcctattagagaacaccgcggttgccaggtttaataatgcctccagattttgttcagggccaagggctcgcttttggagctttctcctgatatctcagctgattgggtaataaacatcttttaggatcaattgaccctcgagggagttgggtgacaggggagtatattttcttaaggcctcccatagctgcttgaggaaggcagtaggattttcttcctttccctgagttatggtggacatcattgaataattcatgggctttttcctaattctccttagtccttctggaatacaggtcaacagatgtttgcgactccagttcccatgatctgagtctaggtcccagtggggatccataatggggatggcttgctgcccattagggaatttgtccctttcttcggctgtcattttgtcatttacttgactaagataccaggtatctccaaattctcgggctgcagctaaagctgcattcttttcattaaaggccagggtttgatctaacaatagcatgacatctctccaagtgaggtcgaaggtttgccctggaccctgtaggacatctatatacctaccaggatcatctgaaaactttcccaggtctaccttgatctgctttaattcagagagagagaaggtcccatgttgggccaaattcccctccccctacagcttaaaggagacataactgatagcctgaggggtttggtggtcctttggaaatttctttgcttgtttccttctggatggaggagattagaggaggctcatcattaataggaaggggagctgtagggaggctaggatatggaggtaatctgagaggtcctcctgtggaatgtaaatcgccagctttgcatagttgtggattatccttcagtaaaaagaaagcttggacataaggtatttcactccatttcccttccctcttacagaaaaggtcaacctgcagaatagtgttgtaatttatacttccctcaggtgaccatttttccctattagagagataatattaaggccagaccgtagtgcagaaaaaataagccgcttctttttcagggtttgcgggacaaattggtcccaatggcttaggatgcgtttcaagggtgagcttgttgatgcctgggtgtttcccatctgaaagaaaaaaccgcctgcagttttttttttttttctcttctccctgcccaagaacccacaacagtccctggatcctgctgttcggaatagctgtgctcaccaaagcagcagcggaaacactagttttcctcctagaccacaaaaaggactgaggaaggtcagatttagtggcccttaccaatggattctcaaaaacctgcacccttgcctttcgtctttagaccacaaagaggactgagaaaagtcagatttagtggcccttaccaatgcattcttgaaaacctgttagagtcctaagtgttttctcctgttgttattaggaccttacccttgtactataaagataatatgcctcaaaatggagtggagggccataccctgagggaaggaagggatctccagggttggaagagtgatgcgttttgtcctcacttatcatatgaataggaaggatataatttctgagtctcctcctatcctagctttgggaatagcctttgttaggtctgctagtctgaggagggatcctaaaattccagatagtcccccacaacagggctttggacaaaaattatgtctttctgattggtgagcctgggtgcctaaagaagggagcagagtcctgaaatttatattagaaatcatccttataggagaaactggaagagcaccagggacagggagtggtttttagaagcaagactaaccttggagaagagaggcgggagaaagtttgtctgacaggtgttaggacccaggaggcaagggtcaggatagataggatagatgggtgagtcttgtttgggctatgtaactttgagagttctgctcatggctgcagggccaaccaactttttgttgagaccccggagctgaatggctttcctctctgtcgaccctaggcttagcccggaagtgcaggaaaagcagaagctggttccaggcaaaccaatgctcctgactccaaacagtcgggggttgttagtgagccctttcccagagagcctgacatccatgtccttagtcctgtggccatgctagttgcttttaactggctgacaggtgcctagttttagcccctgaattctaaggaaaaataggacagaatagcaagcaaaaggggtctgatggtactcaccacgttgcaatatctgggaggatcccccaagatgtgtccagagttggttccagccggtggattcatggtctcgctgacttcaagaatggaggcacggaccttcacggtgagtgttacagctcttaaagatggcacagacccaaagagtgagcagtagcaaggttaactgtgaagagcgacaggacaaagcttccccagcgtggaaggggacccaaatgggttgccactgctggctggggtggcccgcttttattcccttatttgtcccctcccatattctgtttctgtcctatcagagtgccatttttttcaatcctccctgcgattggctacttttatactcctgctgattggtgcattttacagagcgttgattggtgcattttacagagcgttgattggtgcattttaccaagtgctgattggtgcgctttacaaacctcttataagacaggaaagttcctgattggtgtgttttacaatccttttgtaggacgggaaatttccccaagtccccactcaacccaggaagtccagctggcttcacctctcatttttatggcctgaaagcttatttgtttttagtgctgaataatattctattgtatggatgtaccacagttcatgtacccattcacgattatgaatgaagctgctataaacatttgagtgcaggtttttgtgtggacttaagtttttagtttatttgtgtagataccaaggagcatgcttgccacattgcatgttaagagtatgtttagctttgtaggaaactgccaaactgttttcccaagtagcttactatttgcattcccacccgcaatgacttgagagttcctatggctctgcatccttgccagcatctgctgttggcagtgtgttggattttggccattttcataggtggtatcttgtgtttgttttaattcacagttccctagtgattcataatgtggagcatctttttatgtgcttacttgccatctctatgtctaatttggtaaggtgtctggtcaggtcttttgtccattttaaaaactgggttgtttgttttctaatagtgaagttttctacagctctgttgtgtggttacttcttttttacatcaagatgagtcttactacctggttagattgggtgttacttgtagagatgctctccttccttccttctgtctcctagagcatttgccacacttcagatcctcagtaaatacagtcttcccaacccaatgcctgccacatgtttcctgacctcaagttcatatatcctctcgcattccctttactcctttccatacataacagtggtggtcactgctgagtccccctgaaggtgagcttatctacctctttttatatccaagctgcttaattgctataatatccaagctcccagatcacagcttttagttctttttctgaatctgaactggtgataagattaagaaatctcttggttcttttgcattaatttcttggttttgctgtctactataataatttaatagcatattttaaaaatgtttctgatggctgtttagttttgtctgctgactacaaaggttgttttgacctcatcttgctgacctgccaaaagcactaagtctatggcagtaagagagtggaaagtctgttccagtctctgtataatacaattacatgtactgtgtagcaataataattaacatgggaggaaatcagtacaaattagggatattcctgaatcattggctacactgtagataatgcagcttctcaagccagtttgttacaaatgggctacaggtatatccaagtatggattgcctcagccctcaggcagccttgacccctgaggctacagagcccctagcagggggggttaaccatttatgcaattatgctgctgcccagatgttattttctatacaagtagttcctttagagagagcaagtgcaagccccaagcactggcacaatatggagtggggaaaacaatgattttgaattcagaagaattcagttcctggtcagctctctgatggcagggattttgtctgctcagctcactgctctatccctgtacctaaatcagtacttggcacactgtaagcactcagtaaatatttatcgatctaattcttctgtttttttttttttttttttttttttttttgagacagagtctcgctcttattgcccaggctggagtccagccatctcagctcactgcaacctccacttcctgggttcaagcgattgtctgagtagctggaattacaggcacgtgccaccatgcctggctaaccttttttgtagttttagtagagacggggttttgccatgttggccaggctggtcttgaactcctgacctcaagtgatccgcctgactcagcctcccaaagtgctgggattacaagtgtgagccatctcgcccagcttcgatttaattattgaagcatacttgaattcaagcatgttacttaatcctctctgcacctcattttccagaattagaaatatagtttattcctatacagcagatataaatttatgtgtagacagttgggctgttgttgtaacctaaaagtgacatatgcacaacctgtagcacaatgccaggtacagagtaggggatccagtgggttctttcttaccctctttcatttgaagtttttaaagtatcaggtgaagatgatgatgatgatgataatgataatgaaagtgatattttttgcatacatttcagtaaagttcattaccttacactgatgtaatcctcagagcaattcttagacaattatggttttttaccccctctttattttattttatttttgagacggagtctcactctgtcgcccaggctggagtgcagtggcgcaatcttggctcacttcaacctctgcctcccgggttcaagcgattctcctgcctcagcctcctgagtagctgggactacaggcacctgccactacgcccagctaatttttttgtatttttagtagagacggggtttcaccgtgttagccaggatggtctcgatctcctgaccttgtgatccacccgcctcggcatcccaaagtgctgagagtgtaccccctctatcaatgatgagactgatgctgagaaaagtaacatgattatgtaagattacacaagtgaaacacaccaaaaacagaccttgaacccagtttttttattttctcacgtcaacttttcctccacaccaaatctaataaaattttataaagaattactttaaagactaaatcactttcgactagcatgttgtctggatgcaaatgatggtgataaagtaagtttaataatgcttaaaggaggtaaacaattcctaaaccttttaaaaaatctagtcagctaaagtaggtttacgctaaactttcatcagaatccttaaattctaaatcttgaacttttaaatcagtaatagagttttaatgtgaattaattgtctgtaacattttcaaaagataaaagtgataaatgcacaaacctacctgctattataaaacttgttgtggtggaatgagacaagaatagatgtactataagaacaagagggatatgaagaggcaggtttatgtcgatacttaaaatacatttgacgccatccttttgacaggaaggaatgtctttaaaatctcacaccagtgagagtgggaaaaaaatcagccatatttctgctttttttaccctttcattggaatgctcagtcacttggtctactctggttttgattcacaaatgagttttcagaaatgactgtcccactggctttttaaaagaaaaattcagtttttcctctgaagactgacacacaatcactcagagatggataatcctaaatgttttccttttccagctgaatttaatcttatgctatcaacaaaatctggaaaggtttactttctcatatcattcattactagttatgaattctgaaccgtatttgtaacctgttcatcacatattcatccctgcatgtattcattccctaaatatttattgaatgccagcaatacaccctgaactcggagaaaacataatctttaccctcaaaaagctcacagtctggtgctcagttgaccaaacatcgtgtttcttttctaccgagttgcaggtcttctctctgtggatgtcattgaatgtcgtttgcagaattctacttgctatagtaggcatctgtcttgttcatgagccacattacaacctcgtgtgttataggcaaaaaggcaatctaagaacggcctgacattcggacgcctaaggggacttccctagtgagggcacaagacagacaaatcccagaatattttctatatgcagaggaaacttctctggcatcttagaaagacaaagacagcaagactgaagatagaaacaggaggatagcaaccttttaaacaacttgtttttgtgaaatttgtttctgtttgctttgagaatgggggaaaagagaactctaattacaaactccacgtttctttcaactatactattttctttctttttttttttttgagacggagttttgctcttgttgcccacgctggagagcaatggcacgatcttggctcactgcaacctccgcctcctgggttcaagtggttctcctgcctcagccttctgagtagctgggattacaggcatgtgccaccacgcccggctaattttacatttttagcagagatgaggttcctccatgttggtcgggctggtctccaactcccgacctcaggtgatctgccggccttggcctcccaaagtgctgggattacaggcatgaggcactgcacctggcctttttttttgagacggagtctcgctctgtcgcccaggctggagtgcagtggtgtgatcttggctcactgcaaactctggccctcgggttcaagtgattcttctgcctcagcctcctgagtagctaactaatttttgtattttcagtagagactaatttttgtatttttagtagagacagtgtttcactgtgttggccaggcttgtctcgaattcctgacctttggtgatccacccacctgggcatcccaaagttctgggattacaggcgtgagcaactgtgcccaaccagttatactattttcaatcctatataatttgtacagctgaagtggcaactgcttgcttttaaatgggaagagaagatgtccccatttaatgcttagaaaagattgacttcggtttaagccaaaggagcatcctggagaaccgaatgattcatgattagtaattctcaaggaatggccatgtggctcttcatagcgttggcccttgggggggtctactttaatctttgttctaacccccgccgcccctgttgtccttttaatcctcatggatcaggtgcgttcacagataaccactaaagtgaggctgaaagaggttaggatggggatggacacctgtatttctgagaggacctctccatgatgtttaggaatggggttgacatccttcacctagaaggtcctttcccaagattggacattgattttggtcgctggagcagcctcatcagcatttctacaaggtccccagaagggaggaagctattcattgaatacttcatatggaggtggttttatgttatttttatgagatattaaggaatcttcagaaactcatagcatctccatgttgcagataaaagaggctcgatggaatgggagtgagtcagttcagagttactctgctaataataaacgtgctggctttgaacctacgtctctctgagtaataagcccctgccctctcttccaaagcacattccttcccttgaatcagagagcactagatgggaagggtgatgggagctacattatcactggcagatggaactattcagctcctgtccttccattctctaagaaccatgcatgtgtgtaaacacatgttgcatcagtgattgttccaggctttgcctacttgctcccaaacatgtgaaaaagaagaggaagattaagtaagtcattcatatattacttatatctgagtgtttgcaatcatataggggagcatagttcccacaaggaccggtttttgtaaacttttgcttctctttcctgtatttaggcattatatagctatggcagtgatcacccacaggtacaaattctgtatcattcattgcctttacttggaggtttacaaatatttttagtctctacttctttttcaaacacaatcttgaaacctcaacatatgaaacgaataaaggaaaattttgttagcataatgtatgttagatttcagcgtgtaatgctgacttataaaatcaagaagaaagaacaatgaagctttgtgatgaacacagaaatttgaaagcagtgttagagatgacagctgcaatcttctttaacttcagtttccaatttattgccttttgttgttaggtatattttttatgttgttgtgcagtattgagaaaaccctgattccctaaaataaggagttgcaaataataatgagttgttttatttttttaaacagttaccttgcaagctcaggatatgttttcctttaaacttatccacttaaaacgtgttcacttaaaacaaaaggaagaaaagaaatggcttctttcaaagctgatatcgctaacaatgtgaaaccatttacattttttaattggtaagcctgcgatttggaggaccaatgatagcttcctctagcctaaatcttccattagagggagaaaacactttttaaattataacattaatgagatgctcattgatgtacttaaaaaacaagaagaagaagaaactcataagcctgagggagggctcatctctttcaattttagaaggaagaaattgtctttgctttgcatggtgggtccaatcttgaactttagatttaatctctgacattggctaccataagcatggtatgtctgacagtttaatgccaataatttaattttattacaccattttatactacatgtttatttattacataccaaaattcactgaggacaagaactcagggtgttttgtctggtcttggccgttaattgtccatgatacactcatgctgtactagggtgctcacttgtgaaatttcatgcaagtggacgtagggagaacttaagtttatatgtttaaaaaaagcaatggtagcgctacaacctttctacctgagaaacaggatgtcactgagatgacgggatacctttattttgagatctacacaagcctggcagtatggtctggcccattagtagttgtggcaatgccaggatggaagttacatttgattaacggggtaactaagaatctaacttcagaagaactcttgctatcccctttaaccctcacaacaacagcaacaaataaatcagttggcaaatcttgaagatgtagagccttactaacaaaatggagttaagaaaacccttcatgcaagcaaaaaagcttgatctctgctagggacatcaaaggtgcagtggtgtggacgtccagacacagatctgatgtaggctttcctcttgggccttagcctagctcagtggttttcaaattccactgtatgtgagcattgttgcacagggtggtataaacaaaaactgtatatagtgtccttgttgggcaatgtaagacacttttatttattgagccaatacttacagagtgccttctctgtgctaagactcataggtgctgcagtttgagcaaggatgaagagaagtcagttaatgggtgatacaaaaatacagttaaatagaaggagtaagttttaggattcaatagtacatatcacttgtacccccaaaatatgtacacctgtgatatatcagtaatgaataaataaggagcatcattctagcgcaggaaacaaaccaacaaggactttgtggtgtaacatcagctgtgatgaatgaagagaagaatcagaggggcgagggaagagggggcctgctcttttagacaaggcgaccagggagggacacatcacagcagagacctgaatgaagagaactcatttgccagaggagcattctaggtaggaccaggattgtgcctggatgtggaagggagtgtggaggccactatgctggagcagaacatagggaggagatgggcaggaaaaaagaggaggagggtttcacatagttggggtcagatcatgtagggccttctaagtcttgacatggaccaggactgtggtttttaccataaatgtaataggaagcattgaaaggtttgagtggaatggtattaggatctgatttgcaccttacaatttcaaggatacttttgaacccacacactctgcattgggtgggaactttagaccctagcccctgaattaagtgttattctactatatggcacatggagagcttttctgaaactacagttacttaataatgagaaattcaatttaaaaataaaacgcagatgctctgaagcccgttggtagaatctttggggcttttaaataagtttaaaagctacaagcttcaataaagattaaattagaaatcctatataaagcttctaagagtgtaactagcattttagtaatgcttactaagtgctggttctgtccctttctgctctcctattttttttatcagcgcctttgctattaggccaggcgcagtagctcacacctgtaatcccagcactttgggaggccgaggtgggaggatcacttgacgccagaagttcaaaaccagcctgggcaacatagtgcgattctgccttgataaaaaataaaaataggcagggtgtggtggctaacacttctaatcctagcactttgggaggctgaggcaggtggatcacttgaggccaggagtttgagacaaacctggccaacatggtgaaaccccatccctactaaaaatacaaaaattagctgggtgggtggtgggcacctgtaataccagctactcaggaggctgaggcaggagaatagtttgaacccaagaggccaaggttgcagtatgctgagatcatgccactgcactctaacgtgggtgacagaacgagaccctgtctcaaaaaaattaattaattaaaaatttttaaaaaatacaattaaaaaatacctttgctattgatgtctgtttctgattgtctgtcatcccggtacactatatttactttccagggaaactgagtcattcaacaagcctctggcttctagtgataagcactatcattagaaagaattatgttctgtgtgttaaggataagggacacattctttttggaaaatagtgcttgtgagtctaggaatagttgtataatctgggaatatatgctaatgctatagctgagttcaaatcacttttttaaaaatgcaaacttatcttctctgtcaccaagcatgtcttccatacaaaaggcacatttctgtagcttcatccatgttactctaggctatttcctctagtttattaaccacacgctcagcaaactgtagagagtatggtctgatccctttctcccataataaaaattttaagactatgtacttgttgatagatgacaccaacaggatatattttacagaaatgaaacaacaacatgtgaagaatattttaggtcactgtaaagttcctttaatagaaaaaaaactttagatttaactgttaaaccctttgaaaaagaaataatttatttcatgcaaatgactaaagcaaaatggagtgtgcagaagacctacctgcatactgtatgtaaaatacagttttctgggcttcactcccaggaattctgattcacaaatctggggttgggcagctttcaattttgagaagtgccccgagtaagctgatgtcaggaatgtgaattttaacaggcaccccaaaggaaggctgtgggaaaccacatttgagaaacactgccaaattaccaaaggaactttaactttgtgttatagaaatatcaaacacatttaacagacacttctcaaaagaagacatttatgcagccaaaagacacgtgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgcaataaagacacatgcacatgtatgtttatggcggcactattcacaatagcaaagacttggaaccaacccaaatgtccaacaatgatagactggattaagaaaatgtggcacatatacaccatggaatactatgcagccataaaaaatgatgagttcacgtcctttgtagggacatggatgaaattggaaatcatcattctcagtaaactatcacaaggacaaaaaaccaaacaccgcatgttctcactcatagatgggaattgaacaatgagaacacatggacacaggaaggggaacatcacactctggggactgttgtggggtggggggaggggggagggatagcattaggagatacacctaatgctagatgacgaggtaatgggtgcagcacaccagcatggcacatgtatacatatgtaactaacctgcacattgtgcacatgtaccctaaaacttaaagtataataataatataaaaacttaaaaaaaaaagaaatatcaaacacatttgaaagcagagaggtggtaaatgaacgcttttgccccaccaccccattcagcagcagagccaacatcgttttctctactccacctctgcacctggattattttgaagcaaattccaaataacagtattccctggaccttgcatcttcataacagattgctgttgactcaaaatatctataaaatattttactatttctataaatgattaggattcttcttctcatacacaactacaacatcatcatcacaccaaaaaatgcattaacagtcatttctcaatatcatcaaatatcccgtcagtattcatattttcctaattgacttattaataagttttattttatgttgtaggattttttaatagtttatttgaaccaagatccaaataaaggtcatttcggtctcctaaacctcttttacactactcggtatcacctatgtcttttttttattttgcagttttttctgttgagaaaccagaccatttgtctggtagaatttcccacccgtctgggtttggatgattgcctccatgtggtgttgctaagcatgtccctctgtctcctgaatttcttgggaattgctaggaagttctagaggcattgttttgtttgctttgctttgcctgactgcttcatagttggtgttgtgttgtgtatttccttcaggaggtaatggttggtggcatctctttttgcagtgagactgtcatctgaattcataaatttatcagggattgcaaatagtggtagtctaattctattattatttgttcatttgttagcaggaattattgttcatgaagagaaactccttgcatctgtaatttatctacccggtgcttcaggttttgtaggaaaagcaggataatatactagattctgtctatttaccaatttgcacgatacagctagttcacagtgtcaaaccaagtcactgtgttttgaaagcatgactgtaaattcatagattgcagcatatctgttgtgtttcagtccatgacagtgattaccctttttcatgttcagatggtcccctgtctgagcattgggatcctattcagtttggctactgagtccttttaatccaatactggctgtctttgatagttttcttgctttctagtataacactatgttccaggctcatcttgtacatttcttgccttagctctgggatcagcttttttccaaggagacctggtttctttcagtgagaaatgatatttggagaccaaagactgggccccaggggaactgttctcactgggttgaatattgtttttcctttccagtggacacagccagtgataggaaatctgtgtctctctagatatagatatagatcgattgtgtgtactttttttttttttttttgagacggagcctcgctctgtcgcccaggctggaatgcagtggcgcaatctcggctcactgcaagctccacctcccaggttcacgccattctcctgcctcagcctcccgagtagctgggactacaggcgcccgccaccacgcctggctaatcttttctgtttttagtagagacggggtttcactgtgttagccaggatggtctcgatctcctgaccttgtgatcggccctccttggcctcccaaagtgctgggattacaggcatgagccatcgtgcctggccgtgtgtacgtattttttaaggtaaaatacctcatgagtttatactgatgtgccacaaggcttttacttaacttcattcattttacatcagtattttctttctctcaaactgaaaatagcagttctcactcacaccaacacaatttactcatttactttctcccacactacacttgcaataatttccgaacaaaaatgccagtgacattgcaacaatatgcttactgaaaatgtttaaggttttttttattttgattgtttagttttgtattggtttttagtccactgggctagagatggacaattacattacaatatgttagggtcatttggaatagttacagtctgtgtgtttatgccaataactggatatacatttgagttcacttactttaatttgagacttcctaagaggcttttgaaaagtgattcttgttcaataattatataaaaatatttaaattttcctgaaacaaaacccacaaaacaaggtgaagtcgttgaagtctgtctttcatgcctgtctgctttattttctcctttttaccatttttaggcatatctttcatttttattataagcaatcatactatttaggtaggtttttttttttttttttttttttttgctccaatagatttatttatttatttagagacagggtctcactttgtcacccaggctggagtacagtggtacagtcttggctcactgcagccttgaactcttaggcttaagcaatccttctgcctcagccccccaagtagctgggactacaggtgtgccccaccatgcccgctattttttttgtttgtttgtttttccagaccaagccttgctctgtcacccgggctggagagcagtggcaccatcttggctcactgcagcctcaccctcctgggtttaagcaattctcgtgcctcagcctcctgagtagatgggattacaggtgtgcgccaccacgaccaggtaatttttggatttttggtagagacggggttttgccatgttggccaggctagtctcaagttcctggcctcaagtgatccacccgccttggcctcccaaagtgttgggattacaggtgtgagccaccatgcccagccttccagtaaaaatgtttagaataattccttaatatggtacccttcttatcccccaaacttttcttagctgttgtttattggtttccaactctgagtgattttgaaattcttagtaccctttctttcttattttcttctctggctataatttgatttaaggtaatatccttttactcccacttaacatctatgttagtgagattattttcgttcctttcatattcttcccgcgtgtttttttttaatcattatactatctatattgtcagggcacatagtcattatatcgttctggctatatgtaatattgtttccttgtaatcatctttcagtaacagacctacagctgattatgtgttaaatgctcacccagtctttgtatcagtgcctttccagccagactggttgcctgactcttctcccttgcagattactaagggtttctgcgaacaatattccttgggtccttgcatattcataacagattgttgttggctggaagatcattttggctgggtataagatccttggcttagttgtctttcctgagtgtcacgctactgacttttagcatgaagcctggctcttgaaaaatcgggtgacactctaattttctgtcccttataggtaactcagtcattttacctgagtgtccaaagaatttttttttgttttctttcctaggtcagtttttccaggtgcatggagtattctgtcaatatatagtttcaaatctttttctacttctagaatttgtgcttcagtcacgattttaagcatttgctgtttttattgcttttcttcttcaaaggctcttattacagtgttatgttgggttttctttgctcatgttccttttctgagtctttctcttgaattctatttctttcctcatttctttttgatgtttaacactttctcctttctattttttagcactcctcaaagattatctgttgtatgtattccctcttgtgttccttcttatttggtcttcatctagaaaatggattttcttttttcgttttcttcaaattctttcccacgttcttttgcctctctctatccaactatttcttttctccaatcacttcatttctgaatgtttttattgggattagtgttcctttatctcttcttactgcctcattttcttttagctcttttgaaatattaaagttttcatctgttttgggggcatgtctctgtggtaagaatgctactctgatttttcttcttataataactgtgcactgtatttgaccacaatcctattttgttactcatttttaagtggaatgagttttcttgtatttttagggataagggatgggccagaaaatattttctagtgtctaggccatagaactccgtcttctgttgtttccatggaataaaataaggcctatattttcttagcttcgtcttctctgcctcccttcacttggatctgccccctcccttcactttggctaaattattactgccatgttcgatttagattctgctctcaaaagtttcttctcaaggtgatttggtcgtggaaggaagcttagatttgttggtctcaagagtgccctggctccgtaacacctaagcacctcagaccttcccagggttccttgccctcaccccatgaattggattctgcaggaccccttgccaatgatgctgctgtgctcaaaatagctcaccaccctgctgaccgtgccgtaaggacctttggaagcttgggagcccgttgtgccaaaaccttcagatgcccactgcctctcctccaactttctcttgcacagatattgcttctgcctggctctgtcactataaatggttcggccacacccattcctgtcttcaggtttatggactacacagtaacctcattttgtcttgatgtggtccatgggtttttggctgtgtaattccaatttctctgtttttgttgttatcattgctattgttactggcagggaggaggagggcagggattctgaaaaatttttttaaactgtgctacctttgacactggtgccatcatcttccctgaattcccgctttaattttttcttttcttttcttttttttttttaagacagggtctcactctgtttcccaggttggagtgcagtggtgctattttggctcactgcaacctctggctcctgggttcaagcaatcatcccaccttagcctcccaagtagctgggactaaaggtgtatgtatgtattccctcttgtgttccttcttatttggtcttcatctagaaaatggttttttttttttcttttacttcaaattctttcccacgttcttttgcctctctctatccaactatttgttttctccaatcacttcatttctgaatgtttttattgggattagtgttcctttatctcttcttacttcctcattttcttttagctcttttgaaatatcaaagttttcatctgttttgggggcatgtctctgtggtaagaatgtgccaccacgcctggctaattttttgtatttttggtagagatggggttttgccatgttgcccaggctggagactcctgggttcaagcgatccacccatttagacctcccaaagtgctgggattacaggcatgagccaccgcacctggccccacttcaatttttttttttttttgagacgaagtcttgctcttgtcccccaggctggagtgcaatggcaccgtctcagctcactgcaacctccgcctcccgggttcaagtgattctcctgcctcagcctcccgagtagctgggattacaggtgcctaccatcacacccacctaatttttgtatttttggtaaagatggggtttcaccatgttgcccaggctggtctcgaacttccgacctcagatgatctgcccacttcagcctcccaaaagtgctgggattacaggcgtgagccactgtgcctggccccactttaattttttaatagtgcttgagaagatgtttctgctaaatactatgcctctggattaaacctcaaatacttcaaaatgaaaagtttgatttcggtcacagatttttagtaaatactttttagggacaagaaaactacaaagtgctttgaaaaacaaaacaagctcaattttttatttgtttaacatatgtagaaaataaaattaatacacgtatcttttccaaattaacacagtatgaaaccaaccactactaattcatcaaaagacacaatttagatcaagtttaggcttggttaggacgctggacgctgagtaaatggtagctctgaggctgaaaaaaaacccctgagtcactctggtacacattctgatgtcagcatccccaccccaccccaacccttattcccgccccgcccccggccccgccccccccccccccccccccccgcgaaaagaagtctctagctctgaaaattggcttgttataactttacaaatgtagttgccaaattgccattgacatcacatttttctttttggcttttagtagctagatagtaatactataaaggaactctctgctttttctattttgtcctttttaaattcttggaggcccttcataacatggaacacaggatgggcaaacgtgcttcttatagtgtaggttagatttagcaccttttgacaaagggccttgtttcctgtgcagtttaaatttagatccactgagaatctgagaaattcagtaatgaaagggtaactttggagtttcctcttttggaagctttccttattaaattctattaatgactctgttagacttgattcccatcttacacaagagattccagaatagcaacttgaattgcttcttagtccctcttacgaagtcactccttcatttggcattgatcgagtacctcccgtgtactggctgacggggcttatatacagagccactaccttatttttcattctgttattttaagagtttcttgatagtccatctacttaagaagtgttgctattaaatttcagtctatctcataaatattattctgagatcctcctggctggatttataggtataaatcattcttggataaaatatacaatataaacagtaagtggaccagttatctgattatacgtgctctgagtctacagaaagacaatatcttggtatgtttcaggagacttgtagagatgaggtgtaggacttctcatttctaattaaaactaattaaaatttactgtctacaagggagatggattgaacatcacctttacctttctcttgacagcaatgaaacctgactcaaagctggcactaaatgtattatttcagtatctgtgtcctattatgtgttgtaatattttggattaaaaaatggagaaaaaataaacaagaaatttttatttctgctaaaaagtcaacagagtccattgttatctttctttgcttttcagatggcagaaattgggtgtcaggtcctataacacaggggttcccaacccctgggccatggaccattatgggtctgtggcctgttaggaactgggtggcacaccagtaggtgagaggcaggcgagccggcattagccagctcagccagcctaagctccacctcctgtcagatcagtggcagcattagattctttctcataggaaagtgaaccgtactgtgaactgcacatgtgagggatctaggttgtaccttccttatgagaatctaatgcctgatccccctacccctagcctcatggaccagtgccaaaaagtttggggaccactgccataagaagtcccgaccagaagtgtcacatctttctattgcatgatgctgcttcttgaacacccatagtagccaaggccagaattagtgtggcaccctcttccccagacaaggtccatggacagtgcatttcaaaatacaggaagctctccttacactctctgctacctagcttccatggttatcaagtaattatactttatgctgagccaacttatgcatttaggaagagatgaagagaaattatatcctcaaatgggctggaacaaaagggaataccaataatttgtaagttaatcaaattataattaaagcaggaagagacacaaggagcttggattatctatgttttctgttagaaaataatacaacaaaagtatccagggagtcttatcagttctgtaggaatttggcagaacagtaaggttataagttgtccttttaattcccagccacctctggcctctgcttaccatggccctgccttctgacttgctgtttgctcagctccttagtgcatgggaagagcagaaacatcaggggaagagcgctgagatctgctgtgcacctgtgccgcacagcccttcccatgtagacatgtgtagcttttgggtttgccagtggatggaacttatccgcatcaagtagccttccacgggggtggtgctgatacgcactcccacccacagccgatacagcctaatcacaagtggaacaatcagagtggaaagtagcggaaagtagcagcctctggtttccaaatgtgagagagcctcagggctcagtcctcaaacctggtctgttttttgttgatgccttcaaaccatctcaaaactgacaccttctccagcctgggccttttctttgaacctcaggcttgcatatcccactgtctcttaactgccttcagtgggatgaactcttgatattctaccccaacctgcttctcccactgccttcccatctccttccagttactcaggccacagttgttgacgttgtccttgatgcctctttttctcctacacaattctgctggtccacggtgccaccatctcttggctggagttcatcagtaacctcctgagtagtctctctgcttcttctcagaatatctcctccatgcaacagccagcatgaactggtgaaaatgtagtccagaccctgtacctcctctgatcaaaaccctccagtgcctctcagctcactcagagtaaggacctcagactttattgtggctcaaagaacttgtcacccccaccctctgacttcatttcctgctccccaccccctttactcagtgccaggaacaccacctcgatggtgttcctccaacacaccacacaggagcccaccccaggaccttggtaccttctgttctttctgtcaggaaggctcttcccccagtcaccacattgctttctatttccctttcttcaggcttttccccaaaagttactgtctctgtgaggtcttttttgactgacaagcttgaaaaaatggtcaccagaccaccaccctagcccccttttctgcttaactttttagcatctatcaccatttaatggaaaatacttcattataaatcttttatttccatgaggataggtaattatttgttgttgggggtgtctttgtcagcatctagtacagtgcctggcagatggatgctcaataaatattgatttaatgggttatgagggtgttaatataaaattagcatttattcagcaactactatgagtcagccactgggctaagtggcttacatgttaagaacctcacagaaggccaggtgtggtggctcacgcctgtaatcccagcactttgggaggctgaagcaggcagatcacctgaggtcaggagtttgagtccaggctggccaacgtggtgaaaccccatctctactaaaaatacaaaaattagccagttgtggtggcaggcgcctgtagtcccagccactcaggaggctaaggcaggagaatagctggaacccgggaggtggagattgcagtgagccaagattgcaccactgcactccagcctgggtgacagagtgagactctgtctccaaaaaaaaaagaaaaagaaaaagaacctcacagcaacctagtaggtgagcactgttactcttgttttacaggtgagaaaattgagccctagagaaataaagtaacttgcttcaggtctcatggttaaggggaacctgggccctaacagtccacttcctgtaccttcaaccacggctctaccgcctccgctaggagatggcccgaggacattccttagctggcttcagcttgctctttttcccctgcggtccacccctgtctcctgcttggtcatcagtgatttccatgccatcccatgtcattggaccagttgtgtgtttttaataggagttctcatctcactttctccacagctttgccaattctgctctccccctcctgtctaaataccttcctcccttggcttcctgaacaccactgtcttcgggtgccatcatccctttctggcccctccttcctaagtcttcaggtgttccctttctacctgctttctacgcctctaagtgttggagttcctcatggcttagtctctagaccactttgcttctccacttaagtgttctgctagatgatctcatccaaactcacagtgccttgatggatccatgactcctgcatccatgtttctaggccagacctctcatcatcttcgggcctgtgtctccagctacctactctgcacctcctttggggtatcacaatgtcacctgaactcagcacgttcaaagtcaaagttataacaatcaccatcccaccaaacctcatctacccaagaattccccatctcagccattggcatcatctagttacccaagacagatgcctaaaagtcctccttgaagcatttctgtccctcttcctctgcatctaatgtgtcaccaagtcctactgatgcaatctcctcagtgtctttcgaatgcactctctctcttccggcccactatcaccattctagtcctaaaacctaccttctttctaggagccacagcttctctggagtttttacacctcttccaactgttcccatcaccccgttcttttctttgacaacattttttacatataaaaataggtatttatgtgattatatcatgaatgtcttttctccccaactaagaagcactatgagagcagggagcttcctgtttctccccgttcaatcctcagctcctagcagcacagtgcctggtgtatagcagattctccatcagtatttgatttgttgagtgaaaaacttagatgtattaaatgacaaactgagatcaagggagaatgaagaatcaatcagaagcagatagaaaattatgctgtgtggtatggcaacatcatgaatggactgttaccgataatacacactgagtcatcaaagaaacattaacatgtattctctattttaaaagggaggtacataaatatagaaccaaataaacagatctcaggaacatttccattcagtaagcaaagttttagaagggaaagagaaattaagttcacatcatttcccaataacacagatgaatgttttccatccaattctgaggacaaagatagcacctcctcgcccatccatgccaacggaggctgaggtagcacagataattgaaattacagtgaagaaggaaaggggttgattgatttgcatgccatctcttttctttaatagtggaggaattgccaaaaaaggctaaaaatgggcaacaggaaaagggagaaacagtaagaatcttggataatcttccactagataattaagacttaactgggtctgttttgatgtgtgcacatgtttctgtacatggagaaggatgaacccacaaatattataaatgccaatttccgaaggcttttggaaaatgtaacccatagcatatggtgtcaaattaatttggggttttacttgtttcagtctgatttgggcacattgaattatgagataatagtttggcatccatgtttgctgagtgcttgttgtaagtttctcaatttcacaaaaattctctgaggttagaggacgcgtcgtgaccctcgtttggcaggtgaggaggtagcggcacagagccgatccgtggctcgcctgagctccggcaggaactcctgggcggagctgctgagacccaggtctgcagactgtcactctggcttcactatttctggccttcctttgagcacttttcttacttttgttctgtttcatgcacttaatgcacctgtttcatcatgctgcctgtcacagttaaaggaatttaaaacagaatggatcgtatttgacagtaaggagctgtacagctgaattccatcaagacaatgtgcttgtagccccaacggcattaaaactttcaaatgatgctttatcacaacttcctctgggctgcacgtgacaaaggggtgcttaaccaggagggacatctctctttgcttgtaggggcaggttgctgttttttgcccacctctaaaatctccttggagcactcagttcttcttatcctccttaaagccaacaactataaaatttaatttaatgttgaacagctgtttctgttgcggtccaggtgaaatttgaggtatcagctaattgtgctaaagttcccaaaaagaagtattcagaaggtgtggatcaccaattacctcttggcagagctgtgaactaataactagtagcagtagataatgtactcagatgccacatgaaatgcaaaagattctatgctttattccataaagcatggctataggacattgtctactatgtaactaatatttaaatatttatagatttttaaaagatttcttcaaccttcttttctcaccctgtttctagatctgatgcacaaaggaaaataataatacaaaacccataacctattcattgtattgttgcggtagatcgagctacatgctgcacagcaaaagaccttctttgcacttctttcaagcagaattattgctgtatattcactctgaactgagaggtgaggattgaactgtgtagtgcctcagaaaatatcaagagttttaaaacattagttttgagagattgaaatacatagaaacttggaatgtttgaatgtcagcccagacattggcaggcttccatgcagatttcattgtgagtaaaatgtgtactcagtggctgggttcaagcccttcatagtttataagcaaatgtctctgcttcttctagatcattgcaaaaaaaaaaaagaagaagaagaagagaagaaaagaaaaaagaaataggttaagcaaattttgtggtggtgcttatgtgtgcacagacatgcatgaggcctccgcatcttccaaacttggaaagcatattttaacagcacaaatatatctacatgtttgatctacatcagagcctctttttttccctcttccttgcatgcttttaaattatatagtttaaatgttttaactattaaatctgtttggtcttcaagctgtaaacatcacacacagctaataagctttaggaaagaaaaggaaattgacatttagtatagaggttctacaaaaccaatgaaaaccatgcaaatgagctatggaacagagagatttgcatatcctcgttgatttcatgatgatattctcagcatgagcctggcagccttgcctttttacctcttgggatgatgcatgtactggtggtagagccctgcagggtcaatttaacgagtgtaacattgtgattttccatgcggtttctcagaaccactgagcaaaatgcagcaataaccagtgacagaggaaatcgatttttgaagtaaatacttttggaggaggggaagaaggtacattcccttcatatttaatgttgccaaagtaggttgaacaagtttttatattagtaccatttggtatttcaaaataaatagattatccaccatttccatcactctctggataccctcacatgtttaccaccaaaactcctgcgcagagactggtcctcttttgcaaactgcctttggctcccccgcgatctctcatcagaaaagcaggctaaggaatctgcttttgcccccatcctgttagaatgataaatagtagcctgatggccaagttgtatatttatttaatacatcgtctgtattgatagtttatgatgtcctggatatgaatacacgaaagcacagttgcatagtggcgaagaaggattttgatatcgtggagatctggatttgaactcaactctggcagttctccctgccttagtttcttgcccgtaaatgggggtgatgaggtagttgtgagaattaaatgagagactatgcaaattgttataatactccctggaaaatagttaaatacccaatagatagcatcactattttgaaatgctttcaaaattatactcgagttttacttctgcaaaatcaaggcagctttcttcagaaaagagagaaatgaacttcacccctaaaatgtacttggagaattttagagggtcttttccaagttgttataaagcacttctgaagtgaatttgcccatttctgcccacaccaatcttataacattccaggaataaaatctgcactcgagtttaaaaataaaacgggtggaacaaactgaattagaagtccttggcagacatcccccccagcagaatgttctctcaattggtggtattgcaataaaagagatgtatattttttagtctgctcttcctccctgataatttcagccagttgtatttctctattctaaaaacctggtatgcttggatttaatctcaccactcctatctacgctcctgctcctacccccacacccatttcccccaaaaaaaccccacatctgcacagaccctccttcccaagaaaacatggaggcgggctgctctctgataccgtacatgtgcattccggactgtgctgaggaaggtcatagaaacatgagagggctctgctgttgtcagttgtaaagactgccaagaaagaacaacaaaaaaatctcaaatgcattcacatttctcccgcctcttttttcttctgtaaatattcaaccctttttagagaggcttttgataatgtgttatctcagcaaacaccacgaaccttggatgtacgcagtactccctaatcccataggaatgactcagtcaagagagttagatgaaatatggttggcaagattgggtggggaatcttgttactacacacacatacacacacacacacacgcgcacacacacacacacaccagcagcaccagccactgcacccctatcatcgccatagacattatgtaaaaactagacattctcctctcccttacacagtcagttgcatctttcccaaaaatggaaggggaaaaagctttctttggctgagccatatgcaaaaaatcatggaacatctgtgtaagtaacaacatacaacaagacaaattattggtggtaaaaggcaaagcccttgtttcaaaaacatgtctggaaatagtgtgtatacagaaccttcctttgtgctaattactcataataactgtcagctttgtgtaccacaggctgggctgttaataactagtggtcgcagtacggtgttctttttctttccctttctttttttttttttcctatccttccttccctctttcctgccttcttttcattgttgttgcacaaatcatatagccttattccaatagttgctggaagaccaaatcagagatgtgggggattcagggactcgcgacatcttggagtatactagtggataaatgccacttcacccctgatgtggccgtttccctccaacacttgtctaaggagtgcagggactttggggtccaagcaatgtatcagtaaacttcagaatttttttcctaacatttaactctattctcagtctcaacacccgccacaaaaataatgtcactccaggcaaatttagtcgcttacggattctgagtcttattgtgattttgcctgagtggcaagcttttcaggcacgtgtacttaaaaatgtgatgtggtagaatttgcctccagctaggaatccacagacttgggtttgagctccacgtcccacagtcaccacgtgatcttcagaaaagaatcactgaactgcctgtgcctccatgcccccgtttgtcaagagggaggtggtaatacctgctgcggtttttatgtggatcgaatgggcctaaaactcatagaaacacagaatgcttctatgataagagaaaactccagccaggctcagtggctcacacctgtaatctcagcattttgggaggccgagatgggtggatcacctgaggccaggagtttgagaccagcctggccaacatggcaaaaccctatctctactaaaaatacaaaaattagccaggcgtggtggtgggcacctgtaatcccagctacttgggaggctaaggcatgagaatcacttgaacctgggaggcggaggttgcagtcagctgagatcgtaccactgcactccagcctggaggagactctttctcaaaaaaaaaaaaaaaaaacgaacaaaaaatactctgatgctattgctactggttgtttttttttttaatgctaaaaggactccaaacatcctgttatcacccactgtcaaatttctgcatatattttgcagtgccagtgagaaacttggggtctctacagtcagtaaggaaaaaggagtttgaaagaactaagggatctctgtctatggggaagaaatagtagggcagagaatttaaatttagggttcttaggaaatgatgcaccagggccaccgcacagccctcatgtctcctctcttcagtgtcctctctgcctccatcacctagtgaggagggaacaggtgcaggaacaggtcgccagggtgtccagcaggtgacctcccacccccctaccctcgccgcccccactgctccactggcagcctatgtcccaaccaaaccttacttcacattgtaattctaatgttctgtgcgtgttcatcgccatatttccctccatctgacccagcccgtcaaaatccttcctctacttcagggcccagctcccatcccctcttccgcaaagccttctaaccgcaaacccattaacctctccccacttggggcttctgagtccctttattatttatggttaggagaaagcatcacgtcggtctggtgatgtgtagtgagttgtgtgaatgtgttagcagagcagggtggccctgcatgtgatggttgggtgttagctggagtgagccagcctgggttcaaatctccctctggcatcagcttgtgctgtaattggggtaagtgctgaaactctccctgtctcctttcctcatttgcaaacttggcttaataatgatagctacctcaaaaagttgttgtgataattaaatgaatgtcaagctcttggaacagtgcaagcgcttaagaaatattatgttggtgcaaaagtaattgtgattttgccattactttcaatggcaaaaaccacaattacttttgcaccaacccagtatttgctattactagtcctggtcagctgagcatggtggctcatgtctataatctcaacactttgggaggccgaggcaggtggatcgcctgaggtcaggagtttgagaccagcctggccaacatggtgaaaccccgtcgcaactaaaaacacaaaaatgtgctgggcatggtggtgagcgcctgtaatccctactactccagaggctgaggcaggagaatcacttgaacctgggagccagaggttgcagtgagccgagattgccccattgcactccagcctgggtgacaagagcaaaactacatctcagaaaaaaaaaaaaaaaggcctggtctaccagagacaagaggccatgtcttgtccatgaaagccttgcaaccatattttacagatagaaaagacccagtccatgaacattaaagtcagtatcaggtacatttatcaacataaaatctgttcctttgaatcagctcaataataaaagagtgcagctgagcaccccctcccacagccccatgcctctagtcactgaaaatctgtgaggaatttttatagagtgtttcagaacagagcatttcaagacaaccctagagccctatggaatacattttcaatcatctttctgcgtctgctttcttttttgggtgcacacagcagacactggtgatgaggcatgtgcctgtgtgcactgttgttttatagaagctgaatgaaagcctgggagttgtatctgcctgaaaacttccatcctggcttctagagctcaacacctgaaacgctggaggcagttgaggtcactttgaaaacggaacccttgatgttctgctcaaactttagaggcatttacaacaaatcaggcaaatgaaagtgtggaaaaatcagaaacgaggaccactctgtcttagggattttgtcattgtatcgtgtgtgtgtttatgaatgtgagtgtgtgtcacatgtgagtgcatttaaccttcatgcaataagagagtagttttccacttagaaccagccaactctctataaaatttacctccgtgattctaattttgctccctccgccgtgggcaagttggcaatgtctgaatgtctgaagtcatttttgcttgtcacgactggggaggagctaccagcatctagtgagtagaagtgaggaatgctgctaaacatcctgcaacacacaggacagcccccaccacaaagaatcatccagcacaagatgtcaacagtgccaaggctgagaaaccctggtttaccttaaccttaaaagaacaattcgaatgcttgggaagggatgtctgccacatctgtactggagagaagcatggcccccagtcaaggacatggagagttccatgtctggatctagaccgtgtccatccacaaagatgcctcctgctcttctccgacatacaatctggtccatgagaatagactttattggtgagggggcggggctttaggtgagcggcattgaagggcttgttctgagcttggcctctgctggcagattattttctggccactttaatctcgatcctgcctctacttggtctttttttttttttctttcccccagtttttggatcttatagttccacaggacaagatacatctaagagatgggggaaaaggttaaagcagcaaggggatgctggatagagggggagggaaacaagaaaggaaaaaacaagacagagagacagagatagacagagatgtacaaatgggggctgcttggttaaagtgtcctggagttttcagcaagagattttgctgccagtgtctctccatccttctctctgcctctctctctctctctcacacacacacacatacagacacacacacacacacactcggccccaccaccacacacaggccaggtggctctgcttacatacatggcttggcgcttttactccttggctaagaccatttcacacatgaacaacacagcctcctcctagagatttgtcatccatctgcttgcagaagagctgtctgtttccctctgaaaattggtccaatcaacattttcctttggccagggtagcttaccagcagctcctccataaggtccataattgcaatttctcattctcatttgcctggctggcttcacccttctgtcctctctgcaccttcccacaagtgccccaccctccccaccagccctctcctccttttgtgttaataagccctgtcaaaatgaatgacagaatcaacttccttctcccaaaatggctcattactcataaatttcaagcaatattgccttctgtcctcaaaaggtttgcagatttttttcccccaactgatcccctttccagagtgaaatagcggatgaatgccttgcctagcaccctctctaagctctgcctctgtggcagtattgtgggccaatatgccaacgagtctttccttgtgatctgctccagcctgtcttgtgccatatgcttgtggcagacagtggttaatatcagtctgtgagcatcttgaggctagctttgaagtctaattctaatgtcatcatgcttatagggtgcacactttgtttgttctggaacagagggtcatctgctacgggatgtggaacactgaccctgatattgcagccgtgtttgtggttgagtgagggagcaggtgatgggcataggagggaaccaagccctgagccgtgtttcagggatgctcggtcccatcccctttctcccagatgacttcttattcttaaattttgaatagtgagtaacacaagcaggaggtgggatagcatgagaacttaggaaatcttcccatctctttgttacttacaagataaatgtctatactgaagctttagggacccagattacaactgaattgttttataaatgcgtctgaaatctgctgttttgaaggacaaagtaatacctgaagaatgattaagaaggcttagagaatccgcaggctccaaggtgtgtgaataatacctttccatggttcactaccaggtgatctggacctacagccagtcttctgtgtttcagtatattatgttgggagcattcccagacagttaatgcgtaaaatgctattcaaattctcctttaccgaaaggcattttaaagtaatacacgtgggtgaggaatacaagtgcctggtgggatacttttggtaaacaacgtggcacagtgggatggagtagggtctactttttcccaaatgtgaagttagtagctacagaggggtcctgagacagaaagcatttgtaaatattaatttgtgctctgtttcacagaatctgaaatcaggcatctgtgcactttaaaatatgaaagaactaagagatctagtgtttggtagcattttagagggaaaaaaggccatagctcaaatattgctctgatttcagttggctgaatttatgtgtaaagggcatgttagggaatagtctgcaaaggtaccagaaactgccattcatggaaggccctgagtgcaaaatgcagcagtcagtagttctgacccatgccattagatggttctggaaggtcctcagaggagacgcaacaccaacagtgacactgcttccagctcaggcaggctggagctgttctgagtcttcctgaaggttctgaatggtccagcccttggactcccttcagagagtcatggagcacccacatttcctttgcacctgaaacacttctttgtttctgtcttcaccctgactcctcatctattcagagatcccagctgatcctctctttcaaagccaggccagtgagctcttacagaagcttacttcagcattccttccaccgtcttctgagtagcagggcagacagagacagcaatggagaattccagttgattccccataaaatggccactttgttgtggggcatgagctggtctgtacttgtttgtgcctggcagtgcacacactagaaccctgggcaaccctggatgtaaatcaactagatactattattaaatagccgaaggtttgccagtgcagcctggagcaaagagagaggggtaaaatcaggctcccaacagacttccccataggaaacctctcctctgctgtgattttccagatgagctgcgtaaatggctccaaatcaccgaatgtttgtgcacgcaggctccattcatgcgcatgcacacacccggcttgtgtccttcttccctctcgtcccttgaacccgtagctcttgattctgcctgtaggagcaatgatgttgtagcaaccatgacaaaagaaacaaaatcagaaggcagatccaggccgctccctgccacctgccctctgtctaccttagacagatcacttaggcccactgggtcttgataagacatggtcttttcacacctgttcttccagtcttataggattacctggaggatcatgtgatgcgaaggatgtaaaagtgctccaaggggttaaaaggactttatataataaattcctacaaactgctataggcacagccatagctctgaaactagcattctcgtaaggctagtccaatccataagtttcgtttgcttcaagcagctcagatagacactctctgaagataaatgatgcataaaaacaccattgtttgtgatcagaataatcaggtaccactaaatagtcctgcatgtgtatgcatgataccagcagcctccaacttgcttctccaggagcactgtacttaacttggaaacccctttatttaatttctgtccactcacaaagcttcaccttgtcttctctcctctctgtcctcccgaggttaatccttgagagcctgtaatcaaggctaggccctgcccaccttaagtcaccctcccctctctctaggcctccacctcactggggagcgtcattgcagccagtggcaagaagctgcaaaattctctcatctgtgaagagagcccctaaaaccccaaatcccggaccagtagaggaaaccattgctgccctaatatcacatgttacaagtcttcgagcccatggtatctgagatgttaggagctagcattccttgtaattaaacccctggaacatcacaaggacccagttcagggggcttggttggttgactgattgatgacagcatctcaattatgtaggagatttctgtaaagaggagtgactggaaggaaaagaagataaccttcatttatatcatgagaccttgcgtagtagaaggccgtgaggatgggaacaaagtgaaatcatgaaaaacagcctgatgcaaaatgacaaagaagaatttcagggtcgttgagatcacacttgaacaataactgaacagagccagcactacagttttcagacctgatggctaacaagtgaaatgtattcagagagaggtgtgtgattataaagactccccctacccctggtgctctattccactgactgtccctttatgaaaaatgaattctagagttccctttctgaaatttcttacctgaatcagatcagatatgacaattctattttttaaagcaccttactgaaaataaagtgcttttcagtagtaaacctttaagattcctggtttccctctgacttgtgaaaatatgaaagaactgaaattagaccacattggcccaggttgggaaaacagatggcagagataaggcagatcaaagaaacatctctctgtgggtgaaggagttcctggttgtcatgtatccattttttgtagcgttttccctacttgaggaggctgttgtgaagggcaggattcttcactgaatctttattgtaaaaggcataggtgtgtcttgggtggattccagttctcaggttgatttgcttgacaactcttaggaaggaacaattaatactgctgcccctcaactagctagggagatttcactgtggaggtagaagtcggattcactgaggcagaattgccagggcttgagacccttcatgcctctcttttccaagtctctctctccaagaaagggtgaacttttcaagtcaaagagcagggacgtaaataaatgcagttatggctgtcttaggaggatccattcacttaaggcaaaggtcttagaagttacagaagaggagagagaatgggaactactgtggcaccaggatgtctggagaagagaaagtgcgcttactgtgcacagcttcctctccctcacctgcgccacggtgaacccacctatatctttctgctggcaaaaacatttgctcagtgtgtcgccggagtacttgagtgtctgatatttctcaaggcagaatctacctcactgtctctgaaacctcaaaatatgtggccctctcgaaggataacagttggcagcaacctaaggctgttctgctccaacttggaatgaagaggaatatgatttggccattcttcttagcacagaggcaaataaaaaaaaaaacccttatatacttcaaaagatgaagatcttacttcttactggctatctttgcaccaggtcctgggattggcatataataaaaaatgcatatgcagtggccatgaaatgggcttaaaggtcaatcttggctgccagtcgtggctaaactgcattgtattccatgtttttttccatattgcccctgcagtgtacatatacatgcacagtcatggcccctgcacactgtgtacacactcacgcctgcacacatgtatgcatatcaacgcctgcacatgtacttgtatgcacactcacccacacatgtgcatttgtgtgcactcacttctgcacacctatttgcatgcacgctcatctcccacaaatatgtatgcatgcacactcacgccccccccaccctcccgtgtgaaactctgcacctgcttgtctttaccctcacccttgaacctgtgtataacctcataaagtaggaagaagcccagtgttgaactctacagccttttacattcaaaatggttttgaaaaatgcccattcagaggaacaggaaagcaccaaacctaaaaggtctgaggacctttccatgctttctgtctcctaatctcagagctgtaccaatctgttatttaaaaattagtcattatttatccaaggcaggaggggacaaatgtaactgttagttcagtaaatgatttcattcttttttttttcctgtgtcctttctactgttaaagtgacgaaaatgacaccacggtttgatatgtggggttggtttcagtttgaataatctcatccttagctgcatgtgaactcatgtcttctcacactctattagataaaagcctaaaacaggaaggccagaaacaactgtttttaaaaagctcatgctaccctggcaacttaagttggaagaacctaataaataaatacaaagctgcccctctgtcctaatgtacttcttctgaattccagctgggcacctcatggtttcatgcctgaatcacaaaggcgagtgccagtacccagccagagcagttttcctaccataaaccagtaaatgtgtgtgtatcacatgtaagtcagggtcagatggggaaaatcaactacaaaaccgcagagacattatgcaaaattggattacgtacatgttttcagttttgtctcttagcagtttaagtctttaattaaaatacacacgagagagagagacagagagagagagagagaatctgtaactgttagattttataggccccggttatgagataatagccttccaagtaatttttatgggtcattctatctagtggcaacttagactataaagccatctcccagcttcccaaaagtaatgtctgttttctcactttctaataattacttcagatttgaaagtaaggagttgtcacagtgaatacaaattagagtcagcttcagggtattactaaatgtggattgttttgttccgagttttatccattttaggcagagtaacatgatcatttatatacatctgcctctatgcaggctgtgtagacatactcagaacaccagcttcacctcttcagtcttctaagacagtctttctaatactctatattgtctaatagctaagctattgttaaataaaaacacgcaaatgtttgcagttaggctcccccctccattctcaacctcttaagtgatacagacagtaaatgcattttgatgtttatttagaaagttggcatcctgggactgttcacaagatagctaatttgtctgaaggtccccagagacagtgaaagtcatcccaccatctctctagctgccctcataccggggaagtaaaatgcagcatagaacactgcagctcacgttatggagaacagtggtgctatggtgatttcctttctattcaaatcatttagtgaggatttacataatttgcattaacgtgtgactttcgatcacttatgctgcagcagagtattcgttgcctatgttctctaaggcaccagtgtggtggttcatgtgtccttgtataaaagattactgtcctccccatccccagtctttgtatctgtgcaccagaacaaaatgccctcggatcatggccacccaggccagagaatgaggacccacactttaaaaaccctgtagatgataggatgagcggtcctcatccgtcccctccctgagagtgaggttgggttggagtagaaggatggactctgccaaatgatgacagcagccctgagagtccttctcacaggtggccagctctgtcccctccagcctcaccacacattcccctagtacacaaaggcagacccgggcagccactcagcatgcacatgtagcagtgtcccctgtacactggtaccctcaaggcctccctggcacctttgcttgttacgttggctgatttcttcaaagggaaatatgggatgtggtgcagcctggccctcacacactctgaaaatagcactgcccagggccaggccttttcctttgcacactgccatacccaccctggaaagtactccatggttgtatcacaagaaaacagccatttgggcattttaaattactcaaaatattataaaaatatttataaaatatattaatgtatatatttataaaatacaaagagtatatgattaccaggcaaatgagtagacagtgatagaactatcataagaataggattggctattaattataataatgattggaatagataacatttattgaacatgtattatgtgccaagcactgtgctaaaatatttacatgcagcagttcatcaaaagctcatgggaagccatgtgcagtgtcatgcacctgtactcccagctacttgggtggctgaggcaggaggatcacttgagccccagagtttgagcctagcctaggcaacatagcaagaacccatctcaaagaagaaaacaatacaaaaagctcatgacagttgtaagacatatgtaccatcattacccttattcaacagaaaaggaaattggggcttagggtgggtggttaccttacttgtacaaagtcacacagctagtaagtggaggagttggttcaatgaaggataaccagggaagcatctgtgggcatatcgaggcctgaaaataggaacaccttggccaaatttcagaccatgacatcaagcgaatgcttgaaagctaaggaacaaatagaaatatgttgtatcatttataacaaattgttaccattaacacctacaattattagcgttaggagtattgcggtgggaattgaacaatgagaacacatggacacaggaaggggaacatcacactctggggactgttgtggggtggggggaggggggaggggggagggacagcattaggagatatacctaatgctaaatgacgagttaatgggtgcagcacaccagcatggcacatgtatacatatgcaactaacctgcacattgtgcacatgtaacctaaaacttaaagtataataataataaaataaaataaaaaaaaggagtattgcatggtcagactgttcagatctcatgaatgctccctgcttctctattccttctttgatttgacatgtgccaggccatgtattccagtggatttctgtactttctactttattccaaaggctaagcattcctgaaagccacagagggagttgatgtgcttaaggaaagaagtatcgcttaatgtggccaaaaaccgattccatttctgtacaaatgcaaggagtttttgccaggagccagggattaatagtctagaggaagggactaattgtacacaggaacaatatttacttttataatgggaatagtttgagacagtgcatcttctagacacaaacattcagtaggaagggttatgcattaattctttcatttaatgagcattttaagcacctattatgtgccaaatatcttttcgtagctctacaacagtgttcacttctcaatcttttgctacaccagagcgttgggaccatgctcccattaatcaccctgtctcaaacaacatgctttaccttcattcgttgatttactcatccattccttctcatagtttttaacctcaagagctctgaggttcagggtggaataatatggagggcctttgagaggctaacttttgaaccaaatcttcgaggatgaactagggtagtggcaggtagaaaactgcctttatatttagccttctttggtacctggtcatggatttcttcttcaagcatgaatggcatcagttgtctgggagtgagatacagtgttcgtatgctgagaaacagattaggccattaaaaaaaaagttgtggccacgtgtggtggctcacgcctatagtcccagcactttgggaggccgaggcagggggatcacgaggtcaggagatcgagaccatcctggctaatatggcgaaaccccgtctctagtaaatatacaaaaaattagccaggtatggtggtgggcgcctgtagtcctagctactcgggaggctgaggcaggacaatcgcttgaacctgggaggcggagcttgcagtgagccgagatcgtgccactgctctccagcctgggtgacagagcaagactccgtctcaagaaaaaaaaaaaataagaaacttgtaactccctctctctacttgatgaagtagacatcaggaaagactttcttattctgctttccattaaaagccataacttggaaattattattgattgggcttggtgtggtggcttgcgcctgtaatcccagtgacttgggaggctgaggcaggaggattgcctaaggtcagaagttaaagaccagcctgggcaacatagtgagaccctgtctcaaaagaaaatttttttttaagtagcctagcatggtgatgcatacctgtagtcccaggtactggggaagctgaggtgggagaatcacttgagcccagcagttcaaggctgcagtgatctatgattacaccactgccctccagcctcggcaacagagcaaaacctcatctctaaaaaataaataaaataatatcttaggggaagttgacaaaacattagaaatattgtagggttaggtgcctgttgagccccaggatttattccattattcactcatatcttcatgtatccattcaataaatacttattaaaagcctacaccatgcaagataaaagccacattctactgagtatgcaatgatacacggtatggggtttctgctttatggaaactaaaggcctactagaggaattcaggaattccagtgtgtaccagctcggctgtaacacagtgaggaagagataggaaccatgaactaagcggtgaaaatgtgatgggattcagaggggtcagaggtattggatacagtgagattattttaaacgtttagggtgtacgagcaagatgagtaggagatttctttaggaaacatctccctatgaaataaaagtttatataaaaggaataataattacagttgatatttatgaatacttaatctgggccagggactatacttagtacttttcatgcattgtctgattaggtcctcacaacagccctgtaaggcaggtattgtactttcttatattttatagtttgcactattgtgtgctccatggttatagcaaaagctttgtctgtaaaaggccacagggatagaaggcagagaggaaagtagatgtgtgatgcagtattaattattgagccaataaaatctctctaatttagattttttaggaggaagtcattttacattttacattaatttaatctatattgagagatccttctaagaaaataagttgcattacttcaagtatacatagccatataaattattgaccaattttttttttccaattcatagacattactttccagaaactagataatgaccatttgttatcagcacactgactgcaaaatggatgatgaagaaagcctgggttttttttttttttttttgaaagcttggtagttcttcttgtgaataaattaaacactttcctgacgatcctgtttgcattattgacttatatgtactggctcatatgtagctgcccatgtataattctccccactcattctgaagggagggaaaaaaacgattaaaaatttcccctccttctttttcctgttttgagattatttttgctcccagcagaggcgcggaggagggagctctcagagccccattctgttccctacctacagcatgaaggatccagataaccgcagaatgaatgaggtttgagcatttgtttttgctataagtaagatggtttcccattaataaaagtggcactcagtttactttgtcttcgccagacaggcaaagggtaaattaaggtggttacctgtggtgtcccagctctttcccaaggctggactagtgtgagccgagaaccaggcaggactcactcacaggtccctttctctgctacttctgctctggttttatgcgaagccctatttcccagctgcttcgggtaaacaaggacttctgtgttgaaataataaccacttgggctgggcgcggtggctcacgcctgtaatcccagcactttgggaggccaaggagggtggagcatctgaggtcaggagttcgagaccatcctggccaacatggccaaaccccatctctcctaaaaatacaaaaaattagccgggcatggtggcaggtgccgtagttccagctactcgggaggctgaggcaggagaatctcttgaacccaggaggcagaggttgcagtgagccgagatcgcaccatttcactccagtctgggcgacagagtgagaccctgtctcaaaaaaaccaaaaacaaacaaacaaaaaaaccacttattgtttcactgcctaatattaattaattggccaaatttctattttattatattccatatattttaaaataatttcttcttctgttgtacaaaccaagatagaagataatttgcccaagaacacaattggtaggtatcctagctaggaaagtgggtgcttctgaaaattataaaaatgaaatgaggtaattttctgggcccttggtacaatgcctgagatgtcatatatactcagctaattataagtgacattttgttctagaatccagtagctcaacttttagtccattgtgctgaacacaaatctatagatccttaaattgtatacttttattaatttaattttaaagagccagaaaaattgactacattggaaacattccagtccaccaacatattgagtagaaagaaggacaaaggccatattctctttcagatgctacaaattgtgtatattttcagtaagctgtgtctgcttaaggaggcattactgcattcggatagataaactcaaataaaaaggcctgagtgaagaggctctactgggtttagcgtttttttgttgttgttgttcagttttgcatgtgtgtttttaaatcagtttatggttcataagctgatgaagcagtgagtacaagtttgaactatgagaagcaggtttgaataagtctagacatttggttatcttctgtctagcattcatttgtgtcgtgggcgtcacactctggggattagtgtttcattatgcagaagctgttttatctttagctttcttataatagcttaaagtgaattctgagtggagagagaatgaaggccaggccttagtaactgcaagaatcataccaaaatgggttggatgggttttaacagtgaccgataagcattacgacctcactctctgatagttcagttggctcgatgctgtctcatcacctcatttagggtacaatatgctgaggaactgaccaaaggtccctgaacagtgagagatagggaagagcagaaatccgttcctgtaccaagtgtctaacacttaatataggtgagagctggcgtgagattatctgtgctgtggaaaaatgaggacctatcgatacctctaagtatataatcactgccgtgtcacattttaattagctccttgaggctatagaaagaagttcgcttcttatcctccaaattaagcatcacttttacaaacaatcaatgttccattttcaaaaccccaagtagagcaatgtttgattttccttactttccagctttgagaatgtttcatttttagaaatatgttataggaatgtaaagtaactcttgtttccccaaataaccacctccttattatctgttcccctaagctgaatcctttcaaaggaaattttgtcttcaggctaagtttagtggctgatggaaatcaaaattatatcaggtgggccattgcgtcagtaaaaaagcccagaccaccaccacacaggatttttctccagacacccaaacatcatgtcacaaagctcaaaaaagtagtgattaacatgcagtgctttcaggaggcccacattgccgattcagtcccagtatgggctcgtcagtttcactttcattcattcatttatttatttattcccccacccattgattcacattcactcatccattcattaaacatttgctgcacacaatatcactgttagacagactttcagaaatgattgggttcctgtattacagacatgagcccacggcacaaaggtcaaactaagagtaagatggatgtttatagcacaagcctataacaaaaagaatgggtcccgagccgcatcttcttccaaatgcacaaactatatttgtaccttaaaaaaaaaacaaaaacagtgtttccttttgagaggcagcatggtatatgggaagaacacggatttaagaactagacaggcctgggtttgaattctgcatccataatgtgctaactgtatcatttcgaggaagttcttttgagtttcagtttgtctttaaatagagtcatcatttctactttgtagggttgtgtgaggattaaatataaaatatgcagcataatgactggcacatttaaacgaagtgctcagcaagtgctatttcccttcccctttcttcatttctaacatagtttgggaatggtttaggatgactctttttcttcttgtgaatagatagagacctcatcaccctaacactagaaaactataggacagagaccatacttcttgctgtggccagccctcatccactttgatgatgcttgcagctcccaagagagacaacagcccccacggcatggccaagagaggagcaaactctctccccaaggcagtcactctggggatgccattgttccattgccaaactcatgacctttggggaatttggaaatctactactttgtggggagaaaaggacaaagaaagtcaagattaagctttatatgtaaaggccttttattttaatggtgttgaattgagtttggattttgcgtacccttcaaatttcttagggtgtgggtgagggcatcctaggagatttaattagctccttgagcggcactgaagtttgcgacattgaggcacattttcttctattgtccattgaagtgggggagcctggcaatgaaatttctgagaaactgacgctgttgccgtggatagaattgtatggatatttgaatttagtttagtcacttggtggagttttattttgttgtttggtttcttttggaaagagaaaattagtatagtatgaatctgagcagtctggttacatgctttaatgggcctctgagataaagcagaaaaggatgtagtctagtagtaaccctttagatgataagggacacgcaggaggctgtccaagacagtctgttaatcttaatagtctctcacttgttaagacctgatttatttcaaactaaatttcttgttttgagtttccgggtgaaagttctggactgaatccctaaaaacatgcacaacaaagaagaaggcttttagaaaggtttctcctattgacagggttcatattctatagttcacaattcagtgaatcaacatttatattaatttcatccgttacaacctcagaatttgcctacaagatccaatggcatttttactgcccttatttagcaagcctatacagtacttcatgcacttggtcatgtcttcaactaatatttattgggtgtcttccctaagcaagatagtgcgagagagagagctgagttaaaacattcaagataacctcaagaagctgacaatctactaagggagataagacatacatattaataagaacaacttaaacacaaaggacaagatgatatgtggcatatcttatcaattaaataatgttggacttcagagggtgaaggaattaggcatgaaggtatatctcaacagggctgtgaatgactggaaacaaggtcttctctcttcacactgtgagccagccacatccatactacggtgacattcatttctcccccaggccagctatgggcagaagtttaattatccttgaacgtcttcaatgatcctcatctttgcccttgttccctctttatcctttctttctccccaatgtcttaaatcctgatgcagccagggagattttttttttttaaccttcaagaaggtaaaaaactatgccagggcaaaatgccagatcaatgttgctattaatataatcagatataaactttttccagttggcaccaacaaccctgggccttctctgagtaccacctataaacagggcttcaatttcccatttttgcatacttactaatgtactacagatcttgcactgactttaattcaatatcaatattaaagtcatatgaggtagtagtaaatagagatagccataccttagagtcaataagacataaaattagttatgttattattattattaattatgcataatatgtcattttcctgaagagaacagactaatagctgatttcagcaagcatctttaggcttttgttttcaaattattttacatctttttcttttcttttcttttcttttttttttttttttttttgacacagaggtctcactctgtcacccaggctggagtgccgtggtgtgatctcagctcactgcaacctccgcctcccaggttcaagcaattctcctgcctcagcctcccaagtagctgaaactacaggcatgtgctactacacacggctaatttttgtatttttggtagagacgtggtttcagcatgttggccaggatggtctcaaactcctggcctcaagtgatccgcctgcattggcctcccaaagagctgggattacaggcgtgagccactgtgcctggccacccacctattttccatctttagcactggccgttctcattcaaaatacgtactgctacactaagaggagacttaacttcaaattcactttgctccacggatgttgtatatgacctgaatagatgtaattctgacaagcttgtagttcattggaggctcacaatttgaaagaaatgcatgattaagactttagaacataaagaagattctagtaaaacaaatgattgcacccttttggattttttgcatattatctttatgtagggaagggaatgatatgttagaaagaatcctcaaacaggtttagacaaatcactggttgaaccataatctccaaaatatcgctacatcagaaaaagcccaacatagcctctgaggtattcgtcagaaatcccagtgcaagcattaggaaagaaatgtactccctgctcctcacctttgtaagtcagatttagtcttcactgttcatttcaggttctctgcctccataggggtcccttcagcacttgtttggttctctaattggcttatgatagtgggtcttacatcatcaactggattgtaaattccttcagaaagagatgtcaattaagtacacagcagagtcacagtatttcaaaattggaagtcatagtaagggggaaggagggccgctagatgctgtgattcacacggcgtcatagtaagcaagaggccgaggcagtgccagcacccaggtagggctccggtgccaccctctgcttcatcctctgccaagcctatcacgacggtcgttcagctcatgctctccatgcacgtctggtgatttgatgctcatctttgccagcttcagagcatcactggacacatgcccagtcttgaagggttaattttcaagtaccaagcatgctttggacaaactcaaatctgttccttgttttcgctcaacccgcaaccagcatcatcagcccagacgcagcttccccagaaggccagcaggtggagcacagttttgtggaacttctctagaactcgctgtttaaaagccgcaaaccaagacatgtgaggctgtggggtggggggcaaagaagagccccagattctgcacgtctggaagcttttaaaattgtcttacaacaattttagacctacaaaagccagcttttgaaattgcataaacggcaagtcgagttcttttttttttttttttttgagacctagtcttactctattgcccaggctggaatgcagtggcacgatcttagctcactgtagcctccacctcccaggttcaagctattcccctgcctcagcctcccgagtagctgagactacaggcgtgagccaccacgccaggttaatttttgtatttttagtagagacagtgtttcactatgttggccaggctggtcttgaactcctgaccttaagtgatccacctgcctctgcctcccaaagtgctttgattagaggcatgagccacggtgcctggccagcaagtcaaatttttaattagacttaaaatgttggtgctcataacaactacagttactgtggttttttttttttagtttcataaagaggacagacgctaaggcaattgtgtggaacagagcagcttctcggggtaaccatctcctgctgatgtataaatatcggggcaaaactgagtaagttttagaaaataaatgtcaaagcaagtccgagtcatttattccttagcaggaaatatcgatcctgtgacattatttgattataatgactgtttctattaggttaaatgactgaggtatacttaaccagtttaggtgaagaatgaggctcattgcaccatttgattgactaaaccttagaacccatgtattctttttatttgttcagtcaccaatttttatgaagcacctactgtgtgccaaacaccctcttgggtgccaaggtaagaattaaattttggaattaagcaaagcatgatggctcatccatgtagtcccagctactcagcagactgagacaggaggatcgcttgaacccaggagattgaggctgcagtgagctaagaacatgccactaccctccagcctggatgacagagacctcaactctaaaaaacaggttttttaaaattggaattaaacacacttgggttcaagttctacttcagctacttattagttgtgagaaaataaatgtcaaatgtttttcaatttgcataagttatttaaccacattatccttactttccttatcattaaaaccctgaaaaggttgtaagtgacaaaatacgtgatacacacttagtgcctgtcagatgataggcctgagttactgttaacttttttttttttttttaccatcctcatcatgttcctcattctcatcttcttccagggttctcacttgatgaaggaaagtatttaagacaatacttctttaacatacttaataatggaatggatatagaaatgggagaaatcagtgtgaaagcaggctttggtgaggccactatttaaaataactatagtttatttaaaggagacacgaagtaactgagatttcacaaggccccagacccccttctcgaatgttattatcaactcccgtttctgccctgtgatgtcatgagggttgatgatcggttcttcttttattttgttgccaagtacagcagggatatgtgtcctctctattcctgagtggtgaaagttctcttctgagaccacaaaacatggtggcctcaggttctttatggccccacggtctcttcctgcacccctccccaaggggctgggttggtagatattcctaatgttatatcccctgttgttgacacccccatgcccccaatcccgcatgcctagcagatgcaccttaacccaaccactctgggtcagttccttcctcacacagcaagctgctaagaaggttgaagaattactggacttcagataccacatggcaccattatccctggcaggtttcctgtcactgcctgtttctttttcttccaggaggctcatcaaacaggcctccacacaaacagaacatccatccacttcacaggccacccagacgtatccagagatgcccagatgagacctgatttgcctgggttaaccgtgtgtctgcagctcagaccctccaatggggcttctagctacatagtctaatgatgaaaagctactggcctgggatttaagagcacagctttctagcctaactccacaactgtgcccctgggaattttagtctcctctctgcatttcaacttcaccaactaaataagtaccttttaatatctaattgaattgatatgctatataagcaaaccagatgttgtgagtaaaaccagcttcagcatccaaaagttgatacagatacttttgaggagcatgtttcaacatattccttaggacagccttactatgagaaggtcatctctcagtgatttcaatgtgccattggaagaagagcttctgccatttaaatgtccagttaggcactggtggacacagcagtatccttcccattcattccgaccatattattttgaatcataaaggcatatccttagaggagaacatttaaaaaatttaataatgtatttgtttcattaacatgaagttaagactttaagataagggtagtgcccacaacacaatcttttaaaatgaagccaagttaacagtcattactctgtgatctcaggcatgcccattatctctctgagctataacttcctcatggatgatcactagtctcctgccgctgtgaacttttacaaatctgattccatagtacacatcttaagtgttagaaatgcttgttctttggtgctgtaaagaaatagaccttgaacataaatttaatttcctcagcaagaccatttttactttctgcagaaagggtacacttgccagcagttttgccacaagagtacacggaacaaaggagacagggtcattataacctgacgcgtccaccctactgctatgtccagtttccattggctggaatgggacctcacattctgtatttgtcccgaatggctagcagcttagaactttttaaaagcagcaaaagcagaagagaacaaaggaaggaggaagtaacttgtgaaatgctgagaaaggtaaaaaaccttcaaataaggaagaggaacaggctatgacctaatgcttgcttggaccagtataagcatgctagggtaaatatttaggctaaattgtgggagctaagaacataaagtacattgatttctttattacagctagcagatatttaagaatgttagcacaggtctttgaataaattttgcttctaagagaaagtactattaattcctaattagatggggaggaaaatctttgaagaggaacctctactttactttttacattaaggaaatagggtgtctagtaatgccctcaaaagttatgaatgcccggtatccgttaggtttgaactaactgatcttcacattactttaaaaatagagatgactcaattattggttggctgtgagtaaaaccaaataaagctttatttaaagttttatttagattcttgaaaaaattatttaacttgggttctccttggtatgattaatttagagagaaaggaatctgagaatgctgttgacctcatcattccttcacatgttccacttttttagtctctcattttaacttaatgaaggaaagtcatagggagaaaaaagagagagaaaagaagataaggctgtgaagagagagggttgttttaagacctcacgttgaacaatcagctaaatctgcattgaaagcaagagaaatagctcaaacacaggtttatagtattttctttctgagagtgaacattgtgcagtaaaaggtccttcacatgctatggttcatacactggcatttcatgaagcagtagggagcagagttaaccccaccaagagcactgcagtgcggccttccttcccagcccccgttccagcacctctttccatttcccgacttttctttcaccgccagtaaatttaatgtcttcagctgagcactgatttcatgagcgtaaaggacattagcagtacttcgcacatggtatgcacaaatattaggcaagtccaaggacaggatgagctgcaagcagtctatgataagagtcaaaggcaggagttggggttgtagactcctccagccaaccacagcaaccaggaatttggatgcttcggccgccagagtgcttgcaagagttcatctctgaaatcgcttccattccagcgctaacattttatgaaacctgtgcttttcaaacagattgttttattgcttcctgcatcaccaatgtgttttctctttgctcccagctccctgagagcattttgaattatagcacagatcattgccatccacaaggtgcatgacatcacagtggacttgggggaagcaatgtcaaatgagactgagtggaatgggaaggagataggctggaaaatttaaataaaggtctttaggataaaatacagaatccagaatagttcctaactctcactacgtagtcgtttgtagcaaactgctaggactcttggcttttattggtgtgatatagatgcgctgctccttaatggtagagactgtgtctttaatcaaaagttggctacagagttgtttgtgcctgtgatatacttattagtccagagcagatatattttctgtcgtgtgtgctgaggagcactgatgtaaatccacttaatgttcatatcaaactctattctccaggaaaaggtgagggactgaaatgtacatacttgttggctggtcacatttgatattcagagacccaaatgagaaagtcttgcttctgagaaagtacccaaacaccaggacatcttccaagccccacacagtagcattaatgttttaggtgtgcaataaatagtgctgaatgaaggaagaaagtttcccaggctagaaacaggtgagtggagacgtgattattattaatacaaaatctggtgtgaggtgggggtgggaccctctccccaggctgtaccgacagccccttgctctcagtcggactcccaggctgagatccggccactaaagagggaacagtgacatttcacaggaaatgacccagaaaactaacaacgtggagtgtgtgtgcgtgtgtgcgcgcgcgcgagtgcgcgtgcatgtgcgtatggtgcacatgtggtgggggctggggacagcttgaatacaacccagggaccttaactggaggaaagactttaccaggcagactctggtaaaagtcgagcaggaagctgagcgtgacaggaaccccaagggtgtcaaaatgccccctcactcagcatctcttgagtcccatcaggacagaacttgtgcttagtcaggttctggacctgacagatgtgaaccagacgccctctcattgctgggggctctgggagggaaaggtgggatgaagagggcacattcctcccaaaggacaaagcaccttttagtggaaaatgtgaaaacaaaacatgctcagttcaaacaaggctcactttggtccagtacttcctttgttatgttcctgcctcttaaatctttctgctttaaagaactctccaagaaaatattttcagagtatacttttcagaggccctgtggaagccaagaataaatggcctccttttttgggtaaagagtcatatgtttaagatagttttatttgctccccccacctcctgccccgcatgcacacacgttgatatggttaactatcttctgctctgaatcagtattaagaatgggcacagagatgactaaaagccagaatttaccatattatcccacaaagcagtaacttttcaattttaggatacataatttcagcatttttcctatcactagatgtttagagctccctccagtgtctctatattgtcatatttactttgagatttttttttttcccaaagatcctaagaattcttttaaccatagcagggagagtatgttattgtctttaagcttacttcaagaacagaacgtgaaagccagaaatatcacatgcagccccacaacctatagattgtccattcctgctgtctgtgctttttttcaggatgaggagagttttggaggtagaagaagatgaagtggtcagaggatgggactcaggaggggacagggtaataaatatggtatgaaagttgctgcatttaaagagcttagggccgggcgccatggctcacgcctgtaatcctagcacttttggaggccaaggtgtgaggatcacttgagctcaagagttcgagaccagcctggccaatgtggcgaaaccccatctctactaaaaatacaaaaattagtcaggtgtattggcatgcatctgtagtcccaactacttaaggggctgaagcaggagaattgcttgaacccagaaggtcaaggctgaagtgagctgagattacaccactgcactccaacctgagtgacaaagtgagaccctgtcttaaaaaatttttttttaaagagcttgaataacttcctcttcttagaaaacgcataaactctgatgtgtcagctgagaagccgaggacctgggatttcaacctcttgcccgtgtgtttgtgattctggcgtgaaggtgatgatgcatttccaaagttgaacttggtctgctaggtttgggatgtggcagaattctggttcctgccagagtcccagtctttctgagtgtatgtgtgtgtacatgtgtgtgcatgtgtgacgtatgtatttatatccatacatacatacacgtgcacatctacatgtgtatgtatatataatcaagatgttcaaaattcaaagcgctgttttaagagagttaaaaaaaattcactatctacagatttgaattcagactgggttaaaaccaccttcctcctctggttgtcaagaggaaggttttggagttcgtgaattttttctgtggagttaagataacgtttgatgtaggagagcaaagctgcttcccatgcctaattccataaaaagcccagaacctctgaggcccatcttcagccaagcagccttgccctctggccttttctgcaacagtgagacaacagccctgggcacagcgggagttggttctgacaccagatgttctctgctcctggttaatgtcagtgagggctggaagttgaataaatgagaacaggagtggtctgggcccatgtaaatgatcctcccttgaaaggaggaacagctttcatcatttgttccagctaagccttgcatgcattatagatctggtgctaagcagtgggaaagatctcataagtaatgttttatgttctttctgtctctcctcttctgttgttcttggcttgtgggttgtgttcgtgttgttaactggaaaattgctataagccagttgtctcgtaagttttaaaaacgaattagaaaaaccataaaatcctctggcctatgcacattgtccctgttttgtgaaaacattaaagggtaaataaaaaggaaggagaacagtcaataatgtgcatcaaatatattctgagttctagagaaattaatgaccaagcattagaactagaagcaaaaaaaaaaaaaaaaaaaaaaaaaaaaaaaaaaaaaactgtcagtggttggcgagaagtcttgttttttccagccatatagatcaactgatgatatggtttggctgtgtccctgcccagatttcatcttgacctcccatgtgtgtgggagggacctggtgggaggtattgaatcatggggggcaggtctttcccatgctgttctcgtggtaatggataagtctcacgagatctgatggttttaaaaagaggcattcccctgcataagctctctctcattttttgcctgccaccatccatgtaagatgtgacttgctcctccttgccttccaccatgattgagaggcttcctcagccatgtggaactgtaagtccaattaaacctctttcttttgtaaattgctcagtctcgggtatgtctttatcaacagcataaaaatggactaatacgactggtggttgagaaaatgtagcagcctgagatttaagaaacaagtgatccctgagacagagcccttgaccctaaaggggaaaaatattcagttacactcatgagatataaacatagtacttttgttgtaactgctgagaactgaagagctaaaagtcaacattattttcctttttgagactcaaagtgtgtccaccaggagcactcttcccaatggaggcaaaatctgccaaagttgtttttgttgctgtctaaccttagaccatttcatctgccccaactaaaagtcctagccacagctctctcaagcgattctccaccctcagcctctgagtagctgggactgcaggcacatgtaccacacccagctattttttttaaatttttaaattatgttttttagagtcaagggtctcaccttgtttctccggctgatcttgacctcctggtgtcaagtgatcctcctgcctcagcttcccaaaacaccaggattacaggtgtgagcctggtcccccaggcttgacttggcacattgaatcttttatgaagaacaattaatgacttcccatgttgtgtaaagagacgggcaaatgtggcttcaaagcaagtcttgccaaccctcgctacaaccagactgtccctggcctaagcaagcccctcccatgtagacctggaaagccacttccaggtttcaaggatgagttttagaaaattaatggggtactagcatatgtgggtcaactctttattttaatgtaaggacactggacactttaaaataagttttctaatctttttaaaaaggaagggatattttaacatccccaaagtgaaaataatataatatcagagtaagtcctagaaatttaatattatggtacatttactatgttgtctttatttttcttcatttccacggattggccctggttctcagaccagcatgtgggaactactgggttggagtgttagccaataaaaatggccaaaaagtagaccatgaccttctttgagcttttctctggcttgtaattcccgaagctccttctagtgccaaaatacttctccctccctccctcttttagactgtaagctcattgagaacaaggacaatatggtaatcttaatatctttagcacacagtcagatatgaaagagacacatcataaatattggattaacaaatgaatgttctgaaggggaatgtggttgttgccactgtagaaaaggttcaggaaccaggaattcttgtgtaagatgtcatccacatagtcactggagaattccacagttgggttgagggcaaataggaatgccatgatccaggtacctagaactggcttgaaaacttgtaccttgcaacaataaatggaagccaatggccatgtggtctggccatggccacgtggtcagaagagaaggaattttcgaatgaggatagaggaagtagccacggagccctgaacaggggcttgggaggttgagctctctccacctcagagggctgtaggagaaacagggctgtctgcagggagccaaggttacagtctgggttggagagaatgttctgaggaaaggctgaagcaagaagagagctactttttactagattactgtgtattcagagggcagagtggaaataattaatactgagtgaatagaaggacagacagacctaaggataggtgagagaggtctgtctggtgcttctgaaagtttcaagtgtctaggaagcccccagcgttctagtggaaatgcacattctggttctgtcagtctgggtgggacctgagattctgcatttcccacatgctccctagtgatgctgatgctgctgggctgtgggccatggtgaggctagcgtttaggtcaaggaaacaagcatcttcagaggatgtcctccaggagcccaggcaacagttagaaggtcaatggaaaattctctggctgcagctgatcttttctgcttccctttagagcagggaatctcaacagcactgttgacatttggggcccagatcatcctatttggggaagcagggagatggagggggtggaggtgtcccgtgcattgggagaaatttagcagcattcctggcctctatgcgctggatgctggtagcacccggcagttgtgacaatcaaaaatgtcctcagacacttccaggtgtcccttgcagagcaaaattgcttccggttgagagccagagggttagaaggagaattatgtgtcttccctccccgcttgctgccacctccacctcttgtcttctagaaccatgaggcagaaatgacttaagtctgatatgcttggaacgcaacactcttttcgctatttctgtctttagaaatgttgagaaagtgtttgcctttatttgacggcctgattactttaaggtgtcctcggcatagaccagtgagcgccttggccctatttgctgacagttttaatagaacagcagggaaagtcctttccaagaaagtgttggctacgtagcctaacgtcattttaagtcatcaccatacacccaccaaacctctgagataaaatggaaactccatcatctcttgccagggtaatggtgttagtaattcactagtgacctctaagaatttctctgtgcattcactgccacatttaacttttgttacacggcctccaaaatgttttccagccacaaggtcagtccattgacaatctcaaaaatcctgacaaggggacagatgggtttagtttttgcctttgtgatggttagttctgcttaatgtgttgagaaaacatctgaaggttttaaccctggctggagtcgtgagacggaggcatgtttaatggaatagcacacgatcgtcctctcatggtgagtccacgttggagggcccaaagacccatgttgtacaatcggttcaactttttctgaaagccaaagaaaacctacctccaaacaggatttagtctcaagctagagcaaaaatgtacatcatgttgaaaagtcttctccaagtgctacaattcataagcagtgttgtgtttttactggaaaagcttgccatctagccaagcattcttcacatttttcccaggatttagtcataaaatcattttagacatattgcaaggataaaatgtgtacatatctgataaaaggcagggatttttttcttcttttttgctgtataactcctggaggaggcgaaaaacaaactagacacacacatacacactcacaaaacacacgtatttgtgcatatgtatgtgtatatagagagtgcacacatgttcatatatatacgtgtatatgtgtatgtatatagtttgttttccccctcatgaaatgtgtgtgtgtgtaaaataaactctatacacatatacatatatattattttcaccattaagtgcaagaacttggattctttattcacgattacttctatttgaatttaaattagatgccttaggcttctctttgggtttgaataacttagacacaaagtataaaacacttcctaatgatgcccacctgcctaggacatctttaggaattcaggtggaagtgtgtttgcatttgatttatctaagacgttgcagcagtggggatgtaatttctgcctttgggcaggaagggagcttagatggtggagttcgtatttgtaaacgtagatgtgggtgcctcaaagttggctgcgttgctaactaaaggaaggagagaagtgagcccagatgttgaccttttgaaaaaaaagtcccattttcatgacagattggcataaaagcaataacctgtggtaaagtctaaagaatacaagatttggatttctggatttgagtcctgtctatgcaacttactagatatgtggccttggacagatcacctaatctcacctgtcaaacagggacaatgaaactcaacatagcaatggttgcgaggagttaatgaggtaatccgtcaaattctgtggccgtggtgaaggatgatacaaatatccagtggcgtttttgttcttgaagatagtattcttgtgtgagttcttgccaacacacatacaattacatttctgagtcagactgatttcagtagcagataaacagagggagtaaatcagcaatagattagttggaaactctggacagcaatgatttggtggcatatggcttggtggtatgtacctgcacatgtaatcatggaaagttgactattcctactgttctcccctagttctatttcacttaagaaaaagttggaatggataccagcagtgtgctgataaaagtttagctactactggcggccgggcacagtggcactttgagaggctgaggcaggcagatcacctgaggtcaggagtttgagaccagcctggccaacatagtgaaaccccatctctactaaaaatataaatactagccgggcatggtggtgggcacctgtaattccagctactcgggaggctgaagcaggagaatcacttggaggtggaggttgcagtgagccaagatcgtgccattgcactccagcctggatgacagaacgagacttcatctcaaaaaaacaaaaaacaaaaaaacaaaaaacaaaacaaaaagtttagctactggctcgggaataacaggacgtttgatttgtagcatttactgatttctgtaatataaatactctcactgtgactaatttcaaactaccaatgtgacattaccaaccatgagattgtaaagagatgcacagtagcacaccaccatataggacagtcgtgcatcacttaataatgggaatgcattctgagaaatgcatccttacatcgtccttctgcaaatatcataaagtgtgttcacccaagcctagatggtacagcctgctacacatctaagctatataatgcagcctgttgctcctaggatacaaacttggacatagggttacgattgcctacagcactcagcaccttactgtactgaatactgtaggcacttgtaacacaatgttcctaaacatagtttttgtgcatctagacatagaataggtacagtaaaaatgaagtagaaaagattttaaaagggcacacctatatagggcacttaccatgaatggagcttgcaggactggaagttgctctgggtgagtcagtgagtgggtggtgagtgaatgtgaaggcctaggacatcactgtatcactgtaccccactgtagactttataaggactgtacacttaggctacactaagtttgttttttaaattgttctttctttgataataaattaaccacgctcagcttacttttttactttataaactttttaatttttaaaaactttttgataactttcataatagcactcagtttaaaatacaaacacattttacagctgtacaagaatattttctttctttatatctttattctataagcttgtttttgtagaaactaagtctcactatgttgcccaggctggtttcgcgcacccgggctcaagccatcctcctgcctcagcctcccaaaatgctgggattacaggtgtacaccaccacatccagtttataagctttttcttattaaaaaaagttttttttttttaagttttctgttaaaaactaagacacaaacacatacattagcctagccccacacagggtcatgatggtcagtatcactgtcttctacctccttatcttttccatctgtaaggtcttcagaggcaataccatgaatggagccatcatctgcgatgataacaatgccttcttcttgaacacctccagagggacctgcctgaggctgtttacagttaattggcttttttttttttttttttttttttttgagacggagtctcgctctgtcaccaggctggagtgcagtggcacaatctcagctcactgcaacctccgactccctggttcaagtgattcttctgcctcagccacccgaagagctgagattacaggcacgtgccactatgcccagctaatttttgtatttttagtagagatgggtttcaccatgttggccaggatggtctcgatctcctgacctcgtgatctgcccaccttggcctcccaaagtgctgggattacaggcatgagccactgcgcccggcctacagttaatttcttataggtagaaagagtccactctcaaataacaataaaaagtatagtatcgtaaatacacaaaccagtaacatagtcatttattttcactatcaactattatgtactgtgcgtaattgcatgtgctatacttttataggactggcactgcaggacgtttatatataccagcatcaccacaaacatatgagtaatgtattacactattacattggacagctacagcatcagtaggcagtagaaaattttcagctccattataatcttatgtgaccgctgtcacatatgcaatccgcggctgacccaaatgttgttatgtggtgcatgactttatatccactatacaagtagatgtaattaacctcagtcatacagataatagtaaaatagagtaaaatgagggatgatgatgagtttttgtttttgttcttgtttttttttttttttttttttgagacggagtttcgctcttgttggccaggctggaatgcaatggcgcaatcttggctcaccgcaacctccacctcccgggttcaagtgattctcctgcctcagcctcctgagtagtgtgattacaggcatgagccaccatgcccagctaattttgtatttttagtagagacgggatttctccatgttggtccgactggtctcgaactccccgatctcgggtgatccgcctcgcctcaggagtttttaatataatttattaaaccataagtttatataagttaatttttaacattggctatgttgaacgcttggctgtcaagcttaactgttagctctcacagacctggctccaacatgctactgtttctccttggctgtgttacagtacaaagttataccatgaattagcaagttcaggaccatcctggaaagccagcgtggaaaatgcagtcataaatggatttttatttctgtggactttggactggctgtctactcttggtctcacattctctactgcatatctctttggctaagaaaattagtattgaaaaatggtttatggatctagttattggagctagtattcaactttttagttacttaaaagataggacttaaacagagctgaattttatagggtcttttattttcttctttggtccttaagagaagactgcagaaaactagacaagaggaatttgaatgttctcataacaaagaactgataaaggtttgaagtgaaaaatatgctaattaccgtgaattgatcattacacaatatatacatgtattgaaacatcatactctagcccataaatataagaaattatcagatgtcaattaacaatggaataaaatgaaattaaattttaaaatgaaaacattctagaaaatattcccaagaagagatttatttatttatttttctggctatctatccttaagggttcgggaaaaaatggccggtggagaacaaaagattgaaattttagctcattcatgatgcacgtgaccgggaaggagtgttaagatgtcctgtacttccttccataatcacaggttgaggtgagggttgcctaaagtctgatcagccacattttgacagtggagactcagaggcctagttaggaacacagaaggaaaaatgttaaaggcagacctttataaccaaaacaatcaacaggtctaaaagccaaagaaaccagtatttcagaattgttaacttactcctagatgtgtgttaggcatcgggcttatcttaaagaagtgtcttagaccacagaaacatagacccatgatatttggaccaagcataggttaaaactaggggagggaggcacgaattacaaaaaaaaaaaaaaaaaggtgattccatgttagaatcccatgttgaaaaggtattacactttattgtaatacagacaagatttcactgtgttggccagactggtcttgaactcctgacctcgtgatcctcccaccttggcctcccaaagtgctgggattacaggtgtgagccactgcgtctggcctaaaaagcatattttaaaattagtcacatatggaagctaagtagtgcattttgtgtttccgaacaggacttaaaacgtcagtgccataaacactggtatgtattcagacacactggtcatatgtcatgaatttggtagacatatttgtaggcaaataatgtagagatagagtcacatattttaaactaaacaactcactatgaaccatcatgatggttcacacctacaattccaacactttggaaggccaaggtaggaagatcacttgaggtcaggaattcaagaccggcctgggcaaaaaagcaaaactcctctctacaaaaaaatttaaaaattagccgggtatggttgtacatctctgtagtcttagctactcaggaggctgatgtgggaggattgcttgagcccaggagtttgaggctgcagtgagctatggatgtaacccagaaagaccctgtctctaaaaaaaataaatatatacaataaaataaaaataaattaaaaatttaaaaagccactgtgattcttctctgtgatcattcgtaagtcatacactattttgtgtgggtgaaacatgtgatctgttagtgggtctgagaaaatcatatttattaagcaaaaaagtcaatatgtgcttgtgttttgcttatgaatttactcgaataaaatgtctgaaggtcttgaaacttcttaaaagaaaatggttcttacttcattttggtgtgtttacattaaggggagccatgtgacctcttatgagagttactgtcaaatttcaagtgcatgggcattgcctggaggacttgttcaaacacagattgctggaaagcccaagaatttgcatttgtaacaagtttacaggtgatcatgatgccgctttccctgggtgactcactttgagaaccactgtcttgtgagtttagagataaagaatggttgaggtcgtgtgcgatggctcatgcctctagtcctagcactttgggaggccaaagcgggtggatcacctgaggtcaggagttcgagaccagcctgcctaacatgatgaaaccctgtctctactaaaaatacaaaaattagccaggtgtggtggcgggcgcctgtaatcccagctactcaggaggctgaggcaggagaatcgcttgaacctagaaggcggaggttgcagggagccaagattacaccgcttcactccaacctgggctatagagcaaaactccatctcaaaaaaaaaaaagaatgggttggaaaaaatgtctgcacatcagtaagcacaaaataaccattgataaatagcattacaagcatccaggatcctaacaggaggggagaaaatcaggccactttagaaacacttttatgactggcagttatccagtttgctactaaggtcaggtctaaaagattgttaagactagcctgtttctgtatccatgggtatcagctggggaagccaagttctgtctttgtgcttggcagccctccccaatgccatgtctctgctgatgacattggaatttcctccaaattaaacagcctgacagcagccatctgtaaagaaggcagcaaggttacgagtgatcactggctagtgccatttctgctgccaaccaggcaggcaaagcttctggcatgttcttgaccacctctgagaagagttgatgtttcctttggggtatcatagagtttctgccacccagctctgtttctctgcctcctggtgcctgcccctaattattgcatagttgtcactgatcctggtaacctgactgctggatttttgctccagaaacctacagtaaaggagaccgtaggccaccagaagccaggaggaaacatcaggctgcagtcaagggcactgccttctcccctccaggctgctgggctttgagggcagagaaataaaaagactgaaagggattagaggcctggagtccacaacaaagccctgtagtcatccaccaccttgcacagcctcttcctgccatgcttacaggtgaaaagtctagttcataggacacattgcttttccagaaccttccgctgccttccagagccagcattcttcctgaaaactctctcttgccagttgtttgccttcagagttacagtttaaaaaccaacacttaaactgatatcctctgaagaaaaaaacagataacaaattcatgaatcatagttatacttaaatttcctccgtcacagagaaacatgttatttttagaaagtggatcccaaacctaactgatcagaatcccttgggggaaatgtttttaaaaaataccattacctgtgcactggcccagaaaatccagggccattagagactgcaaatgtctgagaatctgtgtttcctaaaaggcacaatggtgattctgatgggcagccatgtttgagaacctctgattgaattgtgcacaattttgatggtgctgctgttgcattataggtaattcaaagaagagcttcttttttttaaaaaaaaatagtaatctataaatataatagttttcatctgaatagtgttttcttgttttcagaagaccttcataactttttttttttttttttttttttgagatggagtcttgctgtgtcacccaggctggagtgcagtgacgcaatctcggctcactgcaacctccgcctcccaggttcatgtgattctcctgcctcagcctcctgattagctgggattacagacgtgtgctcctacgcccagctaattttttatatttttagtagagatggggtttatccatgttgtccaggctgatctcaaactcccaacctcagatggttcacctgcctcggcctcccaaagtggtgggattacaggcgtgagccaccacgcctggccataactattatctttgacaattttcctgggaggtggatgacaggacctgttactgacgccagtttacatctgagatgctgcagtggagaggaattggaactagaaccgacacttacggcttcttgtctggtgtactctctgctgttccatcttcattgcttgtgtgcatgcgtgtgtgtgtgtgtgtgtgtgtgtgtgatgtgtttatttgactccttgaatctatgttgtcttgtttttcgtaaatggattaacgccactaccacggatcatcagggagatatgacgctagagatagataagccaaatggaggtagaaaatccaaactgaaaacagggagagaagctaagatagacccaaggagtctaacaacccaagttctaaactagagagaaggccactgttcatctatttcagggatgggcagttatggaaatagtatgaactcaggcatcccaaaggcagtgcagtgtatgagagaaagatgcttgcatgcatactcccagcaaagctctcagtggggcccaagatgcagggcatggagggtaataaagattagccaggaaggtgataggacaacagatactgaaaacatggcaatgaaaaaacatcagcattcagaggtgagaattaccattgccagaagttcttgggaagtaaaacaagtacagagctatgggtcaaggatctcacagttagagtactagtagcagtagggtggacttgagtctgtagtttgggaccagctgctaacttaaagcctgggaagctcgtgttagccagacattacagatactttttatgtcaccttgaacaagcttcactatccttatatttaaaataaggagtaggcctattaataatctgtatgtatttcttgcagtaaggaaatctaattttgggaaatgaatagcaagaacatagcttggtgcagtgagtcagtgagaggatttacaaaaggtgaacgtacacaggactcttaatactgatcctgggctagtcatgtcattgcacatgacacctgctgttggaaggaacaggttaagcatttagttgtgtgcaatgaacctgtgagccctgtgggctggtcccacttatttgaaatagaacgattgcagtgcctatgtgagtcagggtacacctgaatgtttagttagtgctttccattaacccttttcaattttgcttctatgttttcttttcctccagaaggaaaatgagcagaaggtgtgtcacatgctcgctttttatctgctgcgtagttcttgtagtgaaaggattgtcgataagttcagaaaccaagactactgctgcctccccttcattcattcagtagtcttacagcctaaagaagacaagaaaattaaggactctcaaggcaaaaggaagtcaaatgaaattgggaagtgggtctacagtaaatgcaatatctgtcgctttcttttagaactgcataaaccacatggaaattttccgtgtatatttgctaccaagggatgctatcatctttttctttccttttttttttttctttttttttggagatggagtctcgctctgtcactcaggctggagtgcagtggcgccatctccactcactacaacctccgcctcccgggttcaagcgattctcctgcctcagcctcccgagtagctgagatgacaggcgcgtgccaccacgcccggctaatttttgtacttttagtacagacgaggtttcaccatgttggtcaggctggtctctcgaactcctcacctcgtgatctgcccgccttggcctcccaaagtgctgggattacaggcgtgagccaccacgccgggccactatcatctttttaatttaggcacatagtgctcaggaaaagacaaggatgatggatggtaattaagtaaatgaagacagcattggtcaggagggcagtataaacaaagtaaaatagaaagtctcttgttctattttttttaaataatgataattatatatttcttacagtcatatccagagcttacttgaatctaaagcagtatttatctttgcagcaagcctatgaattagctttacagactgtaggatgcagagacccttggattagaaaagttcagtaacccatgagcagaggcatgagaatgttaaaacaagtcactaaaggtcacatagcattccactagctgggctgtggttagcactcatgacctcctggggtctcatcttttctgaatcttattgaatcatgccagctttctgatatggtccataaaatgctgatagaaatcacatgtgaagttcccaactgtgaggacagcagacttcctttagaagataaatactagacctaatctaatacactttatttgacgtagcagaatttctcctgcatccttatttcaaaagcatacctgcctgtggtcttcccgggtcttaggagagtccatatgtctgatggaagcagacaatctagtgctactcagagaaaccaccacttgatcctcagtttttttgaggaatttcatgtgtttttatgtgaagaatcactctcaggaaagttctgtattttggtagcagagatcctgtcaagaaggcagtgagatagatacacataataagctgttcatcattactgctgatggaactcttcccaggcctgcagctgacagcattgcatgggacctgcagcccctttcaccgtgactgcagattctttggttaagagactgtcagtggtcaaggctctgccccggcttctcgggatcttcacactcccctgtgcatagtaggctttgggttattggccatcatgaaaaccaagattgtcgtttaatgatcacatctatggacttggggtcggaggaacctggattcacatcttggctcctccactgactggtaagttgcttagattagttgcttttttcctctctggctgaatttatgcaattgggagttttaaaaagtatccactaaattcattgttgttgttgttaagatttagttgtgtattgtacactacctggcatgtagtggatgtttggtcaatggtaactattaaaattattgcagatatcctcaggtattatatttttgacaggagatatctgatagcctgattcgatattttatgtggaaggaagaattaaatacagaagaaccctaagacaatgctatctgttctagagagtgtttcgttaaagttgcagtgtttcataacgaagcaggcaggacggccctctgctatgcagagctctcccgctcatgacaacacaacaagcactcccggttcatccctacctactcatcccaacaatgtttccaagttgttttaaggattcagaatggccccactccttttcagatgtccctgggagggtaacccctgccttgtttgagaatcacgagcaagcatagtctgagtttgacttctgtacccaagtagcagggcaccacctccctctcagtggctgatggagaggtcttccacagtgaactttcagtgaagaagttcatgtctctctacattatctgttttactcagcattcagagatatgtggtgcctccacaggggccatatccaggctttctgatgaccctatagggagcaatggcaatttaatgaggaggggaaaagatcagcttaacctagcttctacttcatccgggttctcatggttagttgagagtgctgatccgtgaccaccattgagtcattgatctcccgctcttcctagtcaatctgtcattcagagatttgcttgatcccttgtgccagatgcatgtatttaacaagctaacatgcactaagcatctgctatgtgtcaggtactattagacgcatcatactacaatgactaagacacagtccttgtcctcaaagaaatagtagccctgggagtaaaaatgatataggggaggctgggcacggtagttcacgcctgtaatcctagcactttgggaggctgaggcaggcagattgcttgagcccaggagtttgagaccagcctgggcaacatagtgaaaccccgtctcctttaaaaataatcaaaatatttttaaaaagtgatttgaaggagtaacatcctgttcatgttcagaggcattcagcctatgagcccaaggagttacgctcatttctctctatgtacatcttttagtcctaatatgcgtttcttcatttcttttatttttgttaccattatactctttacacaaggtccttcaccagagacctgttatcagtgtcagagacccagccctggtggccttgtgcagcagatcagaataactcaaggagctcccacatttgctctcctgactttctagaggcacacgatatccacatatgttaatgtattggttttatcataggtttctccttgcatttctttcatgtaaaagtgttaagagttcagtctgatctgaaagcaaaagtttaagttctcagcataactattcttacaatcttgtgcctttgcaaatatgttaaaatgttctcagccccctccagtcctgaactccccatttttttatggttaacgcgctgtcaccactacccagcagactacaaagcagcagcaagtgcaatgcagagaacgcgatgtagatcttgttcaaagcagctgacatgttgtcatctcaggaagggcagaatggcaaggaggagtgattgatggaaacttgatggagcaaccttcacttaattatttttgcatagattcctgaattgtggcttctttgctggaaaaaataataatgatcctgtaatgcagactgctttagaggctggaatgtgtcatcgtatgtgaggattaccacttgctcttttagaaccccaagcatctatctctacctagaaattttttatcgtgaagactaatagccttaagggtgaaggagaggacagagaccctaacccagagtaagataggaatgattaggaatgattgttggtgataatcagatgaacacactgtagccctgtatcaggagagaaaatgtgtttgagattagcacgttatcagaaaaatgtttgcacttatcttattctttgaataagttgcaagctatttctcttctttcacaaaggcaaagtagtaagccaaacctgtaatcagaaaaatattgatatgttagatagagaaagttatttttgtgtgtttgtttcagttgttgaatcaactggtatgtatcgagtacctactgcatgtagggggattgtagagaactttcagcgtcaagttagagattttaaactttatcctagaagtaaaacgagaaattaaggcactgagttagaaaggagctagaccatgatttctcccatatctcttgtgcaaatggcactagccaagccagaagcccctatgctgttcctccatgtgcccctgcccagccattcagcagccttggtgctgagtctgcctgggacatctcccctgtccgcctcctcttctccatgcttactgcccctgcagcaggccaaacctgatgacagctcagtggcattgcagcaagttcctcccgactgtttgccttgcctgtagaacctggtcccttctcatccatcttctactctatgaccagagtgacatttttaatcaaaaaatgttcctgcctaacccttctgagattctccataccttcaagagatatcttggggagagaagggcactcgttacctccttcctcccctcctggcatgccatacttgtgcttccctgaatgtggcatgtccccttatgtgactctgcatgagctccctcctctgtctagacaatgttccctctcacatcacatgcagtcacacattcctgtgtactcttcaaaactcaaccctgccatcagctccaaggagcccaccctaacttttccctcctggtctcactgagccactctgtgcttcccacccatgaaactcatatgtaagatttttagtgtctgttctcttgaccatctctgcacactggatacagatgtattagtctcttctcacattgctatgagaactacctgagactggataatgtgtaaagaaaagaggtttaattggctcatgtttccacaggctgtacaggaaacatggctggggaggcctcaggaaacttacaatcatggcagaaggagaaggggaagccagcacgtcctacgtggctggagcaggaggaagggaaaggggaggtgctacacacttttaaacaaccagatctcatgagaactcactatcatgagaacagagagggagaaatctaagcccgtgatccagtcatctcccaccaggcccttcctccaaacactggggattacaatttgacatgagatttgggtggggacacaaatgccaaccatatcaatggagctccttgagaacaggaactgtgtcttttagatcttctgttttatatgtctgatgcatagtaggcagttggtgatcactcatttggtgaatgaagtgttaggctgaactgaagtgggaatgaatatgaagagataccacacacctgcattccttgctatctgtgccatttgttccatctcatatctcatggtcacaccagtctgagcaaggtcagatactctttttagagaaccttctgtggccttattccatgttcagttgtttaatcacgattacctttatttttgtattggtccatgtcctgagtattttttaaagcattgactgttgtggatccatggagaagtcagagaaaacagatgaagctctctgataggaaaaaggattgaataatcttgccatccaaactgtggtatcaaaatatgactatatatgttgcaatcaggtgcatgcgtttcttggctttcctggatgtgcaaaatagaattcaagacagggtacagagagaacacattctacataccccacataaccttggcatgactgtttggaccttgctggtaagaagtggcattggctagtcttttgttcacaggctggcaaggttgctcctgattttctctttacacggataattcctttactgaccaaatctcatgagagcaaagtgaagtatcctgtagctggcactacattcatgaccttttctatgacaggttaatcatttctttgtgtgttcactcactgacctttacttcattggccaaaggagtgccccatgtcaaagtaatgtcctcgttcctccattccatcatccctttggggcagaaaagatgctgtcttacccgtttttgtccccagactagctgggtgcctggtgtgtagatgttaaatgaataaattgtttaggcaaagccgttagtagcatgatctaatgaccacaaacagaaaagtgtgtgtggtggggaagggcaacttatattttaagaattgtgttttaataagtggtgaattatttcagtataaatccagtattatcattaataatagataaatatattgagcatttaccataagcaccatattctatcgcctctcccattacgtgaaagactaagttttatagtttgaaaagaaggaaaataggaaatatataactacatttaatattatagcataaagggctcaagtggaatgatgctggtatgacagagtattcccaacagtcctcccagttctttttacattaatataaaatgttccatgaattaaagaaaaatatagcaagtcataaacatttacaattctctttcctcaccatctaaggaggacaagttctgtgcttatttagcttgctattccttgtgaggtcagaaaggtcaatgattaaacttagattaggccaaattcctccttaagagaagatatggtgcggggtagggagtggggaacataagaacagccattatagggacctgtaagagaggagggcgagatgggaggaagagcaatcgtcctgggaaaagggaacttgggacagagaggagtaacaaggctttcagggagtctttctgagcatggtgccatgctccctactccccacttccaccctccccactccccccctcccattcacctctgccatccaggccttcccaggaacacttggccaagacttgcaagtttatttattttttttttagctcatcagctgtcattagtgatagtgtcttttatgtgcagcccaagacaatttttctccttccagtgtggcccagggaagccaaaagattggacacccctgctctagatgtgagtcttggatgaccacccttcactctacctaggctacagtaacagacgttgaaagtcagcatcttcattgttatggaggaatggaaatgggataaactattttaaaacaattttggatttaaaaaaatagtttaaatattcctgttctctcaccccacccacccctaacttctttgcattattaattttcttagctaatcttatttctaaaaaagcaaaaccttccaagggaattctttttcttttctttagggagagagtctcactcttgtcacccaggctggagagcactggcacgatcatagctcactgcatcctcaaacttctgggcccaagtgatgcttccacctcagcctcccaagttgctgggactataagtgcacaccaccgtacctgggtatttttttttttttttgagatggaatctcgctctgttgcccaggctggagtgcagtagtgtgatcccagctcactgcaagctccgcctcccaggttcacaccattctcctgcctggctatttttttaagcttcttgtatagatggggtcttgctatgttgcccaggctggtcttaaactcctggcctcaagggatcctcctgccttggcctcccaaagtgctgagattagagccataagccaccaggcctggcccaaatgaattattaatttgttttgggtagaattactaatagccaattactagttagtggaacttcaatttgggatgtttttatctatttgaataaactttcattctgtataactccatgtctaaatctataaatgtagacatacatcagtatagaaacgtcagtggctcttagattgggtactttaataataactctccatgactgaccactggggacttctcaaggagcaggagaagtatctaccaaacgtagatacctgagaaatagtggagtctgctgtaatgttcactgtggataacctgactggcagagttgtcccttctggaagagaggcagctcaggtcactgtgtaaggcacctgtcttaacttgcaatgggaattttgcagtcaggtgaggggcacaatatatgtgaagaggaagtgaatgttgttgatagcatcacatcataattaaattccagccactggatgatgaagtcattccttcacacacaaacggcattatatgcctgtaatatttttccagggctgccattacaaagtgccagaaactgggtgacttaacagacattgagtgtctcacagctggggggcctggaagtcagagatcaaggtgtgggcagggccatgctccctgtgaagatgctcgggaaggatctgttccaggtcactccctagcttctggtggctccttagcatgtggctctgtcactccagtcctcacagagcactctgcctgtgtgcctgagtccacatttccccctttttttttcatgatggagtcttgctctgtcacccaggctggggtgcagtggtgcgatctcacttactgcaacctctgcctcccaggttcaagagattctcctccctcattctcccgagtagctggaattataggcgcccgccaccacgccaggctaatttttgtaatagtagagacagggtttcaccatgttggctagactggtctcgaactcctgacctcatgatccgcctgcctcgacctcccaaagtgctgggattacaggcgtgagccaccgcgcccagcccacatttccccttttcacaaggacaccagttctgtcagattaggaacccctctcctccaggatgacctcatcttaactaattatatctgcaacaaccctatttccaagtaagttcacattcagaggtattaggggtcaggatgtcaatatataaatttggagggacagaattcagcccataacaatgcctgccagtggtagttttttgggggtcagggtgagtctagtatctgcattttcaacagcatgcctttttggggagatgagtgtcaagcattcactgatttgaggtaacggggccctcttgagtctgtgatgtaatctcacactcccctaagagctatttatggcctacaagcctgtgcacatttgaatgcgcgtgtgcagaaaagacaatgagccagacaggcttctacacccacttaagagcactcacatggatcagtcacccaccctgaatgccacgttagttttgacatctgaaatgtgtctggcattttcaggcagagaaggcttttaaaaaaaaaaaaaagtcacatggatgccagttccttactatctccctaaaagagcctaaacacagaaatccagacacaggaactcacaagaatattagataataaatagccaagcttctgaagaggcctggaaccagagaatgatatttaagggttattaagcttaattttttgcactgtggtctgcctggcatatagtagacactcactgaaagtttgtgaacagatgactaggagagtctctgttccgtgggtatgaatcttaaagatgcatgtattcagccccttctcctggcttctgttctaagcagagggaatctgatgccttgtttctgcgcatctgtgatctgggcagattacagatgtcacaagccagtgatgtacacctggattgcatcctgaccaaaatcagggaagtacccgctggcatgttgaggacctcctttgaagaaaatcctgtggctaaaccaattcattgcccttgggagagaaacattctatagcctgctgggtggatgtgtacagtccatgtggacccacctaagtttcctattttgttccttctttcttgttttcctttccttcctcttttcttactttttaagccacttattgagtttatcctttcaaaactcatcttgaggatatgttcaaaaatgacccatctagagcttcctgtacacttctttgcagagtgagttgctgctgacttatttctccttccagcgtcttgctgatgcctctgtagagtcatttattacctgcgtaagagtgacctctacacgtgcctggttcccaacaagacatggagtctcaactgaattttactcatctctgtttccctaatacctagtgcagtacctggttagcacttcctggatgttcagtgtatggttattgaatgaatgaatgaataagctgttactttctgcttgcatagcactgttctagagtgtcatggaggacacaaaggaatagaattgatagtaggtcattcttcagttgcgttgcatcacaagggtaaaacgtgtacttattcaaaataagtggcataataataacttcttaaaatttttattttatttttccgtaagttattgggatacaggtggtatttggttacataagttctttagtggcgatttgtgagattttggtgcacccatcacctgagcagtatacactgcaccatatttgcagtcttttatccctctccccactcccactcttccccctaagtgcccaaagtccgctgtatcattcttatgcctttgcatcctcatagcttagctctcacatatcagtgagaacatatgatgtttggttttccattcttgagttacttcacttagaataatagtctccaatctcatccaggtcactgcaaatgctgttaattcattcctttttatggctgagtagtattccatcatatatatgtaccacagttcctttatccactcaattgatgggcatttgggttggttccatgattttgcaattgtgaattgtgctgctataaacatgcgtgtgcaagtatctttttcgaataatgacttattttcctctgggtagatacccagtagtgggcttgctgaatcggcatcataataacttaataagtcaagaggaggtctgggcactgtgctcatgcctatactcccagcattttgggaagctgaggtgggaggactgcttgaacccaggagtttgagaccagcctgggaaatatagtgagactttgtctttacaaaaaagttaaaaaattagccaggggtggtggtgtgcacctgtagtcccagctactcaggaggctgaggtgggaggatatttcagccagggcagtcaaggctgcggtgagccgtgattgcaccactgcactccagcctcggtgacagagtgagaccctgtctctaaataaataaataaataaataaataaataaataaataaagtcaagagaggggcccagtggtgtaatggaagagcactgttcatagaatctgtagatttgttttctagtcctggctccacaagttacatattctgtgctcctgggaacttcccttaacctacatgagcctgagtttactgatctaaaaagtgggcctaacgcctatctgaaagaattactggggatattaagggtataatgtatattataaagtgcttggtaagtcatagcatggtatctaaatctaaggtatgttgcttttatgacacaaggcagtatctgagttaggacagaccaggggagtggtacaatcagttaatgttctgagttgctgggtaggagttagcaagtaaggcacgtgcaagaattagaacttggccagagctttgaagaataaggccacctggcatagacaaagggaagcagtgtggcctgagtacctgcacacaggttgtggtgggccaggaggatatgaacgagccccatggctgccatagagggctggtggtgcccgagatggccctccttgccatgaagtaggcagaaggcgcttagagctctagtttcccaaatggagctcaattgcttgtcatattacatacacgtgctgttatgtgtgatgatgctctgttctaaccctgaaagacctggtggagccttagcaaatcactggccattctcccaaacactgcgtgtgcttatgctatgccgccatagttttacaagcatttttcagcgtttatgcaaatgctgcccttctgtctttggtaactgctttgctcatctttcaggattcagcttacatcttgtcttctctgtgccacattcctgtcagcagccacctcacaccacccgctcctgtgcacacaggcgtacagagatagtcttgttcctctctgctcttagagcaccattcagctacccccagtggagcactaatcccagtgagctgtgatggtttcttggtgtctgtctccccgcgagaccatgggctcttggtgaacagcggctgtagcctgttcagctctgaccctccggaccctcatataacctgtatgacccatgaaggtgcacagcaatgggaaggatgagggaagaagaaggatcttttcaaactctgtacattcttcacacagaaaagcaggctcatatcagctgacttgttctcccaggcagagaacaagagtgtgccacattcactccagttgaatggtttcaaacttttcttcctttgaggtggatgtatttttggcttttggcagtgtcttagtccatttggactgctaagcaaaataccgtaaacttataaacaacagaaatacatttctcacagtgctggtggctgggaagtccaagatcaaggtgccagcagcttcaggatttggtgaggtttgatttttttggttcatagatgacaccttcttggtgtgtcctcacatggtggaaggagcaaggtcgctctctggggtcccttatagatgggcactaatcccatatatgagggatactgaaagtaaattgatggaagtgctcgtgtgaatgaatgaatgaatgaaaccattttgaagctagattgctaggttcctgcaggttatatctttgtatactccttacctttcaagaatgtctgcagctctctgcatacaataacttccttgagtatatataactacagtatgacaaggcttttaaattgaacaattctaaagactgtttttttgagtccaaaaagtagaatttggtatcaacattaggtttaaaagaagtgatttcagagtttgtcaactattcaagtgtcagaaaaaaataatgtaaatgatgtgcttaagacatttatttttgtattctcgattctcctgaaataaagggaaattgtcttgaaaagctgtagattttaaatgaaaaggaaagcgggaaggtgacataatttgcctctgcctttgcagaaattcaagtgtatatggcctctctccaatccaccattttcccacctccacaggccccatgtcagctgtttccttcatatcattgcaatgctttgagggtgattgttggtttaagctacagtcccttcaaatttgtgaaagactaaacagattgataacaactccacctagattaaatgaaattctgtgggtagacaggctagtcaaaatacaatccccacacaccccaagtgagcattgcttctcctttcagatatgctgtgggtacaaagaaaggatttagtccaaagtgccttggggttttgttcagtccagagtgtaatttttttctctcttttgcctatagccatttctgtaacattactgaaagggcttttttcctaatgaagcatgaaaattgatcgtatcttgccaggagagttcttcctaagtcttaagatattaaagatttcatgagaaccgcatgaagaatatcttcttgaatcatttacatttttcccttttgtaggcttatgtaaccatgcagaaaatctaataataagtgtgctattagtgtaccatgtgccatcccgcaggcagctgtgccatggggcaccagtgcccagggcttgtggatagcattaacctgtacaactttctaaagtaaagcccagtgggaaatctgtaggtaattgaacagatagtccatttttatcagacttccccctgccccttccctgttctgtcttttctcttttcttgtgccagaaggaaacaccttggccataggcctttcattcacaatggagtatattttccaaagcaaatagcttggactatttcaattcccagagcaatctaggtgggcacacagagctaaatttgggtttgaaagaactcttaaattagtatcataggaaggcaatgagcaggaaaaaaaaaaataaagatacaagcattgtggtctgatggaaattatccagcactcacttacaaatgacaagtgggtaccacccagcctttctcatgttccaaaatttaataaagggttccatctaggtcccccagaaactactgtgattatcagggtgagagaagggggaatgatgaatttttgtaatgccccaatctttgtaaccaggcatagaaggacattcgctgggctcaggatgggtgttagcatgtagtggataaaggaattgcagagttgttgacagctgtttcctcagagacacttgtcctgatgatatttgctttggattctaagtaacagagctgtagttcttaaagtttaaattgaaaaaaaggagttttctgtcaagtggcttagtcatggaaatcagtgaagttaagcttgggcaataatatatccttttcaaatccaggtgccttcctgatcatgccagagcttttgtgactcctttctccttggtgttcttcttttgatgcggcgatagggtctgaacacgtccaggctgtctttgctgggagagggcagaatgcctcggctttcttcagccttgcctttcttcattgtcttcaccctgcagcacttctgcaaagctgctggggtaggtgggtgagtgggcgtcttttctttgctagcccaagctgagttctgaagggaagttagcagggctcagctgctgccgcaaagtcagtcagaccaattctcatttgcatgcctacagaattagacatattcaggggctcgggttaatgccataccctcctcttgtccttggaaaactgtaagaatgcgtgcaggtaactctgcagcaattctgtgttgctcagatgtatttctcttctttcagaattcctccttctatagcattcccctaatatttatgtgctggggctttcttctttcatcccaggccccagcttcgctctatatcagacagaggtgggagctgctgatcaagggggcacacttgccatccaaacctcacgatgctcacaggtgtcctttcaaccctgctaacccagatgatacatcaccatttatacctttggaggcattttctctttaattgatgctcacttagacctaagattgttcattaaagtccagaggtgctcattaaaatgaacattggatagtgtggtagatgcaggttatcattatgaatccaagaaagggctctgtggaacttgttatatacggcatttataggttgttaaattaaaggattagtgttgtgctaaaccattttcaggttaatcagttgtgggaaaccagatctaatgttaaagcaggcttaaactatggtttttatagtagggaagtttttaagctactgttatttctaataaaccctctagcttgctaatcgagcatacttttcaatttttgcacttaactgaatatggtcttgttccctaatttttttatgtgtgggctttatttcttcaagctggattgtaagttcctttttagcagggtctatgtcttttttttttttttttttgctcatatcctaaaagcttctggtataattcgaggtatatagcagatgctaaggattttattgagtgattactacatttttagagtgtcattacaatgtattatcacctggtttatgccgtggtgctttatgtaacatgtgcctatttacagaacattgatataacatgttggtctgcaaccaggttgttatcagcaataggaaaagcattacagagttcatatggaagtagaggagaaacaggtctaatttgggtgtgatgccctgtattagtctgttttcatgctgctaataaagacatacccaagcctaggtaatttataaagaaaaagaggtttaatggactcacagttccacgtggctggggaggcttcacaatcatggtggaaggcaaaaggcatgtcttacatggcagcaggcaagagaaaatgagaggcaatcaaaaggggaaacctcttataaaacaatcagatctcgtgagacttattcactaccacgagaacagtatgggggaaactgcccccattattcagttgtctcccagcaggtccctcctacaatatgtgggaattgtgggagctacgattcaggatgacacttgggtggggacacagccaaactatatcatgccctaacctgatcagatatggcttccagactggcccctggagtggcctgaataccttcaccaagacacgtgtgtgggacagatcaaaagtttccatctgccatttgtctttcacttggtaactgctaatgattgcttgttaaccatacacattaatatgcccgtgaagcagatagaaaataaaataagtaaaaaattgtataagtggaaaaactaagacccaaacaagaaattatggatcatttctaaatggtggccaggacgtttatacggagaaaccataccattgaaccataatcaatgtaagaatacaactgatggtttcagactttcaggaatagaatgagtctcaggcagacatgttctcaggcaacatggcctgggacatccccagaaacctcctccatggagttaacaggacacctacatggccctatgtgtccctccacttgggcctcttgttcaacctcgtatcacatgtccccttcctaccacataaacttctgtctctacattctctactctaccacaggttcatttatttgtttgtttgtttgtttgtttgtttgtttgtttatttatttatttatttattttgatacagtgtctcactttgctgtccagctggagtgcagtgtgcaatcacagctccctatagcctctgtctcccaggctcaagtgatcctcctgcctcagcctccctagtagcaaggactatagacatgtgccaccacgcccagctaatttttaccttttttttgtagagatgagttctcactgggttgcccaggctggtctcaaactcctgggctcaagtgatccttctgcctcagactcccaaagagcttggattacagacatgagccactgtgcccagcccacagtcatgttttaaagtgtctgagctataaatactactataaaggtgtcaactggttgtatatgtgggcccttggcatttcagaaatgacagttattgccaaccattaccaaatggaatccattttatccaaatgggcatggttggggctgagcatgggatggagtaatgcagtcttattgcatttcagtgttagagggctttcactcggtttgcagtttctccacagctcacccaccaattctacctgtgtacttcttttctgttccctctcaacttcttttccattctctccttcctcttgtttctgtccatatctctggcttcttttaatttcccttttcccttctttcttattggtctggccctgggtctggtgagaccaagggcacagaaggatactggctccatgccaacctttcctccaaggcacaatctccttcttggcatttactgagatgttcaacttcctgtgtttctaatattccttcctgttttataaaagaaaaatagattggatttgcaaagtgccttaatttgttgattttctaaaaagcaattttaaaaatgtgtatcaacaatatcacatacatgtaactgatttattgactctggcttgccctgggtttaatcacacataaagaaattttacaataacacatgatccagtagagaaagaagtcaaagaaatatgtaaagtcctgtgacctctgtagacatttgggattaaaccaaattaaaacacctgtatgggctgggcatggtggctcatgcctgtaattccagcactttgggaggctaaggcaggaggatcacttgagcccaggattttgagaccagcctaggtaccatagcaagacccaatctctactgaaaaaaataaaaataaaaataaaaataaaaataaaaataaataaccaggcatagtggcatgcctgtagtcccagctactcaggaagctgagatgggaggatcacttgagccagcagtttgagactgcagtgagctatgattgcaccactgcactctagatgcaacagagcaagaccctgtctcggctcaaaaaaaagaaaacacttgtatcaattcaggtcaaatattggtttcttttttttaagagcagattaacatcttgcatatcttttgctatcacatttcttcttatctgaccagctgaaatggaactagtgttaaatacaaataataaaacctgtaaagatcctaagtttttgcatggtacaataaatcctcactcattcacatgcttggagaaagtccagtctgattcaattaatgaaaagcaaaaaaaaaaaaaaattgtaactacataatttttatctcatgtattagctcctatttagttcacataagtgttcaaataggtactcatttttaattaacaaaatatttgtgtgtagtgagtatttttaaaccaattaaaacagttccttcttgtaagtaaattaagtgctattcttagacgatggtatgcatcattcatttgctttgcaaaccattctttcacaccattctagttggtgtgaaagcaaattgagcccatctctactggaatttattgcattctcttaatttctgacactctatgctcccaatagtagggactccatcttagccaccacgacatcccaggcatggctcctagaataatttcagctctttaagactcaattaatatttgctcactgattaatatttagctccattaatttatgtgtccaaattccttaccatttgccaagtgcttttggattttacagttagttacaaactgtagtttaaggtttttctggctttacttcattcttcctttaactagctttaaaaaactagtttataattctagttacaatacaatgttaagtgaaagaactgattcaaaattatatattcagaattattctaactttgtaaacatgcatagatatatgtgagctttaaaaaagaaaattatatatatatgccaaaatacaatcaaaatgtaaatagtggatatatcatgttggagatattaggagcagttttatattttttaagttttctgtgtttccacatatgatcacactttatttttatatcagaaaaaagctatcttagttgtgcattgtacattagaaatattagttttgaagataacctaaacacaagtttttatttcttctgtcacagttgcctcttttcttaaaatcgtgtttgccagtttctttcacgacactgcaaacaattttagtagcttcagttctttgataaatctgtagcttttagatctttgattactattagcaaagaaaagatagacccaaatgaaaaacagttgcatttttgaaatatgtccggcgggggttgatgtggaaagaacaattcctctcaactccagggtcaaagcagcagccctgccaggctctgtcggggtcgcctggagaacatcacttaactttctacatcagttcctgcttctggacattataacattcatgatatccacctcatgcaggattcctgggaggagcagatcagatcataatgtgtgtgaaggggctttgaacgacagtcaccacattattaccaccataagcattatttccatttcaaaaatggtagaggagggaagatgcagatgttctctttatgttggctcggcaccaggcacgtccaggttgtgctgctttaccctccagcatgaagagttagaaggtaaatatcgatattgcttttcataactaatagcttcatagttcatgtcaggtgatttcttggcttccgttagcatttcagagaccattatacacagcagccatcctctgcagagctggagaaaactcatttttcaaggcaaatagtcccaagtcagggttcagtcctggtggaatgaaataaagaaggagagtttatctttaaggtaagctagcatttaagtagatgttggatattatcagagatgcttatgaggggcagagagcattgaagacttataccctttgcacatctttaaatgcctgtaagtgcttaccaggagccaagagcgaacgggtggctgcgtgcaaatgctagaggttaacccctgtccatgggcatttaccgcatgagtaaaaatttattgcagagttcaggactgtgattctgctgctcatttctgtagcgtatttctttatctgaaaggatgcccattgtcctttctagctttttgggccataaccgtgagggaaggcccaaaggaagaacctctgttggagatcaggtttattcatccatgtgggtggaggtacgaaggagggaagaacctctgttggatatcgggtttctttgtctgtgtgggttggagactagtagaataggggaaaccacatactgcccattcctccaggatcattttccatttggatatttagaaagcaacaagagaggagttttagaagacaaggtagatgatttcaagttactttaacatagaggaagaaagtttccttctatttttaatggctagtgcatgatttgtgggagtgaagattgggagggggcacggacgaacaccaggaagaggcggttaatttattggtccccattaattgaatttaataagtgagttttgtcagtttagcaatatccattagtttcagagagtgtttcagtattattctgtaaaagcatccagggatatattttacagctacagcatagattatcttgcacacatattgaagtaaagatacctttcaacattccagatactgacttttcacccaaatttgaaaatctccatttagcactttctaaaataccagtgaaaattaatatagttttgtagatttatgtactaagatgcagattaagacatgtggaatctaatgaacatagcaggaaaagaaaattttctcaagtctgttcattactattcctcatcacattttttattatttaatagcttattccttgaatatgtgtgacttgggattagatgtgccagttggaagacctcagaggttcagaaattcacagacatgtgaaatataaaaccgtattcatttagcagatactgataggcatataaaatagaaccttcatcatctatctttagaaaaagaagattaaacagaagtgtaattaatttgccaactctgcttcccgattgagacatttatcaaagttgatctttaatcattagtttcctaatctgtaaaatgaagtctattatgacctctaaggtctatttgtaacagttaggattaggttcagttccatatcaccaaaaaaaaaaaaaaaaaaaaaaaagaagaagaagtcaagccaaagaaatagacatttatttttctctcacataaaagtggttttgagaggtaagcagtccagggtgattatggtcactgcacaggctcagaaacattgtcacctttctattctgccatgctgtagtatatttcttttcttttctttctttttttttttgagacagattcttgctctgtctcccaggctggagtgcagtggcatgatttcagctcactgcaacctcttcctcttgggttcgagcaattgtcctgcctcaggctcccgagtaactgggactacaggtgcgcaccaacatgtctggctaatttttatgtattttttagtagagacagggtttcacatgttggccaagctggtctcgaactcctgacctcaagtgatgcacccgcctcagcctatgtctcacatacaagatggctgcatagctctagcctttaacattaccattccagaaagcagaaaggaggaagagacgaaggacctaccccctttccaaagacacttgccagaggaaccataccacatttttgtttacttcatgtcaacaagaatttagtctaggcatacctagctgcaaggctaggcataccttcttgcaagtctaggcataccttcttgcaaggcaagaagaagatcaggtcattcagttgggcagcaatgtgtctacctcaaaaccaaggtttctacttctaaggaaaagaaggaaagtgggatattggggtaagcaacaattatccacaggttttgagctcaaaaagccgtgatcgcatgtttctgggaaaatttgacctatacaatcgagtctgaatgtgtgctgggtgtgtacaaatcagacaacttcaactgtgagccttcattagctctcccctttatctagacttaggattgtatttccaggcataggtcagaatctttacactgattgtgtgtgtgtctgtatgtgtgtgtgtgtgtgtgtgtgtgagagagagagagagagagagagagagagaaacagaatcttggctgcaagatgtgctgaatataaacacaataacttagcaatttataactgcccctttcccatctctgccccctccccagtatcagcatacgcagtgttacccccacactatcaatatgtcaatgattaatagcaactggcaaatgtgtgctttccatgagacttgtatgcaaggttactcgggttcacagaggctgctaataacagcagcactattgaattatgctatgtgtctgtgtctgttaagacaggtcggaggacaggggaggaaacttcccccagggtaattgagagacaaagtcactaaaagctacagatctccagtttgggctctatgcatgagattgttcttaaaagtcaaagaaatataaaaggaaattgcacatttgtaatttttttaagttccccatttcatagctcattaaaaccaggactttaatattctgggtcagaacccccattggatatttttgtgaacatgtaacatgtgggttgattagaggtttgggcctgtttttttctttttctttttttttttttttcagacagagtctcactctgtcacccaggctggagtgtagtggtgtagtctcggctcactgcaacctccacctcccgggttcaagtgattctcctgtctcagcctcccgagtagctgggattacaggtgcccgccatcatgcccggctaatttttgtatttttaatagagaaggggtttcaatatgttggctagtctggtctccaacacctgacctcaagtgatccacctgcctcggcctcccaaagtgctgggattacaggcatgagccaccgtgcccagcctggcctattttatttcatgcatatatagtttaagtgtctctgagattcttgatcaactaacaaaatccaagaggcccttttgttatattctaaattcattcctgcttctgattgttgcaaaggggtcagcggatagggtgccagagccagaagttagctaggtggcaggttctgaattaatgtggtattctgggtaatataatgtcatttcctagggaactgccagcatctagctgacctccaagaggacaagtggtcaggaaggtggagatagtattagaactgttattattgttgttgtttttaacaagcagacctgtcatgaaacttgccatagaggtccccttttccatatatcaccaaagcctcataggtaagaaaaggtaaacatccaagattgtttctttaaagattgctgttgggcagaccaagatttagccacaaaaataaacataatctctgatgctgagaagagatcagaatgagttgaaacacaggggaaaaaagaagtaagcagaaaaaaattttacaatagtagatatggggattagatagatagacggctatatagatatataggactctgaatagacccattacaggcaggcatgtaagtggaaatgattaatatatagatgtagacacaggtaattctatataaatgtggaagagcagcaggaagtttctacagctgggaaggaaaaggtaattttttaaaaatgaggtcattacaggttgtttgggtccaggcagattcccattgtcctccctaaacactgcttgtaaacagttttgggactgaatgcaccctttgactgtagtctatgctttacattgactagaactgacaaacagatgaaaagtaaaataatgtttctagagattttctatttggttatgtcatttttttccatggacacatctggctaaagccaaggggtgttaagcccccaaatgtcatttgaatgttcttacagtatgaagaagaggaagaagaaacactttgaaaaccaataattcggccaggcgcagtggctcaatgcctgtaatcccagcactttgggaggccaatgtgggtggatcacctgaggtcaggagttcgagaccagcctggccaacatggtgaaaccccatctctactaaaaatacaaaaagttaggcaggcgtggtgatgcgtgcctgcagtcccagctactcaggaggctgaggcagaagaatcacttgaacttgggaggcagaggttgcagtaagccaaggttgcaccactgcactccagcctgggcaacagagtgagactttgtctcaataagaaaaaaaagaaaaccggtaattctgttttggaactccttgctctgctatggcacatgtatacatatgtaacaaacgtgcacattgtgcatatgtaccctagaacttaaagtgtaataaaatatatatatatatgaaaaaagaaaaagaaaacaacagtgctgattgaggtgtcacacttttgctggttgtctctcctgggtatacctctagcttatcaccgccattctgggaagacaggagcaactgccttttagctgtagtcaccactcatttccctgttagccccttgtggactggaagctccttgaaggagacaaggcaccaagtcacattttacttcatatcccaccaccatgatgtgcctggcacgtaaatgttgaataatctgaacgagtggatccctgaacagtttaataaaatggggtttaaggagactgtgacattcatgaatagcatcacatccaggcttatttctatggctttctattgggctcaatgcctgggtccctggcacatgagaaacaagtatccttgagcagtaggggaaccataccttattcttaccacctcaaaatatctagaactggctgggtgcggtggctcatgcctgtaatcccagcacattgggaggctgaggcgggcagatcacgaggtcaggagatcgagaccatcctggctaacacagtgaaaccctatctctactaaaaatacaaaaaattagccaggcgtggtggcgggtgcctgtagtcccagatactcgggaggctgaggcaggagaatggtgtgaacgtggaggcggagcttgcagtgagctgagatcgcgccactgcactccagcctggcgacagaacgagcctccatctccaaaaaaaaaaaatctagaacctcagcatgaagccatttttaaaatggtgccctatacttagtcaaattcaggcaattcagtttggggaattattttctgtaaatgaggtgctctgaatcagagttctgactccagctttactggctgcctaagtgccatggtttagtgtaatgaaaatacagtggggggtccttaaggcatcattcagggtctacctttaagcgactccagctcttgaacttaatgaactggacactttcaagttctgaacatggtaaataaaagccagcacctgctgccaaaataccttgtctcataatcaaaatcatttctagagccagcggaacatggattccctgagaaattcccactgactcagcaattttaggttgggattttattttagagtcacttaacgaaaagatttcacctagtggcatggccccaatatttatcaggtaactctggccccatctcagcagactgactgattcaatcatcttaccctttactggggatgaaacgaaatgcttactaactcactcctgaccccacctgccactccaagtcattccagcaaacaaatccgtaatagattgctgagagggggaagataggtgaaattggagaatacactaaaaatcaactagttttaaacggtacgggtgggagccatgccccctctgtactggtccactttataaatcccagagggaactcattctatgcttgaaggaaaactttgccttgttctttggttagattgtgctgaacagatcaattcatgtcaaagagcatcaacttttcttatttatgccatggcttccataccacatcacactttatttactcttagtggaaccttgaatcaatgatcaattttgttttgtccttcagtggagtatcagacaccaggacaacctggtcagcaaatattctgaagtcctcagcagttattactagacaggatattagcatatggcacatcatggaattaatttatgtaacacatacttagcatgcacctatcaaatatgtatcaggcacagtgccacggccttaggatggagaagaaaaaacatagttcttgctctcagagagcttagatctagaagttgatagatgctgttttccaagtttctccacttgtatttctgaaactgtgaacagccaactgacatgtagtaagcaatcatttttccagaaaaagtctgttggggtgaaataacatgataagggatctgagaaaagtaggcagggtagggatggcaatggggaagattccgttataaaggaacagcatacatatagattatatcgctgtatatttgtgtctgtgaagcacctcatttaattagatggtatcatggcaactagaagagtgcttacttaaatgagcggctccatgcaaagccctagcagactgaaagtgctttgtaggtattagctgttattattcctactgctcatcactaatatgtagtaggcactccataaaggtttgcgacatgagtgggtgggagatttagtgctgaaatgtaaacctatacataaactgaatatcacatctatatgaatagagaaccttttacagtacaagcaagagcaagatgttcacattatattctgcaaagaatgatctgaacacttaaacttacaggctccgaaagtgtctctctgcccaacatccctatccatttaaatagaaatggcagtagcagcttcctggtgctgctggtgggaagagccgtggtaaggtgtctcctttctttcactccggagcgggggtgatgacaggagagggaccgggcgggagcgaagtgatgatggtgataatgggggtaactgctgagagcgggagggtgggggccaggaacaggaggagtgtgagcgtgagaagacagtgctcagaagccgacacccaggtgacttctctggaatctccctgctctgaaatgggtaacgtggctcctttctctgaagctccaacacttaaaggagcttcttgttttaagcttcttgtgttaagctccagatttttacaagcatctcttcagagcctggtctccaaagccatccgtccagtcagatcaagagctacttgccctgtttctccatagtcacgaactggttaatgtgaggggaaggcaagaatggtctccatcgtcacgggtttctgccttggtttgaagcaagctccagcagttacatgaacaccagttacggaatgtctacagttatgacaagacacagcagggctgacccggctcacccagcaagggaacaaaggccatccacacgtcagacccagcaattcaggtgaaggaacacacagaacctcctagttcgctggatgaggagtcccccaatttcaccagataatcacacaacatgttttcatatggccacatgcccacagcctcaagaaggtgaagcattttcagagaatgattcctgacactacagaaacattgaccatttagaatcagaagaccctcagtcaaggctggcctcacaggaaaatcaaatgtaatgattcccataatgagttcaagccagacaactgaattatgcatctgacattaaaacaactgggggattgtaggaggaggagaagtttgggaagagagaggacagtgtaatcttctgggagtaaaatttattactgaacattaaaaaaagatctgcaagttaagttgagagtcattttgtttatactcgaaatgctacaatgtcctttgatttgtttatgcaagttttaggggacaagttacgtttttttagcatataatctacatttattcccaaaacactgctcctgagacaatccatcagatatttcctcaaggctgtggaaaaggggataaaaggcatatttttaaaggtgggcgtgtatgtgcaaaacatgtttgttttaaagagatctgaatgctgtagaaataattagccatgtgcgtgaacgaaaataatgaataccaaatggtacaatgtcctgcttgaatcctgtttcagaaacagaatgtgaaggaaacattacgttctctcatccctctcttttctctttcacccttgttacccctgaattttgtaataatcactattacccttttggctatgaatttaatgtctctatatatagagccacacccctaacacagattcttcttgcctctcagagacagttaaatgtctttgggtattgcactacttattctccataggggctcagacatattcactattgagcattttcattagctaaaataaattaaatgtatgtcgtaaatgtgcagcaacactgaagaagctgcgagctacatcttgtccttgggagtcatttacttagaataagtaaagactttctcacttgctagtttcaggcgtcttaccttgtgttattccttacaaatggacagggctgttctagaacccacttcctgaatacagggaaagaccccagtggtgtattgggataatggagacagacaggtctgaatgtgaggtgtggacgtgggcttgtgtgtgtgttttctccactggatttcttcaaacctaaagttgctggatcacatttctaacaacaatttgcctgaccttataggatctcctttctcactgaatatgttacgattagaggaactaagattggctaaaggacttttggaatgagccctggacttaaaaacccgttgaagagggagcaaacaagaggaacagtgttttccaagaggcttacttctcttaaattgaaatatagtcatgttccctggctctgagggcactttctcagagcccatatgtttattcaagcatttgcttcgtgatgtgggaggctcagccagtgtaatcccaggcatgagatgttcaaatgctgaatatgttattcaagcacattatttcccattgacatatgtaaatttaaaaataaaataataatgcaaatttacatattgaatcttgggaatggaaaacacatttccgatgtcactgggtatatctgttcccctactttaaaataggactatagagctgttctctttgaagtcatctctgaccatacagtttaatccagtgggcattaattcagattctgggttagtgtcttgtagaagctctccggtgcttctaatattcagcagatattgagaacccatggtctaatccaatggccattcttagtctttctgtttctctgctgcatttaatataattgatgtcttaattttcttctgtcttttttatttttattttttacgtccataggttttgggggaacaggtggtgtttggttacatgaataagttcttcggtggtgatttctgagattttcggtgcagccatcacccgagcactatacactgtacccattttgtagtcatttatccctcacccccctcccaccctttctcccaagtccccaaagtccactgtatcattgtgaggcctttgcatcctcatggcttggctcccacttatgcgtgagaacatactgttataggatctctggggtgtcaatttttctgatgggaaacttctgtggccgcaacgccttttaagcccaagtttttgtcctgcgtccagaaagaatgaggtacacagacatgtgaagggtgaaaaagaagagttttatttagtgttagaacaactcggaggagtggggagctcctctctataagcagatcgtcccattgagtgttcagctctcagcagagaggaggccctggaaagggtggctcctctctgcaggcaagtcattctgcaggtctctgaagcactcctcttagcagagagggtagctcctctctgccagcaggtcatctctgcagctggttgtcccatcgtctccagctatcagcagagagggtactcctctctgcaactggtcatccagtcccattctctctctgccccctttgtccctggccatcctcctgcctgctgtggctaagcccagggcttttatggacctcagaggggaggaagtatgtgccaattggtccatgggtggccatgggtggacggaagaggcaccacgagtccccactctggtcggcaggactggcagcccggcccccagccttcaggccctccctcgcctgaaggtggggcctaattggggactcccctcttttctgccccggaccctgtcttcctcctgctgccattcatggccccggggcttggccccaacccagctctgagatctgagtgggtgcctggaacggagagaggccaggcagtgggcgcagacacatctgagcatgcagagatggggagggtccttcctggggcgcccaagggtgcaggctgcagagacgcccaggtcctgtgcctgggagggttggccacagctgcacccgggagctcccgccctgacaactcggaaggggcagggctcccgcttgttcctggctcctgcctgcttcctggaatgggaggcccaggtctgcagccgtgggtgcggcagctgcagctgcacctgggaaggcagatcctgcctgttccaggctcccccaagagcacagggagactcggatctacagctgcagtttgggtggctgtggccccaagagggcggggctcctgcttgctctgtggagcaggaggcctgggtctgcagctgcagttcaggtggctgcagtggcacgcggagctcccatcccaactcggaatgaacagggctgccaccagctccatggagtatgcagcaccagccgcgcagccagcttgatggcagcagccactgccatcattacggtgttcagttttccattcctgagttacttcacttagaataatggtatccagttccaaacaggttgctgtgaatgctattattttgttcctttttatggctgagtagtattctgtgatatatacatacaataatttatccactcattgattgatgggcatttgggctggttccatatttctgcaattgcgaattgtgctgctgtaaacatgcatgtgcaagtatctttttcataagacgtctcctctgggtagatacccagtagtgggattgttggatcaaatggtagttctactttaagttctttaaggaatctccacactgttttccatagtggttgtattagtctacattcccaccagcaatgtaaaagtgttcccgtttcaccacatccccatcaatatctatcattttttttattatggccatttttgcatcttcgcccttcttgactacttttcctctctctaaccaaaattatggtaggtgtttgctcttcttgccttttgattgcctttcttggatatttctcccagtgtcagcttccctcccgggtactggtgctgcttctgtcaccccgttcccttacctactcttggtcctttcaggagagttcctgtatgtttatcttagagccacgtaaagctaaatgggtcttactatctttattaacgagctttattatctgcccctcctctagcttagcactctgtccattctgtgtatcttattgcagttgtacctttcctattcccacctgagagctcccactcctttggttcaacccagcttccatcaatcattcctcgagccttgccaattttttgtctctcttccatgtttattgtcgctacctgagtctagaccctctgggaactgagctgattggattgcagtcttctgcacggggagccatggtgtagagtggaaagtgtaatggatgtggagttagaaagatcaaattctggactcggttaagcatttaattaaaatgtcttggccaggcatggtggctcacacctgtaatcccagcactttgggaggccgatgtgggtggatcatttgaggtcaggagtttgagaccagcctgaccaacatggtgaaatctcgcctctaccaaaaatacaaaaattagccgggcatggtggcgggcacctgtagtcccagctactcaggaggctgaggcagaagaaccgcttgaacccgggaggcagaggttgcagtgagccggggtcacgccactgcactccagcctgggtgacagagtgagactgcgtctcaaaaagcaaaaaaaaataaaataaaataaataaaataaaataaaataaaataaaaaataataaaataaaaataaaaatgtctcaaacccataggaccttagtagtgcatatttgtctctaggcctgtttcgccacctataaaataagctgcattttataaatggaataactataaatgaatataaatcgatgtggaatttgcataaattccatatagatttgggtttcttggccttatgctgaaaccagcatttgagactgttggtgaaaagaatataaagaggtggtgtggtgtacatattactgtccgtattatggtctgattgtcaccacagtcctccatattagctttttatatgacccctgctttcccaatctagatctccagaatttttttggtgttttttgaatataatcaaaagtttgttttgctcaagattcatcttcctaaaaatgtttgacaaatgcctaatttgaaaattagtttgctgtcttcaagcttctcttaggaaagaaacgtggtccaaaagaagtttgtctagtatgcagggatttttaaaaactggataacccagggtggtctgcataagttatatgcttttcccccaaagaatttcaaacggctttcctggtatcatttgtccttatgtttctttagttccaggacagttcatactgttcttggcagcttacaaaatgagaaactgaggtattgtaattcagtctacttcccttccaaggaaaattgaaaaacactgtggggaaaatactaacaattatgtgagcctcaactttagattctgaaaaatttattcatggaaagcaaaaattcattactattcccataacattgccaacagcaaagagattatattcagaattaaatacagccctgttccatttcttctttgctttgaaactcagtgtgagacagcagtggaaccttttctgacttaaggccaaattaggtcaaaaacctttgctttgaaccttctgagtcatagaataagcagggaggaggaagaaaatccgtgacctgtgccacgattttttactgaggttttgtgcaaagagtgccgtgggcaggaaatgtaggaagaagagaggacatcacttcttcagtgtttccctgtatgtccagagataggaaattcagacatttgctttatttgctaaacttcacagatgtgagcaagaggaatattagaggcaatgtgtctaaattacttacttcgatgtaatgacttcagagctctcaggaggagaatggtcgcggggaaggaacgagcccaaccaatggcatgcccagagtcagcccttcatctgcagttttaagaagtggtggttggagcaagacgtgtttgcagttacaggaataagcaggagagggcagctcaagttgcccatcaaaagggtgggtgaggggctgggcgtggtgcctcacgcctgtaatcccagcactttgggaggccaaggcgggtggatcacctgaggtcaggaattcaagaccagccttgccaatacggtgaaaccccgtctctactaaaaatagaaaaaaattagccgggcgtggtggcgcatgcctataatcccagctactcaggaggctgaggcaggagaattgtttgaacctgggaggcagaggttgcagtgagccgagatcgtgccacttcacaccggcctgggcgacagagcgagactccgtctcaaaaaagaaaaaaaaaaaagggtgggtgagtattcctgcaggaaggggaagattgagcagagaaaaatgtcatccctttcttatccatggggcttctcctcccccaccaagctcatccatcagggtcgacactgctcttgtttgtgtcttcgcttagaagagcctgctagaagagtggcagatgagtcacctgtcactaaaagtaggtgttcttagtgctggggaaaatggaaggtggcagcaaattcctgctgcagttttccgtaaaattggattaccactactggttttaggtgcccctggttttaggtgctctgtatgtaagtttgtgcaaaagtacagcggcatctgtgggcatccaagctgggttctgctctcagcaaactgaagcaagcccaggccagtccaagggaagatggctgtggaccttccttctgttttatgcagcctagtttgaggcagttcaactgccccagagttaaacagttcaccatacataatagaggacttcgtaattaaaataaatacctctccaccaagagaggagaaaaagaaagatgtgcacagtgtgatgcagaaatgcaaggtgccctaaagtcaaatatgttacaggacacagtgtgcagctgtcagggcctctggccagtctccagctatgctggaggtattttctgtgctctgaccataggctacaagaccacatggctgctgctccactctgtagagtttcttgcatatcagaaaatctgagacctgacatttgtgatgaatatttcttgtacccatcacaaatcagaagaacaacccagagaggatgtcaggcacctgttggtctttcctcttgatctacttgttgcctccaagcaactaaggttctttttagagctctcacccctcaaagtgtagataattatattatcctctaaatatctaaaaactttgtttaaaaggactcgattttgttttctgggaaaagcttggtttaatacaaacaaattccatgtgtaacccagctttataaaatagaagggtccgagtgcggtggctgtaatccccacactttgggaggctgaggcaggtagatcaggaggtcaggagattgagaccatcctggctaacacagtgaaatcccgtctctactaaaaatacaaaaaattagccaggcatggtggcgcacacctgtagtcccagctactagagaggctgaggcaggagaatcgcttgaacccaggaggcagaggttgcagtgagccgagattgcaccactgcactccagcctgggcgacagagcgagactccatctcaaaaaaaaaaataagtgaaataagatagaaggaagggggtctggctttattgtggagggcactgttttagggaggtacatacatgaatatgttcctccgtcagggaactgagggtccactgcactgattctcaaccatggctgcacattgaaatcactgatacccactccgaccctataggttctgagttcagtggcctggagtgtggtgtgaccggcaagacttttcaaaatctttccaggtgattctcctgtgctgccaaggttaagaagcacaggtctagtgtagtagttccccaacctagctgccaatcagaatcaccaaaagagatttttaaaatacagattcctaggtcccagcccagacctacacaatcttgggaaactacagaggatgtgtatttttacagcatcacatgtatttctgattatcgactcaggggaccctcactgtaatgtcctcatgcacgattgtgatcttaaagcataatgcctgtagcagtttttatttatttattctcgtagacgaagctgtttttcactgcttcaagtttaatggccaagtgtgtttgtaattgtggttttttgttttttgctttttttgagacaaggtcttgctctgtcgtccaggctggagtgcagtggtgcaatctcagctcattgcaacctccgcctcccaggttcaagtgattctcatgcctcagcctcctgagtagcagggattacaggcacaagccaccatgcctggctaatttttgtagttttagtagagacgggggttttggcatgttggccaggctggtctcgaactcctgaccccaagatccgcccacctcagcctcccaaagtgctgggactacaggtgtgagccaccatgccgggcctcctgtaattgcttgttaagagaatcagacacctttctgaagccactaaccaaccagcagcattccccattctatgagcgcttttcctttctgctttcttggcacatttctgtcatagacctcgttctcagccttgttgagacacctcctttagtttagtgtggagtattttcctagaacaccgcagccagacgtcccccgttatccgcaggttgatttctgaggccaactgcagactgaaagtatgaaatggaaaattccagaaataaacagttcctaagttttaagttgcgtgctgttctcagtagcatgataaaatctcacgccttaccccatcctaacgcagacgtgaatcgtccctttctccagcttgtccgctgcgcagcgctccccgccggtgagtcacctagcggccatcttggtgcttagatccactgtggtgggatggaagtgcttgtgttcaagtcacctttattttacttaatgatggtcccaaagcacttagtgatgctggcatactgttacaatcgttctattttattattagctattatcattaatctcatactgtgcctaatgtataaatcaaactttatcgtaggtatgtatatataggaaaaaaacatagcgtacatagggtttggtactatccagtgggtttcaggaacccactgggggtcttggaacctattcctcatggataaggcggggactattgtactgaaatctgacaataactctgccatgatgcttcttttgagccacaaagggagccctcgatgtgccttgctgtggtcatttcctttaaattcccttgctgtgatcatttccttccatccagcccagcctgagatgtggagactaccagacagagcctcgtgtgatgctctgtcggcttgagtgtgaggaagcttgtaaatccatgcgttttgttaaaacattatcttctacagtgtcattgagggaagtttcaaatcagctgtgaaagaaaacaaaacccacccatctaaggcattactcatgcctggctgttcctggcttgcattagactccctggctggtcccttcaggctctccgttgagagctttctgtgaagttctttgtatattttcccaaatatgtttattatgggttcattttatcttctacgttggaaacgttatagattgagactcagtcactgccttattgctgcttttcatcatcccacccaccatcccttgggttaaccagagcaaaatagaagcaaactatattattcgcgaaactatagcagggaaaaagatccaagtttctggaacgtgtcctgatgaaaaaataagagtgcatcagatgtggagataaaatgtctcaatgttgaagggatgcatttatctacttaacactcagatgtttttctgatggaagcctctgcttatttatattttagcaaaggccaaactaacctgttctaagaaataatctcatactgaaagagagacctcacttcccatttcccaatccaaagtaaatgctgtgaaagaccaggaatgtagtaccgtcagcacacatctgggactgtttgtagcctacgttctgaaatcaggggatgctgacaggctcaagctgcgatactgaaaggaggcctggtttcccttctgttggaattacattacaaggagaaatattgatccagcatactcaagaatgggctgggtgtggtagctcatgcctgttatcccaacactttgggaggctgagacaggcagatctcttgagcccaagagttcaagacaagcctggacaacatggtgaaaccccgtctctacaaaaactacaaaaattagctgggcgtggtggcatgcgcctgtagtcccagcaactcaagaggcagaggtgggtggatggcttgagcctgggaggtcgaagctacagtgagccaagattgggccactgcactccagcctgtatgacagagtgagaccttgtttcaaaaaaaaaaaaaaaccctgaaattaaaaaaacattcactgggggaaaaattggtttcttagtagaagaataccagcaaaactcaaaatgaaaatggaaatgctctgctgccaatcaggaaaagactgaaaatcttggcagaattctgctggaatcctctgcccatttccttcatgttctcataattataaaagaaaaagaaatgaacattgataaagttcctgctgaataagagaagttttttctacctcacatttgttgaatgcatctcatttagtcatcaccctaaccctgtagggtacgtgttattatctccattttctttattttttgagacagggtcttgttctgtctcccaggttggagtgcagtgccgcgatctcagctcaatgcagctttgatctcccaggctaggctcaagcaatcctcccacctcagcctcccaagttgctgggactgcaagcatgcaccaccacacctgcctaaatttttttattattttgtagagacaggcctcactttgttacccaggctggtctcgaattcctggcctcacatagtcctcctgcctcggcctcctgaagtgctgggattacaggtgtgagccaccacacccagccaattcccattttaaaatgaggaaaccaaggcttgggttcggtgatttgctgtgactgaaaatccttccctccccacaaatagggacaccactatcagatatcacatagatcatttcccaggagccaagggcaaagggcagacccgtctttggccaaagccaaattctttcctacacagtaaatatgggaaaaagagagacttcaagcttcaccccaagagttgagacattttgaagaaagactgacacaattaggggagtcgctggatataggagtgaagtgcgagagaggtatcaaatatcaggctctggcctatgcttggagaaatggtgcaaaaccgttagcagaaatatggaaccggagtgcatgctgatttgagaggggtggtaagcatccaagtggaaattcctcacagactcttgagctgagactgaagttcaggaagaagaacacacctggattttttttcttatgctaggcattatagttgcttttatttcatctcaacaatcttttgaaaacgtattatcatcattcacatattccagatgaggaaactgaggcttacagaggttaactgcatcttccacgtccacagtgctagtatagaaaatgagctttgttgtaaacaggagactgccttactttttttgcatttccgcttgtccattaaatattttattgcctgtttagattacagtcattggtgcctacagcagcattatttatctttcattgggaattagggccttaaattaaatcgttagtcatattttatgtttttataatgttgtagagattctagttagggcatggtattctaaaaaggaaaagcattgatttaatttataatgaataattgtatctaaacagtgtactatgtgttctgcgttcaaataagccagaaagcttctatttataccaaaggaataaacagcaaacaacagacatacttaaattgaaaacatgagcacatttgaattttatttttgaatgtagatgtaattgaccatttgttctgcaaacaaggctttggtccagtttagggggaaaaaaaaatcagtgcactagtgtggagtattttctaaaagaagacaattttagagacttagtaaactttctgaaccggtaagacttgaaatgcctcatgaagggaagtgaggcagggaaacttttaatgagagattattccattcaccatctttgctggagctgactggtgtctatgatgcaggaagtaacctgagaaagaattctagggaggaaaatgtgttttttttttttctttctttcttttttgagacacagtctcgctctgtcaccaggctggagtgcagtggcatgatctcagctcactgcaacctctgcctcccgggttcaagtgattcttctgcctcagcctcccgagtagctggaactacaggcacgtgccaccatgcccagctaatttttgtatttttagtagaaacaagatgtcaccatgttggccaggatggtctcgatctcttcatctcgtgatccaccagcctcagcctcccaaagtgctgggattacaggcgtgagccaccatgcccagcctgaaaatgtgatttttttatgcagatgaaaataggaccacagtgaaggaggtagagaagagggcctttcttagaaaataatcggaacaaccacagccagtaattgtaggtcttgagtacgccaggccctcatctaaattcttcttatgtgtgaactcacagcaagcctgtggggtaggaactagtattattcccactttggagatgagcaaactgaggcacagagaaatgaattagttaggcctggttagtacttagatcagagaaattaattaacttgcatcagatatacacagctgaggagtaaggccaccaggattccaaatcaggtggcctagatcccaggcctgtgctgtttgctgcagcagtcataggaggtagtttgaactggaaagcagttcatcatgagaggtagcattttttgaggcactactgcctgcttgcatgctaggcactgaattgtcccatgcaattctcataacaacttcatgaaataaggcgtattactatcttcatttttttttttctaaggcagagtttcactcctgtcgcccaggctagagtgcaatggtacaatcttggttcgctgcaacctccacctcgcgggttcaagtgattcttctgcctcagcctccctggaattacaggcactcaccaccaagcccggctaattttttttgtatttttagtagagacggggctttgccacattgaccaggctggtctcgaactctggatctcacatgatctgccccccctcggcctctgaaagtgctgggattatatgtgtgagccaccgtgcctcgccatactatcttcattttcttaaagaggaaatcaaagcttagaaagttgaatgggcccggtgctgtggctcatatctgtaattctaacactatggaaagccaaaatgggaggatcgcttaagcccaggagtttgagaccagcctgcacagcgtgatgaaaccctatctgaataaaaaagtttaaaatgtagctagatgtggcggcacaagtctgtaatcccagctactaaggaagctgaggatcacttgagcacagggaggtcgaggctacagtaaactatggttgtgctactgtgtccagaattaggtgcgttcttggtctcactgacttcaagaattaagccgtggacccttgcggtgagtgttacagttcttaaagcggcatgtctggagttgttcattcctccctgtgggttcatggtctcactggcttcaggaatgaagctgcagacctttccggtgagtgttatagctcatacaggcagtatagatccaaagagtgaacagcagcagcaagatttattgcaaagacaaaaagaacaaagcttccacagtgtggaaagggatcggagaaggttaccactgctggctcgggcagcctgcttttattctcttatctggccctacccatgttctgctgattggtccattttacagagagcccagtggtctgttttgacagggtactgattggtgcatttacaatccctgagctagacacaaaggttctccagggccccactagattagctaaataaagagtgtcgacacaaaggttctccaagtccccaccagagtagctagatacagagtgtggattggtgcattcacaaaccctgagctagacacagggtgctgattggtgtgtttacaaaccttgagctagatacagagtgccgattggtgtatttacaatcccttagctagacataaaggttctccaagtccccaccagagtagctagttacagagtgtggattggtgcattcacaaaccctgagctagacacagggtgctgattggtgtgtttacaaaccttgagctagatatagagtgctgattggtgtatttaaaatcccttagctagacataaaggttctccaaggccccaccagactcaggagcccagctggcttcacctagtggatcttcacagaggcagtaggtggagctgcctgccagtgccgtgcgcccgcactcctcagtccttgggtggtcgatgggactgggcgctgtggagcagggggcggcgctcgtcggggaggctctggctgcacaggagcccacggaggggcagggggaggttcaggcatggcgggctgcaggtcccgagccctgcccgccagaaggcagctaaggcctggcgagaaattgagcacagcggctgctggcccaactgctaagcccctcactgccctagggccggcggggtccgccgctgctccgagtgcggggcccacggagcccacagccacctggaacgcgcgctggcccacaagcaacgcgcgcagcccgggttcccacccacgcctctccttccacacctccgcgcaagctgagggagccggctctggccttggccagcccagaaagaggtcccacagtgcagcggcggggtgaagggctcctcaagagccgccaaagtgggagcccaggcagaggaggcgcagagagcaagtgagggctgtgagggctgccagtatgctgtcacctctcactacactccagcctgggtgacagagtgagacccggcgacaaaaaagagggagagaaaattgaaagactttcctaaagtcacgagttatcaaatgccagttagcccggtctaacatgacactgaatcaactatgtgcttcctgctcaggagtcagaacgatattatcaagtgttaatgcttctaaatgcaaagagggagcaaggtgtttcttctctttagtctgtgaccagcagctgctcactataacctctcttccactgcatgtccaaggattactgcatagaggaggattcccatcttcccagcccctaaatttaaaaataaattaaataggctgagcgtggtggctcagggctgtaatcccaagcggtggctcactcccactttgggaggccgagatgggcggatcacctgaggtcaggagtttgagaccagcctggccaacatgatataaccctgtctgaaaaaagtacaaaaactagccaggcatggtggcaggcgcctgtaatcccagctactcaggaggctgaggcatgagaatcgcttgaacccaggaggcggaggttgcagtgagctgggatcacgtgactgcgctccagctctggctactgtctcaaaataaataaataaataaataattaaaagaatatagaaccgccctcacacttcctgccggatgcagtcaatttgacagtgtgcctcattcagagggtgttgcctacatccagggagtgtcaatttttttttattgaatgaatacctgattaagttaatgacgctgagctgggggaggaggagcagtttggcagcccaatgctgaagggcttctggcagctcattcagtgtccttaatgttccattggctttgtgctgggccgcatgtgagccccaggagaggctgctgtaattactcagcttttttattgaaaacagctgcaggtagcgagtcatcccattgtccatcttgctagtgactggaaacaactcggggccatcttgggctccactacactgcagcctcattctgaagtcagtggaggtagaaagtaggcttcccacttgctgggcttttcaaaatgagccattcatcttttgagggtcagaagtcagccacccattcaccgagtgtgagtcatacccctaattttaaaacaaacatttattgcagagagaattcttatcttggccgatgtgtacagctgatctccttgtccttcctacgattgatttaggctggtttcaacaaaattgttgtctttgtaaatacacacctcttccagtaaatccagagactaccgaggtgtttccttgagattgagcctaagacaatctttaattagttttggataattggatatgaatgtttagaggccttcccatatagcaagtgtctttaacatctcacacaatatattatacttgtacttcctgacccgagaagtaacaggagttaataatctcacgtgagaaagtatgtttgaaatggaatctcaaggggcagattctttgcagataccacaacattattttatgtccctccgtaatgagttcagttttttatcatcacatccaaaatctagaaaatgatccagaaatcctttgccttttaataaccagcttgtaaggaagacaaactgcaagagatggacacaagataagaacagtaaccaaccaaggacggacagcaccctagaaacccaaggggttgtgaacttcagtctctaagcagcatcggagtttacggtctaatgacgaaaacacgtgaaaacaaggattgcagcagccggaagtggctttgctgagagtttaggaatgattgcctaaggaagtagcagttaggggacccactgtattagtcagggttctctagacagacaggactaataggatagatgtatatatgaaggggagtttattaaggaatattgactcacatgatcaaaaggtcaagtcctacaataggccacctgcaagctgaggagcaaggaagccagtggttgaccagtctgagtcccaagacctcaaaagtagggaagccgacagtgcagccttcagcctgtggccaaaggcccaagagccctggccaaccattagtgtaggtccaagagtccaaaagctgaagaacttcaagtcgggtgttcgagggcaggaagcatccagcacgagaaaaagatgaaggccagaagactcagccagtctagtccttctacgttcttctgcctgctttcattctagcctcactggcagctgattagattgtgcccacccagattgagggtgggtcttcctctccaagcccatgacccaaatgtttatctcctttggcaacaccctcacagacacaaccaagaataatactttgcatccttcaatccaatcaagttgacactcagtattaaccatcatgcccaccatggtgaaggcatgcgggggtggctggtgttagactaattggagccttggaggatagtcgaggaaacggttcctgaacggtgtgtggatgagaatgttggagcagggtgctaaggaggcacagaggagaggcagagggtatggggttggagtggggagagccttaaggaggtgacatggaaggagagacctgaaagatgggtgaggccagtgcttctggaagtgtggttcctggaccagcagcatcagcagcatctgggaactccgggtgaatgtgatgcgcacgctcgagtataagaaccactgcattagaaaacaggtgacagtgccttgcggaggagcggtggctggtgtggaaagtactctaacagagcagagggaacacatacccagaggcctgcagcaggcatatttgaggcttgatcaggacacagccacccacacccactggttacaaattatctgtggttgctttcagcctgcagaggtagagctgagtaatggccacagaggtgtatggcccgcaaagccacacgatttactaggtggccgcgcatcgtcaaggttttccagtccctgattcagagggtggaactgacataacctgatgacagaatcaggggagaagaggcatacagggatatcggccagctttcagtcttcagtgagcaatgacatgatagagcagtgacactaagatactgctgcctcactttttacagctcacagtcccctttgcggatgtgagaaagggcatacagctttaagggcttaaaggatgccctgacgtccagtcctggaatacaggctaatgccagcaggtatctcagagatccttgtagctccaagcagatgagggagcggggcgctgtgtggtttcaaaacagaaatgcagtttgttcacaaacttttaagatcatgacatatttatttatttatttatttgagacagagtctcgctctgtcacccaggctggagtgcagtggtgcgatctcagctcactgcaagcctgcctcccaggttcacgccattctcctgtctcagcctctcgagtagctgggactacacgtgcccaccaccacgcccggctaattttttctattttttagtagagacagggtttcaccgtgttagccaggatggtcttgatctcctgaccttgtgatctgcgcgcctcagcctcccaaagtgctgggattacaggcgtgagccaacgcgcccagccatgacatacttatttttaaaaatttttgactggtgacaaaatatgcataatatgaaatttaccatcttaatcatttttacgtgcacggttaagtggcacattcttgttcaaccatcaccaccatctgtctccagaatgtttccatcataccaaactgaaattctggaaccgttaaacaactcccattgccccgtcctcccagctcctgctaacgcctgttctacgctctctccaaatttgactattctagattcctcatagaaggggaatcatatgatattgttcttttgtgtctggcttctttcacttagcataatgtttgaagatttatcaatgtcatagcatgtaacagaatgtcattcctttgtaaggagagggggatgaataatagctcgtcataaggatataccacatttttaaagtttattcatctgttgatgatcattgggttgttgacaccttttggctcgtgtgcacaatgctgctatgaacacgggtgtggaatatctgagtccctgctttcagtgctttgtggtagatatccagacgtggaattgctgagtcatgtggtaattctgtatttcacattttgaggaactgccaaaatgttttccatgcagctgcatcattttacgttcccaccaacgatgcacataggttctcgtttccccatctccaccaacacttgctattttccatttttgttttgtttttttttttaaaaaaaagaatataatgtccatcttaatgagtgtgaagtggtgtctcattgtggacatagcatataattttaagtatgattaaaggaggttagaacacgacttttgtgttggcaaagtggggaaaaggattggctgctgtaattaaaatcactgagacaggccgggctcagtggctcacgcctgtaatcccagcacgttgggaggccaaggtaggtggatcgctcaggtcaggagtttgagaccagcctggccaacatggtaaaaccccgtctctaccaaaaataaaaataaaaataacatagccaggtgtggtggcaggcacctgtaatcccaactacttgggaggctgaggcaggagaatcacttgaacctgggaggtgcagtgagccgagactgcacccattgcacaccagcctgggtgacagagcgagactccgtctcaaaaaaaaaaaaaaaaaaaaaatcactgagacatactgccaaggacagatggagttagggggcttaaagatcctctataccagccgggtgcggtggctcacgcctataatcccagtactttgggaggccgaggcaggcagatcaagaggtcaggagatcaagaccatcctggctaacacggtgaaaccccatctctactaaaaatacaaaaaaattagccaggcgtggtggtgggtgcctgtagtcccagccactcgggaggctgaggcaggagaatggtgtgaacccgggaggtggagcttgcagtgagccgagatcacgccactgcattccagcctgggggacagagcgagactctgtctcaaaaaaaaaaaaaaaaaaaaaatcctctataccagaggttctcacctctggctgcaaattagaatcccctggtgcatttcctaaaatgccagtggtggtcccaacatctagggattcttattcagttggtctggggtagatctggacattatgtttttaaaagctccctgggtgagtctgatgtgccgtcagcattgatttcttattctgcaggtgagagagtatggccctagtactaaggctgcaagggttctggtctctcagccagagctgctgccactgatacaccattattcagcatgaccacaaacacagtgaaaccagtagtgtcccaggtacatgtgcatcctcctttgtattgtggaggaaatatgtccccaaaatctgcagagccaagtgcgggagccaactcctccatttggtctgttgggatgttcagtattctatggtagatttctagtaagtcaatttcactcagtgggctgaggatattaagacaccggaagttagctgatgtgttcccccattgctccaacactttgaactctgtaccccaaaaattgatccactcagtgcttcttacatgtatgtgccattggggagatttccacagggaggctttctctgagcctttggccctggtgacattacactgagtaatatatatccctgttcctttctgtaccacccatctgcctgttccctggccacagtttggggtataccaatttagattaacctaattattgtttcacaaggcattcttatcactgaacgctgatggatgttacttcaacgttgttatattttattacttggcctatttaagtgtataaccatcactagctataagaaggtgaccaactacaacgttagagagagcagtgcctgcaccacgaattgcaagttcagggggtttcccagaccaccctccgttttgataattcagtaaaaggactcacagaactcactgaaagctgttctactcatacttattacagggaaaggatacaagttaaacttagccagggtaagaggcatataggagaggtctagaggggtccagacatggggcttctgttgccctctgcccatgaagtgatgaacagcattacctcctcccagccatgatgtgaagaatcaccaaccagggaagctcacgcgaacctcagcatctagagtttttattggagctcaattgctactgtcctcatgactgacctctagtccctaggccctcctggagatcaggcaaatatctttcattattagttcctctgaggttggaacgtatacctcatggcccaaagcccccatcataaatcacattgttactccatccagtggccaataaacatacttctgtgaggcaggacattccagaggccgagagatcacctccccacaggtgggggcaaaggccagacctgagtttgggtgaggttaaattcttcatggtcaggcgcggtggctcatacctgtaatcccagcactttgggaggccgaggtgggcagaccgcgaagtcaagagatcgagaccatcctggccaacatggtgaaaccctgtctctactaaaaatacaaaaattagctgggcatggtggcatgcgcctgtagtcccagcttcttggaaggctgaggcaggagaatcgcttgaacccaggaggcagaggttgcagtgagccgagatcacgccactgcactacagcatggtgacagagtgagactccgtctcaaaaaagaaaaaaaattcttcactacacactaatgacccactacacaacccaagaactagatcccaagttttcatattaggattttttgtgtgttgtttctgcccttttttagccatgtaatcttaggcaagtgacttacactctgagcttcaatgtccttgtctttgaaatggggtgatcatatgctagttgttatttatatgtaaagcattgctgtagcctgcacaaattaagcatcgtgacttgtcctgcctgctgtgccttagagagcctgggtcccgggaggtcttggggtctttgcagttgagagcattgaattgtgcagtgtctcagtgactgaaaccaccatagaaggtaagccagtgtgtgacacctggaggaacagctggttagtttatgaattatctggaggcattggctttgctttcattcagccacaccaaggacagtgaatagttttaagactctcccagagtacctcagttcccacgagacctttttcctgacttgatggagagttttatgttctctgttgtagactggggctgtctaatgtcctggaaacccagccccctggtggctggcaggatccagcctaggcctcctggagcagttgctggcgctttgcatcgtgttgtgtggtgaagctcgtgagtgtgtgtgcgggtagacagctggcagccttccctgcgggatgtggaaggaggattctgcatttccccaccatgcgtcttgggaattactcatccaaaaagtattgtggaaaagcaggcagagtgaaacacggaggcattgcacttaacccttccctggaaatgccatccttgagtttagcgtctgagctttctgtttattctgcttgtgtgctgaattgccttccttcttgttggtgtgcataggggtctgcacattgggcacttataaatattatcccacctatcaagtgaagaaaaaaatgaactctcaaacacccatcacttcctctttttctatcacagatgtgaggaaaaaacagatgtttgaaagaattgatagtttgaaggtgttgtattgattacatcatggccaggagagatgagcaacagataagtgtgggtgatcactgagaattcatgaggaaatgtttattgaattataactacgatggcgaccatgtactgagtgtgtgttatactaggcactgtgcatgttaattcttccccattttaaaggcagagattacaactttacacattgttgaaatgaaatttttgcctcattaaacttgggcacatgtataatcgcaagtaaaattaaaattattattttgagatggagtctcgctctgtcgcccaggctggagtgcagtggtgtgatctcggctcactgcaacctccgcctcctgggttcaagcgattctcctgccttagcctccctcgtagctgggactacaggcgcctgccaccacgcctggctcattttttgtatttttagtagagacaggatttcactgtgttatccaggatggtctcaatctcctgacctcgcaatccgcccgcctcagcctcctaaagtgctgggtttgcaggcatgagccaccacgcccggccaaaattatatttttaaaaatggataacataggtggtttggggtaaagccaaggtttgaacctgttctctaccttacggcgtagcccactctaactacaattctgtgtgtccttagtagtaatagcagtggaatattattgatctattatcatcattgttagtaataataatattaatatttatcttgatattctaaataggacagtggatgtgaatgcttcatgcatcgggtagtgagatctatcacagtggtggtaagaaacattcaagtgagagtcaaagtgacaggttctcatcctcctgaccccagttcttactgtgttaccttggccaatacttttcatcttcttgcatcagtccttgaaataagataatgaagagggctcacttcctctcactttgaaacaagttagtctggactgggatgagaaccactaactccaggcagcgtggaaagcatctgtgtaactgttcccagccttcaaccagagtggtggataaacagaaacgtgggtgcccccgggtagctaacctggaatgcactacgctttaaagcaaaaaagtatttgcttctgtattgaatcaggaaaggtcttgacagaaaggcatttccagcttttcttaaaaactccaactcaacctctgtcagacaattcatttgggaccagcttggatccagatggttatttttccatcttgagcctttccaggaattccggcatgggcaggccgccagagacactggctacacagccactgcagcgcgttttccatgtgagccggcttctagggatggcccagccaagctgtggccccgcccctcctccttcctcatccaggctgatcctccagctctcacggacatgtgccatgagccacgcagggggaccccagccacatggccgatgtcctgatgtttccaggggtggcagagctcactaactgcacccccagaactgtcatctgctcactacgaatagcaatggcagaagccaggaatctaagaattgatgaagcctggccctccattatgtggacaggtagtagcaaatcactcagccccacttagggataagggagacagcaacttaaccacgtgccaagcagacaagttcagcagaatggcagccagtgcagctgtgtgtcttgaggaattctttccagcctccccttcaaggcccttaatcaaagaacaactccccactggacgcagagctacccaagccagcgaccacccgaatgagactattattttgggtggatttaaattttttaatcattgcttcaagtatagtcgtatccattgcccaaaaagtctatagatgcatggggtcaaaaaacactactattcgtggtgctgataatataagtagtggggctgcttttctcctgcctttgcttgacccactgcagtcccagctggcagtggtagtggcagattcccctgacccaaccacccccaggaaggtcttgcctcaaagaaaaggaaaatgtggtgtgtgctgctggctgccacggactcaggggagcctgtgccaggttgcaggcttgaacttgcttcttgtgacactagagggagagagcttgtttcaaaagcatgttagtgctctcagttcctcacgtccgacctgtgccagaggctccttctgcagtctcaccactcctatggcctggatcacaattgggtgggtggtcttgaacttggctgctgagcctgaggtcccctgcttgcttgcctgggaaatacaaacatcctgacctctcttccttggtcactgatcagtctcttccttactgaacgtctcaccagctgcagttcttgattagtcaacatggtgcagaggtcccctagacatcttttcccctacttatccctgtgcattctgtcccttttctacatgaaaaataaataggcatatttgctatgaggctgccatcgccatagccaggaggtgagtgtaacccgcatcatggttgggtagactaagaaagtgatttccagtgctagttctacctctgactgtatggccttgggaaaacctcagtgtccttatctggaaaatggagataataatacaaacctcacaaatttgttatgaagagtaaatgagatatttaagtaaggttcttggcatgtataataagtaatcaataaatggaagatatttggattggtttcttagggctgccataataaattaccaaaacatatcgtggcttaaaacaacagaaaagtattctctaacactcctggaggcttgaagtctaaaattaaggtgctggtggagccatgttcccttcataggctctaggggataatctttccttgcttcttgctgcttctagtagcttcgggtgatccttggcttgggactgcgtcattccagtctctctgcctctgcctccacagggcctttgcctctgtacatctcacatctttctctgcctttctcttataaggacatttgtctttgaattgagggcccacctggatcatccagcatgatctcatttccaaatccataattacatctgcaaagaccctttttccaaataaagccattcccaggttctgagtgggcataacttttagggatctaccattcaacccactgtccttccttattcatgataaaaattaagatacataaaattatttattttttatgtccttaggccctcgtgtggactccttctagcttggattacgagctttcatttcttgctttttctcttctcactcactacacttccgtgaagagcaagatcccatgtcccaggggtgcagagccgagaagggaaacccgagcgcgttggggcgaggctctcagacagcatcttctacaaagttgtgccaggtcccagctcgcctctctggtggtttctggcctggatgtctctagacagggccttcagtccccttcaggagcctcctcattttgggccaagaggcctgccccatgaagctccacgcttagatagacatggaagagaaggtcaatagtcagtttccactgaggacacagcaagaagaaattgtgacagtagactgggatgacaagccagccaccttgacacagagtggaatcacagtctcagaatgttcctaatggcaaaaaaatgtagagtaagtagttcgaacacccaaccagggcagggacccctaccccatatccctgagtttctatcctgacccttggggtgacccagagatccctgactcatgaggcagcccagtccatttttaaccattctcattgcttcctaatgctgcagctttttctgttcttccccagggcactcattcccagttgtctcagctgttactcatctgcttgcctccagacctcttgcgcaactgatcactccccctagacatgccccatccttcccacgtgcctttgcagcaggatttcaactgtggctttacccgtgccatctatggttgcagtatttattcccttattctgaacattgttttctttctcttttcttgagacagggtcttgctttatcacctaggctggagtgcagtggagcaatcatggctcactgcagcctcaacctcctgggctcaagcaatcctcctgccttagcctcctgggtagctaggaccacagatgcaaaccaccatgcctagctaattttttttattttttgtagagacaggatctcgatatgttgtccaggctggccttgagctcctgggctcccaaagtgctgggattacaggtgtgagccactgaacccagcctgaacattatattttttttaatgaaggttataattactatactttttaagaaccctaccaaatggttgttcatattgagtgtatagtcaaacaaaaactttctgggctctttcattgaaaccattattaaaccagatctcttcaaccctgctagtaggctaattgagctgttgaaaccaagggcaggcatttacatttattctcattgatcttaattttcctggtttggtaccatcacttccggcttcttaagatatatttgaatcttattcgcaacatatatcccttctagccttctgttacttcgaaatatgataaccaaaacactgtattagtattgaatagaacagaactaaaaatagagttctggcataccatttgcttcacactgacattgaacaattgaggtccccgtcatacatactagaaacggaatgagtgtttgatgaatgaatgtgtgatccactttgggggcatgcctgttcagtcaaccataaaggcatctaattatagctatcatccaatccacctttctccattctagatactccaagcatgtcgggtttggacctgtttttaatgcttggccaaaatgaagtgctttctgccagtgcaccacacaggccttccagtttagtgatgtaataaagctggaaggagattggtgagtcagcactttgagaatccttgacatgcccaagtaacctctgtcctcacacccaggtattctgccctcttcagtgtttgcatacgtagtttttccagtcctggcacaagctcatcagcctgctcttcctcttctttaaagctgaaaccgtgccctgtttgtccatagatatacaggccaggcagccatgggttcattcaaactgagaagcacaggattgggggtgtaggaaaagcaacccattttcttgccctaggtttaagatgtatttttaggagtttatatatcaaattctaagagcatcttccattctgagcagttggctgctatttactggacttgcagtcagtgggcatatattccccacatccctagcacagaagcatctcattttcctatcacttcccaagcagtctgaatccatggtaatagcaaaaaatttctcgaaatgaaattatagcaaagaaagaagtgtggagcttcctttgttaaatttcatttttcttcctgggaatgattgagttgtgtataaaatttatgataatagcctttttaaagtatatttctctgcagttgtgtaaagaaccagaagaaaagcagcatttgttatttgcagccgtattaggtttagatgaccccagaggaagcagtggagcatcacctaaatattagatgtttatctccgaggctccatcaactctgtgtttacgtacaacacctagtttggtttcccagtgcctgctccattaggaagaggctagagatgtttaatttgcttaagagtttagcagtagaaaatttaatcggatagctgctagggtttctcaaaccttactgtgcatagaatcatctggatatcttgttaaaatgcaggactgggtggggcctgagagtctgcatttccagcaaacttgcagaggatgctgatgtcacgggtcggaggaccacacttcgactagcaaagccttataccactgggctaaatttagaaattatgatagagagatagttaatgtagctctaaagcggcttaagatgaatgtattcagaacagtgattatcaggcaaaccatgggtagcaaactctaaatacatttgtcttgattcatctattaactctccctccaatttcccttttccaataggaatgtttaaacagtgcgatctgcatatgtggctctctggtaatttggcattgatataattgtgcatggccccatgtttggaagaaatctttttgttgtggcaggtgcttccagagataaactcctcgggggtcccctgggagggcaattcaggacacagaggccagttgtctgcaactagagactctaagagcagaaatcccactctccttttttcttttttcttctttcgtttctttttctctcttccttattttccaaatctacttttccaccttcataagttacttctttgttgtttagtcccatgatcacccgatagaccaggaatgtggtgccatcctggggcgccctctggtggttcattgaaaatacagcaagacccaatctctacccgtgggtttccccttatcagtactgaaagcttacggggcccagagaagggacacatacctcagcgttagagagccctgtctgctccgtgctgcactggtaaatagccctaaatgtaggaggaggatgggtggaaacttttatcggtttggccccagctcgctgcaactgctgtcttaatcattgtgtccttgatttctcattggcaatctctggaaaagatgctgtttatcaatggataagttttcagaagaataaatttggatttgtgtgttaaggccaatatgtcttagcaatcatttcgcagaagaccagtccagtgagtcttcagggctgactaagccgatgtctctcaaataaacagtataattaaacctgagcactactgagaaccaagtcagcattctttttcaaatttacgaaagctggcttcctaaagaagtaccttcagaggagttttctagttttgtgtattgtgcattcaattgtacaggcaatgttacatttgcattgctaatagacccttcctgaatgtgtttgacattttacttggctttgaaaggacttttatgccgctgctttttcttccctagtgctgccttgggctaattaacctattcccttactggctgggcctactatatgcaaatgttctcattttgcattctgacacatcactcttgcataaatatccctcatgaaaccctgtggggttttattggatcagtgctgcaggagggccagcagggggcgcatggactggttctctctgagtaggtctcacgcatgagttttccttgctcgttggtatggaaatgtgggagcgtttggcattccctttcttaagagtgagtcttgaaatttaaagataaaagttcattattagaacttctttttacaagggaaggctgtacagaacacagttatttgtcacttacaaaaaccctaggtgggcagggcgcagtggctcacgcctgtaatcccagcactttgggaggtagaggctggtggatcatttgaggtcaggagttcgagaccagcctggccaacatggtgaaactccgcctctactaaaaatacaaaaattagccaggcatggcggcagccgcctataatcccagctactcaggaggctgaggcaggagaatcgcttgaacccgggaggcggaggttgcagtgagccgagattggcacattgccctccagcctgggcgacagagtgagactccatctcaaaaaaaaaacacctgggttgcgagagtaaataagtgacattactccttcaacacttcatttcttcagcataagtgttttagggtttttttaaccttatttttcatttccgtcccagtctttaagcgcctctcttgtcatatgagaaattctattcttactgaaatgtcctttgatatcgagacaccaaatttctaaacctgcaccttcctagatatctgatcaaaatcattaaggattgagaactttctgttgtatcatttgtcatttcattatgatgttcattgatgatgttggagcaaaaccaataagggccattaaatcattgccccttccaagctggctgcagtggctcatgcctgtaatcccagcaccgggaggccaagtgggtggatcactgaggcctgttcaagaccagcctggccaacatggcaaaaccccacctctacaaaaagtacaaaaattagccgggtgtggtggcgtgcacctgtagtcccagctacctgggaggctgaggtgggaggatcacttgagcccaggaggcacaggttgcagcaagccgagatcacgccactgcacttcagtctgagcaacgaagcaagaccttttcaaaaaaaaaaaaaaaaaaaggaaggaaggaaggaaaaaaatcattgccccctctaaaaaatagttacaaagtagggggcagagtagagaaagggggttatgtttcagtagggatttcagtgttgctccaacatggacaaggattgaatgctgaaggccgctactttattgtgtttgttttaaaatcggatcattggctacacacagtggctcatgcctggaatcctagcactttgggaggccaaggaaggaggatttcttgaggccaggatttcaagaccagcctggttaacatagcaagaccccatctctccaaagaaagaaagaaagaaagaaagaaaatcagatcattgaaaagagggtctggatgtgagataccaaaacccaagggtgtggaattcccaaagcccaatcccacagctctcagaatcacagcatgttgcactgtgcatacctacagctgctacctgtggaagcaatcacatccgctgcttgctagcctgggtcatgtcagttccactgatatttggcctcttgtctgttgggcattggtttgcccacacagcagcagtaactcagacttcagtggttagtaagagactgagatacttgaccataagaactggctccagggtcaccatttgtatgtccaggtttgaacacactgatctgatttgtctgaaagagctgtcgtctctagtgttaatggcgagttgttactttccaatgagaaaggggacggtgtgaaggggaacttcaatgacaacttgaaaaggaagagagagatggacaaaccaagcatgtaacccactgagaaaacattcagtgcactagccctatttttgtatggtatttgggttttttaaccataatcaaattcggtttttaacagtctcactccgtcatcatatgagtggctgtactgggaattcttttgaaacttgcagagaacaggattatttctggcggcctctgctgagttggcgtgtgtgtgtgtgtttgtgtgtgtgtgtattagggagaggaaatcgtaggtccagtgtggacccagagctaaggggaatcttggagagtagtggctctggcagatgaggattcagaaatcgagtgcaaggactgttctggactttcactgctaacctgctttttctcagtgcctggctctgagggcagggtccagctggtgtcatgctctccaagggcttcattttatgttccagccaggcaaaggagaggtgagaaatggaaccaacatttctgaaaaggaaatttaagaactgcatcatctgcccttgaagaagaaaaggagaaaaaaaaacaggagagagggtattgagaacatcttaggggagttgttaactccattaaaaaatatatgtgttacagtgttcacttgcccagtgtcttcataatcttcctttataatgtgcagctgccacggctagtgtttttgtttttgttgttgttgttttgtttcgtttttggagacagagtgtcgctctgttgcccaggctggagtacaatggtgcaatctcggctcactgcaacctctgcctcctgggttcaagcaattctcctgcctcagcctctcaagtagctgggactacagccgtgtgccagctaatgttacaccaggctaaatttgttttttattttttatttttggtagagacggggtttcaccatgttagccaggatggtcttaatctcctgacctcgtgatctgcctgcctcggcctcccaaagtgttggctagtgttttctctgcttcagtgcttggggtatgattgggttatgggagttcacaccgagtccagggcctagtcttaatcttgccaaagatgttctttccccggtgctcatgttctgatgtcctttccctccttccctttctcctccctttccttttccctttgtcactgccctcttccctttcccagcatccagagctgctgttggcggattgtacccacggggagatgattcctcatgaagagcctggatcccctacagaaatcaaatgtgactttccgtttatcagactaaaatcagagccatccagacagtgaaacagtcaccgtggaggggggacggcgaaaaatgaaatccaaccaagagcggagcaacgaatgcctgcctcccaagaagcgcgagatccccgccaccagccggtcctccgaggagaaggcccctaccctgcccagcgacaaccaccgggtggagggcacagcatggctcccgggcaaccctggtggccggggccacgggggcgggaggcatgggccggcagggacctcggtggagcttggtttacaacagggaataggtttacacaaagcattgtccacagggctggactactccccgcccagcgctcccaggtctgtccccgtggccaccacgctgcctgccgcgtacgccaccccgcagccagggaccccggtgtcccccgtgcagtacgctcacctgccgcacaccttccagttcattgggtcctcccaatacagtggaacctatgccagcttcatcccatcacagctgatccccccaaccgccaaccccgtcaccagtgcagtggcctcggccgcaggggccaccactccatcccagcgctcccagctggaggcctattccactctgctggccaacatgggcagtctgagccagacgccgggacacaaggctgagcagcagcagcagcagcagcagcagcagcagcagcagcatcagcatcagcagcagcagcagcagcagcagcagcagcagcagcagcagcacctcagcagggctccggggctcatcaccccggggtcccccccaccagcccagcagaaccagtacgtccacatttccagttctccgcagaacaccggccgcaccgcctctcctccggccatccccgtccacctccacccccaccagacgatgatcccacacacgctcaccctggggcccccctcccaggtcgtcatgcaatacgccgactccggcagccactttgtccctcgggaggccaccaagaaagctgagagcagccggctgcagcaggccatccaggccaaggaggtcctgaacggtgagatggagaagagccggcggtacggggccccgtcctcagccgacctgggcctgggcaaggcaggcggcaagtcggttcctcacccgtacgagtccaggcacgtggtggtccacccgagcccctcagactacagcagtcgtgatccttcgggggtccgggcctctgtgatggtcctgcccaacagcaacacgcccgcagctgacctggaggtgcaacaggccactcatcgtgaagcctccccttctaccctcaacgacaaaagtggcctgcatttagggaagcctggccaccggtcctacgcgctctcaccccacacggtcattcagaccacacacagtgcttcagagccactcccggtgggactgccagccacggccttctacgcagggactcaaccccctgtcatcggctacctgagcggccagcagcaagcaatcacctacgccggcagcctgccccagcacctggtgatccccggcacacagcccctgctcatcccggtcggcagcactgacatggaagcgtcgggggcagccccggccatagtcacgtcatccccccagtttgctgcagtgcctcacacgttcgtcaccaccgcccttcccaagagcgagaacttcaaccctgaggccctggtcacccaggccgcctacccagccatggtgcaggcccagatccacctgcctgtggtgcagtccgtggcctccccggcggcggctccccctacgctgcctccctacttcatgaaaggctccatcatccagttggccaacggggagctaaagaaggtggaagacttaaaaacagaagatttcatccagagtgcagagataagcaacgacctgaagatcgactccagcaccgtagagaggattgaagacagccatagcccgggcgtggccgtgatacagttcgccgtcggggagcaccgagcccaggtaacgttagccagggtggcacagggatgggacaccacaccgtgatgccatcatcatctcctggcaagacgaattgcttctatgaggcaggattaagggttctcgggtacacctagaccttagactcggcctttcccaactgcgttctctagaaaaaataagccccatttccccgtgatctctgctgtgtgtaatgaattaacctccatgcatggagagtggggctagttatggagtccttgagacaatccagaaactcaccactctagttattttttgaattctgtgattaagatgaggaaccctgattaggaaacgctgctggacttcaggtccttctagtggtcattcggcactttttcttaccaggaaaagacagaggatgccgttggagtgaggggattagatgctaaagcaatcatatcccattgcaacatccatgttttaaaatatgtcttattagctgggtacagtggtatatgccttcggtcccagctactccagagactgaggcaggaggatcacttgagcccaggagttcgaggctgtagtgagctatggctgaacctgtgactatcactgcactcaagcctgggcaacatagcaaggcccggtctccaacatatatataatgtcttattatttaggtatgataaggccaacagatagatcagcagacaactctctttgacgagataatttttatactctctgatcccaagaggaaagggcactctacaccaagaggtgtagaacaccgtaaagtggggggcacctggggaagccccaggtgggtcaggaggtggagggagtgaggggaaatgtggcaaacaacagcctttattgtggtttcatgggaggcagggtaaacgggtttaggattggttagagtggataattccagtgtgctctggggtgtaggggctgtccttagttgtctggctgctggtgctggggtgatcaatacaggtggaagggctgggcacagtggctcacacctgtaatcccagcactttgggaggctgaggcgggtggatcaccagaggtcaggagttcgagaccggcctggccaacatggtgaaaccctgtctctactaaaaatacaaaaattagccgggcatggtggtgtgtgcctgtaatcccagctactccagaggctgaggtaggagaattgcatgaacccgggaggtggggattgcagtgagccgagatcaggccactgcactccagccttggacacacagcaagactctgtctcagacaaaaaaaaaaaaacagatggaaggcagccctaagtgtgatggaccaatataggaggctgctggggagtgggctctggactggttagtttgcatatgaaagtcaggctcctaggaattagctctggactggttggtttgcatataaaagtcaggcctctaggaattagctaatcctaggagagactatacctctgggatccacaagacactaaaatatcaaagcatcagaaaataaaagcgtggttaatacaatctgagaagtcagggctgtcccaggtgacctgctgggcttggggtaaagtcagctgtagccaagatgagtcactggaagtatggttaacgctcttaatttccacaggctccttcaatctacccttttccaggttcttagatcgattacatgcatttattccacagcccatttctttcactgcccaagttgctgggagtccagcaggttcagcctgcagctgagagctttcctggctatcgagcgtactttctacaagtgtttccatctaggatttgaaaacattcaaatgggacagagcctccttccagcttgagttgaaaatagtcatgaaatagctgctatttgggacattcagataaaataaaacaagaaaaaaaagataaactaattaatggtttgaattgttttgggcatttttttttttcatttttgagacagtgtttcttgtctcctaggctggaatgcagtggtgcaatcatagctcactgtggccttgacctcctaggctccagcgatcctcccaccccaacctccctagtagctaggaccacaggtgcataccaccatgcccagctaatttaaaaataaaaaacattttagtagagatggggtcttgctgtgttgcctaggctggtctcaaactcctgggctccaagcagtccttccacctcggcctcccaaagccctgagattacagacacgagtccctatgtctggcttttttgagcatttcttaaatgcccaagtgaggaaaggaccaaatcagttttccagaaccactcgtgaatgactggatatgggggcttgcacaaagccggggccctgcattgccgagagcttttagccctgaatacttttctttgtattatgagatgtcactgtaggtttacagtctttggaagggcccaagaaagatttccccaaagatcttatttaaaaaaaaaagaaaatcaggatttttaaaataaatggcataataatacagctcactacccctctgtagtggctgttcacttcctgcatgaattaggggtgggtactaggagaaagaaaatgaactaccttgagcaaagttgactcttcacagaccccaggtgacacatggaaaataaacatgagtgaagagtcattgcttttcatggtacttagaatccttaacacatttttgtgaacagaggcaggtgtgaaaagaggttttgtttagaaatgcgactggttccttgccggccagcatcaacttcagcttgagaatgaaggcagccacttcagctgtgggccacacttcccaggcctggcagcctctgcagaaaccagactcttctattttttttttttttttttttttttttttttggagacagagtcttgctctgtcacccaggctggagtgcagagtgcagtggggtgatcttggctcactgcaacatctgcctcttggttcaagtgattcttctgcctcagcctcccaagtagccgagactacaggcacacgccatcaccccctgctaatttttgtatttttagtagagacagggtttcaccatgttggccaggctggtctcgaactcctgacctcaggtgattcacccgcctcagcctcctaaagctgggattgtaggcgtgagccactgcgcccagccccttacagccctcttctgttcttggggaggaagatctaggtgtgtttttccctactccaaactttgcaaaattaatgattaaatgaaagagaaattggcttccctgtgaagtcagagccctgttctcatgttttttcccatagtgagatcactaaatctctctactgacagccagggtgcagacgagcaggtagaagtgttgtcagggcctgttggcaggtctgtgaggttggcccccgcgtggctatgctgcatgccgggaagggcttcctcaaagaaaggcaagtgtgctgagacctgctgaaaaggcagctagggcttcacgctgtagaaacaaaagtgcaaggcctgacgcaaccaatgatttgtcactttaccgaggagcctatcagaaatcggctgacatcatcacagctaaaatactccaccagctgtgtttgccacaagtgacaggttcagagtcagtggagactcagacagagagcatgagagggggagatgggagggagagagagaactcatatctggacttaattgaggttccaaaggctacatccttctcccctctgcagtgccttcctgaggggttttctcccctagcctgaagaatcttcctggtcttctcaactggttaggcactgctgacactgcacccacagagaaattcagaaatgtgcaaattgttgagcttaataagcaaaatcacaaatttgattggggaagttgtggaagaagagatggttttctccaaaacagatggcattgtgactctaggcagaaatcctgcatgaacagactcttgaggatgcctgaactcataagacccccccaacatcacacccccagggaaagcagtgtgatatagtatggtggtgacagacccaggggtgcggatttgggtctctggcaggacaagttacttcacctctctgagctgcagcactctcctctctaaaccaggcaaatgagttttgtttttctgtgggtttttgtgttcgtttgtttgcttgttttgagacagggtcttgccctgtcacccaggctgaagtgcagtgatgggatcattggctcactgcagcctcaacctcctggactcaattgatcctcccacctcagcctccccagtagctgggactatgggtgtgtaccactacacccagctaattttctgtgtttttttgtagagacagggttttgctatcttgcccgtgctggtctggaactcctgggctcaagcgatccacccacctcggtctcccaaaatgctgggattataggcgtgagccacggcgcccggccacgtatgattcttcataggagataatctcttgagagggttccgttttttaatgcttcacttttatactttccagaacagcacagcccttgtaaaaatttattagcgtcggttaacaaaaaaccaagaagagcattaagatgaacatgtactgacctcatgctaagcggcacacagacctcatgggaactaaagccatggcatataaaactgaggggtgtttagtttggggatgatttttaaggggctgaattcctcattaagactgtggaaagatgcccccagcattgtcccagctgacgctccagacgaggcaatgtaggagaaaaatgcttttccgtgtttgtcactatccctgtggcattgccctgcccagtacagcttttctccactcgagcaaagcgtctatgcatcccccaggcccccacctaggtgctgtgggaggaaaggggaatgccaggtgttgtccattgttactgcgtgcaccaaaggaagcctccttcctcttcagtggagggtgatagcacgttccccaccctggaagagagttgctgctttgccatgccttgattctggttgagagtcccaaaggatgacagaatcacttcccttgggcctcactgccaaatataatccacttaatatcctccaagtttgaggccataagtctgtggcgcatccagatgcgacccccgaggcgatagcatcaacgtgggagccaatgcaactcaaaagaaggatggggcttcgcacctcctccttgggtaggaagtaggttagctgcttggaaaatgcaggaactggcactgaagagatctgagtctgaacatatccctcacccgtcagtagcactgggaccttgtgcaatgttagttttcccttccctgcttcaacttagatggctcgggccctgagaaagtgattcacagctgaaaaataaatcaaaggcctcgtgttctaaaaagagtttatggaaggagaggcagctgatgaaagtctagaaagaaggctgaacttttccaatgagcacaataagccatttttaccctgcctgtaatcctcggggtggaatcccgcgagtggccgaggcgagcacccttcccgccgttcctgtttctaaggctaaatgatgtcatgccagcctgcgtgagcatatcaatctgtatttctgagtatgaactggatttgaggggtgcattggtgctccagccctccagatcagtaagacaaccaatgcagaaacaagggctcccaggctcctcttctgcaagaggctgttagtgacgtgcccgctgggacagccctgcccaggatggccccagctggggagcctttggcttccatctggcggcgttctatattatcccatccttctgtctcacccttcctaggttcagcttctctgaagagtacacagcatttgctcagtggagttgtaaaatgtattggtaaagtgctctgggttgacacgttcctttgcttctttcctaaatgccaggctctgtgttattagggccgtctgtcgcttcccagcgcctcccgaggtgactgcttccctgactcggtggctgcttaatattcagtgccatttcctcctcccgactgtcctggcgtgggtgtgagtgtgcctgtgtgtgtgctcgtacagcagttgttatcatgatgtacttactggctgtctaccgatggctttcctttcattctactattttttggttgacttctgtgagctgtgagtcatcggtggtaacattatgcattgaatggattagctggtacctaaaaatagccgaggccctcatgcaggcggcacatgagcctgtagagtcagtccctttgcagccaaggcagacccacttgccaacattgaacatgccgagcttggtggcgatgaatcctaatgtatcaaaaaatagatagttggtgactgccctgtgtgcagagcccagccctggatttgtgccgcagttgttggtaatacacacttcctgtctgttctggtgctggaaaggctccaacagagaaactatgtcaaaccacatttttgtttgtgggtctttgtacctctctaaaaaaaaaaaaaaaggagaaaaatgctctcctttaaactgtatgtgctatatgtgcccccaactgggtcatcttatatgttttgattctctcagactgttgttgtttatagcatttagaaaaaaattaaagactattgtttaaagcagttttaggtgtacagcaagtagagagaggtctcacacacctaacagttttccctgttattaaaatcttgcattggtgtgatagattggttacaactgatgagccagtaccgataccttatttttaactaaagtccatagtttatactacagttcactctgtgttgtacatgctgtttttgatgaatttatgatgtcatgtatccagcattacattattatacagaacagctgtaccaccctaaaaatcccttatgcatcaactatttgtcccccacaccccacctgaaactcctggcacccactgatcattttactctctccatagttttgcctgttccagaatgccatgcagttggaatcatccggtatgtcgccttttcacattggcgtctctcacttagcgatatgcatttcaggttcttccatgtcttcttgttgctctgatagctcatttctttttagcactgaatattatgttgttctttaaggcacattttttttttttgagatagggtcttgctctgttgcccaggctggagtgcagtgacaccataatagctcactgcagctttgacctcctaggctcaagcaatcctcccacttcagcctccctaggaacagggaccacaagtacacaccaccacgcccagctaatttttctatttttttgtagagacggggtcttgccatgttgcccaggctgctcttgaactcctgagctcatgtgatcctcccgcctcaggcccccaaagtgctgggattacagggatgagccacccttccctgcctaaggcacacattttaaggccccagaaaaggaaggcaagtgagctagaacctgtgtgcctaagggcttccgtgtcacagctgctgtggtcactcactgggcagtgtccttcctggccatccctgagcctccccacagggccttcccacaagggagctctgtgagccacgctaccatgtgtaagaaaaacccagcttttaatgtgggatttgtgttaggaggcgtcccggtgctagggtgtgggtttactgaacaaccctgaaacacttccaccaaggactgagtcaggctttgcgtgaacatgattcagtgttttaaatagaacactcacagagattcttacactcagccaaagcgttttgactgtttttattaatgatttttaaacattgcagtaaatgggtctctcgcttacccccttcatctttgagacggggttttctgatttttttcatgctgagaacgtaaccatgcagacttagccttccaggaaagcagaccggcctttctctacaggtaaaacaagactgagaatttcacttgcagacaaagttaagaatgcccaatttaataatttcgccaaaaaacaagacatacttactgaaacctagcttatgagagaattcattgctcccagcaacaggcgaaatttgtatgtctgggatagtgtcatgaaaaaatgttttgtaaaacagatgcccttcgcaatttgtgaaaacagggactcttgtgaaggaaatgggagacatatttaaacaacagacgttttgttttctttctatcttgtttttggtgatatgtacatatgtgtgtatatagacatagcaccaatctaagattgaaatatacaatcaaacagcataaatatgcgtgtatgtgcatagtgtttagatatagtagttattgactaagtggtgaaaggaattttattgaattttcatacagaggagctaaaatttttcttaaaagccagtcattagtcagattaggaaggtgacatttaaaaaataattatgagcccagaagtgagtcggtgttgtctccctgtctaggttcgtccatccaaaatgggagttggaggtgacagttctagaggagtcgatttagggggatggatggaggaaggggtaggcagatctcttataaccacactgatgagcacatgggcttgctggcagcagtgggaggagggagggaaagagtggaggagggtgggaggcggtccacccccaaaagcaagaggtgctggcgacagggcatccagagatgaaagacagagggccctcaagcttacaaaagtataaaggccatccctgggcgcggtggctcacacctgtaatcccagcactttgggaggccgaggtgggtggatcatctgaggtcaagagttcaagaccagcctgactaacatggtgaaaacccgtctctactaaatacaaaaaaattagcctggtgtggtggcaggcgcctataatcccagctacttgggaggctgaggcaggagaattgcttgaacctgggaggcagaggttaccgtgaatcaagatggcaccactacactctagccttggcgacagagtgagactctgtctcaaaaaaaaagaaagaaagaaagaaagaaaagttataaaggctattctacttactgcttagggtgtttgaaacaggatatatttactggatgaaaaaatgggctatattgagctgtctggcgttatgtaacgtgctttggttatctgtggtactgctcccatgagtttattttcattgggatttaatcagaaaccattctggaaaatgtgtggaaccccagcaagatcataaaatgacttaatgattactaacacagctgcaagaacgagagtggagagaaaataactgaagtgtgattcaataaaatcatgacgacctcagcatctgacaaggtgaggtggctatggctccgctgagaaagctgcctgttaggcggtaaagccacaccctggagaaagcactgctcctctccctgggggaggtcacagcccactttagttctggctggttaaaaaaaaaaaaaaaaaaaaaaaaaaagacaggcagtctctctattgccccctgttgtccacttgtaccattgcaatgtttttccatacagaaggcaaacagaactattctttcagttttttttttgttttgtttttgttttttttaagacggagtcttgcactgtcacctgggctggggtgcaatggcgtgatcttggctcactgcaacctccgcctcccaggttcaagcaattctcctgcttcagccttcagagtagctgagattacaggcacctgctcccacgcctggctaatttttttgtatttttagtagagacagggtttcaccatgttggtcaggctggtcttgaactcctgacctcatgatcagcccgcctctgcctcccaaagtggtgggattacaggtgtgagccaccatgcccggcctcttctttcagattttaactgagcacctattacttgctaggaagtcttttagactctggagatagaacactgagtttggggaaagaggcaaaacagacaaatatacaagtaaataaaaaagaatgcataagaagataaccagtcccttttggcaccagggactggtttcatggaagaagattttttggcaggatgggaagagggagggggatggttttgggatgaaactgttccacctcagatcatcaggcattagttagattctcataaggagtgcacaacctggattccttgcatgcgcagtttacaatagggttcacgctcctatgagaatctaatgcttgcgactgatctgacaggaggcggagctcagtctggaatggttgctcacctccagctgtgcagcccagtacctaacaggccatggactgctactggtctgttgcctgggggttggggatccctggtataaagaggagaaggggccaggctaggtggctcatgcttgtaatctcagcactttgggaggctgaggcaagagggcacttgaggccaggagttttgaaaccagccaggccaacatagcaaggctccatctctacataatgatcatcattatcttcaccaacaaaacattagctggacatggtggtgcatgcatgtggtcccaactactcaggcggctgaggcaggaagatatcttgagcccacgaggtcaaggctgcagtgagccatgatcatgctactgtactccagcctgggcaacagaacaagaccctatctcaaaataaaaaaaggaagctatggaaactagagggttgttattttaaatagaactgtcaggggagttctctctgaaaaggacagtgggtggcaacagtacgtgaggcaaaaaagattccaaatgaatggagagagtagcaggtgcccagacggaaggcgcaagaggggttaaagaaccagcaaggagaccactgttgctacagtgtagggagtaaggggcacatgcagaccacatcaggcttgcatgtggtgaccgagcgagtgagatgcagcttggccaggacaaaggtggtggaggtagtaaaaaaatagtatcattctaggtgtatttggaaaaggaacccatacagtttgcttataattgggatgtttgtgatgtaagagaaagagcggaagaaagtatgattccaaggtgcttgattgaacagccggaagaatgggataccatttatggagatggggaagaacatgggatggccaccgggcaggggcacatcgggaggtctggtgtgttttaggtcactttaagtttgagttgcccattcgacatctgagtggacgtcatcggatagtgtggtcactggtgtccaaatgtacccgttttgcgtgtatgttctgtctcctggtgggaggcaagaaactaggtcttaaccaatagatactcttctaaggttcctaacacttagcaggtgctcggtgtatacttgttgaacttttattaaaactggaaagcctgaaatgtatcattaggaaccctcaataatattttgaggccgggcacggtggctcacacctgtaatcccagcactttaggaggccaaggcaggcagatcacttgaggtcaggagttcaagaccagcctggccaacatggtaaaaccccgtctctactaaacatacaaaaattagccaggtgtggtggcttatgcctcccagctactcgggaggctgaggcaggagaatcgcttgaacccaggaggtggagtttgcagtgagccgagatagtgccactacattccagcctgggcaacagagcaagactccatctcaaaaaaaaaaataataataataacaatattttgaagctatcagcatcatagagaatacccatatgggttttaaattcaaggaattcacagacttattgttccagttgaagatgacatcatcctacaaaatcacaccgtctctgtttcacatccaaaccagtccccgctggcattgacagcatgttttgagatggagaaggctcctctccaagggaatttcaagcaacagatttgatgatatatattctcactgagaaacccctcagtgagatttcttcattaacggttaatgatcagttaacctttaagaatgtttatatccttatgacaaacctaattataaaataaagatagatttgctatgaatgcttgagtgtacctatttgagatgtgtgcaacaagattttaactttcaccaaagaagggaaaaaaaccttattttacttctcatacattcagaccccaagggggaaaaagtacattgtctaggtagttcacactaattagtgaggagaaaactagcattgggctggcaagctatccgatctgtgcctacaatgatcagattatctgaataatcttccgctcccacctcagctttcatggacccagctgatatctggtcgtggcatcttttcgcagggtgacacagctcctttggtaggaagcaaaggcagaatttaggcaaaaagaaacaaagagaagcctttgaagtgattaaagaagaatctcccaagcctatctaggttaacataaatttcattaacaggccaggtgggcgcggtgactcacttctgtaatcctagcattttgggaggctgtggcgggcagatcgcctgagatcaggagttcaagactagcttggccaacatggtgaatgaaaccccgtgtctactaaaaatataaaaaattagccaggggtggtggtgggcacctgtaatccctgctacttgggaggctgaggcaggagaatcgctcgaatccaggaggcagagattgcagtgagctgagatggtgccactgcactccaacctgggtgacagagcgagactctgtctcaaaaaaaaaaaaaaaattccattaacgtcatcttgttttagtacgcatctcaaatattctctctctccatcacttttctctcgtgaatttttcggcaggctgttctagctatggttcacaccacagcatttaattctaaggcctgtctttggagatttggagtttggtttggtttggtttggtttttagagacagagtcttgctctggcacacaggctggagtggtgcagtagctcgagtgaccctcgcacctctgtaactgaacttaggtttggctgctcaccactcaaaagccaaatacgagagatgaggttggtgagaggaaaagcaggtttattgggaaagccagagaaattgagaagatgatgagctagccttctaaagtaccatctccaggccaggcatggtagctcacatctgtaatcccagcactttgggatgccaaggcaggcggatcacctaaggtcaggagtttgagaccagcctgacccacaatggccaaacaccatctctactaaaaaatacaaaaattagccaggtgtggtggcacatgcctgtagtcccagctactcaggaggctgagacaggagaatagcttgaacctaggaagcagaggttgcagtgagccgagattgtaccactgcactccagcctgggcaacagagaatccatctcaagaaataataattttgtaaaaattaagtaaaatctccaattttttaggctggttggagggtttttatgggaggggggtatggggggagacgaaggggttagtatcgaggagactgaggaccatagacatttgggcaccagtgagggttcaagaaggttgagaacttctttgtccttggtcaggtcataatgctccttcagtctttagtatttttaatagagggtttcaccatattggccagactggtctctaactcctgacctcaggtgatccgcccgcctcggcctcccaaagtgctgggattacaggcgtgagccaccgtgcccagccactcctatcagtctttaacaatatatagttagttgtttatatacttcccctttaatcccagagttagtttctaaaagtacatgattgttgtttgtgtatattatctcggtgccataaaattatcctagcctacgtgcaggaaagggtaaaaccctttaaacaaaaatggagttagttatgttcgttcttttgctatttcacaattgtacctcagcctcccaaagtgctgggattacaagagtggtgtctttggagttttgagatgcggaaataatgaaaggctttcaaaatgtccaataacattatgaagtctttagagggaaacacgtgtatctgtatcctgacttttgcactaatcaattatagtacctgttataaagggcttgtagacatttcttaatgagtctacagatacttggtaacgtggaaatcctcagataagtttacctatgagaacacagtagatgttattttcagaaaattaaatattgcctgccctgtgaagtgtgtataatgtggctcacacaccaagggcctctccatgggtaggtgtccggccatctgccagcaaggagacagggagttatccgggaacacgcagaaccagaaaagaggctgacatgtttggaactaaggcttctggtcttctgaatgtcacattacctctgcctggtgttgggcaagaataagcaaaccgcaactctggtagagagtcttacgagacagatgttaacacctgagagttttatttttatgacttggatttgcagcaaaacaatctccacttgatgtgggattggtttccttctgttcagtttatgttgttaatgactctaagaggtttgcaagaggatctatggagccagttccagattggtcctcctacttagaatacagtgggtatccccatctgatacagtcacttgtaagtatatttgtctatgtatatatgcacatatatgtttctgtgtgtgatgtaaatgtagttttgaaaccaaatagtgtcacacacttgtacagggtaactagaattgtatgagtggctataaggcaaacactgcatcacaattatctgtaccatggaacaagcccatgagctcatgcctttggatcctacttatttcagtcaatattcaccactgttggggggtagcaggaatgcttagttcatctcttttggtggcattgtaatgtctttgctcacaagggtagaggtcaggaggcacagaaaaaagaaaatgggtttgggggccaatgactgggataaaatcctaaacccattagctaatagctatgacattaggcaagtgacttaatctctctgtgactattcgtaaaatttacaaaattggaagagcaatactattccatactaatactattatgaacattaaacaaaatactttttgtaaagtttgtacctgagagcttgacagagagtaggcactcaaaaacttttagcttgcttcacattataaaaatagcccagaacaatgaaactttcccccagtaatacacacaggagaaggggttcatgcttacaagctgccatatgaatgtactcaagttgtctcttctaaaaatatgccttgtatggatccagtaaagtctgtcattctagaaatgtatcagaactagatcaatcagagttaacaaaggaaacaaagaagatgaagtagaaaagcaacaatctgtggaaatctactacttttaaagtttttttggtacttcaattatgcatgtgtgtttttgtgtgtctgaatgtgtataaaatccaatggaggcctgacacggtggctcacgcctgtaatcccagcactttgggagactgaggcgggtggatcatgaggtcaggatatcgagaccatcctggccaacatggtgaagcccccactctactaaaaatacaaaaagtagctgggcgtggtggtggtggtgcatacctgtagtcccagctacttgggagtctgaggcaggagactcgcttgaacccgggaggcggagattgcagtgagccgagatcgcgccactgcactccagcctgggcgacagagcaagactccctctcacaaaaagaaaaaaagaatccaacaatattttaaatattgttacatatagccaatattcattcagattcaccatgtatctaccattttcattcctcttcattcctccctgtacaaacttcaatctagatttgttttttctctacctaaagaataccttttagtattttctataatgcagatctgttgatggtgaattcttttaattactgtttgtctgaacatgtctctattttgccttcattctggaaggatctttttgctccatatagaattcgccattgacaattctttttctttagcactgtaaagatattccattgtctccattgtctactggcttccattatttttgttgagatgtaaactgtgagttccattgttgcttatttggagataatatgtattttgttctagaggctttttttttttaatggagtttctctattgtcgcccagtctagagtgtgatggaatgatcttggctcactgcaacgatcttggctcactgcaacgatcttggctcactgcaacctccgcctcccgggttcaagtgattctcctgcctcagccccccgagtagctgggattacaggttcctgccaccatgcccagctaatttttgcatttttagtagagatggggtttcaccatgttggccagactggtctcaaactcctgacctcaggtaatccacccacctcggcctcccaaagtgctgggattacaggcaggagccaccacacccagcctgttctagaggcttttaacgatattttttcctgtttagtttacaagatgtctttgatttatagcagtttaattctcatctgcctcagtgaggatttctttttgtttatttttcctgtttggggctaggccttcttgaaactgtcttattatccttcttcagtttgggaaaattcttagccattacctcctcaagtattaacttctgccctattatctccctctcttcctcctcctaggattcaaattatgtgtctgttagcccctctcaatgtatcctatgtgtctcttaccctctcctccatattgaccatctttttgtctctatgttcactctgtggagtctcttctaaagctctaattagagaatccagttcctgaattctttcttaatccatgtctattcaactggaaagctcattgcattcttgatttcagtggtgtatattttaattctacaattctcatagaccttttttaattaattaattattattattattattatttattttttttttttttagagacagagtctcactctgttgtccaggctggagtgcagtcttgtgatcatagctcactgcaacctctaactcctgggctcaagatcctcctgcctcagcctcctgagtagttgggactacaggcacgcatcaccacactaggctatttttttttaaatttctgtagaaacggggtctcattttgttgcccagactggtctgaaactcctggcctcaagtgatcctccctgtctcagcctcccaaagtactgagattacaggcatgagccaccatgcctggcttcatggatcttttaaaaacagattctagtttcctatcaaaattctcaagctgtctttaatcttcttaattattgtaagcatagtctttgtaaagtctatatgtatgactctatatgagaagccctggtgcatccttttttaagatctgatattttgctagtgcttatacaagctatctggtctcctcatgaccaccaccccccttttttaaattgaatgcttttatttgcaaaattgtgaaagtaattcaagaccttaatccagttttagggactcagatgagtcaatctgagcttcagaccttgaaaggcctgttggcttgtggttcactgtctcctctaagggacagtgctttggggtcacaactcaaaagaatggggctcaccagagaacaccctcccttggtgtatcctgaactccattacctgttccctatgctcttaacactatcaaaagcccacttggtttcccaactgctccactttggaatgttcaagtgccttcaggagaaaacaggcccccaacaccagcttcacctctctgggccatcatcttttcctgatccaacccaggaagtgtgtgtgtgtgtgtgtgtgtgtgtgtgtgtgtgtgtgtgtgtgtgacggagtttcactctgtcgcccaggctggagtgaagtggcatgatctcggttcactgcagcctccgcctcccgggttcaagcgattctcttgcctcagcctcctgagtagctgggattataggcgcctgccaccacacctggctaatttttgtatttttagtagggacagggtttcaccatgctggccaggctggtctcagagtaaagtggcacgatcttggctcactgcaaccttcgtcccccggactcaaacgattctcctgcctcagcctcctgagtagctgggattataggggcccaccaccacacctggctaagttttgtatttttagtagagatggggttttgccatggtagccaggctggtctcaaactcctgacctcaggtgatccacgcgccttggcctcccaaagtgctgggattacaggcatgagccaccgcgcctggcctttttactatcttatttgctgtccagtactataagaaaaaaagtttaaacattttgtccagagtttttaaatttatttgtttgcttatatttttgttcagagtttttagttgtcctcagaaggagggttggtccaaattacctagtctactacatctagaaaggacattggaaattgactttttttttttttttttgagacggagtctcactctgtggcccaggctggatcgcccagtggcacgatctcggctcgctgcaacatctgcctcctgggttcaagtgattctagtgtttcagcctcccaagtagctgggattacaggtgcccgccaccacgcatggctaattttttttttttatttttagtggagacggggtttccccatgttggccaggctggtcttgaactcctgacctcaaatgatccacccaccttggtgtcccaaagtgctgggattacaggcatgagccactgtgcccagccaccaagcatccttttaggggctggggactcagtgataaacacactgtgcctgcttcttggaactcacagtctcactctgatccatgtttagtcctgtcctgtatgataatagcagttgtccattgagctcataaaatctaagaccgcgctgggcttgtgagccacctgcagagcctagcttggtgctgaaagctaagtgggtgctctgtcattactggggttcgattgactggttctaacagagaccagctatagagctaacacttgatggaatattttgaatattgatgaccttttcactggcttctgcctatggcaagtagaggtacaacccaaagagaagagcctcatttatagtgtgtggctgggggagagggaggtttgcaaactgagtcattttcccccattcagcctgtgtgtgtctgtgtgagttcatacctgtgtgtgtgcataaaatcaaacaagaataaaatgttttcatttgttcccttccttcttcctctctctgtctctccctgtttccacaggtcagcgttgaagttttggtagagtatcctttttttgtgtttggacagggctggtcatcctgctgtccggagagaaccagccagctctttgatttgccgtgttccaaactctcagttggggatgtctgcatctcgcttaccctcaagaacctgaagaacggctctgttaaaaagggccagcccgtggatcccgccagcgtcctgctgaagcactcaaaggccgacggcctggcgggcagcagacacaggtatgccgagcaggaaaacggaatcaaccaggggagtgcccagatgctctctgagaatggcgaactgaagtttccagagaaaatgggattgcctgcagcgcccttcctcaccaaaatagaacccagcaagcccgcggcaacgaggaagaggaggtggtcggcgccagagagccgcaaactggagaagtcagaagacgaaccacctttgactcttcctaagccttctctaattcctcaggaggttaagatttgcattgaaggccggtctaatgtaggcaagtagaggcagcgtgggggaaaggaaacgtggctctcccttatcatttgtatccagattactgtactgtaggctaaaataacacagtatttacatgttatcttcttaattttaggtttctgttctaaccttgtcattagagttacagcaggtgtgtcgcaggagactggtgcatatgctttttccacgagtgtctgtcagtgagcgggcgggaggaagggcacagcaggagcggtcagggctccaggcatccccggggaagaaaggaacggggcttcacagtgcctgccttctctagcggcacagaagcagccgggggcgctgactcccgctagtgtcaggagaaaagtcccgtgggaagggtcctgcaggggtgcagggttgcacgcatgtgggggtgcacaggcgctgtggcggcgagtgagggtctctttttctctgcctccctctgcctcactctcttgctatcggcatgggccgggggggttcagagcagtgtcctcctggggttcccacgtgcaaaatcaacatcaggaacccagcttcagggcatcgcggagacgcgtcagatggcagatttggaaagttaaccatttaaaagaacatttttctctccaacatattttacaataaaagcaacttttaattgtatagatatatatttccccctatggggcctgactgcactgatatatattttttttaaagagcaactgccacatgcgggatttcatttctgctttttactagtgcagcgatgtcaccagggtgttgtggtggacagggaagcccctgctgtcatggccccacatggggtaaggggggttgggggtgggggagagggagagagcgaacacccacgctggtttctgtgcagtgttaggaaaaccaatcaggttattgcattgacttcactcccaagaggtagatgcaaactgcccttcagtgagagcaacagaagctcttcacgttgagtttgcgaaatctttttgtctttgaactctagtactgtttatagttcatgactatggacaactcgggtgccactttttttttttttcagattccagtgtgacatgaggaattagattttgaagatgagcatatattactatctttaagcatttaaaaatactgttcacactttattaccaagcatcttggtctctcattcaacaagtactgtatctcactttaaactctttggggaaaaaacaaaaacaaaaaaaactaagttgctttctttttttcaacactgtaactacatttcagctctgcagaattgctgaagagcaagatattgaaagtttcaatgtggtttaaagggatgaatgtgaattatgaactagtatgtgacaataaatgaccaccaagtactacctgacgggaggcacttttcactttgatgtctgagaatcagttcaaggcatatgcagagttggcagagaaactgagagaaaagggatggagaagagaatactcatttttgtccagtgtttttctttttaagatgaacttttaaagaaccttgcgatttgcacatattgagtttataacttgtgtgatattcctgcagtttttatccaataacattgtgggaaaggtttgggggactgaacgagcataaataaatgtagcaaaatttctttctaacctgcctaaactctaggccattttataaggttatgttcctttgaaaattcattttggtctttttaccacatctgtcacaaaaagccaggtcttagcgggctcttagaaactctgagaattttcttcagattcattgagagagttttccataaagacatttatatatgtgagcaagattttttttaaacaattactttattattgttgttattaatgttattttcagaatggcttttttttttctattcaaaatcaaatcgagatttaatgtttggtacaaacccagaaagggtatttcatagtttttaaacctttcattcccagagatccgaaatatcatttgtgggttttgaatgcatctttaaagtgctttaaaaaaaagttttataagtagggagaaatttttaaatattcttacttggatggctgcaactaaactgaacaaatacctgacttttcttttaccccattgaaaatagtactttcttcgtttcacaaattaaaaaaaaaatctggtatcaacccacattttggctgtctagtattcatttacatttagggttcaccaggactaatgatttttataaaccgttttctggggtgtaccaaaaacatttgaataggtttagaatagctagaatagttccttgactttcctcgaatttcattaccctctcagcatgcttgcagagagctgggtgggctcattcttgcagtcatactgcttatttagtgctgtattttttaaacgtttctgttcagagaacttgcttaatcttccatatattctgctcagggcacttgcaattattaggttttgtttttctttttgttttttagcctttgatggtaagaggaatacgggctgccacatagactttgttctcattaatatcactatttacaactcatgtggactcagaaaaacacacaccaccttttggcttacttcgagtattgaattgactggatccactaaaccaacactaagatgggaaaacacacatggtttggagcaataggaacatcatcataatttttgtggttctatttcaggtataggaattataaaataattggttctttctaaacacttgtcccatttcattctcttgcttttttagcatgtgcaatactttctgtgccaatagagtctgaccagtgtgctatatagttaaagctcattcccttttggctttttccttgtttggttgatcttccccattctggccagagcagggctggagggaaggagccaggagggagagagcctcccacctttcccctgctgcggatgctgagtgctggggcggggagccttcaggagccccgtgcgtctgccgccacgttgcagaaagagccagccaaggagacccgggggaggaaccgcagtgtcccctgtcaccacacggaatagtgaatgtggagtgtggagaggaaggaggcagattcatttctaagacgcactctggagccatgtagcctggagtcaacccattttccacggtcttttctgcaagtgggcaggcccctcctcggggtctgtgtccttgagacttggagccctgcctctgagcctggacgggaagtgtggcctgttgtgtgtgtgcgttctgagcgtgttggccagtggctgtggaggggaccacctgccacccacggtcaccactcccttgtggcagctttctcttcaaataggaagaacgcacagagggcaggagcctcctgtttgcagacgttggcgggccccgaggctcccagagcagcctctgtcaccgcttctgtgtagcaaacattaacgatgacaggggtagaaattcttcggtgccgttcagcttacaaggatcagccatgtgcctctgtactatgtccactttgcaatatttaccgacagccgtcttttgttctttctttcctgttttccatttttaaactagtaacagcaggccttttgcgtttacaatggaacacaatcaccaagaaattagtcagggcgaaaagaaaaaaataatactattaataagaaaccaacaaacaagaacctctctttctagggatttctaaatatataaaatgactgttccttagaatgtttaacttaagaattatttcagtttgtctgggccacactggggcagaggggggagggagggatacagagatggatgccacttacctcagatcttttaaagtggaaatccaaattgaattttcatttggactttcaggataattttctatgttggtcaacttttcgttttccctaactcacccagtttagtttgggatgatttgatttctgttgttgttgatcccatttctaacttggaattgtgagcctctatgttttctgttaggtgagtgtgttgggttttttccccccaccaggaagtggcagcatccctccttctcccctaaagggactctgcggaacctttcacacctctttctcagggacggggcaggtgtgtgtgtggtacactgacgtgtccagaagcagcactttgactgctctggagtagggttgtacaatttcaaggaatgtttggatttcctgcatcttgtggattactccttagataccgcatagattgcaatataatgctgcatgttcaagatgaacagtagctcctagtaatcataaaatccactctttgcacagtttgatctttactgaaatatgttgccaaaatttatttttgttgttgtagctctggattttgttttgttttgttttttaaggaaacgattgacaataccctttaacatctgtgactactaaggaaacctatttctttcatagagagaaaaatctccaatgcttttgaagacactaataccgtgctatttcagatatgggtgaggaagcagagctctcggtaccgaaggccgggcttcttgagctgtgttggttgtcatggctactgtttcatgaaccacaagcagctcaacagactggtctgttgccttctgaaaccctttgcacttcaatttgcaccaggtgaaaacagggccagcagactccatggcccaattcggtttcttcggtggtgatgtgaaaggagagaattacactttttttttttttaagtggcgtggaggcctttgcttccacatttgtttttaacccagaatttctgaaatagagaatttaagaacacatcaagtaataaatatacagagaatatacttttttataaagcacatgcatctgctattgtgttgggttggtttcctctcttttccacggacagtgttgtgtttctggcatagggaaactccaaacaacttgcacacctctactccggagctgagatttcttttacatagatgacctcgcttcaaatacgttaccttactgatgataggatcttttcttgtagcactataccttgtgggaatttttttttaaatgtacacctgatttgagaagctgaagaaaacaaaattttgaagcactcactttgaggagtacaggtaatgttttaaaaaattgcacaaaagaaaaatgaatgtcgaaatgattcattcagtgtttgaaagatatggctctgttgaaacaatgagtttcatactttgtttgtaaaaaaaaaaaagcagagaagggttgaaagttacatgtttttttgtatatagaaatttgtcatgtctaaatgatcagatttgtatggttatggcctggaagaattactacgtaaaaggctcttaaactatacctatgcttattgttatttttgttacatatagccctcgtctgagggaggggaactcggtattctgcgatttgagaatactgttcattcctatgctgaaagtacttctctgagctcccttcttagtctaaactcttaagccattgcaacttctttttcttcagagatgatgtttgacattttcagcacttcctgttcctataaacccaaagaatataatcttgaacacgaagtgtttgtaacaagggatccaggctaccaatcaaacaggactcattatggggacaaaaaaaaaaattatttcaccttctttccccccacacctcatttaaatggggggagtaaaaacatgatttcaatgtaaatgcctcattttattttagttttattttgatttttatttaatataaagaggccagaataaatacggagcatcttctcagaatagtattcctgtccaaaaatcaagccggacagtggaaactggacagctgtggggatattaagcacccccacttacaattcttaaattcagaatctcgtcccctcccttctcgttgaaggcaactgttctggtagctaactttctcctgtgtaatggcgggagggaacaccggcttcagtttttcatgtccccatgacttgcatacaaatggttcaactgtattaaaattaagtgcatttggccaataggtagtatctatacaataacaacaatctctaagaatttccataacttttcttatctgaaaggactcaagtcttccactgcagatacattggaggcttcacccacgttttctttccctttagtttgtttgctgtctggatggccaatgagcctgtctccttttctgtggccaatctgaaggccttcgttggaagtgttgtttacagtaatccttaccaagataacatactgtcctccagaataccaagtattaggtgacactagctcaagctgttgtcttcagagcagttaccaagaagctcggtgcacaggttttctctggttcttacaggaaccacctactctttcagttttctggcccaggagtggggtaaatcctttagttagtgcatttgaacttgatacctgtgcattcagttctgtgaatactgccctttttggcggggtttcctcatctccccagcctgaactgctcaactctaaacccaaattagtgtcagccgaaaggaggtttcaagatagtcctgtcagtatttgtggtgaccttcagattagacagtcttcatttccagccagtggagtcctggctccagagccatctctgagactcgtactactggatgttttaatatcagatcattacccaccatatgcctcccacaggccaagggaaaacagacaccagaacttgggttgagggcactaccagactgacatggccagtacagaggagaactagggaaggaatgatgttttgcaccttattgaaaagaaaattttaagtgcatacataatagttaagagcttttattgtgacaggagaacttttttccatatgcgtgcatactctctgtaattccagtgtaaaatattgtacttgcactagcttttttaaacaaatattaaaaaatggaagaattcatattctattttctaatcgtggtgtgtctatttgtaggatacactcgagtctgtttattgaattttatggtccctttctttgatggtgcttgcaggttttctaggtagaaattatttcattattataataaaacaatgtttgattcaaaatttgaacaaaattgttttaaataaattgtctgtataccagtacaagtttattgtttcagtatactcgtactaataaaataacagtgccaattgca

SEQ ID NO: 5304 - DNA, 472379 bp, Homo sapiens
ttcactcttgactaatgctaatgtcattttcattcccaggaagcctgtcttgctacagtttggtggagggtcaagaaagatgattcagaagtatgtcttttaagagtcttggtgacacgcacagagcccagtgactttagtctgggtgtggtgagctgacctcagagtctattgtgtgagtgtttttcacttttgagtttgttttacttttgtggtctccccagccttatttgtgagtgcaatctaaggaaagtatatttgttttgcaagcacactatggtttgctcagatttttaaatgacatatgtaggattacaccctctttattctgtcagtgtttccattaaaaattcaaactttctgggatttattacacagccataacaaattgctccaggcagaaacttggcaaaccctctttagtgtgggagaaaaattcttttcagcattttagaaaagataaaaataaataaatgtttaccaactcaacttactcatgtgattttgtgatagggaagacattcaaataaaatacacattatatcttcacatttgtttgtcgtacaaatttgaaatattaatattagcttataagtcaacttttgctcaagagttgtacaactgtcccccccgcctctcaaatttttaatgattctaatgtttgattctcatatttggaagtctgattgctatgattctggcaggtgctggatcgcatcaactatgaatctttgtgtttcaacgtggtaaaaattaacagttttccaaaggtaagatctgttctgctctgatctccttgcacactaagatgtcttactcaattttatattctcaagtcttagttattgtagatgcagagtaagtgactgcttgtaaataaataataaatatataaacatattatctaagaataactttgaaaaacctttaaaactgtaaaaaatgctctggatctttagtctgtataatttccctcatttatgaatacctcaaagcactactgaaacaattaaatgactcaatgttatgaaagcacgatgtggttccataactttttggatacttggcttttaccaagtatgttatctgcttcaagggagtttttgaggatgcaatatggaagagtagtgaaaagtatgaaatactacgtaggtataactgaaacctaaatcctcaccactgcaagcattaaggagaaacccctaaaattattctgagtgtaaacacagcaaaaggcgcatggaccttaaccaacatgtatgacaccaaatgaaattaagttacctgatgtagggtccagtgaactgactctgtttttagataaacaggagctactattagggttgcctgattctgtgttatctttgtttttgagtaaagctaaggcatcttagggttgcctgattctgtgttgtgttatctttgtttttgagcaaagctaaggcatctttttcacttttgaggtccactttcttttaagaattcaagcctaaaactctaaagaagtttatctttattttattcaactttcaatctgttcagttacatagttgttatgacctggtaagcctatctgtgtttgctcagttgatttgcttcattttgaactacataacaggctacttccaatgaaaacatatactacaatgtaaaatctgtcatgatttggagagacctgtgcactggttttattaagcactcttgtgctccctctgctgccatgaagaaaatgttcatgttcaagaccccagtacattcctcagcagagcattcttttttggcaataatgatgcagatgtgtgcacttacagtgcagtagtatttatccaaagcatataacataataatttttcattgaaaagcacaaattaataagggctgtacttactaaaaaggagcaaaaaagaaataaatagaggaattaacttctgcacttgtgcccaaatttatttaggttgatccctgtggtatagaccagtgttcttcacatgataatgtgtttagaaatcacccaggggcctggttcaaaggcagattctgatttggtatgtctggggtagaacccttgactctgaatgtctaaaaagctcccaagtgctgctgtggcgactttgaaaactacactttaagtaagggtgtaatatgtaattatataatatatacttgctggcccatttaacaccttcaagagtagataccaccaaaacagtaaaatagatatgtgattacaattatttttcatggtatttaagcaatctatgacacaggatacgagtcaagctcatcaggccttatttatcgatttcctgtaatttcaaaggttgacttatgcttttacaaacataacaccagccttatgagtaggactatagtactatatatttgtctactagcttcttggaagctctgccctttttcattgagtttttatttgcacgagaaagtcttgtttctaaagaatcagtgcctgttatttgtgattgtacacttaatattttgccatctgaaaacaaaatatttcagtactaaaggtaatgagacagtttcatgagtatggtgtttatgttggatcttgcaggaagaaatagttacagattttggtggcagtttatggctttaaacttaatggctaagaaagtaaatgacacatttcttattaattgtttttaccatttgggtaatatacatatttagcttccttgagagaacatttaaattaattgactaactgtaatctgaattatgtgttttaatttaaggttgttaaaatcacgtaaattaactgcttgtgccaacgtaaaattacaatattagcttttttttaactgaaaattatctaaatgtaagatgtctaaaaatagagtggaggtggattggacagtttgcagattatgagttggaataaaaacatcgcagttaagccaaaaacatggcaaccaatattttctgttataaaaatatttgagatgaatttagtttttatgaaagctgtctgaaactgaaatgaatagcagaagctttctgtttattcacagtccagtaataataatacctgcagcacaaagcatacgtcttttctatataaagccaacaagcttctgctcctttctgaagtcgtctttgccaagcagggtgttgggggcgggggtgaggataggggtgaggggacattttacccggttatgctcttacgtactaaccttcaccttgacaaagcttgtcaacgaaaacaaaaccagtcagagccttttcaggaaactgatgttaactgtccactagaggctgtaatgagaccaacaatgtcactttagaccaacccgaggtttaaaccgtaacaataatcgatttttaaatggaaaaaaaaaagttgtagaaatgagtaagagtgaacactagtagttatacttaaatagccacatatatgtgcatggtatttcaaaaatgtgagaaaaaaatatttccggggctctgcaccttcctcgctcgtatgtttatttttatttatgaagcacgtaggctcttgcaggccagagttgtgtaaaaactgacactttttttttggtcatcctgtgccctgcctcagttggtgactaaccgttaggtcataagtaaactcagccaaaagatctctcaaatacagcttacagtcaagattggtggctttcagaaagaaacttacgcgaaaggatcatgtttccagacacttagttctaagcacctgaagaaggtcaaatgtcgcccgacacctaccggccttccagaatcatctgcaacaagaacgccgcactgagcgcccttagtctggaggcgcctcctagtcctccaggtgccacacctgttggcaaggtgcacccatccgaagaagattccttcgcgtggaggtcacacctggcggcgagacaggcggaggggcggggtggtgggagtcggagaccgcactgaaaccctgagtccagatttaagttcctcgtcgattctcgagaactgccatttgatgctccggttgctttctctgtctcctacactggttacctcatttccgattaaattaatgatccgaaattagctgcgagaggagtgcgcgggtctcctttccaggctagagcggagtagttccatatcaaagccgatttccggacctgcgtgcgaagagagaaagagggcagggtcgggcggtcgccagcgttcgccggcaggaaaggtgagggtacctgtgcagtcgggggaccccttgaaactttccggagttgcacgcagaggcaatccccgcggcccccaggcctgggttccggaacgccgaagcgacgccggtttgtggcttaacgtgcagctgatgatcagagtgagccctctcagatgctgctccgagcgcctgggaccaaggacacgtcgggattagaatgggccgacctcccctccccgctggggtgttgcatcggctcccagctgaagcctgacagcccttgggggagtcccccaggttgcctgagtagcgccccgttgtcgttcagtcccctccaactaggtgcagggacccagggaggcgcgcgaggaccgacccgtcaccgctcaaattacctcatcgcccagctccccgcccccttcccaaacctggaaggaaccttgccctccggtccgcgtctcccctcccccgcaccccatcccgagccactctttgggaaaggtgcccgcctccccgggcggcgcgcagcgaagggttaagggcgcgggccggccgccgcgcggtgcgctcgccgtgctctgtgcggctcgccgggccgcccgccagagggtgccccccacccccatgaagtcggatccttgagctgcggcggcggcagccaactgctccatatttggcttctattacacatttacatactggagcgagcgagcgagcgagcgcgagagagcgcgagggagggagggagggcgggcgggcggagggaggagggaggggaggggagcgggaggagggggaggaggaggaggaggaggaggaggagagagcagagtataccgcagacatcatttctactacagtggcggagccgtacaggacctgtttcactgcagggggatccaaaacaagccccgtggagcagcagccagagcaacagcagccgcaagacattgtttctctccctctgcccccccttccccacgcaaccccagatccatttacactttacagtaagtgactatttttttttcctcctccgattctttcccccctcccccattcccttctccccttatttagattaaaatccctcctcccccgatctcccgagaggggcaaaagcaacaaccagcaaacaaacccaaaaccccaatcggctgcacggaaaacagctggaagaggagcgaaggaaatcgacgcgtcgtgttctgtgtgtgtgcgtgtgtgtgtgtgtgtgtgtgtatgtgtgtacatacaaccgtccccggctccaggctcccgggccgacacccccactctgggcgcaggggcggccggcgggggggctgtcaggggctgggtgggcgcccgccgggctagggggcgcgcccgggcggggggcgcgggcggggagagcggcggcggcgccccgctcccccggctgctggtccggtcgcaagtgcggagagccatgtcctcctccctccgggtggcgcaggggggaggcggcggctggggttggggggtggtccctttcccggccgccctcttcccattcctcctccccggagagggcggtgagagagagggggtctcacggagggctggacttctccgcgggtggtcgcccggcctcggcgccctggggcgggggtctcccctcggagggccggcctcgccgggtgtgcggctgcgggcggggaagggactgctcctgcagccgggacgggactttgcgcgcggccgggtgccgggcggggggcgcagaggggtggcctcggggaccgcgcgggggtagcgggtgtgcgggtgcctggagcgcggctggagtggcggtgacggccctggccgccgccgccaccgccgccctgttggtgcggccgcttcctgatcatgtgcagcggcagccgccgcccggagccgggagcccgcgagcgccccagtccgggccggcgcccccgccagcacccgcggcaggagacgaggagccgcggcaggcgctgccctgagccgggagtgaacggctgcgcggctgctgggagggtgaatgaagccaggaggaggggaaggaggaggaggcggcggccgccgcggaggaggcgctgcggggattgggatgcgccctggagccccactgctcgttcactctgggccgggccggagactctgccactcccgggggcgccgccgcctcctcctacgtggttccagtgctgcgcgcaggccggtcccgcagggggcagggaagggggccggacgggcggagcgagaggtgaggcggtgtcggagcgcggcgtgagtgtgagtgagtgtgtgagtgactgtgtgtgtgtatttgtgcgcgcgcgcgccgggcggggggcgagggccgtcgcgacgcggagggggcccttccttggctacttggctgactctgcagcgccccgacccctcttcagccccccgccttcaggctgccttcttaaactccgtggcttgtgctttcattttgtttcagaccacgtagggggctgactgaaagggatgaaacaattcaggttttctagggagattgagcaagaaccttagtgggggtggaagtagggtggtgatcgagactctgccagaaaacaaaacaaaacaaaaaaaaatccgtttctaaggacggcggggattcggttcgagcccgtggctgctctgttttgttttgctttcttggtatataatcctacagataaaagggtaatataaatatttgagaagagggaaattgctgaagagtagtaagggcaaaaaaaaaaaaaaaaaaaaaaaaaaaacagtcggaagaagctggttatataatgcgcgatgtggctaacaagaaaggcaagctatttttattttgtttaccgtatgctgtgcagtagggactcctccaaactggttctgtccccgaagagattcttagcttccctgcgagatccacaggatacaattagcaaaattagaagaccctattacacccacagaataaaaactaatgccttacagtggctttctccctgcacatcctgtcgtgcatgcacgggaatgtgtgtatgcaaataagttctcctttggcaatctagtagtcacatctcaatgacatttgtgttttataatgcaggctgtttttaatatttaaacatcattgttatatattgcacacagcagtgggtagttacttggttatttttaggcacagctagttactttttcaacagtgttagctgagacatttctgtttgggttttttaggaggctgcagttcctagaagccccccttaagcccacccttcggtttatttgatgggtaaaggtagtttgatacttgagctttttttggagtgaagcttatgtctgaggaaaccaccagagagaagagaaaatcctgcacaggaactcttggaaagggattgcaccataacggctagcgctgtggcatttaatctcctctgattgccctctcactgtgcatgcatcagtcaatattttagcagctccgcaaataaatggacttgaatgccatcttctacataaagcagaggttgaagggctcccctgaacctcctggctgcctgtcagtggtgtaggttttcggtgcacttactccagtcctgatcactcatgtaattagatcaggctgccatggcaacagacagtgttcctcgtccattcaggtgggtttgtcttgtgcctgaactactccaagtgttttatgcacagcatttatgctgcccaagccagacgagagactccactatttcaattgcatcttctttcagtcatttggatgggagacactgaatgaggcttctagctactcaacttttataaaggagaccaacaagctgttcttcctaggtgcagtatgtaaatgcatctccccagacagtgaaaggagcctgacaatcctgctggtgtttattgtgaacagatcaacaagtatttggtacttgttagaaacctttcagagctcactaaagcaacatttcttttgcagtctggtgcctttggccttgcagtcagtcacttaaccctttcaagtgtgaagagcgttcatcatttggaacctccattgcccatagcgatggctggatttctaaagggtttactcaggggaataacttattcggaaaatatattcccattgtcacattttaaaacttgacagccatcataacaaaaactggtactgacagtaggcagacattctgaatgtattcattcttaatttggatctattggctgtgatttgaatgatctttggtagtaagttaaaaggatttttttttccttagctaagcgagaaacgatagaggcctatagctagaggactgatagtgcatggtgcttttggacaataaacatgtactttattttaggatgtaatttagtgagcagttagaaagcagtattctagtctttgcattagggcaccactgataaagctggctaagcaaagagaaataatattatggcaaaaaggaaaaaaggaaaagttgctttagttgctgaagctctgtgctgctcaggcaatccaactaagtggggcagggggcgggcgggggggagtattttcataaccctggtatttgaaagaaaagataattgagaattatgtcttgatttagttgtgactgccagtcagtttacaattttatggccaacaaagctaaactggtaaattttttcccccagggctaggattgagagagctactcaactctattcccagggggtttatgagtttttaccgttttgtgagtttatgtggttggtaaattcattgtggcctggtcagatgaagcactgctgtagttaaaatgagctattatttcttctagctactcaacttttataaggtggtaaatagatgggaagcaaggatgtcaatattacacaatgccttggaggtcctggattctattttgcaacatatagaaaaatgctttacttgcagtaaaatgtgaacatatatttttcagtgcacaaataaattcatgtgaaaataagtataaaaaaatgtacctggtgggaaccgccaaaggcaatatttttccttgcggatttcgttttaagagggtttggtaaacagaagtgacactttgtcaaaaatgttacgactagacttcaggacttctgaattgtcttttacacttagaggaagattaaacagaaactctttagccacaagattacatgtcaaatgcctgtaagtttcaacatacctaagtcagttgcctaggagtcctgggaaaggccagtgctgagattattgaaatattagtaaacattactatgactcctgtttttgttgtcattatggagtccaaggacgcacatttctttgaataatgttgtgcctttattgtttttcattctgaaatgtcaagtggattttacttttttgcacataccttgagtgacagtttctgatgactaacactaacactcattttgtttcctattaaaagttaagcaataaacatattttactaaaattctgaaactcacgtaagtaggtaaatgtgggagtgaatgttaattctttaaactgtagttatctgaaaataacacatagattaggatctgaacagcttaaatacttgcatcggtaaagtgacaatagtgaagtaagacaggctattatttttaggggagagatagattatttgactttccttgctctgtattttcagagtaattcaatagttcgaatgattagtttctgtgagagatttagatctgtgcagcttaattgcttcaaataacagatttagttctggtcatacttccaaggttatcagaagcaggccctccttattttgataaaagcattgaaagcaatacattgtagaaatggtaatagaaataataatttctgttttaggaccttacatatagaacttccttttctaagataagaattttaagtcatcaattatgttcacattttattttcatgtaatttagtttaataaaataaatgtactcattcaaaatttttttaagaagtgatatacagtgtcagttttacagaattttttaaatgttggctgaaagaacggtaattacattgagatttttaaaaatatataaatgcttaaaattacagaagtaataaaaagaatggttttagacaaatcttatggaaagttttttattttattcttttataattatatttatggatatttgtctttattagtgtagtaatatattttataacgctcataatttgaactttcaggctaatgtactataaatatttgtattacgcattactaccatcccaaatgtaccaaaacacgtttagagagaacaattatggacaaaaaagcaacaagcattatattttgtttgacatatttcatgttagcagaaatgtttcattgatttttctgtaacttttaatgcatcccatttgtggagtaatgaaaatgtaatgataattgccacaatgtaagcaaaaattgtatcctacctgaaaattactttccagaaaattcatggtagtgtactcagaatttgagactcaagagggcagaggtttccccgattgtgatgttttgatttgggctaagaggaactctttttttttttttttacacttaggtgccctttaacatgacaagttttgaatgagttaggtagcagaagtttttcgtgacagttattgtagctactaacctatagcatctatccttctaacgttcaaagaaaatatatttttctgtcactgtgtatggcaaactttattttcttgtgcccttaattttgttcccctttctcacattatctcctggtacttactgaccattacctcagttttgtttaggccgtctttcttgttaatcttccaatattaatagtattgtattatgttgctctgctgggttttaaaaatattgagtattccatttttggtgtatattattgtataaaatgtcctataaattattttctggtatattattttgtaagtttttgcagtgaatacgtgctgccttgcttgtattcttgccttcttccctctgatggaatacaagttatgtaaactctctgtattatcctaactagtgcagcaacacaaatacttttgaaataagaaagcatactcatgcaagagtaaagtaatcttctatggcatttacatcatgtttgaccctcctctgcacttcagcaaactaggaggaggttgtaacttggactctataaaaccttatctgccaggtgatatgtaaacaggattgtgtgcacacacattgtcatataggcaaacactctcccaactggtgagctcataaaaagcactgtctgtaaatttatggtacctgcacctcatttgagaatcaagtattttgatgcttaatttgagatgacatcatgatcctccctccctgcttcctcatccttaaagaagtactaagattaaatagaattttgtcaacttctacttaacttggccattatttatatttgtaactcaacaggcttcttggtggagggactgtgccttctaaagatctgaaagaccttatagtgtataacagcttaccttccttctctgtacgcacagatcacatgtggggaaaccaaggactacaagaattccttcttttgcatatcagtcctcggcaggcaatcaatgcttaaataaatgcttggtgaatggattagttagaagtaagaacattttggctactgttcattactttgaaaagtgctggaaagaagtggaagttattttcctttccagctgggctgtgctcttaaaaatagtgagtgtgtatggatgaaaataatcatgagtaccgagatgtgttgccatgtacccaaggataattggctcacttacctgtttacggattattcacattggagatcatattcatagctccagaatagtttctttctgacatccaatataaacctgggcctccttcttcctactgttacctggcgtgagcttaggaaacccaaactaagtttaaaatcagcctaagcaaatgtgcagatcagctccagtaatcaaagactgaaaatcagtccagcattcactagtttggggatgattttatagtaaccctgctactgattttaaaaaaatttttttttctgtttaatgtggataattggtaattaccggtatttaagaatataattttaatggatagggctaaaaaaatacgttagcagatcgagtcctcaacttcttccgtttctatgcataggttttacctcacaaaaactactacaagcaccaagctccctgatggaaaggtatatggaagattcattcattctttctttcattcatccattcacacattcactcattcatcatacaatggaaaatttttacttaaccatgtgcaaggaattgtggcaaaatgaaaatgagatgtacattcagtatttaaataaagtttagtggaaagtttagtgaatataaatgcacactttacactttttttctgcattttttcctttcttctattccattggactggtatgctaatagctgtgcactttcatcattgtgtttcaagttgcatgttgatagataatatatgccacattaaaattaggctttggctcaattactattcaatccatgcccattttcacctgatactccttgtagttaccagcatgtgtttatcagatgattggctagaatcattggagaaaagaatgacagcggctggctcaaatggggagaccatcctcttaatttgatggaagggatgacctttttgtatgttggcctccctctgagccttgttgagtaaaaccagacctgccttttgagctggctgggatctgtgtaattctcatacaacagaatgccgaatgtgatgttcttaaaatttgtatttcggtgcatagacacttaaggtggacttattttttaaagcagtctattctgtttttcattttggatttcctctcctgcactccctcgaccattgcaggagcatcgtgcatcaagtcaccagggtggtccattcaagctgcagatttgtttgtcatccttgtacagcaatctcctcctccactgccactacagggaagtgcatcacatgtcaggtgagagttttgcgatgctctctgttttccatctgaggataaagtcctgacctggaaaattgcctcctagccatgctcccttactttgttggctgttgaatatcattttctttgcaaactctgtttgggcatagtgtgggaagttgagaaattgccaagattgttttttaaaacttcgattaaagtatctatctatttggtttaatctatatgttcatgaagactttcatttgactttgcgatgattgataattgccaattggggcttgaacctcatcattttaattgtcagttttccttaatacaattaagaatgctatgctaccagatatcttaagtcacagtttttgcattttagattactgttgtagtataatatgtgcgtagcaaaacagagacctatttgtttaggggaaccagtatttgttgaatcttgaatttctttgtgtctgtttggattttacaacttcctgattttcccacgtacagtaagtttttctggcctggagagtcatgcagacatagggtgtatgcaatggtgatgactcatggttctctattgaagaaagggccagaggatattgcctcaaattaaatcaggaaggaaaaagaggtttgctagaacttggggcagtaagggcttgggaacacaagggtttgagtgtatgtaaccaagggagattgtgaaatagaaaataggggatcaatttctatttgccttggaaatggacctgcttgaaactgtgaagacagactagattagaggttcccaagcctggctaggcaacagaatcacctggagagcttaaaaaaatagaatttggagctccaccctagacttgatgaatcagaatgtttcctgctggaatcattgatctgtctaggcactgatgctccacaggtttgggaacccctgggtcggccggtcttccagcaactcttcctaagttatgttctgtagacttagttggtgagaagctcattctacttttagcaaatctcccatttgaaaatttgaattttcaaaactcatttttcaagaggtagatggatatttgctttataacaggttcatttaaacaataattgaccagatttctttgaagaaagagctgcctctttaccgtaagagccaatttttaagttacatataaattctctggcatcttagataagagcatggagctccgtaatcaacccatctggacttaagatctggagctgccactatgaccttgagtagtcctatgtcctttcaatgcctcagtttattcatgtataagatggaggtaatattagaactttcttatagggctgctgtgaggatggactggagtaaaatagtagatatactgtgggtagaatagtacctggtgtatggtttgtatcttttaacagatgctatcaagtaacttatccctcaacaggttgattgttatggtcatgttttatgatggttgctcctgaaccatacatgactagaaatatgtaaatatacctggaccttggtctttggacccaccctgtagacatctacggctctgcaaagccaaggagccttttatttgtttttgctgaattttaaattctgaatttatcacaactctctgactgatgggatgcatgtgtggtttttttttttttagattgttgtaaaatgaactgatgaattgcatgcataaatgtggttatttgtggtctgagtaaaaataaacaaaaacctgagtgactgaagtattatgcctcaggaaaaacagccaaaaaagtcccagtgggggacaaggtggaggagggaagagtcatcacagacacgatactcttgtaaaatatggaactggattccttacattttattggctgtggattagagaggtgttctttaagtggaaatgtaacctaaagttacatgcaaaggtaagcctcttaagatctacaagtgtcagctgaatgaaaaaggtagggtgggccaggcacagtggctcatgcctttaatcccagcactttgggaggctgaggtgggtgaatcacttgaggtcaggagtttgagaccagcctggccaacatgatgaaatcctgtctctactaaaaatataaaaattagccaggcattgtggcaggttcctgtaatcccagctacttgggacactgaggcaggagaatcgcttgaatcctggaggcagaggttgcagtgagcccaggtctcgccactgcactccagcctgggcgacagagtgagactccatctcaaaaaaaaaaaaaaaaaagagaggaaagaaaagaaaaaggtagagtgtcttactgctactttatctcttagggatgatactcattttaacggttatgtgctaggctgaaaatcctcacatttagatctttggggaaatagtttaattgcaaatgggttgagtacacgtgcattttttttaacctgtggtgttgaaagggagtcatttgtgataacagaaatatctcaagaattttattgtgaaaaaacaggcagcaaaaagtcatatctcttggtcaatatgggcagcttattgagaagagacctaggtttttataatatgttaggcaagtttaagtgtcttatgaatactaaaatactgacgaagtagcgcaaagtcaccttgaattttaagcgctgacattttctatgattgcatttaaagaaagcttataagcattatctaaacattttgcatcaataatggcctcattacagtcctcacgattgacggctcaacgtaggcagaaaaatagtatcattcatgttgtactcttttatattcattcagtttttttcttaaacctacattatagttctttctggttctagttattttataaatatgatacagctatagcaagttatgacctaacttgttcacagtcactatttatgtaaagaaatgattcattcatttattcattgtgaatttttttaaaactactgcatggtgctgtgggaatggaagtgaataagagctaccggaaggcagttattttcttcctggtcaggcaggggaaagaagaaactctctgaaataatgaatacgaatagaatggggttctaacagtgttctaacagtgaaggaattcagaagagtgacgctgagtaggagtgatcaggaaagactttgaggaggagggatcacttgagttgagctctgctgactagattgcatttctgtgggaagagatggatggagcatgaggaaggccatgtgtgtgtctgggacataacaagccaatgcacggtatgtaactgaccaggacattttgactgaagcctaggtgctggtggacatctgaatttctggattcgagcagacagtagagagtatgggaataaaactgccgagaggtcaagtctgaagataaatttggaggagtccttggcataaaagtgatctttgaaattgggttcttgggcctggcaaaaagtttgacacccaggagggggatgactgaattcagggatgacgtcagctggtgtagaatgtgtagagagaaggtaagaggcagcggagagtagcttcaacattgatgtggcatggccttcgtctgccttcttttcatgatctggggtgaaggaggctgggtggctggaggagttgggtgatgtatgcgtgggccataaggactcttctgcagctcaggcaccttggaaactcagtgctgaactacagttcaatgaaatcttgtcaaaacctctcttcctttaagacctttaaaaaaataggaacttgagctaattttagctaaatctaatgtgtgtgtgtataaaaatgaatgctgcgtttgaaattcagcgtatgcggtatctcgttaaacaaatgatccttctattttcctctaaacagttttattaagattttcagtgaagccctgtacgttttaacaacaattccagcatttctttgatcttttctaccgttgatttattcatctcacatgatatgcgtaaatcacaatgtgccatctacttgactctgtagcaattgttcatttgtggcaattcatttactgtactttgataaaccacattaatttgggtgtgttttgtaactttagaggattccctggaggctttctgcagactctttaaaatgtgagatgtgtgtgtttttgtgcgtgcgtgtatactgtatatacctagctactagacacagctctttgaacaatttggcttcccatttatactttatagaaaataaagagatatagaattggtgaatcttgggtctggggagaaagttagtctaagacttcctgatgtaaagtgaaagagaaggctggagatgatgttacgatgatgttagtgagcagtctgatttaatgtaatgagagaaaatttgaggattaagttgtggtttttttttttggtgctgagttagttaggatgggctctctgtgtagcccaaaagggctcagaataaaagcagtgacttatttaactttcatcaaagacaagaaggttaagacaggaacaagagggatggagcaaacaactccaggggcagatcgttcttgtctgcaattatttaatgagcatctaatgtatgagacgcattatgccaacaaggccctctagggaatatggagatgatcaatagttcacatttactattctgcatattaacttattgaatcctcattacagtcctttgaggtaggcatcattattttctccattgcacaggcgaggaaactgtggcacagagagggtgaataatttccccaaggtttcccagctgttaagtgatagaatcgtgcttggatcccagtctacactctcagccctgttccttaagccctgtccttaagaagcttacagtcgagtgcataaggcaaggcatggcttggagtaatatttaaagagccatgacacaggtaacacagtctaggaagtcaggatcaaggaagggtccttccttggagccttctcttttgatgcctgcctgtctgttcagtcacatatgagctttctgacacaggctgtcccatgcaggctttgtggtgttttctccctttctttcactcttactcatatctccttgagattcctatgcactttcaataattattaattgaagaaaatgatgacagtggcaatttgcttatccgtttcaggggattggcttaagttggatccaaatgttattcagcatcaagagtctcagcgagatgatgaacttttgactcttaaaagaacttcactgggtcattgctcagcttgcaagatttggcagatatgaactatttgtctctccagtgtgataggtggtggtgtggcgctgaacgcaagctctaagaataaaacgtgcagcaaaaggaggtcacgctttagtcagggtggccataaggaagcttagaactcacatcccctctgcccctgcctcgcccagtctcattttctctccttcactagaacagtgaatgaatctgagctcattcatgtcaagatgatagagaagaaagatcactttctcttagctggcttagggaaggccagattgtctttcttacactgagtgaaaaattactgaggacttttgttttttttttttttggtcttcaaggcaacatctcttgcttttacagacccacggaaatcgagaagaggatgcaagatttactattcgtgccctagcctggcagcttcagcctacatcacagctgtaatcatatgtgatgcatttttatttacagattagtaggctctgactctgacatatgactaaccgggaagctcctccctgtaacagttgtatgtcgtctgcttcagagaactaattgcttggcaattcccctttggtaattccctctttattttctgatgagttacttaacagcgatgggcttgttgagcagagcgtggagtttaatgtgtgctccagaaactccactgtaggcctgggggatatgtttttcgagttctgtttagctttactgaaggaacagtgaaaccattatatggcctgttaatatttcactcaataccagattaaacaccgagcagcgtgcagttttccaaaagaaatcaaaaccaggcttctttttaaaatgtgcccctgtgcattagaaaattattaaaaaggaatttaatatgtatagaatgtttaatgatcttttgaaaatatggtttcaaatggagtagtcttccaggaccctacagagtgagtatggtgtgctgttggactggtagtttggaggctcagtttctgttgcctgccctgcaacaggatgacttgtgctactcactgtaccttgctgggtctcagttttcctgtctccaaaacacaaggaggttgaaagaaatgatctctcgggactcttctatctctgacattgtacagttccatgaatagattttattgtaattcttgctcccggctcccccaagacctttgcttctgtcaaacatcatttgctgttgtttgactttgttagattttgtatttaattagaatttatattttagctattattatgtcattatttatagagtaagtcataagcggtgcctaaattcatttatcaccccatctatattagtttcatacctgaatacttcctccgctcctttttactgttcttgctaccatgtcccaaacaacatccatttctggaggtggaatgcagtataactggaaagaatctttcagctgattgtgggattattttttgcaagaggagtgcagaagctctgcttttctaagcagtaatatcaagggccatattctgcttttaatttgcaagtagaaatcgttttgatgtcatttggttttacctgcaggtgcaggttttagtctctaggtaattccttttctcttctgcgtcaactttcccaattagtgtgtgcagcattgccttgtctttttggttaattcataagcagttcatacagatgcctcttgattcattgcaattattaatagtttctttaggcagctagtgcaaatagaaaaggtgacatttgagagggtttgttgttttaatttatttgtttcatagacagagagggagggtgaaaatgaaggctttaaagtcagggagattgaggcttgaatccttctggctctggctcctggctttgtggtccaggtcacattccttaaatctgtgatcctcaatttcctcatctgttgaatggggatgataatatcacctaactcacagaatcactggaaagattaaatgtgcactcactctctagatgttgcttatggtagtatctcaataactaataaaaacagacacacacacacacacacacacacacacacacacacacacggaaggcatagcatttaagagctgaataaaaaaagcaagaacaaaggaaagtgctgcatttgaggtatagtcagggtaggaggagcttctcagagcagccagttttagtaggcagagtttgaatctcaaaaggacctttgaaatttgggaaggactaagcaccctccactaacctgtcagtgacgttttctgcaggtagctcttgggaaggactaagcaccctccactaacctggcagtgacgttttccgcaggtagctctgctctacagaaaagagtgtttactacacatgactgataaaaataccatgtttttaaacatgtattgcccaaaccttacaataataaaggaaagccaataaaagcaaaagttccctttgattccaccattccagtccataaatcaagttcatttttatgtgttgttttttagttcttgatgatgtaacttatatctttttttcagttttgtgtttcccatttagcataaacattcttagtaacttcagctatacagttctcatttgcaaggatcacataacattctatcaggttgttttatcttaatttttaagtttcctatcatttttggacattcgagttgtttctaattgtttactgttgtaaagccgcagcgaatgtctttgcacacaagtatttaccgaggacacactcacatcagaaggctcaatactaagttagagggagcttgctctgaattgctttctaaaaggctgtaccaatttacattgttactaatgatataagaatgtctctagcttcaatcttaataattgtgggacttactattttttggctaatttaataggctctttggttttaaagttttcattcctttgatccctctcagagatggaacatttccatctgtgtttatttactaattgttctttttacaattagcaaatggaagtcttgatgttttctaatctatgtatatgagctctttatatgttctagatattaatccatttaaaaagtcctatttgctacagctacttccctagtccagtgtcctttcatttcagtgatgatgctttttgttgtacaacggttcaagtttttatatgatcagcctctcttttcttctacttgtacccagggccaacctggcaggaataaatgagattaccgcagctcaaattctgcaccaggctggcgagtggtccactggatggctttgctgggaatagctctttctttcttctgctcacttttccccttgggaactgtttcctgttgaagtcccagtctttctatttccaagggcccctttccccttctcccacctgcccctcactccttgattctcacccaccctgtgccggtttcctggctgtggcatcctctctgcccagttctcaaccctccgttgctgacctgtgtgtttctcagggagccctgtcctgggagcagtgggtagaaacatgtctggcagcctccctgactagggcctagagagatcagtcaggaatctcaggcctggccaaagtctaaccattatccaagtctctggggtcggggtctttacaacttctgtcttacatttctgctacgtagcaggctgccctgctaaggaatgggctccttggcgctggttttcatccatgtaggaaccagagaggcacgatgctaccctgattcctttcctgttgtagctcttctccggggatagctcttccagtggaaggttgggaacaacttcctagggattgaattttttgaggaaggctggtctcaaagtgtgagttttagctgagtggctctgctgagctggggtggtttggcatatgatatacctcctaaatggcctgtctagatgtattgttgttctggtccaacatgtttttcctctttgaagccaaaatgaacatttgttagtatttgaaatctgctgacatctctgtttttcttaactccctccctgggttctcatggtcctcaggataaagtctagaatccttagcctggctccataggttttgaggaccttccttatctctccagcctcatcactcacatgttgccctgtattcgtcccacgtcggtcccatcgcacttcctccttcaagtgccatactctgttttttgctccagcctttagacatgttgttcttcctccttagaacccagctcctctctctgcactgtctggctacctttccctcattcttgaaatctcagcttagagtctcttcctcacgaagcccttggactagggactatgttatttgctaccttttctgggttcccatagcaccccattcttccccttgtataatacttcacaacccctttcctggcccagcgataggagggactgccctctttccagtatgtggcatctagtgaatgggcaatacatacgggcattccccctgtgatgcttatgttacaaattggatgtgattccatctattaatatggactgtgatgtatataattgtggtgtgtataattgtggtcaggaaccagcatggggtcctgtgaaccacagtggtggaaaaagctatggcacctgtttgttccactggctttgtgctttgtccatcacacagtgagtgaaaaggtgacaaaaatgtgtaagaagcctgtgctaaggagaaagaaaggtccaatgatgaattttctggaaagaaagctgtacgtaatagagtgctgaattcgctcaatcatatttaagttttatagtactgcacttataaccacacaaaacactattattattgaaattcaatacaggaaaaatgcttttgtttttgaacgtctaagactgtcttcctcctcattgaaaaaattcctactgaatttcgattatatgaagatttttagaaatgcagctattgcatcgaatgaataaatgaatttgaggttcacgttcttaacatctgttttctgactttgatcagtctcctttaagtgctctcgtggtcatactctgcaactcaggtgaaagtttctagtgagatagttatcccaaggagatacttttatctggaagagagtagttctgaagttctaagtgaggttggttggttagatttaggttaaggtaccacatggaaaggagaactgcttaaaggggtagggtgaccatgaaaccttcttctgcaaaccctgctcgtcaagtatgaaaccggtggggtaggaggtccatctaatcttatctgtgcccttttgagttggccggccgggtgaccatccatctcctctgggttgtaaatgacttcatctcgaagttgcactgttggtggtaggtgaggacgccttctccaggtggagggagtgcatttgtggttgatggtgtgagcgaccatatgttggaccatatgtcagaacctgttaagagattctgacaggtatggaaatgcctcccattggaaactgaagccctgggtcctttgaccgctgcagcacccccagaggagagtaccctaaggcccttttaaccttgccctgccctggcaggttccaaggggaggcagaaatgactctggatgaattttgttttgattattcttccccttttccaggctctgtgtccagttcacctctggagctgcctgggtcactgcaacccagactagagagaagtatgaccccaagttgtggcttttattgggagacagccttcatctaaggaagtgggaaagaatgtgttccccagctgctgcctttctggtgtctgatctgatacttttcaaaagatagcagttttgtttggtttgatttggattttttttttcttttgtaagtggtcatagacccataagacaagtttattattgtattgacagaagaaaaaaatgccatggttatttatttaaaaatctctttccatacaactttgctttctattgagtttgaaggaaatatggtgatggcatctaagcccaaatttcggtgttttattttggctttcctgttctgtttaagcctctgtaaccccttgaacctttctctactcttcagaaggaacaagttatattttttttccatctcaacatcgtccaaatgaaccgtactattttaacaatctgtgtaaacagatataaaaggaggaagactactttctttaattttcctcccagcgagctgcaaagctgtttcagtcatcctagtgattagcagaatgtgagtaataaacaacattaaaatgaagaaacgtctttctgagtaggaccttgaaatgtgggtctcaccagtagtatatgagccttcctcagactaaactccatgacacagttcatatcatctttaagtcctggagggagggttttttaatatgtgtaaatgaccaaacacagctgttggctgtcctgctgtacagagaacattcggtgacctgaaatcgcaaagtttctgtctctgaagggtgcacttaatttaactttttgccctgaagtctcaagaaatgagacttcctttaaaaaaagtgttcttaaaactttctcattttaaatgtccagggtcttcaaagagtatactgggaggaaagtcctgtgtttcctgtttctcttgtaggactagtcaaaagtaccctttctcttgatggtattctgcagtctgagcctctgatttagtaactacagcctttaaaaccacagttatccagaccatgtgcagtggttaatgtgtcatgagtctgcctcagctgataatagcacatcacagaattcagagtgccttagataaattgtttcagtggatagtcataatgactgcttgagtagaaaagtaccctcattttctaggggagaaaacagaacctacgaggttgactgatttactagattccagtggttagaaatacatgtagcctgtgctgtaaacctgattttctgacttgtagttcagctctcttctccatctccttgtacagccaagataccccagaaattatttgcgtttccgaagttgtaggatgaaaagacatgtctttgcttaactgagttagccccctagaacaatattgagatggagctggaatggtgaagaaatgcaagagtccaatcccttgggtatgtgcaattcccagttaccccttgaaacagtgcttcattataaatttagatgttagaggctgggcatggtggctcatgcctcgaatcccagtgctttgggaggccaaggcggtgggatcgcctgaggctaggagttcaagaccagcctgggccacagagtgagaccctgtctctaaaaaaaataaataaataaataaaaaattatatgttagatgtttttatagtgccggagcctaaacttgatggataaacagagaatgattttcattttgcagccactgcacctttaaagttgagctttttgaggtgtatttcctttaatgcacccatgacagcaaggttgaaaacatcaggaaatcaaattgatctcatatatggaatcttgaaatttaatgtcatctgctctgagaagtccttgtggatgggaagattgtacaatcagatcatttctctgtgtaggtatctgctgtctttctactagatgttacagaagagattagaagaagctcttccagccacctgtgaatcagctttattctgctaggcaagaaggagctggtgctggacatttgtatctgcaaaaaccatgagttacttccccaataattaagtatctactgttacaacatctagtggctaatcttttagtaaaatacactgtccatctcttggtgccagaagcaataactattatgaagccttttctttctttgcagaagtagtttgctggtgaccatattgttagttgcagaaatactcagaatctgattcacatttagacttgacagaagccagattttatatctggaaacctcattagtgaaactgcaaacaagacaaaggccatctatctctctcttaggtgccctcctcaatctctttacagcttttcccccaggagtcaaggagatacagcctggcagggacttttgcttggtgatggagtagctaagaatgtttctctctaacaggtcacagaacagaaagtgctggtggacatctcttcttgccccaagatcttcgttggaagtccccgggacttggtgtctttgccgttcaaagtgtttatgaactcgccaggaggcataatgtgtcaccattttattctgggccaccctaaaggatgacacccagcttcagagacctcctcttggacgacatccctgagaatcaatgttttagctgtcccatagtctgacgtctgtttccgaccgcttttgagctggcgcaggcttagtcattaatggccaggacgatgttaaatgttctgcctgattggcttgcagctacacaccttttgtcatttgcagagcagcaactccctcttgagctcttggggagtctttacacaaatacactagaaaaaaggcacccatccattttttttccatcttggcattagctcacaggcatagtcctgggatgacctggagtagaggcagtggaggataaattcatcttgcacagacttgtttgtgctagttctagcctgtctctcgccacagatctagcttttaaatactcaagtgattggttttgtgtaggaatgtgtggattgttggattggaagaattttctccctggatttctagtgtttacataagcagatacaaaaaaaatttgatcactgatttaaatagcagggcttattttaaaaagttatgggtgcttcaaggtggtacagaataaaaatgtcagggttttttttttttttttttttaacaagtcgtaacacaaccaaaatgtatatattaatgttttgtcaggaaagggtcaaaatggaaaatttgcaacaaagacaaactacaatagaacaagtgcaaacagaagctgacaaatatatgcccctcgttgggagttcagcccatggaatgttatgtaggacaaaaggaatggaagagatatttcagtaacattttgttctctgtcaaaaaccttctgaaatataaatctgctgtgtattggagaatggatacagcaattgattcaagttgaatagctttcatttaactagaatatcccacagaaagcagttcttgttctgacaaccatatttttgctttctttcacttaaagaaaattgaattcatgtttacatatcttatagggttgttttatggacaaagacacgggtcaaaccccatcacagtggctagtgttacaacaaatagaaacatttctaaatgaaataacatttctaagccagggccagtgcctgcagtaataatactaggttggtattatgaagccatttgcaactataaataattcagtcatagatgtgctttttttaaaatcctggttttttaaaattctagtcttttgccaatacacacacccatacacatacttcacctatttgcataatagaggaggaatatgaatatgtatataataaagtcactttattttggactttctgaaacagattaccttttttcttctcctcatgatggctccctgagttgcttccaattgttgaaattccataattacccacaaatatggatgtgcccttctaagggtcttgccatgtcaaccagcccagctgaaagctaatagccagtgttagcggtttaaggaactgagcttcagaattgagagcccccagcaaaggaagttctgtttttattctccatttctactctcctcaaggagaaattaggtgtttattgttttgttttgttttttaaattcccagatcattctggcattggtcctggattcgctgcaaatgtaatttttagcaacatctattactcctgaaatattttggctcttcgtggcctgtatgattcagtagactctgaggttttccaagtacattaaggacttaaatacagaatgtcttaaaattttagggctattgatcaagagaaagcttctcgaggaataaagttctgttaggttttagccctattctgctttcaaaattcttaactggatgccgtctattttgttttctttctgtgtttataactaatttgctacttgggtttattgttttcttacttagaaactacttttttttttgttttgtaaatgcacagcacttaaaaatataaaacagttccaaacagttccaacctgttcattgtttataccttgaccatcttttctgtcttattgctgaaccatcgcttctctttctacttctcttctgggatttcatcttgctcagctaaaattctagtgtgttattctgaatattatggctggagtttcctgaccaacttcttgcatctgagtccatttcctgtgcttaaggctgctggcattccattcactgctcctagtcaaaactgaaacttctcctgctaatgagattaggccttacaacactattaatttcttcctctctatttcttgctccattgttatttctcagagatgaaaatctatttgtcattatgagattcattttggcatcacttactaaagttcccttggatttttctgttcttcatacaccctacagcttcaaactgcaacagtcatcaactggtctttgacaaattagttgtctctacacatggtttacaatattacactagctgtttaaaaataattaagcttctttctgtgttctttgctgtgggtcaggaactttacttcctttgccatgcaacacagaagttaatcacaaatgggtcctctgaaccaaataattaaaaatagagcaaagtttctgaaccaggcggttggcagaaacgtctgtacttccatctgtgcatggttaggaaaatatttcacgatatttaaatagcatcagctttgctctcttttgtgtgagagtgtgtctgtgtgtctatgcgtaattcattgctttgaaggtttgtttgactgttagataatcatataaaaaaagttactggcaaggaaacaggaaagcaaatccaggtgttttgtgcatacattctttatttaccagtctctgtgaaggagcaatgatcttgcttttgcttttctctctgactgaaagtttttgccttgttatgtgctgcagaaaactaaataacattgcattttgactttgaaatctttatgtctcttgattttccacttacaaataacctttgctaatggctttggggagctgttcgtatgtacccgaaatgctgatgaatctatttcagtttgaagtgtggcagattaggaatttctgctctctggaaaggggatttatacctggaatatgcatcaaattcacaaacactttgcgatatacgtgcagacacatgagtgactggttttgacaggaatttaatccttcaattggatttccctttgttcttgtgagtaatcagtatctcataaaatatattcagttttggctaattgtacagctatgatacaactttaagtttctaagatgtaaattactatgtgatataaagataattcccctctagcatttttcttttgtaacagcctctttttactcctgaaaagctctttattttaaggttgatttcattctactaggagaactgttgtgttagataacaactaatgcccaataaatacactgaagggagattaggaactgttaaagaaagaacacaaagcaaatgccttaatttcgttctttcagaacgtatatatttcccaaagttgtcagttcctttatgtttctaaaaacttaccaggtaggcatattcttaatactttgataataaaattaaacactgaaatcaaagctgtagattgaacatgctcacattaagtgaaattaaggagagaggaatacatttcattattaatgtatcagtgaattctggagtttagccatgaatatcagctataatcaataacagtttgagtatttaggcagtttgtaattcatgaaatttaaatcagaagggtctttaaacatctttttgtctaatctcattttgcattcaatttaattctattttttctcagcctactatatgcagagtactatgctagcagggaaaaataatgcggaataagttgtggcccatggtttcaaacagattaatctttgattactctttgatgctttttttgtattatttgagggacagtttttttttcttttttgagatggagtctcgcactgttgcctgggctggagtgcaatggcacgatctcagctcactgcaaccttttaaaaagagttaagtggatcttcctaatgattattctttgtcaatgtaagatattaggacttaatgtattttgtgaactctgagtacacctacaggtgagtggtagatatcttcatactttaaattactgctggattttgtctgtaccccgagacagaattttggtcttctcttatatatagcagttaatattaatgaggcttccctgaaagggttcctggatattcagattcttcacacttttcttataaaccattagatttgtttcctccattcatttgggcatcttctagtgacacacggagtggctcttaaaaaagtggaacttgattgctgatagttttattcaataaatcattgttaataaatatttatttgcgatcagaaacacaaggagggagtgtacacactcagaaaagcccacaatgcagggagcctgttcttctaacaataataatggctggctggcatattgaggatttaggatgtgtcagtcactgtactaatcacttaatcctcacagtaaacctacataggtcattattatctccaccttacagatgaggtaaccgggttagtagcttgcccaaggtcacagagctagtaagtggtgggactgggcttcatgcatgccattttaaccttagaccctgtgcttttaactaattatactctattgcctaccacctgtgtcattgtagaacttgcaaaattatgttcaaaaattgtttttactaaatataaaataaaatacagtaaaatagaaatacaaaagtatattcacaaaataaatgtaaattataaaaaataagggttcagtgaacactcctttaactctacacccatattttaaaattaccatcaactggatgtcctctatgtggacctccccaatcttgtcacattcttcccacctcagaaggaaccactatagaaacatgacgttttaaaatatttttaagactaggcacggtggctcacgtctgtaatcccagcactttgagaggccaaggcaggtggattatttgaggtccatagttcgagaccagcctgaccaacatggtaaaatcctgtctttactaaaatacaaaaattagcacacgcctgtggtccccgctactcaggaggctgaggcaggagaattgcttgaacctgggaggtcgaggctgcagtgagctgagattgcaccactacactccagcctgagcgacagagtgagactccatctcaaaaaagtatacatatatttttcacgaaagtacacaaaaatgcacaccagccagatcactgtttgttttctctcctttttctcttcttttttccctactttttcatctctcatccttcttccttcttttctcgcaccatcatggagaacaaagaagaactgggtcagaacaaacctttaaaaagtgaaggcgagcgttccttgcggggatgcccagtgtcatgactagtgttgggaattcttggtgagatgacaatatttttgcctcactcaaatgaggcatgcccttccaagtaaagcatgctatgttttgtagcaaacagaacacctgagaaggatgatttcatatgactgtgccaacagatctctcacaagcttgtcaggttataattcacaaatcttaactctatagtctatagacattttttttttatatggggtctcactctgtcggttgcctaggctggagtgcagtggtgagatcttggctcactgcaatctccgcctcttgggttcaagcgattctcctgcgtcagcctccggagtggctggggtttcaccatgttggccaggctggttttgaactcctgaccacaagaaatccacctaccttggcctcccaaagtgctgagattacaggcatgagccactccacccagccagtggttctttttcatttgagatggagttttgctcttgttgcccaggctggagtgcaatggcacgatcttggctcactgtaacctctccctcccggattcaagtgattctcctgcctcagcctcccaagtagctgggattacaggcatatgccaccacacccagctaattttgtatttttagtcaagatggggtttctccatgttggtcaagctggtcttgaactcccgacctcggcctcccaaagtaccgggattataggtgtgaaccaccatgcctggcctgtttcttttttttttccaagaggtcagttctcagtctgttgtccgaactggagtgcagtggcatgatcacagctttactgcagccttgaacccttgggctcaagtgatcctcctacctcagcctcccgattagctgggactgccgctgtgcaccaccacacccaactaatttttaaaatttttttgtagagacagggtcttgctatgttgccaaagcttgtctcgaactcttggcctcaagccatcctcccgcctcggcctcccaaagtgttgggattacagacatgagctgccgtgcctggctgacttgtggttcttaatagtgtggctcttaaaatagcaaacatttttgggaaccaatgtgagggcacttcataacacaatcaaaaaccattaagtggaatatgttaagataatgtaaccttgttgttgtcccttaatgctttaatgcaggctttcagcaagtagtaatacctggtatggtgggtgtaaaactcagaatgggtcccggcatggcaggaataagagaattctttcatcggttggaaaatatgtttgaataattcactacatttaaaaaataggtaaagaggcttttggttttggttgcaaattgcactcatccatggaagtttttcaagggccatacaattctgtagatggaggtggcaatttaatgcagtcttagctgtttaggatttagaactatgttacttttaatttacttccatgaaattacaaaaacatgtaatgaagctaaaaagatttcaaaagaagcacatctagtcaaacataaaagtacttaataagggcatacatgtagaagtatattagtctttgcacatatttacatatgtatgttttggttgcttaatatttttcaagtgctgcatgcatttgtatgtgtaaatacagtgtgcaccctttatagaactagtgttgggggactcttttatcagctattatgatttggagctttatcaaatggagtgatttttttttgtgtgtgtgtgagatggagtctcactctgttacccagacttgagtggagtggtgccatctcggcttattgcaacctctgcctcctgagttcaagcaattctcctgcctcagcctccaaagtagctggaattacaggcacccattagcacgcctggttaatttttgtattttcagtagagacggggtttcaccatgttggccaggctggtctcaaactcctgacctcaagtgatccacctgcctcggcctcctaaagtgctgggattacaggcgtgagccaccacacccggccggagtgatattttccaatggtcatgattctggcctgtaacaccaagcagtataacgatgagattgaagtgtgaccatgtgcgtctgcctatttttatgttctatctcatctttttgcttggagaaaaattatgttgaaagactacagtgtgcctataaagcttcaaatatgaaaaaagagctacatatgacactttgttgcagttagtccattgtctcaaaaacatgctataaaaatatgacaactagaaaagtcttggcaaatgtagcatgagtgttgccggtttaaaagccgtgtttgagtactctaaagtacttttctgtgacagctattactataggaattggcaccagctaagaaaatttacagtttaatactttagagcaaataattgcttagggtgctttaaatagcacaggaaatgtgtagagtgtttacttgacatttgctatattgaacactaatactgaaacagattctttgaccacagagaatgccagtgtaggaggggtgggggtaggtgggagaaagaggcggagaaggaaacggcaatacaattagataaaaattaaatgacaaatgtactttttcatgatacagagatatcatggggaaaaatgcccatttgtttgatcaagtaatcttctagtgtggtagcagaaagcaaagtacagacaacttcctgggattaggttcctcctgctaaaggctgtcttcaccagaaggtcaaagccttgcagcccttggtcgctctggtttatttttcaagctcctgaaagcaagaggaatgacctccgtttttattaaaaaaaaaaaaaaaaaaaaaaaaaaaaagaaaagaaaaaaaaagcctctctcgttatctgtctaatctgcacatgcttgtgatttttttttatgacgactctgatgccctcatttctcattgcagctcagtgcttgtgatgtttttttcccctgaatgcatcttgcactcccagaatcttcttttcattcttccctggctctgttaatacgggtcttatcttagaacggggtctagtgcagtttagtgtagctcttacatgcagagcattttttttttgcacaaactgcttctcgtggattgtgattcagttgcacttaaagggaaaaatagagtatattttaggctactaaacctccttccatttgtaggcatttgagccagttatacagtgtctttcagggagttttacatgcatatgttaataaccagtggcacctgtgataggtccaggaatgtgaaattgtgcaacgttaatgacatttgtccaagcttcttccttctatcttgtcaatatgagctacttttaaatacacaaaggaattttgaaaacaccaatcaaaagtcaaaatttcaccctgcagcatggcccggcacccagaacactcagcaagaggaaggtctgtatttatggcttttccactgacttgaaatttgacctggaataaatcatgtttaacttctttatgcttcaattagcttttgaaagatatgtgtggttgtgtttagccagtggaaaggcaataactgaagttcacaacgaaaggagaacttgaagggaaattttgttaggaaagaacagtgggcaagaatacaatcttcaggcagggtgctattcctaaaaagtcttggtacacatggttcctaaggaaggtgggacattttcttataatattctttctgtattttgtagaattaagaaatatattattgtacataaatattttatattacattatatatgtataaatacatttatatatatatatatatatacatactgttttaccctttaactccagaaagctttgcgttcacacatctttttccctaacttctacctataaagggatttttagtgataatcttgaatttaaattgtaatcaagcagtaacaaacttcatttaatatgcagacatctaattttataaaggaaattccaagttattgttcatttccatttattaatttatttattttgggacggagcctcactcactctgttgcccaggctggggtgcaatggcacaatctcacgtcactgtaatgtccatctcccgggttcaggtgattctcctgccccagcctcctgagtagctgtacaggcgtgcaccaccatgcccgactaatttttgtatttttagtagagattgggtttcaccgtgttggtcaggctggtcttgaactcctgacctcaagtgatctgcctgcctcagcctcccaaattgctgggattacaggcgtgcgccatcgcgcttggccaatttttgaagtttctttttttaatctgttgccatctctgagatgagaggtttttcattcatttggggaaaaaggaagaaaggtaatcaacatttattgagcacctactgtgtgccaaacagactgctaagcacttagtccttaagtaccctacgtgactgatgttcagagggccattttctctgtgtcaggaatcaggtgggagggccagaatccatagaacaaaaatataaccgttgcaatagataattaaaaagagggaccttttagttagtggcacccaaagcatcatagtgtgggctgtgagatctcagtaaaccagttgttggtaggttcccccaactcagagacctccatgagggttggatggctggattgcaacatggtgctaaaccacatctccctggttaagccatttcagttattgcctcatttaagttgcattgctgtaaaagacataggtatgacaagttgcaatgcctaaaattcgaacgaaagaatacaggctttgaatgttattcagagcttgactccggagtcccagatgcagtttcagggtgagtaaatacaaagccagcagctcccaagtttagatgagaaaacatttcaaagaaagccagcgaacgcttatatatttaacacaatatccatgactcattttctctttgctctctcagtccagccgttattcatttaccgctcaccccacaggaaagctccttttgaagtctgcctttggctactttgcaaaacatataaatatacaccttgggagaataagggtgagagagaaaaaaggcagaggtcataatttttaatcctggttctgccaataacaaactttgtgaccagatactttgtacagtaaaggaggatgtttttaaaacccattctcagttgccagagaggcaggcagtcatcattctgtaggaagacttgtttcaggatttctcagatgtctgctgtgtttggattgctgaggtccctaaagaaccttccctttgagtcagctcgactaggcttttggaagtagccctggaggtgtgatagcaccttaaaaattcttagtaactaggaataaatagaaggagaatgggaaggaatagaagctgggtgacggggaagggaatgccaagctgtcctgcagctgggatccacacttggtgaaggttgtgcctgcgtccctcatctgtggttgggtataccagaattttgatatctctctagttcgaataccagccttgacatttaccaccttggccaagtccctgaacctatctgtgcctcagtttcttcatctgaagagtggggattatagtcaatgtaaggactaagaaaatcaatatacgtaatacccctagtattcacacttcacctgctatgatgatattaccattctcctttggagttttctaacttatttgtgtagcatttagggcaaaataccaggcatatgggtgatggcgtgtagtggagttggtgagagggagaccttgagttgtagaaagggtgggcagaacctggtttctgtcctacatcccagatgttgcccatacatatcctgtttgtttctgaccaccctgctttgctgtgagggttcccagcccctctgcctttacctgtcctcattctgccccactgtccatgcccagcatgaatctccacttctccgggacggaaagttttccccagctgcttcagcccaaaccaacttccctccccactgccctgtgcgcacagcttatttgatcatgtcatttattgcttcattttgtggcttagatgtcttgcgtcccagtcagactccatgtgactggaggcctttgcctcctttcagctccagggtagtgtggcagaaagagcaaggagcagggagggaagggacctgctctcttctccagccctttctctgtgataaactcagcatgctccaggcgtttaatctctgtaatcctcacagcctcctcatgcaaaatgagggtctagaccaagtgacctctacagctgcccttgcagcttccccattttagagtagtagatggtgaataagtatggcccgaatgaatgaacaaatgtgcagtctcaagttggtcagttgtggcttaaattatttttgtgcccactggcatctcggcttggtaaatggaggaaacggtctctgacgaattttcactttcagtagacagaaattttgttaattttgatcattttatagtccgaatttgtggacacattgaattaatatttatattagtaatatgtctaagaagaaaagattttttatgctaacaaataatataaataatgtcacagactaataacagctaagagtcagtaataaaggaaatttgtttttaagcactttggaagttcctgtttgcatgcattatatgattatatatacataatttgtattacattattatataagctctcttagtctattcattaagtaatttgatgatcattttgaaatttttttataagtacttaagagagttaaaactatatttcttcttgaaacattgtaatttggacttgttttcttattcatattagatgtcttctctgagcccagttactgagtatgtagtaacttttttgtgtgttacaataattgacagagacggtggttcaaattttcagcatcaaacctcactttggaattatttatttccattttttctcttacctactagtatatatggatccaaaattaattgcttttttattatatttaatacatctatttgctttgtggttttactgatacttgaaaattgtaaacaattatgaaagattttgaactttaatcatcttaatttgcttaattaacataatttactagaggagagaaagagaaaacagacttggttacttatttatgtttgtaaccacctttgtatatgtagtaacaccagagcaggcacttcataattgaaaaggctttagggtaataagtcactgtctgtttcaaactgtgatgactttctggaaaaaatagcttttgtaatatttgtcatactggcccagatccagaaagtagtatgttcagtgtctaattgtactccatatggcctgaactcttgagcaatccatctgaagtaggaccctgttaagaaattattctttgtttttttttgagatgaagtttcgctcttgtcgcccaggctggagtgcaatggcatgatcttggctcactgcaacctccacctcccggcttcaagcgattcttctgcctcagcctcctgagtagagtagctgggattacaggcacccagctgttttttgtctttttagtagagatggagtttcaccgtgttggccaggctagtcttgaactcctgacctcaagtgatccacccgcctcggcctcccaaagtgctgggactataggtgtgagctaccgggcccggccaagaaattattctatgtcatacataattgggtgcaagaggtcttagtaatttgcattttaaaatgataattggtatcatctacgaagagaagttctaccttagtgttttagtttagcagtgacactaagatattatacatatgaaaatctcttaatgttagtgggcagaactgggaacccttccctttttttttttttttttgagacagagtcttgctctgccacccagactggagtgcagtgatgcaatcttgactcactgcagcctctgctcccccgggttccagcgattctcttgcctcagccacctgtgtagctgggattacaggcacacgccaccacgcccagctaatttttgtattttagtagagatggggttttgccatgttggccaggctggtcttgaactcctgacctcaggtgatccgcctgccttggcctcccaaagtgctgggattacaggcatgagccactgtgcccggctggaacccctccctcttacagttcacagggtataagaagctactttctagggcttcatcttaatatggtgattgagttctatattatggccaaaaggaaaattatgtgggtattgtggggaggaggagtcagagggctaggggcaaagcgggcagagaaatatcagctgcctttatttagcaaatatttaccagtcgttcctgcccatatgcacttgttccttgtgtacttggatctgaattgattaaaaaggtctgtatgtattgagtcttttcccttaggagcgcttaagctttcttttgatgctttttttctcttcctttaaaatggtgcaggaaaatgttggaataaacatagtcagcttgtgaaaggatgattctctcccttatctgggcataaatattgttgaatgtgagaatgtgggagtagctactgggccaaatatgcacaatgagtgcaagtgattattgaccttactgatgagaggaaggaagagaaatactttaaaactattttcacagggcatttcaaccaagatgtttttctaaattcggtttctgattcaaaaactggatttagctctttttcttgtttgtttcatctgaacaaatttaccctgaattgaatgggagagtgtttcttaatcccccatgtctttagcagtgagtcatttccatgttgttgagacattttctagcctttattgctgtgtgtagttcatgcttttctctggatgttttgactccttaaggaactcgcaataacaaattaacaatcacactcctctggaatgaaaacacgcagtatcggagtaataaatagcagttctcgaaacctaaataaacacagaaaactcagctctcgtacttaagaaggctctagaggagtccagtgtccaacattacaagcaagacacaccatttaaagccataggaagttaacatactttcattttaattttccaagggatcatgttataaaaccatatagccacttccattcttcaaaacttaataaacggttagttttagtcatctgacctgccttctctcaaatggatcataatttagtttaacaggtttgacattaaaataagttgtgtttctctgggaaactcatgttagcctggacttctccacttcctgtctttctctggtgaagctggtaatagtgactgagctcaggccatggcgggatcctcacagccctaagactaggtgccacctgtgtgctgcaacccagtaccaaaataacaggaaaaatctaaagttatccagataaaatatgtcaaattataaagcctctgagtcatgacagtaatcaaacctgattctatatcagcaatcaaacctgactctatatcagctttaccaaacactattaatatatcctataataaaaattaaggcgtcattcctcaggttctttagcaagtaagtcagtgcatctatctaatttgctaaggctgaaacctattgtacatagaactcgggtctgaatggttgtcccgtagaaagttttagagcagagcaaggttgtaaatagccagctccagtggctgtttttcaccctgttcatgggttgcttgccctggttgtatatttagttgcctgtgatggatggagtgaagtgcacaggtcgtctctcaggggtgaacactgggtttgattagaggccattgtcatgaaagatactccagctcttccatgaccatacatgcttagaagaaaactttgatgcacaaagaactgaaagccctaggcactggaattcctgctcatcaaaaagacacctaaaaaattcttttggagacttcatgaattttctctcgattcatactgaaggactggtgccagtaatatttttcctctttgcctgtttcagtttctcatgaagtttttccatatttagacacactgcccagttaaagggaatgccagtcactcggggtttaagacaatgaagtatgtacttccctcaccaatcagttgggagagctgattgggctgaacttccagtctgaggcatgtgagtcacacacaggcagagatttaaatgttattaacatgagaaagatcttttgaacgtgaagtcatcatgcttgaggttactttgaactttcctcatagtctcttttatgatttgtgtaagaatcaacatgctttagtcttatgttaaaaaaacacagtcgagtgaaaatggacatgaatttaaaattgcatgatagccagaaacttttcatactgtggaaatgttacactgtgataaacatttagtgaagctgcttggctcatgggctatttttttaatggcttttgggttcagaaatttcaaaatgtcagattctttgtaatttaaatttccttctaagtaaggaagtgcactatgttattaattttaaaaatatatatacttagaagttgaaattgtgtaattatcttaatgctccagagtctcttttctgactaaacattggaacttattctgttgaatgcagggaatttgtccagaaaagcttaaggaaatttagcctacgaggggaaatgcgctagattcataaataaaaggtttatccaaaggggtgatatagaacatgattttatctataaaagattgtacttgagttttgtctcttcctcctccttttaggattaagtaatgattgtagcttagtttttatagttgatttatagtaataagttatgtgtaagctgactgtgggtagttgaactcatttcaactgcagaaggatagattgttgtttaaaggatcatacaaaaattattattttttaataaaatgaaaatgtccccagagatgttacacctggaaacttaaaagtaggaaaaatgataatatagtatgttactctatctctggaaggaatgatctctcccactgaaaagtaaatagtccaaagtttacaatgtttagttgaaatagcttataaatcacggcagtgacttttaatccttagtagaattctcctttatttctgagaagtctgtataaatgtttatggaaacacagtctgaaatattttaaatgtagcataccaatagtacttaaagagaactttacgcatgatcacacacattcagagttgttgggtaaaaacaccttgtaccttctttggtagaaaatacttctgtatttgcgtgtgtgtgagagagagtgtgtgtgtgttttaaattcttaaacataacagatcttttgaagcagagcagaaaactcgcatgttactgacactgcattctcagccatggggaaagcaacagtgtgtttcagctttagcaaattacatgtgttgactcactaaagaacctgagtaactacacctcagtttttattacaggaaatattaatagtgttttgtaaagccaatagagactcaggtttgattactatcatgactcagagactttataatttgacatattttctctggataattgtagatgtttcctgttattttggattttttattatcgttatttactgtgagttttgcgctcatatacatgtagcccagaaaagcgatagtgagatggttcagtgtatggaatcagttttattgaacaaacagtggggcaggtggggggagatacttttttgtaattagactattattagtgagcacttcctttggcttttgttcatttaaatgtatcttttctttataacttcacaggacgtggaacatgtaaatgcattttgagttgaaagcagaaaatcacatttcagtaaaattaaaagctcaagatttcattttcttgtaaaatttctaatcatccccatttgctgaactttgggccctttcttggcattgggaggtcatggctaatgaatgcatctcctgttgcctggcttacagccgccccctgctgcagtgccatttgggagaagtgtgtaatgtgcgtgcttggactcgttatctcctttcatttcctcaacatcagttaatgctgcatagtttgcaacatgatattgctttgagttggtgcctaattgtgtaggctggctagaagaacgaatctttgcagtggtcaggtgaggccactgagtgtgcccctttgcggccactgcaataaggtggttgggaattcttcatttctgatcactgaacttttccagaacgtcccaaggctcccccaggaactgtattacagcatgacattctgtgtatgtgggtttttctgggagaggattgtagctttcaatcagatcctccaagaattctgtttctcaaaaggttcataggaaccatttatttagaattgaaagataggcacatcttctgaggaaaacaaatgaaaggcttaacaaaatgttaaggctgagttacagaaaacaagccataagctacctattttattcaattaaaaataaccatgacatggccattttgtaaattattacattaaatctgcattgcagacatacctggtacgtatttatttatttattttttaagaggcagggtctccctctatcaccctggctggagtgcagtggcatgatcatagctcactgcagcctcaaatacccgggctcaagcagtcctcttgttccagcctcccgaatatctagaactacaaggacgtgccaccatagctggctcattttcaaattttttgtagagacgaggtctcactatgttgcccaggctggtctcgaactccctggcctcaagcagtcctcccacctcagcctcccaaagtgctgggattataggcatgaacaaccacccccagccacttggtacatatttcaaatgtggtttgtttcttttgaaataatgaaaaggaataatgtttcagggtttgtggcatccacattttgggatggctacatgccgtaaccttgttcgtagtagctcctgatttttatctgtattagaaattgctcggcatgagacaaatgaggaacatttggggaaatgtgtgagtaattgagtaaaaactaatagctgtcttaagggaaccatcttctggtttgcatttgtattaataggtatgcagagcaggaataatttggaacgggggagctggttatcctctgggtgtgtcaagcacaaatctcagattccattacatctgcacaagtcttgacagtttgcaaaatgtgcctagaggtatgcttgataaggacagacatttcttgcctgggttctaactgtgtcactgctagcacagtatctggcctgaacagcatctaaagaaatattttgctggatgggttacctcaatgggttctcatagcagccctgtggatatagacacagcatgttttatcattcttttctacaggctcaaagagggtaattacttactcaggctcacatagctggtaggaaaaggatttaggcctctcctttataccatgctttagctcgacccaaataataaaagcaaaaaagccatgtttggatcaactgagttttaatagaagagcattggagagaggttgtaaaccctcagatattttcaaaaataatagtaagcattcttgacttgcaatgcagagaatgtcttaagctcatatgtcttgatggtgctaatcaagtcaggcttttataattgagtgaaagcacagaaaaataatttattcattcttatacaaccaagtatttattgaatgtcttttctgcaccagacatggttgtatgcactgaggacgtaacagagaacaaacaaggttgtctaagtccctgccctcagagagcttatgttctcatagtggagacaaccacaagtaaattgcataagtagactctatttgcagaccccccaaaatagagtaggatatgttaggagaaagagtgatggcaggggcgaaggggattcttttgtttggtggagtcagggaaagtcttaggggatgggcttttgtacagagactgcagtaaggtataggagccagccctggaagatgggagtggtgaagggtgagatgagaatctgaggatgagcactgtaaaggaagagaatggccaggtgaaggctctgaggccagaaggagcctttgaattgatctagaggctgcaggagcttggattttacgctaaatgtgatgggaaactctgttagttttccagggctgctctaataaattaccagaaacttggtgggttaaaacaacaggaatttgttctctcaaagttctggagggcagacgtctgaaatcaggtgtcagccgggccacactccctcccgaagctctgttgggagaacctttccttgccgctgtcatcctctggtggttccaggcgttccttggcttgtggcagcgtcactccagtctctgcctctgttttcacatggccttctcctctgtgtctgtaccaggtcctctcctgtctcttagaagaacagtggtcattggatttaggacccacccgggaaatccatgacatttatgtcaggggctggaaaaggaaggacaggtgggatgtgaccatccggagagcctatctcagctgtcatgggttgtcacaaaggccattgtgtggttaatttttatcttcttattcttgtttcctctttaatctttcattctaagccctatagccctgactggcagattcgctgtcgggtttttctagttgtagatgacatgctttttcttaaagccatcttcatttattaatctacattcgtttttaattttaatgcaccaatcaataattatttcacttgacagtttttgacagcatgctgcttgcgacatttagctgtttagcatgaattcaaaaggtgatctatcaatttgcacaaatgaaataaagttgctctttcttcctgtgctttgggggaatgtataaaaaaatgtatgtttatccttccctggagaatttttgatgtagaaatactgaatagttttctatataagaagacagaggactaaagagctttaaaatttgttgtgcttattttgcttgtatcataaattcacgtgaaaggccagatttctcttaattgcgttgatattgtggagatgaatcattcaacaaatgtttattaagtgctcattgtgtgcatggcactctgcaaatgttatgggaaataaagacagagtccccgggaaataaagacagagtccccaggaagtctagtagtcagagaaacaaagccacttcccaaattatggtgggtagaaaaacttaggaaatgacagttttatcatgctacataccttcacttaatgaatcctatgtgaaaattcccagtaaaaacctatgaacaaaagtgtgtggttgtcttcatgtatacattgtgtgcacacatctgtgcgtacaatgcacagctttgtatgaagctagctgaaaactaaacagctaggctgaacttagctgaaaactaaacagcaggggaaatgttctttctcactaaaatcacagtgttaaaactcttggcagttcagatggtctccactgtagctgttggtttacattttgataatttaccaaagagcataatatatttaattcctagttggatggtgtaactcaacacagcatttccagcgaaacgctttgcaaatgggaagtaagcattttctttggaaaccagcagcttccttactcccttggttcttctgtgggtataagcatgacctataggttagaagttctggaacagaaggagaaaaatgaattatgtcacagttaacaggaaaggaggtgctttgcattcttgctccgttgcagttagttttgttttccttccttggtttgggggcatttggccttgcatatcctggcaagatttaggcaaaacaggcactgaccttctttctggaatgctctttcattttgccccatgcatattattaagaggcataattcactgtcatatttttgtggctaaaagttttctaacttctatacactgagcctttgttttctgcttaatagggcaaaagagctggcattttctgggcatcattgacccttcactatgatttagattttttaaagaaacacataaactgttcattgcaccttgttgtgtggcaactctgccagtcactaattggtactgtggatatttggctgttgctcttatttactttcctctggtttttacatcacttaattaaatcttgtgccagtttccattctatacatgtatagggaagcaaacagaaactttgtcctgaagcaccaggttctttggcttcatcatcctaaacagctctgtgaaaatcagttgaaagtgagtagagccagaagtggcgtgtaagccatgctgtcagcgagggctggctggatctgcatacgatcgccgccttctgcccctgcttttggagactagagatggcttctggtctgtgtccagggcttgccatgctgattcagagagctatgccacagatgagcctgagttgagaccatgatgccagcatatcctcagacccacgagatcgttatgccagaatgttaatccgcagtggaaaccattactaacatactctcaaggcccacatgatgagcacattctctctctgtgttaagctgcatgggaatgtaaatcctaactggaagctactttattgatgtgccttgagaaattgctgctctctggctgcaggtatcagcagcagtcacagtgcacatgctctctaaggaagatccatatggagtcaggtgtttgcttggtgagcagggaatcggaacaagggagtgggatgagttgactgttaagtggcaccaagcaaacatagcctgcctctctgttcatctcaggagaagggtggcttttctagtgggaccaggaacatgtcagtcattgcctgctactccctacagtcatctcactagggtggccttgcctgtgaagacactgtattctccccaacaaccttggcattgcctacatagactttagtgactctgtactttcctggctaagccagccctggcgcccttttgaggacacagtcttttcttaaattcatgactatatttcatcaggtgctggctggggcaggggtagtggtgatggtagtaattatctttcttcagttggctttgtatgtccatgttctcatccactaaattttgttcttactataaaccgctaactaggcaatctcttccccgttgtcaagttcttggttggggaatggtaatctttattgtccttcttataagtccctttggaatggatagaggctttgggatggacatctcgtgaactgtatcttcatatcaagctctgtgaactgaatggcaacaaggaggcattcatccagaccaggagtaggcaaactatggtccatgggccaaatccagcctgttcttgtaaataaagttttattagcacatagctacatccaataatttgtctaatgtctatagcagtttttgcactacactggcagaatttgatttgagtcatggtgaaagagaccatagtccaagaaagcctgaaatatctactatctgatcctcatcagaaaatgtttgccaactgtagtctatacctttgcacgtcagagaattgcatcagggaagaactagaagccctccttttgcacccccacaaccctgccacaattcagtgaacaaacagaagatcagagagggaatgtgacttgaccaaagtcacacagctggttcataggaaagccaggacctgagctcagatcttccagttcctagtgtatttgtcttctacttttggaggacgttgtgagttttctggtttacagatgattaaccattacaacatactgaaagaaagcttctttagtggtcagagctattttccaaactgacttccccaggcaaaatcactagccagcttggcattgatactcatttattaatcttacaaacagtacctaccatatttcagggatggggctggggctaagacactgatgaagaagcacaatccctgcccttgggaagtttggatgagaagagtggtcagatagctagatacagagatgcatgtcattttatctgtagtgtgttacttatcatcataggactgtgatcatatggacgaaggatgcgttaatttagccttgagtgggtgggggtgttgtcaggaatggctccatagggttggagatgtttgagctctgtctcaaaggagattgagttcttcaggtagagaattgcagcagaaatggctgtggtcctctaggcttgagtgtgcatggtatccagtaatttgggaatgcttgtctaacacaactagaggtagggcttaggggacgtggtatggggttacaggaaatctagttggaaaagtaagttggagccaaactgggaaacttacggcatttcaaatgctaaggagtatggactttggcttatattctaggggttttctaatctgtagattccaaaacatatgggagaccacatttcttgtaaaagaggacctgcacattcataccaacacaaagcatggtctgtagatttggtcatcagaatcactaacagaaataggagctttcttccaaatatatgtagctggctgatattgtaagtcattagccagaattcattcacagcgttactaagttcatagtatctttttgaccattgtacatcttcttgatcaacagatattaagagttaaacatctagtgcctgaagtctgcaacatttttgattgaagaaaatgttgggaaccactgccgttgatggcagtagtcatgaaattttttgaattaacacatgttataggttccagagtcagctgccctaaattttactagctttgtgactttgagcaagttatttaacatacctcagctgtaagagtctttatctctaacgttaaaataatagcctctgtctcttaagattgttataaagatatgataatgtctgaacgcatgtagcatggggccaggctgatgggatatactcatgtttaaatagaagctattgtaatgatttttagcggatgtggcatatgcagatgtattttagatttgacccagtgtggacgatgagttcaaaagggagagttgtacgaccttcctgttatccaagtgagaaataatggggccagggtgggcaggggataggttagggaaggagaggggagagggagtatgggaaggtgtatgtccactttaggtaatgaagtgagaaatgaaagaagccacattctgtttcatgcccaaagcaacagacaaggcacaaattagagtgtagggaagccagtttctgtgacttgatggcatagaatggtgtggcttatctggcaaattccacgccccgtaactcctggaattgatctggataagaattcaccttgagtaaattttaaaaattaatttaataaattaatagccccccctttgaaacacagaaaaattagaattacagcatgagtatctttttttgctctaaaacagtacagcccagcagttcagcctacacccatcacagagctttcaaaggaatgtatacaagaaaatacatatacaattacaaattttaaaaattaagtaacatgtatatactgttaaatatttatatattgatgcttagaaaaagatgggacaaatgttaagtgtcagctgggaggtttttactttcttctttgccatttctgtatttttcaaaatgaatatgtatataattttaaaatgtgttaacactatttcaaaaggaaaacaatcacaaaaaggaatagattggaaaagcttcaggggacttgctatccttgtctttttgggtagctgttctacaaaggcgggtggtggtgggtgcctcccagctgtgtctcatttcagtcagcggatgctctgctaaatctagtgatgggcggcctacctccgaaaggtgggtgggagtgagggatgagtgtagcagtagtacatgcaaatggggccaggttttggtgtgtgtgtgtgtgtgtgtgtgtgtgtgtgtgtgtgtgtgtgtggtgtgtggttttttttttctttctttttttctacagtcttactctgtcgcccaggctggcatggagtggtgtgatcttggctcactgcaacctccgcctcctgggttcaagtgattctctgcctcaacctcccaagtagctgggactagaggtgcacaccaccacgcctggctaatttttgtatttttataaagacgagatttcacatgttggccaggctggtctcaaacttctggcctcatgtgatccacccgctttggcctcccaaagtactgggattataggcatgagttactacgcgcggccagggaccagttaagatttgacgattacattttattgaatgtttgcatcagaggcacctggaaggcttgtttagaccacagatttctgggcgccaggcccaggggttctgatttaatagttctagggtggagcctgagaatatgtatttctgacaaatccctccgtgaaactgatgctgctggccccaggaccacactttaagtgaggggtagtaagcgggtggagaactgcatggaggatgaaaagcatccagttggattttatatttgctcccccttcttcatatacacacactgaaatcactccactctatgttttctcagattctttccctgtctggaatatttggttctctcttcatgttcagtcagtagaaacaagaagtaactcttggattgagcagttttcacacaagtagcccaaatgatattgacacatcatttctacacagcatcagcttgttcacacacatacgcccccagaggccaatggcgtcctttggctttgttctcctttttaaaaattcagtgagtaagctaattttataggaatgtctcagaaagctattcctgtaaacccagcgtttgtaaattgaaatagaggaagcggtgctgattaccgcaattgtattgaaacttattcatggagcggtccctctagattcagatagtttggacagaaaccctccaactcttcccttaccactccattgtttggtaaagtttaatgtgctcacatggcatctactttttcagccagggttaatactcctagcgattctttcactggaagggatgactcagagaggaagagttggcattaattgcttcatcaactatgcttattatgagtcatctcttgcttgtcttagtaattcagctggaaaaaggagaaatgttatctctggttcctgaggccagcttgggcttcagtgaactaggatactccctcgtagccatttgtgagtttcattcagttactaagggaatgaacagattgtgaatctcattatcctagcaggtacatataaatctataaatggcgaatggcagttacttcctgatgtttatcagtgatgagatgccacaggcaggacgttagccctagaaaggcactgttttgaaggtggctgattaaggggcaaaagaaaaaaaaaaaaagcaaaaacggagggatatgttcaggtccctgcctttactcagttccctcccctagcttccaatttgattaacagaggtgtcgagggaggaagagaacaatttccaaataaaactgcctttggttctttttttgagtgtaatgtggtaactggattatttggaaacacgaatttaggtctcttactttctacttcttgcgttcagttcactcgtgtcttcctgtttggtgtataccttccccttctgactcagtcttctctatttctcttctcactgtagcagaccaccgttcttcccctgccttaggcgtttctcacttgctgtctgccttgcgtggctgttttcactcaagcatgttcactgttcctttgtacggaataggggttatccccacagaccctccaggtagaaagtacatctttcttttcactaataaattagtttattattaatagtgaaaagaaagtacatctttcttttcactaataaattagtttctatttagggagaacatacagtgaaatcaacacatcttaagcgtacagcgcaatgagttttgatgaatgcatacatccacataatcagcatcctaatcaagatatgggacatttccatcaccccagagcccctctgcccccttcctgtcaactttccacctccccgtcatcaaccactgctttgatttctgtcactgtaattgaattttgtttgttcttgagcttcatacaaatggaatcagtcagtactttttcgtatctgctttcttttgttcagcatatcatttttgagatcatctgtattgttgcaggtagcaacagttaatttaaaaaatgctagccagaggccaaggcaggcatattgcttgagtctagaagttcgagatcagcctgggcaacatggtgaaaccctgtctctattaaaaatacaaaaactaggcggcagcagtggcacgcacctgtaatcccagatactcaggaggctgaggtgggaggatcacttgagcctgggaggggtcaagcctgcagtgagtcatgatggtgccactgcacttccagcctgggcaacagaatgatgtgtcgcaaaacaaacaatctatatctatatagatatagatggtttttttttttattttgtgaacttacatatatgtgtgtatatatatatgtgtatatatatgtgtatatatatgagttctttatatagtctggatttaagtcatttatcagaaatatgaattttttctcagtgtttggcttacctttttcattttttaaactgtgtttgatgagcccctttaaattttaatgaagtctaatttatcattttttaagatatatgctttttgtgtctttataacatttttgcttaccctgtggttgctaagatgttatcctcctgttttctcctggaagatttctagtttagccttaacatttaagtatatgagccatttcaaattaagatatgaggtgtaggggtcaagattcagtttttattaaaatgtatgaaacaacaattattgaagtgattttttttccttatgaaattgccatcacacctttgtcaaaaatcatttggttttatatgtgttttaagactctctgttccactgatctgcagtctgtacttaggtcaatactatattgtcttgattaaaatactgtcatgggctgggctctatggctcttgcctgtaatcccagcaccttgggaggctgaggtgggaggatcgcttgggcccaggagtttgaggctacagtgactgcagcattgcattccatcctgggcagcagagtgagaccgtgtctctattaaaaataataataataggctgggtgtggtggctcatgcctgtaatcccagtactttgggaggccgaggcagaaagattgcttgagctcaggagtttgagaccagcctgggcagcatagcaaaaccccatctctactaaaaatacaaaaatcagctgggtgaggtggcatgtgcctgtagtcccatctactggtgaggctgaggtgggaggatcgcttgagcccaggaggttgaggctacagtgagctgtgatcatgccactgcactccggcctgggtgactgagctggaccctgtctcaaaaataataacaataaaattcaaaaataatgaataaatgttaaaattaaaaactaaatagctttatggtaaatcttgaaaacagatagcgtgagtcctctctgtcttgttttttccctcaagattattttggtggtgttctatctccttcagagttccatataaatccccctaccccccaaaaaagcctgttagaagttagttcagattgcactgaatcataagagagaaatttaaggaaaattcaccttaacaatattgaaacttcaattcaaaaacacggtatatctttctctgcctttttaatgaatttctgccaggaatgtttccctgtttttcctgcagagacattgcatatctttggtaaaatttaattgtactttatgcttttcgatataatacatgtaatttttaaatcatccttttcaaattatttatataaccaggactttttttctgatcgtacagggaaagtattaactatttcaccactatttcatcatgatgttagctgtaggtttttcatttgccttttattggattgacgaagtttccttctattctcttttttctaagaatttgtgtttgtttgtttttatcgggaatgtgtgttgaattttgtgcagttcatttttgcctctgttgagatgtcatatggttttccgctttatgtggtgaattatattgattggttttaagtgttaaaccaaacttgagttcctgggataagaaccagttataattatgtgttattttgacctattgctggatattttggctaacattttattaagtatttttgcgactatgtttattaagaacattggtctgtaattttgtttctttatataatatttactagggtttagtgttagtgttagtaatactgattatataaaatgtattcgtggagtcctcctgttttttactattttctgaaagaatttatgtaagattttctttcctcttaaaattgatgaaattccacagtgaaatctttgggcttggagttctctttgtgtgaaggttctaagtttttaaaatttaatttaaaaacattataaagtaaaatattcccttttttgatgtacaattctatgcattttaacatgtgtagagttgcataactaccaccacaatcaggatacagaacagttgtatcatcattgtgccaaggattttgatactgaattcaatttcttaacatatagccaactcttcagattttctgtttattcttgctattggtaagttatgctttctatttttcaagaagttttttatttcatccaagttgtgagatttattgacataaagtttttagtaatactttcttcttatctatttagtgtctgtaggatttatagtgatatccccttttccatttttaatgatgttttcatttacttatttttgtgattagttttgctagatgttaattaattttattaagctcttcaaagaatgaactactgtttgctttctgttcttctcattatttccttctttttccctactttggatttaattttccttcctccttcctttctctttttcttttcttttctttttttttttttgagacagagtttcgctctttcacccaggctggagttcagtggcacaatcttggctcactgcaaactctgttccctgggttcaagtgattctcctgcctcagcctcccaagtagctgggattacaggcatgcaccaccgtgcccagctaatttttgtatttttagtagagacagggtttcgccacgttggccaggctggtcttgaactcctgacctcaggtgttccacctgccttggcctcccaaagtgctaggattataggcatgagacaccgtgcctggcttgctttcctttctctatatcactgatttgaacgtcttctttttttttctgttcctaggtacacacacttttaagattgatgtatcttcctaataagtacaccctttaattattatgaaatgaccctttaactctggcaattctccttgtctagaaatctactgatctgaatatggctacaagagctgcaggctgttcagacttcagccgaggtcttgcaatgagcccttatgttttaattgcattgtacaaattttgatatatacttttattgtcacttaactcagtattttgtatttccattttatttcctctgggaattgtctagtagtaaacattttaattcacagacgtggggaatttttaagcttcccttttttccttaattgctaattacatttttatttatttatttctcttcatagttgttgctttaaatatctctgtgccattttgttagatgcatgtatgttgacgattataaaatcatctttattggttgttccttttgccagcctaggatgtccctcaccatcatttataatgcttttaaccttacattccattttgtctgatattcagagtgctatcctggtttttgtttttagttttgcttatattttcttttttaaaaatcttttagttttaatgtcattgtatatgttcattttacacgcatcattcttcccccccaccacatattgtgcatagctctgtacttgtctctgttatttgattagtgactttatacccagttatccttactgtaatcatttttattaagatttttagcttcatttaatgttttctacttggctttactttttgttttgttttgttttgctttcttcctttggatagatcggattttttttcccgaacacattttattttattcttgtagcatttatacctttatttaaacataaacttaggtataaacatagtttcctttatgtctaaaaattatcagtaatttttaagttccccaaatgactcccccactcataaccattggacctcttctctctcagtctgctattttccccagtgttccctctactgagacttaaccaccttctttcctgcaagaattccccatcacatggaaaataactctcagctgcatcaacctctagcctgtgcaacttccccaccttgcttggaaccggaaatgacttctacttttagaaagttcattctctgggcagagtagaagatagaattcattggggtgttattgagacagagagaccatctaggtactcttgaagaagtccaggagactttaggagggtccaggttagagtagtggcagtagagtgggaggactggtggaacaaccgggaggatttggtgttgtatttgaggagtttgagaaaaagagaagttgatggtgccaagtatgagtggcaaatatcagatttcttttattttttcctaccctattctcttccctcccaaattccatttgcatgacttcttaccaaggtttggttctgccattttaaatgaaataagacatgtaaaacacatggtatatgtcctagtatagaaatagtaattaaaaaaaatagatgctagcttccacatttctgtctcaagtgctgactgtatgaatggggaggaggagcctacagattcctgaggaggaacaacttctttttcttggtggcagggtggttagaaatgtaattatttcatttcttcatcttttgaatttgagctgccaatgagacatttaggtgacagaaaattgtatatctaagtctaggattgaaaagagatgatagagattcaatagctgttaggaaaactgtagaagctcgtctagcgggaggtgataaagtgaagagaagagaaatttgaaaagcatttatgggatggattggaagaaggaggatccatcagagaaagttaggaggcctgaattcttgtcccagtctggtttatttagccctgaataaagcacttaaccctctcagggtcctctttctttcttcctttttttttttttttttgagatggagtcttgctctgtcgcccaggctggagcgcaatggtgcaatctcggctccctgcaacttccgcctctgggttcaagcaattctcctgcctcagtctcctgagtagctaggattacaagtgtgcactaccacgcacggaccatttttttgtgtttttagtagagacagggtttcaccttgttggtcaggatggtcttgaactcctgacctcgtgatccacttgcctcggcctcccaaagtgctgggattacaggcataagccactgtgcccggccctctcttcctttaagatctctttctttctctctgcctctcgttctctttctccattcttcattaattcaacaaagatttcttgcatacgtattgggcgccaaattctgctctaggtattgaggctaaagcataagataggatgtggtctttgacctctagtactgggagcaggcaacagattaatcattgctctctgttaagcattatggtagggtatgtttcatacctgagtcaggttgactggaggaaagggtgctgagaaggcctgcagagcacgtccttcagtccaagcttttcagaatgaggagttgttcagacaagcttgggcaaagaaagacaaaagaagtgcaaaatagtattatatggatgggctgaaggagcaataagcagtttggtaggtccatagtgaggcaggcctgacaccgctagaggggctcagggtctcgatcaggaagggcccttgtgagccaagcagagatcttggattttatcttggatgcaatgtagacccattcaaggactgtagggatgtgaaaagtcaggtgtgtgtttcagtgatttcattctgttagtgctatgcatttggcatgataagggaccaggtggtgggcaaggagaccagagaggaagcagttgtagaaatccaggtgacagaggaatgttgaaaattccagaaccacagagcacctgcttcatgctaatcacaggtctgtgtgctgcggcttctgcagggaccaggacagacaggccccttgttctcatggagtttggagtggcaatggaagtgacagaatggaaagaatgagcagattggagagatgttaataagcaaggatttagaggacttgatgagcaattagatattggaagtgaatgagaggggggtagtgtctggtttgaggaagtgaatgggcaaatgacaccactcactgtgattggggaaccaagagaataactgagtgggaccttcagggaaaggtgcccagcctgcacttgtataaataggtctggatctcaggaacggcctccgtgacttactggatcagggaaagaattggactatgtggatgtttacgttacttgattttattctgctccatcattcagtttgggtctgtgactgttgagtcacctcacagaggacgaggtatccttatatctctttccctaaaacctagtgtggggtgagcaaaacagtagggctattgtttgaagtaggtctggaattctgtatcattaatttctttgctcaccctctgatccctgccttcactttagccctcccccaagtcccagcataggctcactacctggattttggcttctgtgtgaactgctgtgggcaatcgtgtcatattcctgtcacagagactctaggatgctccagcgggtagggattttaggatcactgggtccaatctctgcaattacagatgagagaggtgaggcctgaggaggcaagggggcctgcagagcactggtgtagggctacagtgtggtcgcttgattcactggtctgttttgcactgtgccccctccccctcgctgagtgcttagagagcagggcaggaaaagttctgcacattggtgcagacgtttggaaatgactaagcctgtgtgtgtaactttgagacttctcgtgaaggttgtcaagaagcatttgatcacttcagctctgaggtagggagacagtctccttgggcatcacacttgcattccagcagcccccttgtttggggtgctctccaaaggctccccgtaaggaattgtttcaccccgggtgtagaatcacattgcactgcggcttcaaaggaaaagtaaaaaagtgcagaaattaccgaccggagtgtgggaagtacttcttgttggtaagattttcaagtgctggggaagagatgtgttgaaaggacatttactttcatcagcttagagcatctgttttttatactttaaaaagaagcaacacctcaaattatggcagtccctgggcaagtaagcacttgagattttgatctgtacagattcttagagggagcgcctcgcaggagctgttagtagtgatttgtagcacttaactgattctgtagaccgacagtcaatcttggggggaaagggggttcagaggcaatgatagttaaggaactgctccgtaaaacagcaaataagccattgctcttgcacccgagtagaaatggaaactgtacttagcaggctctggagaccaaattagataggaaatgaaaataaattccatgttttttatttttaactcagtgcgcacctccaaaacattcgtacagtgtgggctccatgacgtgttttgcctgctctcttatacagatttaagtttttaaatggtagttagagacactcaacataaaagctgctgctttaaccgttgttgttattgctttgtttttttgagatggaatctcgctcttgttgcctgcactggagtgcagtggtgtgatctcagctcactgcaacctccaccccccaggttcaagcaattctcctggctcaggctcccgggtagctgggattacaggcgtgcgccatcacacccagctagttttgtatttttagtagagacggggtttcactatgttggccagattggtctcgaactcctgacctcaggtgatccacccgcctcggcctcccaaagtgccgggattacagtcgtgagccactgtgcccaacccactttaaccatttttaaatatgcatttcagtggcattaagtacattcaccatagatgtactatttattataggcacagtttcctaaactgagtaaagaaaggaaacatttacccccacagcccagtatagtcattgttaaaattaagatgttagtctccaagtcttttgtttacatgattttgttcaaacctagttgcaatacttttcatagaggttataaagagaaatatagagttataaaggaatttttttaaaattatactttaagttttagggtagatgtgcacaacttgcaggtttgttacatatgtatacatgtgccatgttgttgtactgcacccattaaatcgtcatttacattaggtatatctcctaatgctatccctcccccttccccccaccccacaacaggccctggggtgtggtgttccccttcctgtgcccaagtgttctcattgttcaattcccacctatgagtgagaacatgcggtgtttggttttttgtccttgcgatagtttgctgagaatgatggtttccagcttcatccatgtccctacaaaggacatgaactcatcattttttatggctgcatagtattccctggtgtgtatgtgccacattttcttaatgcagtttatcattgttggacatttgggttggttccaagtctttgctattgtgaatagtgccgcaataaacatacgtgtgcatgtgtctttatagcagcatgatttatactccttttggtatatacccagtaatgggatggctgggtcaaatggtatttctagttctagatccctgaggaatcgccacactgacttccacaatggttgaactagtttacagtcccacaaacagtgtaaaaatgttcctatgtctccacatcctctccagcacctgttgtttcctgactttttaatgattgccattctaactggtgtgagatggtatgtcattgtggttttgatttgcatttctctgatggccagtgatgatgagcattttttgtcttttggctgcataaatgtcttcttttgagaagtgtctattcatatccttcgcccactttttgatggggttgtttgtttttttcttgtaaatttgtttgagttctttgtagattctggatattagccctttgtccgatgagtagattgcaaaaattttctcccattctgtaggttgcctgttcactccgatggtagtttctttggctgtgcagaagctctttagtttaattagatcccatttgacaattttggcttttgttgccattgcttttggtgttttagacatgaagtcgttgcccatgcctatgtcctgaatggtattgcctaggttttcttctagggtttttatggttttaggtctaacatttaagtctttaatccatcttgaattaatttttgtataaggtgtaaggaaggggttcagtttcggctttctacatatggctagccagttttcccagcaccatttattaaatagggaatcctttccccatttcttgtttttgtcaggtttgtcaaagatcggatagttgtagatgtgtggcattatttctgagggctctgttctgttccattggtctatatctctgttttggtaccagtaccatgctgttttgattactgtagccttgtagtatagtttgaagtcaggtagtgtgatgcctccagctttgttcttttggcttaggattgacttggcaatgtgggctcttttttggttccatatgaactttaaagtagttttttccaattctgtgaagaaagtcattggtagcttgatggggatggcattgaatctataaattaccttgggcagtatggccattttgacgatattgcttcttcctttccatgagcatggaatgttcttccatttgtttgtatcctcttttatttcgttgagcagtggtttgtagttctccttgaaggggttcttcacatcccttgtaagttggattcctaggtattttattctctttgaagcagttgtgaataggaggtcactcatgatttggctctctgtttgtctgttagtggtgtataagaatgcttgtgatttttgcacattgattttgtatcctcagactttgctgacgttgcttatcagcttaaggagatttgggctgagacaatggggttttctagatatatgatcatgtcatctgcaaacagggacaatttgacttcctcttttcctaattgaatactctttatttccttctcctgcctgattgccctggccagaacttccaacactatgttgaataggagtggtgagagagggcatccctgtcttgtgtgtaaaggaatttaaagacagcctactccttctccccttctctgccccgtttatagatgaagaagtgaatggccaaaagggttaatggcttgcttagctggacagtggccatgcttgtcccagagcataggtgctccatcgcctgagcgccattccctgggctagtctgttgttagtttcaacatgtgtcataaaaaattcattggtggtttatttttagggtaatcttcttttttcctctgtctctttctttgtgtagtttctgtatctaaacttttttaatggcatcttcaaataggaacttgttttaaaccagaacgtcacaacacgtatgccattcctagggtttatcaccctgatgccaacatcccctcccaaacctcgcttctgttcagatattaccatacccaggaggtcgctgctttttgttttttttttttccatttgttttgctggttcacggttcattccagagtttaaaggtgctaaaaccaaagtttaaaggtgatagtaattgtcccatgttgggtttttagctggtttctttttcttcttaagatctgttttccacttagaaatgaggtgaaaactcacagaagcaaagcctagcagctaaaagcagcacgtctgcttaccacgttacaccctccgggctgatctgcagcccagatcccctttccatcctctacctagctcctcaattcccatcggtgagcagttttcacctcctcctgcccacgtttggaggtctgtgggtggcggttaggaagccaaaggaggctgaagctggggtatattgtttgggtcggccatggcaaccgcggcaggaaaaggaacaggactagttttgtgctgctctgtaaatggccaggattcagcagctatctcaggacttctgcttggccccagacaatctgatctcctggtaaggttattaaacttggctctcctcttccaccctcctttgatcatgttgtcaggcagcgagtaggaatggccgtaaggggtcggctggtgggggttgcagagcacagcaagatatgcaccagcagaaacataagaacaggggcagaggcaaatcagggactgtgttcttatcttttctgcaccccagatgcagagaagtacatccccaagtccttgccaatactattcttcaagagttgagcaccttgctccaaagagcctgtccagatcgccagtttgaccagcatggaggagaacaaggaagggccggtcctggaagaccccaggatttttttaattgggaaagcattatttgagttttctctgctgcaaagcacaaactgcctaccacatgtgtttcataaaaatgtcactgaaaaggagagtgagaatacagagtaagcttccatggcttaataatagtttattttgtgacttggaatagcttttcttttcattcagcggatcattttaggtgtcattcagtttattttaagtagtgtgtttcatcctgagcggattaagaattttattttttaaaactctgtactgtgttgcttcctactgggaaatttacattaaaaaaatgttcgtgagcaaaatctatttggtcaaaaagaatggcccacgattatcactgaatttgggatgtttttcttctaagggacacagttgattcttactcagaatcatgcgagtctgacatttcatttggggaagtctgaggaagttggtgaggtcttacgttaataaaaacaagtgcttctttttcttcttatcacctttcagtgtctgctctgctggctcatgcagtgtaggttggcttacctctccctggaagtcacattgtccttcagaactctttttactatgacccacaaacagttttcagacctcactctgatgagtcaaaggtaaagctgtgaataaacagatggtgaaacaacatttgcagttctctgacttcagtcctccctgaaacccacttggaatctagctctgaattcagccggacatgtttgttcttcccttttcccatcctcacctactcctaaccttcagtgttctctttaccttttatttttatttttgtcattttagtagtaaatgacagggacatagttactcaatttgtaaaacattgaatggtgaggtcaaagattctatgacgagcttgagatttctaacaggttcagatggatgacagcaacattttgctggcttaattttggagctgtttttgtaggttttgaaatgcagtttaatagtgagtaatagagaagtttctttctgccgtggagctactgaacccttgaaagtaacatgctggcacatacagatgaactgtagccccacatttattccttgcttagtggtaagctgtacactgaacaatagaaaacaaaaggctatttttctttggaagagcagatactgatttctggacaaagtttatgttgtacaagttaaacattttttattcttttctggttagattttctgccttttaaaaaattagcttagttgaaaaagcaggtattattaaatacagtttattttattgaattggacggacaatcgtagaattttaaagcttaaatggctttaattgaacctaatgttctaattttacagaggaaacatttgaggcttagtgcggttaaatgaccactcctacaacacacagcctgtttgtttgatggctgaggctgaaaaccagactccagactcctaatttaatgcttttccttcattggtcatgtctttttagcttcagtgaagatcttttttttttttttttttttaatttttgaggttatttaaaaaatactttgccttgaaaatttaacatttccacttaatcattctcatacttcaagaacagtttctctgttaactttctgtttaacttcttaaaccatacactgtggaaattatctgtctatatgctgaacagtctttaatgactgcatgtgtgccgtagctgttgagatgttttaatccactttagcaaaaggtttatttgtttaagaaaagtgcagtgttgtattaagtctaagcttagaacaatgaagcatcatctcccagctactgggagtgagaatgggaggggcagggagtggttggtactatgagctgctctaaagaaaattcatttcagcttcctcacatgttaatacaatcatatttcagtgaagcccttcttcagcaacagtcactaatgatagagtgatgtgtttagacttgaaggttctttaggtgctgtttaaatgaataatgagtgtagttaattcacaatacaggtgaaaagttaaccacagagtagtggcactgctctttctttccccgtcacctctgtgcatgatctcttgctgcgccattagaagggatgattagaatgggcaaatattccctcccggtgctcctggcaataggaaagcactgtgggtgagatatgtctgcagagcagtggtatagtttcaggaagggacctcattctgctctctggggcaaagcttccgggtgcctgagtgggcctcttcctagtcgatggggcagcttgatggggtggctatttattggtgaaaacagtatccatgtcccattggttattgggacttgattcctaatttgaacttaggtgctgtgaagagacttatgtaacgctgtttaatccatgtttggctttgttagaagagtttaaaatactcagaaggaagaaatgtttggttcctttgaaaaggcagactgttcatttagctagggagagcctcaccaaatgagtcaattaaaaacatttggggattaagcccagtgagagtgctgtttttatatgagacatgaagagggtgggggaggggcgggtggaactatggggaaacagcataggaaaaaaaagatctttagaaaaggaaaaagttagccttagctcttcagagagcactgggtgggaaaaaggatttaagtggaaagaagaaaagccctagagatttttgtaccaaaaaaaaaagagtgctgttaaaaagatgaatcaacagctatattctaaatggcgtctccttaactgggatttgaagggaagagaaggcctgagtagagtcttagacaagtccaagggtaaaaaagcaaacagatagttgaagaagtggaaattataagtttggtggcaaaaacttacttgtaattagaatttttgtgtccttaatacttgttgttatgctgatatgataatatgctaataatatgctaaggaattttcccaattcataatctaaagcaaaattaactaatatatgttctgttatggaaattcacctaaattgcaccagcaggtgtattcatcccgctaatactaacactctgttactagctccactgtggcgtttccactgtaacgtggtggtgttggtgctactcattgtgacagtgtggtgtcccaaagagtgagcaagcctcgccaacgcttccttaaaactcttactgatggaactaccatgtttatatagcaagaatattagagaaagaagagtcgagaaaggattccacaacacacatctagtcttttcctctcttagcttttagggtcaacactacctttctcttggaaatgagaaggggagaaaaccttttccactattctgaaaagagggttttaaaaattctctcaggtcgcctaagctggaggggctttatgacagcactaaccagtaggtcaaaaaggaaatttattttttcccatcataggttcctctctacacagagaatgcaaaaccgtaattcttaagagttcctcaatgattattcacttttgttcttacttccatatttctctagtaaagatttaaatatttaattttgtagactcctgaaataactgcttccagatagtatatttactcagaatattatttaaatgcattaatgctgacattgttagaaaggggagaaaactcaacattttccggcagaaatcattgtaaaatgtattataaaatttcctcccttcctaagtagagtgctactatatagtgaatataatttaactttttttcttggagacttattgtcatttctgtgaagttattacctcgacatagtagcgtcctgatgcctcaaaagctcataattcttctcgatgccacagcctctgtcctatctacttgtcttggttgtcatgtcttcaatctcctttcatatttgcctatatctgtaaacttaagagaaaccagataatcaatctgataaaatcactaagctgaatcatatacattaattctcattcctagctctctccacctagccagtgtggcctgaggcattcatagccatgttctgagtggtgaaggctaagagagcccaggagagctgtccagggttaaataagacattaatatataaagtaaggactgtcggtatacgtgatatttatatgttatcatattacattttatttatttatttattcatttatttatttgtatatatagagagagaaacagagtctcactctgttgcccaggccagagggtagtggtgccatcatagctcactgtagtgtcgaactcctgggctccagtgatcctcccgcctcagcctgctgagtagctaggactacagacttgtgcgaccacacttattttttgtttttaatttattttttgtaaagacagggtctcattccattgcccaggctgcatttttaagtttagtaactgcccaaatggacattgggtaaaataaaaataaatacagtcacttctcttcttaaatcattcacctctcaagatgaaggtactaataggacattttctagaacttcagtgttaaccacagcaaggaggaaagacaggcctgttagatgtagactaagaacttcagaagctgtctccgtcctaggctgggcccagggctctagaattgtcccacacacctggtgggcttgcttgggtacttgggtggtacctgggagatgatgacctgttcatcttcagcttctgttattccaggaaacagaggtagtcatctggatactacaggtttgccagctctgctacttctgcttctactgcaggaggaggagctatggaatttttatgcatgcatcaaaacactgacttggctcataagactgcttaaaagacagagtgataaattacgccttgtttctcatgaaacagatttttcccaaaagtagaaatactaatttataatgtatccttttcagaaagattgtaagtctaagtttctcagagaaacagtgtatgtgatggcaggaccccagtaaagtccaaaatatcccataatggccttaggaccatgcccatcatagtctccatagagccatggtccccaagagccatggtgcccaagagccaccacttcagtgggtggtaggtggttgtgaagaatggtcactgtggttcacagaataacagtgacaattgtgaatagaagccagtcattacctaactgataaaatgagtgaggctagcaaagggcctgacaggaagtgaaatcacttactgaagtggtggtagagtacgcaaccaagaactaagaacaggagggaagttaaccctagggagagttcgactccacttgaggaggaacattctggcaatcaggactgtctaaaaatggaacaagctgattgatttagcagtgaaacctctgtcactggagatgttcaaacagaggtagtaggaccctcttatcaggaattctccagagaggagatgtgagttggatagaaggttattgtagacgaccacttgtttctctctcagctctgaaatgtagtccttaaggctgacgtgtgtttcccagtttctaatcggaaaagataacataatctacagtgttgaaataatttaaacaaagtaaataactgtgcttttacaaccataatacggtttagcctttcattattttgttacgttcctcattaacatagacataatttcttttaaagaagggacaattgtgacgagcctgggcaacatggtgaaaccccacctccactaaaatacaaaaaattagctgggcgtggtggcacacacctgtaatcccagctacttgggaggctgaggcaggagagttgctagaaccaggaggcggcggagcttgcagtgagccaagatcacaccactgcactccagcctggcgacagagcgagactccgtctcttaaaaaaaaaaaaaaaagaaaaaaaaaaaagaagtgacaaaacttacccagtaaactaaatgttaatttcctcttctcaggagcataatactaacttactcctctgtttttatatttttgagtactgataatcggatagtgatatatttgtgttattttttgttcaaacaattgaattcattcttagcaagaacaaaagtctatttgaaacatgtaggcatcttaggtagattaaatttttcattgtttcaagttttgacttttgtatttctgcacattagtgatccttgaagattaggcaaggccaagttcttttgacttttataattagtgtgtcggaatcccagtttttcctaccctagggtggactgtattttttacaattaactctgtgaagggtgactgggggtggactggtgaggagaggcttccagttaccagagagcctgtgacttactctctgtgcttttcctaggtcaccaattttcaaagaatttgagtataattaaatacacttcataataaactaggctgaacataatttaatctttccctgaaggtacttcagagtcttggagtgctttagggccatgatgagcatcaattatgttctcacggtgggtgtgcagaaggaggtagttaatagagttctgtttgatcaagtcctgggtgactggacatgtgttctgttatgattagcagttcagtgtccaggttttggaactgatgcttagtattaaattctcaggcaggagagaatggaatagagattgacctctttggctttgagaggctgaaagttgatgacgataattcacatgtacatggtatatatagcactttttagcttccaaagccctttcacataccttgtcttccattgcttgtttcttgtgatgttctggaaaggaagcaaggccgctggtatcccatttttacagatgaggacagtggagctcaggaagcttgagggacttgcctaagctcatacagtagatcaatggcggagaccactggacttcaaattcagtgctctttttagtatttcaaaggatactaaacatttgctcacatctctgatgttctttgtgctgtatgtgtagtaactcatttaatcctcacagtggccctgttagtaggtagatatcagttcttctggtactattacgattctcatcttcagagctgaggccactgagaggcacagagaagttagggcatgcactagtgagtggcggagctgaaatctgaacttagagctttggctccagagcccatgcactccaccattatgctacatggctactcagtgtacagatacactgagcttaagtagaggagaaagcttatctatccatatcttcccatctgcaaagacctctgcctgtatgggaggtctgggctcgttctgactaaggttttgaacccagatctgccaatttgagatcttgggcccattacttagcctgagcttcagtttccacatctctaaagtgaaaatatagaacatggaatgtacctgtaagaacacaatggaatacaggtaaagtgcccagcacactgcttattccttagccttcatgttttagaaagtggttgctattgtttttgttgttggtggtggcggtagtggtcttcttcttattattatttatatatttacaatggccaaaattatatgaaatgttttccaaaaattaggtatttgtacccttcatatgaatgtgtgtgttaattgggtataattgtctttcttgagtctttaaaatagacaaatcttttgattacatttgttaatattattgtacctacctatatctgacttgacttacaattttacttcattaaatacatagcaagtcatctgagaacccaaagtaatcatacagattacttgccatatagttaatttgtgactgtgatatggctgctaaggtagaggtttgaatttaaaagcacaaagaaaaatgtttacttcaatggttacaaatagattaatcatataaagtacatatttgcagagtctcgctcagtcgcccaggctggagtgcagtggcatgatctcggctcactgcaacctccgcctcccaggttcaagcaattctactgtctcagcctcctgagtagctgggactacaggtgcgtgccaccacgcccggtgtatttttagtagagatgaggtttcaccatattggccaggctggtctcgaactcctgatgtcaggtgatctgcccgcctcggcctcccaaagtgctgggattacaggcttgagccaccacacccggcctattctaaggcttgttctaaggctcacagatggcaccttctctgtgtatcctcacatggtggaagaggcaaagcagttcctgggggagttctttgataaaggtgctaattccattcaagagggcacctcccaagggctccactccctaatactatcacgtggggagttaggattcgacatgtgaattttggaggcacacagacattcaggccaaggcataaacagtgaccacttttgttctgtctgtccacacactgcctagagcttccatttatttcaactacatttgcttttttcttatttatctgttcagagtatcttctcagtggctatttatttaccaccctttaacatgttttcttgacattgtacttcagcctgtatatgctttgcaactcaggaactatgctggcttaactaatagtacctacttaacaggtgaaactgacagtaacagcttaataggtgctttccatttttaacatacctcagctttttataaatacaaaaaactctcaatcttttaatgtggttttaaattttaaacaggtcttctttcattttcctttacagaaaactgtaatactgcatatgcattttcaaactatgcatatttcttcttcattccatgtggaagtttttattcagcctttcagtaaattttacttagcttgtcccatggatgccgtaggtgtaaggaatatgatagtgaacaagacagacagagctcctcccctcagggagctttgccatgatacacgatgatgacaatgataaaaggagcaaataatgatttgggacctgattccaaagggatatttctgcgacacttacaatgaaattccaacctggcaccatctttttcactgcagaatgcatgaaggtggttgcatcatgtcatttcgacatgcatttaaatgtaatgaaaggcacaagtagtgattgcaaacactacaataagttgcttgttgactctcttactgtcttccttcttatctccctttcttcctttgtctcattctcagttttcagagcttagtcattatttcgtaatcctctcctaaaatgaaatctggggctctaaggacaggaggcacaggttgtgtttgaacagcatcatcgtgctttatgaaggggattggaggggagattctgccccacagtatggtcaggtctcgctccaggcagcactgactacattggtgctggttgggtaactgtggctcggcaggtcactctccctctttccacctccgttttctcattattagtagaagtcgaaatagcatggttttctaaggcctctgccaatctacaattctgtgattcatatgttcctaaacacttgagttactttttctcaataaatggaaatatattttccaatgaggctggaaatacattttccaattatcctctcccctggtttataacatatcatcaatgtgttgggacttctaacactgcttctgctgtaagcccatcaagaggttaattacctttgaagaatgaggaactgctggaaaagaactgtaaaaccttcaagagaactttggagttaatccctctggtaataggaatcaatgtcactcacacatctagttgccagtggaggaggaataacagcactgggccaagtagacttgaaggaaggcaggttgctgatagagtggagagctgaagattctgaatcaagctcatcatgactctcttcctcctctttgaggctacccaatcagagcaaaaacagtattttaaaaaacctcaactggatgagcctgatgcagtggtgtgctcatgcagtcccagccaaagggtcacttgagcagaggagttcaaggccaacttgggcaacatagtgagaccccgtctctaagacaaataataaacatcaaaattaaaattaaaaaaaacccaacccagtgttcccttcagaatcctgagtggtttgtttcatcttcctctattctggcttgtgtcatcttcctctcttgtaatggataaaaactccaaatgaagacaaaaatgaggaatttgtcaaaaaaattgaattgccaacaaaagccatctttggttgatcaaacggtacagacgtttcagttagacaagagggctaagtttctgagacccattgtacaggattattaatattattcatttttagccctcataataaggtattataaatgtcaagattgctaaaagaatacgtttttaaatgtcttcattataaaaaataagtatgtgaggtgatggacatattaatcagcttaatataatcattttatagtatatgtagctatatcaaaacatcacattataacccataactacatgcaattattatttgtcaattaaaaatacaaatctaggccaaggtgggaggatcccttgagcccaggagtttgacagcagcttgggcaacatagggagactccatctctacaaaaaaaaaaaaaagaaaaaaaaaagaaaaaaaaaggaaggaaaaaaaagaaaaaattgactgggtgtggtggctcttgcctgtagtctcagctgctcgggagctgaggtgggaggatcccatgggcccaggagtttgtggctgtagtgagctatgatcatgccactgcgctctagcctgagcaagagagtgataccctgtctcaaaagtaaaaacttacaacaatataaaaaataaaaatttaaattataaaaagccatcttctttcccactccttcccattttgatacaacagtcccagaccccagacttgctttcctcatgagtcatgcagactcaagtattgcagttccaaaacactgcctgactcaccagctccatccaaaagagtatgtattgtcttcatatgccagataggaaattcctgctgcatataggaaaagcagtgtgtttaaatacatggacacacacacacatacacacacacagagtacacatatacacatctgcatatacacgtacacatatgcgcacatattcatactatatatgtacatacacatgcaatacacatgtatacacaccacacacacacatacacacacatgcatctccaagtctatttccatgctttttttcagtaaagcacctagacaaaggagagagatgtctaatcaggttttggtggttgtcagggatatcataaatgagaatctcaagttactaaacttgatttcacaaaatagtttattggtagttttagaatggcattgcattttaggcagccccaattgtaaataagtgagccgggtaaaagcagattggatgtcacccagaatattttctggaaaggggacatacacaaaattctctctttgcacaattaccctgttttgggtttgcaatattatgttgagcaaggctggctattttccaccaacaggatgttacagcttgtcaaaagttattcaacctatagtgttaagcaggtacttcatcattactgaatttggttgatgctctatggagaaagccaaagttaggagttttgtctgtcattgaggtagagaccctcaactagggaagctttgaactgttcatccagctggtattctgtaccaccttgcctctggagttgagcttagaaccctacttccattttttctgtcacttcagggctgtttcaactattgtttcttcatttacttatatcaagtgtgttttctcaattcataagcatgggagaccccaagagacagatatcgcattagtccttttttgtttgtttagcaggaaggtttttaagtaaagctcctaaatgatatgtctcattctcatggaaattcatcaatattgttttactgtctcctatctggttactttttattttaggtaaccactgtgatacaatatacacaagtccctggatcatgaaaataaattgaagagctaatgttaatagtaagttctcaaccaggggttatgctggaacccaggatacataacccacaggagggccctccgtgaactcagttttcatggaattgtcccataccttcacaggtagaagcatggctatgttaaaagtggccaatgaaagtatagtttctttatgccttatactttgtttggtgaggatttctgccagaggtgtttgtttcctttagttttctggttgctatgattttatacagctttggtgacctctatgagtaccagataaagttaggtatgataaaggcacaaaaagaccgtagaagccatttgtattctaaatataaatatacagactaaatttgtatgcatttgtgtcttcattcttcacggtgctgtatcctccgtgtgtgtgtgtgtgtgtgtgtgtgtgtgtgtgtgtgtatttcttctttgattccaggctgcttatacgaaaatgctgattcatagtgtcactgtcttttctttttcctgcgaaattctaaatccgtttctaaactttttctacaactctgagtttaatctctctaaagtttttttttttccctcttgcggacacaaggcactttgctttgtttatgctaataaatgtcagactagcccccaaaaattagaagaaatgccagtaatttcaaagggctcttgagcatgattttttttcctgtttcttaatacattgtacttttcagagtttaagtttaggtgcatgtaggtggtattagaagattcttagattttattggtagcatccagacaatcttgtcatcacccgatatatatcacctctatgtggtagacccttgtggaaattttctcatcacgaaagtcgaaagtttaattttggagaggaagaggtttttcagatacattaaataggttttgctacaataaggtgagatggtactttcaattgagcatttctcatatactagcaagcagacagcttggcctcctggttgtaattacatgccaatggcttggtgctttttattttagaagttgagttcatcctgaattctctgagcatatggagtagtgcactctgattgttcccattaagattgtaattccatccaaggcttatagtgtcattgtaaacactagatggaattacagccccatgcacattttggaagactgcattattcattgaaatactttataaagttaaataattttgtaaatatgctccaagttcatgggacttagatagaaacataatcctggccacaaaggaggttctcagtaaatatttcttgtttatttgatggactttccttatatctttaaataaactgtatttttaaaaagtgtagagaggttatacttaaatatttgtaggactttaaaagatcttgccttgaaatgctcttacggtttcttgcttttcattgatggaaaaattgacttcccatatgaatatgttatttaatcttttctgtttctagcctagagagaaatactgagtagctcgagtggtcaagaatctttattttagggacatccgcatgtcctaagtaattcccttctatataaatatctcttttcggcataatgtgttgcatgccttcaaggtggaccactatgaggtgaataattacacaacgggaagcctggctgtctcgtggaatattggatggatggctttcttattggtcttaattaggacagtgttgttaagataattcactaattcacagtgcgttatcagatttgaaatgacctcttttttttatactacttcggaagtgtatgtataccttttaggaaagacctggaaggataagttgtatattttagtatctgatatggttttaaaatttaagactctgtgttatgtatgttttgggatgactataaataatctgtgtaacaaggtattaccaaaaaccttattgcctttgccaccatgcactgcaaaatatagtatcaggaagcgaaaagacaatgcattttgagtaatttttagaatttgcatttttgtgaattgacatgtatgtatggaggacttttcaaaaaaaacagaacttttcattaagaatattcggtattaagatattgttttaaatgtcagatatttttaaaatatatgaaaccatattaatcacgtattacttatactttttgtccctggaaatattccatttttaagaacagagataacaaataaatataccagtaaagctaaagtcagtgctttctgctcttaaaataatttattgaacgataaaatgaatgtctttgctttgtgaaattatatttttgtttaggacttgataatgcttagagaacattttagtttttacagtttaaagaatgaataatgactggttcctctgctccctgatttgtttccatgtagatagtacttcatttttattacctgtaaacatgtgttagctttatcaattaggctcaattgaatgaagcataaccccctgaaaggccttgccagtaaaataataatagtaataataatattcttttcttcagattctagcagggagtactgctggcttttatgtaagaagtcaactttaaaagtgtttttgtgtgcgtgtggtgtgggtgcagcagcaatattgtgtattcctttcaaatcaagatgcctcatagtctgtgggcgggggaactccctaagatgccctcactagttactcattcatttgttcctccccagaaagggaaaacccaatgctccacactccacttattctgaataatgggggcggggaggtggtggcgtgaggatgtcagtgtcattgggcaaaagccttcatttttaaagtttagcaaaatgcagttttattgctttatgatcagtgtgtattacaagctaatatacaaatggcattagtgatcaaagtgggatactgatgtggcaaaaatttacaatacacttaacagattgacctgacataacagtgaaagcatttgaattccttcccacatagtaagtaacaagtaatttctggagccagaagtgggagggtgtgtgtgtatgtgtgtgtgcatgtacgtatgtgtgtgtgtgtgtgttgtctgtagaagttaacaaatatgttagttcattgaccatttctttcgttgtcctaaagaaaatttcactcacttgtgcttctgatttgtttcccgtgaagtctcttatcactcttagaacatgaaggcgaattaatgaagaatccttaattcttcaaaaaaaaaaaaccagccctaatttaagaaaggagacatttaacttgctaataagatcctaaaattttataggttatataatacattcaaggaaattgaattatatattcattaagaatacattatctctattagcagagagtaaatgattgaggttttactgaacgctaaatgctcagaaagtaaatgcaaagaccatcactggttgagcacgctgggaactgggtggaagtcttaggcctgtcattaactgttgtgcggcctttggcaaataaccgaagttctctgagccttaggaaaatgaggaagttgggttatataagtggttttcaaatgtggcttcagaaaaccctggagagccactgcactccagcctgggcgacagagtgagacaggcctctgtggaattagccaagggtttgggtaaggggtggggctgagacctgagaatctttatgttacaacagctattaggcaatgtcagttcacaggaccactaaatcaaacaatccttcagaccacttccgactctcaagtttcaataagtccctagaaaacatcatccttggtccacaggaagcaatccaataaggaacttggtctcccataaagaatccaataaagaaaactttaaaatgagaggagggttatggatttgatcatctccaaggacccctgtcaagcaagtctaagatctttccaaaggagatctgagaaatatgtctgtatcccaagaaggtttgacaatagtccctgaagtttgggggatgacttctagatatccctgtgccttcaagcgtgatcatgggctggatttgttggccccatggtctgcctctgagtcacagacaaatgatgaaaaaaagaacaattttctgtcagcatgccagaccaagggaggggccaggagaagaaccgtgaaccatgaactgtgccactgctggaggcactgacagctccttggcaccagatgtgtgacctcaacccctgcagcttgggcacagataatatctcagggcaggggatgaggaatagaggaagaagggaaagttgcagggatcctggagtgttaatacccatggtggcggcagagcaatttgccaggaagaaaactctctggttaaccctccggcactagttgccaagcatgtttgtactagaatggagttcaaagttacaaacagagcactgtctgtttttaaggactcatatgaaaggtttgcttgtcctaagcctgaatccaagagtctgtctgtcataaacactttcaggtagcccaaaaatcccttcaatgtgatctccagaataggggaagacaaaggactcaggtcttcagctgtctgatgaggagtgagaaatttttctaatgaacatctctggcttatggatattaaggagagttcagtgtcaaaagtttctgcagcgtagttaacagaggtggaaagttgaaataaccttaaaggcactgaagctgagaaactgccctctttatcctaacagccacagttagttttggaacactgtccatggagaagctcagggctgtcaatttagaaagcagctgtgtgctggcccattgggcaccatctttctctcataggttgttctagtccaaggtgaagaaagctacattttgctctaagctagactgacatatggacttctagatttgaaccctaaacacaggaggaagtgattgattgtattacaaaaagaatcttctttggtaaataactatttttttttttaatggccagatgggagaaagcaaaagatgccttttcgtggtgttttggaaacctagatctcatcaactccctggttggttttggcggtcaaggctttttatgccagagcaactgtgagccaggtttctgaggttcttcctgacccatgttggtagcctcttaaaaataactgtcattccaagttcagctaaaatatataactcaacaaataaatacatataaagcatatgaatagaagcgggaaagtgaggattaacagactggagagtaagagtcttgccatgtaaaatactataaaacactcttaggaagtctcttgcttatgttattacttgtacagtaaatgtggagacctggatctcttcctcatggtcccttatttcttgttttcctgctgggaggtttcaagtagctgatcccttgcacatgtactttaaaacttcaattatatttgtcactggcttatcatgggcaatgtatgtgaatgtgactaagggtcctgataaattaaatgccacttttacatgttcctttctttttcttctattagtgttctttaggactttgaatgggaaatcctcaaacatgtaagtctatgtggcttcagaaaaccccagagaggccaggcgcggtggctcacacctgtaatcccagcactttgggaggccgaggcggacagatcacctgaggtcaggagttcgagacaagcctggccatcatggtgaaactgcatctttactaaaaatacaaaaattagctgggtgtggtggtgcacacctgtaatcccagctacttgggaggctgaggcacgagaatcacttgaacctgggaggtggaggttgcagtgagctgagattgcatcactgcactccagcctgggtgacagagtgagactccatctcaaaaaaaaaaagttctccccagtggcctctactgaattatccaagtgcttgggtagggggtgatgctgaggcctgggaatctttaataagaaagaagaagggaaattccttatgttggacccaacattgagtgtgttcagatacagatgttggcaggtatgggggcattcggaaggagaacagcggctaaccaagctaactgagactgagttcaagattcgcttctggttcagggggactttcgttttcaggctctaatacattcagaagagcaaatattggtactttaatcatgcatcttttccccctcaagttctgtatctgccacgtgtatattttatttggcatttaaatgcacagttcttataattgctgataaatagtctccattgcacattttgctggcactgtggcctcactgtaaatgctctctgtatgttcttgggaagttgcataatggcagttactctagtttactgtgcaatatgctcagtgactaatggcctaatcatgacttgaaaaatatataaacagttcaacagaagcagttgattcactgagctctttcatccagacaagggtgagctaatgggaataaaaaagacggaggtgtgcagcagcgtctttgatgtattgaagttagagcattcccacaaatcccatgcattattgctcattgatggcggatcctttttcatatgcatgaggcaggagtgccaaattatcgtcctaattggctctgacttggtattccttaatgttcgtgttacacttgttacaacttttttcctttcctctaaatactactgacagtaacagctttggagaggcaggctgtcacgtggccccatggcgtcaccctacactgcaggcttaagtgtggctctggtcctgtgctctggtttcttgggatagaattacagctgagactgtgcagtgcggacctgcctggtttacttcaggggcattgttgattgacacagattcttgttcccttgtcctcagtggcaccttttcttccaagaggaacagagatagagtcttacaacagccattaaatagaagatcctggggtctactggagcactgtcccattggtggggagaaataacaatcatcatcatcatgtctcccttcctttggaattgattaggtagctcctatattccacattcctctcacctgttgaccacacacaatttttggtcttgtagcttggccactcattttagctcaatcactggtttaatttttttaatgaaatcactcaatcgatagaggctaacctctcgtagatgtaataattccaaccattctcaaagaaataatgaagggtggaatattatgctttctaaaataatggaatttattttttctttatgcccacagctgtttagtcctaaagagggggaagaaagaatctttcgatcttttggcatgttccatgtcccgtattgatggtcatacttcagcttttttctggttgtttaagaattatgtggccaataggctgccttgtatataacagtgaaaaacacccattacttgtatttgtttcattttaaggtttaggcagttggagcataggacagtaactggtttcccttgttttctggaacctgccccttgctctctcttgggtgatgcctcacccctgccccagtgtcagagctgccctgggtccttcttcccttgaagggtctgatgaatgaaccacacagcttgttagtatctcagtttgttaatcctcccggaggaatgtatgtttcaaaaaagaagctgaaaagtataatggatgagaatttgctttggaactcagcacactgtagattagagaaggaaaagaaagaaaaggaaggaacagaaggacatgtttggggggtagggggcctttctggggcttctgaaagcaaatgttgtgataattagttacagtgtcccaaagatgcctgggtctacccctgaccctctacacaggccaattctgctcccaccagaaaaaaacaagagtacagagcaaagaggcagggcagcagcctctgatacctatttgaactttacacattctgatagaatttattatctgtattgaatatgggagactgtgggtaaaagacttcaagacagtgaaaaactaggaaagaaaaataaaggtgtattgggccttggcaaatttttgacacttacttgactatgtgctttaactttttgaaaaggcagataatatagcaatcacattaaatatttatctttaaaagaaattattttaaaaattactcttaatattaccacattatgaactcaataggagatcctacagttcctttaactttaacaacagtacatttgttaatattcattaaagttaaagaagcttactattacaacagaatgaagtaatacttgctggaaaacaccaatattttacttatctttatctaatccccccgtttaactgtagtgatacaatacttaattttaaaagaggaatggtttgaatgtacagacttttacatgtgttcttccattgagttctttcttgtagtctaacccaatagttatcacacttcagtgtacatgaaaagtgcagtaaaggattgtgcagtatacataaaatcctgtgtggagtgtcttgtgggaaagccaaaggattttcaaagttaattttgactatatatgacttttgcttaacttttgaacttaaccgcccacataaaaactcactccactatatttcccttctctttgcctccctacttctgtcccccctttctcccttttttccttcctcccttgtattcttccatccatccatccatccatccatccatccatccatccacccacccacctatccatctatctatcctcccatccacctatccacccacccatatatccatccatccatccatccatccatccatccatccatccacccactaactcatccatccatccatccacccacccatccatccatctattcatccttccacccatccgtccacccacccacccatccattcatctatccttccatccatctattcatccatccacccatccattcatccatctatctatttgtccatccatccaccctcccacctatccatccatctattcatccatccatccatcttttcttccatcactcctttctttttttttttttgagatggagtttcactcttgttgcccaggctggggtgcagtggcgtgatctcggcttaccgcaacctctgtctctcgagttcaagcgattctactgcctcagcctcccaagtagctgggattataggcatgctccaccacagccagctaattttgtatgtttttgtagagatggggtttcaccatgttggtcaggctggtctcgaactcctgacctcaggtgatccacccgcctcggcctcccaaagtgctgggattacaggcgtgagccaccgcacccagccccttcactcctttctttttctctttccctgccttccttttgataaattaacttaaacattttttttggtgaaattaatatggtgatgtctacttatatttaaatcagaaaattattagtatgctgaatattccaatctcttaggaatgataaaaatattctataaaggtcaatcttaattccacatcctatgttcctactcagctttctgtctctgatttctcatttttagctgggaacatcccagccaaaagacagccaggttctctgtgagcatagcatatcaaactaactgtaagaaaataacattttggcttaaaagccatcttctaatataagatagaataaaaatgataatgattggtatactatgtggcattgttagtaagaatttgaagtaagatttacctaaatcgctgaaaatattgaatagttggctgagactttagaattggtacaaacatgtacattttctcaaaatcaaaagaattaaaatagatatccaagaagtcagattatgaaaaaataagatagtcaacggaaatcctaaaagtaacttaaacattggcattggacatatttcatttgtatttctgccatagaagagttaagttaatgtgcatttttgccatgcaatggcaaaatgaagagacttttttttcccttctttttgctcttggtaaaattaagtggcaaagaaaagatagctctgaggttattgctagaattttgtgctaaaaacattttggctagagcagcaagtttttaggcaaacagcccctgataaaagttgcaagaaaaaaatctcattcgagtgcaccaaacacttttcagatgaccatttaatttttttaagttgcataaacaatttcaagtgcactgtaaatatagaaaatagggtatgatagttgacagaaacagaatgaattaagagcagtaatagaaaattgtaaacaattatatctgaatttcatcagttgtcttgcttacattcacaattagtcatcccgtgaaagacataggtgaacatttagctgcttaaaaaggaattagctgcttgaaaggacaaatgttcatgttaaatttcatgaagactaaccttcagcagacaacggcacaaatgtgtcagctttttctggtgtgaatgaagcaagatacaggcaaaacagatgagataaataggacttggaaaaaaaattctactatacaagttttgtatccccatctttttgctctttgtggagcacctactggaaaccactcctgacctaatgatgaggacacagagagaaaattcaataagcaatggcctgaaaaataatttttatctaagtattagataaacgcagtagcatatttgacttgtaaaaataacatggctaggctttgtatgcctccctgtcctcttacctacgtgggattttcaaatagcactgattctggggaggggaatcaaaaaatagaagactcccctctcccagagcacacgtaattaatgcctgtgttgcagctgggagctctctgccagcagagttctttgctcgtcatctctcagcgctcacccacattccccttgattcacaccgtattgtttgtttacatgtttgtctccctgactcaggttggaaatctttaaggacaaggacaacctcttgttcctttttacatttcccatggtgctttgctcgcagtggccactacagacatgattcattcattgttttaaaaaaagtgttaactagttaagtgaaaataaaatgaaacagcaaaatgagacaaacgcctagatctgaaaggctacaaaatacagcagagggttcagtggacataagaggaaaggaacacaatgatatccccaatcttgtgatggaatagaaaaaaaaaaagtgattggtgttgatgtaacacttttcttggccagttgaacattccagagtagaggtcagttttgtagttaaatctggtaggaagatgtttccaaccagaaggaatcatactaaaattattttatcacaacaagcagtccataaccgaaactttaatttgtgagttgggaatcaggataggaaacccaattttatattctttttataggaagaagaatccattccaccactcagactgctttcctctttcataatcgtggcatactctgccattgtttgtttattttccccacaactagatggagagtgcaaggaccatattttactcatgtgtatcctcagggcctagcacaaagtaggcactcagtaatgaagaagtaagatgtttcaatgtccctaacatttaaaaggatgtatgaaactagtgctaataccagaaagagttggttttcataggctgttaattgtgggttttgaaataatgtactactttgtacattgattttatacaactgtgttatatacttcagtaactttcaaggtaaaaagttagaggttattaaatctggcagggtcttaaaacctgagtctcagtccatgtaagagcattcttttgctcttcttgactagccatgtaaaagggtgaatgtaagttagtgaattatcttttagaaatcttcagttgtatatatatttttttcatcgaattgcaaactcactcacacttaccaatgtaatactaccctgttgatgagcattagtagccttatttgggtagccagattagagacacaggcttcatggtgttacctgccttgatgttttcattcataatgcagcatttgggaatgcagcatttttctatattggagacatgtatgatgatgtgtatgttccttccccataaccctgtccgcttctcctttggcagtgtcttgcatcacaattttattttatttttatttatttatttattttttgagaaagagtctcactccgtcacccaggctggagtgcagtggtgcaatcttggctcactgcagcctccacctcccaggttcaagtgattctcctgcctcagcctcccgagtcgctgggactacaggtatgcaccacaatgcctggctaattttttttatatattttttttagtagagatggggcttcaccatgtcagtcagactggtcttgaactcctgacctcaaatgatccgccagcctcagcctcccaaagtgctgggattacaggcgtgagccaccgcacctggcctccaattttaaatatatgtaggctccatctccacctctccctgaaaaaactttccctgctcctttcgccttcatgtgtgccataagttgactgccatcaggccaatatcattacatataaattccctccacccttcgttttaattttaaaatatctgaaagggggaaagggagaagattccctaatgagtatgttgtgtgattcaggaccttggctcttagatcctcagtcatgtgatattttcagattttatgggactatggtgcaattgaagaaaggcttttgacagaaaatgtgaaatgatgaagtcttagcacggactcatacggcagtatttgattgcgggttaatctccaaacgttgaaataaagtggatctgttaaaaagccattggttactttcagttgccaggggtgtgtatgctcacattcctggaagcacattctataaagtcaccaatctacaacacagacacccacctccccctagacttcagagagctctgctgggctgcagctttctaccaaaagagttgtgtgcctctgaatttcacatccaaccttggaagctgcagtctgtttaagatttcagaaagaatgggggctatgtttccagtttactgctttgttattttgaaattgaaagtctgagcagaattcagaactacacaaaacaggatcttttcacatgtttgtttaagtcatgttcttggcaaaaacttgctgaggaaatgatctgtttctctaggagcattgatttcttactccagtacagtggccatttcccaggatctcattccaaaccatctgttttgccatcagagccagcctttcagtgaatgatctctttggtctacactgtgctaaaccttctgattgaaaggatttttattaatgaaatctaggtaataaagttgcagtgaactttaggaagttctctgtaggcagggcgtggtggctcaagcctataatcccagcattttcggaggccaaggtgggcagatcatgaggtgaggagtttgagaccagcctagctaatacagtgaaaccccgtctctactaaaaatacaaaaaaaaaaaaaattagctgggcgtggtggtgggcgcctgtaatcccagctacttgggaggctgaggcaggagaatcgcttgaacccatgaggcggagcttgcagtgttgcagtgagccgagatcacaccactgcactccagcctggcaacagagcgagactccgtctcaaaaaaaaaaaaaaaaaaaaaaaagaaagttctctgtaacagtcaaatagcaagtgctgacctctgtcgcctctgtagcagcagtatggatgaattgtgagcttgttggctaggttgggctgcgggtcattgtggaaaagccatgtttcccttgcctgtggctgggaataagtatagtggggccattttaaaaaaaagtcctgtggttgaattctgagtttgagctgttttaaaatgtcaaacagactgaatccttgggagactcatttgaatgagaccagcagcaatgtaagaatatatatatatataaaacacgttagagcatttccatgtatgggagggaactgatggagagaacacagaccaccacattaactgccacatgctgtcaaccagtggatctcaactggggaccattttgccctctcaggacatttggcaatgtttggagacactttttgatcgtcccaaatgggaaaacaaggtagcaatactggcatctagtgagtagaggccagaaatgctgctgaacatcctgcaatggggctgggggcattggctcacacctgtaatcccagcactttaggaggtcgaggcaggaggatcgcctgagctcaggagtttgaggctgcagtgagctgtgatggcgtcactacactccagcctgggcagcagagtcaggggtctcttgaatgaatgaatgaatgaatgatttttaaaaatcaatcaatcaatcaatatcatatcctacaatgcaccaaacagtcctctgcctcaaccaaggatcatctggcccaaaatgttaatagtgctggagttgagaaaccctgccttagaccctttccttctcatagtttccaagctgataaatcagcctgccttgacaaaggtgaggaggtaagctgcaggcgtgagtgggaagagcaggataaggaaggaaacggagaaaagaggtagcagcattgcatgaaaataaactacccgggccatatcccatttgtgccaaattaatatttgggattctgtctttatgtgtttggtaaagccggaaagtatgtgggtggctggctgggccatggcctttgtgttagaggtgacctgagtttcttcaaagcacctgtgttagtttttcattgctgctgtaacaacttatcaggaactttgtggcttaaagcaactgtttttatctgacagttctgcaggtcagaaatccaatacaggtctcaccaggctgaaatcaaagtgtcagccaggctcattctctgtagggactctagagaataattcatatccttgccttttccgttttctttcttttcttttcttttttttttttttttggcgggggggaacggagtctcattctgtcgcccaggctggagtgcagtggcacatattggctcagtgccacctccgtctccaaggttcaagcaattctcctgcctcagcctcccaagtagctgggagtagcccagcaccatacccaactaaattttatatttttactagagtggggtttctccatgttggccaggctggtctcgaactctcgacctcaggcgatccacccgcctcggcctcccagagtgctgggatcacaggcatgaaccatcgtgcctggcccacctttttccattgtctagatgccattgtatttcttggctcctggccccttcccctatcttcaaagccatcaatgttgcatctctctgtgctgtgtttccatagttgaatcttcctctgacacttcttcctccttctcagacttttaaacttccttgcgattacattggacccacctgtatcatctccccatctccagatccttaatgtcatcacatctgtgaaatcgcttttaccacgaattcacagactgattctggggattaggacgtgggtatgtttgaaggtcccttgttgtgcctaccacagactccaaggcatttactagagccacattttgctgacttgagctagatgtagcaaaagaagtgttataaaaatgggtttttaaaaaagcctttttttttcctgtggtataattttagtgtttagaagtaatttttcttttaatgcagtatgacacagaaaacatttggaggatgttgaaaagtaattgtttaaattggcaaagacacatttcagtaagggagtaaacaagagggaaacgtgttggggggaaaggtgtggggaggaaactctagaccagaggccctaggacttgaatatacaacttagtcctgttgaaaattcagattcctgggccttaaagtatgttaaataggtcaggggtggggcccaggagttgtacttttaacgagcaccctcctgtgattcatttaacataaaaggtccttggctcacacttggagaaacactgctgtagaaactcaaatacctattttaaaacaaaggtacattttaatcatttagtttaaaatgaaatcattgcataatactgatgttagaggttagaataaacatgtacttaagttcttgatattcttgtcatttcagttacatgtcagggaatgtgatttgtgttttgacgtattcaaatccttgtcatattcaaccatattcgtattcaaaatatataatgattttgacccttgattgttcgaattaagactgtcatcttttctgtgtgattaactcttgtgttgatataaatatgcctttggcttactaatgttcagtaagaactaatgactcttgggaatgttaatagactctgtgagtccctttttaatcatttgtaaccaggctgtcattccatgtttgtttggaagcttagagataacatttatgaactttgtgacacatagtagttgctcaataaatgttaactgtagaaacacattgattagtttcacttcagaaatagacacttagagttcaaaattcccatctgcctagctcctgaggcccactttcttaccagaatctttcctgataccctctcctgcataaaatggttcctcttttgagactttgtagctcttttgtacttctcttattctgttacgttactgcaaaaaaaaaaaaaaagaaagaaaagaaaagtgccaattgtgtacatgctttcctccctgctggaatgtaaactttgtaaaggcatgatccatagcagatacttcttattacaaactacctggcagaatttctttctaaagaacctactcagtaagcctgttggtgaactgagcaacatttggacaattatggcatcatcttacaatttttcagctattggttttcacttgtttagaaatgtaaaactttgcaaggacttttataaaagcaaatttcagaatagttattcactaagcttttttatgctaatgatgtcatgctatcaaaaattagctagagtaaatggactgtaatgaggatggtttgtaatctagattatatgttccacatgtaacatcgaaatgaaatataaaattgagttgttggcatgtggttgtggtgagcagaagcagttattatacattacttggtaaaattcatattcatatcttgtcagtttacagtgagccagagattaaaaataacatttgtttctgttttagtaactgcttaaaaatatccaaaatcattttattttctttagcctgacttctagtagtgttttgaatatgtggcctttcaagcagtaatgaaatgcatcaatgcgacttggcagtgcctcacaggacatgcttctaggatcatttttaatgattaaaagtcaaattgagttctaaaaaactgacccaaaatatagatgagccaagtaaaaacggaaggaaatctgaataaaatcttggttcttggtcctctgcatgtatcctccacatctgttttctccagatctcttttttcttgcttgttgatagcacagaggaagatcgcagagagtaatgtactgtatatgtttcacatcccccttcctctttagtgatagtttggagagtatactgcagtcaccatggttttcagtttggagagtacaaggatcagatctgtattttctagagccagcttttgtggcattctggagaggtgattggagaaccatgagagcaggcagacatctgggtgagagggcacgaggggtgagtgacggcagagccagacttgctggagaggcagaaagggaaggattcaagtagcataaccaggaaatagaattgataggatttggtccctgctgacctgtggaataagggggaaggcagaggagttgattctagtatttctaagttgggccacttagtgatattggggtaccaggaacaggcttagtggacccacagaagtgaccagacccaggagtctctctgagcgcccaccctggcttctctgtgttggcttaccctttcttggttgggggtcatggggtggtcagcttcagtggtgtggtctgaggtgacaggtgctcaggagtgaggacagggagtagacatcaccaatgtgaatgtggaggtaggcaacaagagttattctagaactgacaaatttaatatattttgctgactgctgagttccatttggacaaatacctaatgcatttggggcttaaaacctagatgacgggttgaagggtacaacaaaccaccgtgatacatgtatacttatgtaacaaacctgcacgttctgcacatttgtcccagaacttaaagtaaaaaaaaaaaaaaaaaaaaaagattgttcagttcagttcagagagcaataggagcagtttgctattcaccaaatagggacatcaattctttactgattaatagcagtgattcagaaaactgccttttgtagtagagcacaccaagggggtctgccggatggaaaaagagaacagtgctttgtgaactataattgttgccataagtaaatacttaaaatacactaaaatggcaacatcaggaaacatgactaaggagtcagtgtacgccacgccctttcccccacctttgtggttgttgaaaatttccaccaagagtgatgtatacaaaaaagggtaagatcagggtgttaggtttcagaggaaggcaaaaacttgtgtgattctataaatggagcttacaaatggaaatgcaccattcaaggcagaaagtctatcacagtcattaggaataagcattagagtgattctcctttcttaacttctgcacagaagtttgatgtggtaaagaaacagtctgctcttagccatgttccttgaaaatacatgtcttcaattacttggtttgtctgagagaaaggagggtttggaggagaaggaaatgcctcgtgagtttgacatactatgggaggattgttgttattattgcttgatttacatgctctcattttatacaaagtgtacagcacaatttctcaaagagtaattatgatgccaagaaaatggggtggattctgggcttcctgcagtctgtcatccaaataataatattcattacaaagatccttacccaggaggccaaggtgggaggattgcttgaggccaggagttcaagaccagactgggcaacatagacccctatctcaaaataaaataaagtaaataaaataaaataaaataaaaaataaaataaaataataaaagctccataccagtttgtggcattcctactgaaaacagaggtatacgaaatgcttgaacagggcatggaactggaggtatggatgtcattaagaatggctgagaattttttgccaagagttagtatactatcctactttattctatttcagtttgcagtaggacagacctaattctcttccctgagaaagtcacaaataaactagcatggagcttctcagtgggcacccttggctgaactctatagactcctgttctctttaataatatctaaagcttctggttcaattacatggctaatatcttgactctcaagaccaaaaggcaagatgtttaaaaataaaatcaacgttaaaaacatgcctgtgttccatggacacaggaaggggaacatcacacactggggcctgttgtggggttgggggaggggggagggatagcattaggagatatacctaatgctaaatgacgagttaatggttgcagcacaccaacatggcacatgtgtacatatgtaacaaacctgcacattgtgcacatgtaccctaaaactttagtaataaaaacaaaaaaataagaaaacaaaaacaaaaaaaacatgccagtgttctttagtcctcactcaattagagaaaaatgagagcaagcatgatattttgtatctggcactatgtgcactgccttgagagatttctctagaaggttttaagaacatctgtcatctattaatagttacgaaagccgagactcacacaaatgaggcaacattacagggggtcagagagcacataggtaagcccaccttgatgggagtcctggcccgaggcactttggggaaagagtgagctgcagtggttatagaaagacaaatgtcttgagccgggcattgaaaaatgactaagaataatctagaaagtgttcagtatgtttttaacgattgtgggttagcagaaggaaagccatctgaggtgagagaaataataagcaaaggggacagaggtggatggtgaatcaactgacccaagggagttaagcgtttagaaagcacttcaaaaggataacactacatagctccttgccttactgtggtgccttagagatgactggcatttttgcagagcttgtttcataaatgtgctttcagaggaataaacaggggattcgggctgggctgaggataccttgaattttgtttacagaccatcattttgtttacagaacatcagtgctctatcctcatgtccttctaagaatcaaaagttttaacctcacagaatccagcgtgtggcttgtgagtgagactcctttttccatgtgataaccggtctgctttggggaggcaaaagaatcttaccgacacgtacatattttaggatgggctctgagccaattcatcaagccaactcctcactttgaaacaagaaagtgaagaggatgtttcatgattgtggaatacctgccagaggaagaatctaccgaagttcagtcaactattaattggaaaggaggcagcagactgaggagatagagaatctttgctctcaggtggatggaggttggagtcctcaatctgtcacttgtgggtacattatgtagctccttcacctccatttctttatttattagaaggcgggtaataaaagtgtccactgcctaggatggttctagggcttagaggagataatgaaactcaagggcttaacatgtgaatgttagctattatcattgcatgtgtccattaacacccaaagataaccagtgttgtttagtagttctttgcgtattttctttctaaatagataatgatttataatttacctagttacttcatgaattgatttcatgaaaaaggtctttctgaatctctttccatgtactttaaaagtttattcctttagttaaaagaaattttaactagattcttaaagcctagattggaagaaagtgtttgctaaaaaaaaagtcatggctgggtgcagtggctcacacctgtaatgccagcactttgggagaccgaggcgaacggatcacaaagtcaggagagcaagaccatcctggccaacatggtgaaactccgtctctactataaatgcaaaaagtaactgagtgtggtggcatgtgccagtaatcccagctactcgggaggctgaggcaggagaatcactggaaccagggagtcagaggttgcagtgagctgagatcacagtactacactccagcctggtgacacagctagactccaaaaaaaaagaaagaaagaaaagaaaagtcatgtatatatccagaagaaaggaaatcagtatattgaagagatacctgcactcccatgtttgttgcagctattcattatagccaagatatggaatcaatctaagtctccatcaatgaaggaatggataaagaaaataaggtacatatacacagtggaatattattcagccatacaaaagaatgaaattctgtcatttgtaacaacatggctggaactggaagacgttatgttaagtaaaataagccaggcacagaaagacaaatatcacatattctcactcatatgagggagctaagaaacatgacgtcatggagacagagagtagaatgatggttagcagaggatggaaagggtagtgaggagggaggaataaagagaggttggttagtggctataaaaatatagttagatagtaggaataagagctagtgttcagtagcacaatagggcaacaatagttaacaataacttattgtatatttcaaaataactagaggaatgaatttggaatgtccctaacaaaaagaaatgaagtgatgggtatcccaaataccttgatttgaccattacacattgtgtgcttgtatcaaaaaatcacatgtacccaataaatatgcacaacgatcatgtacccataaaaataaaacaaaattaaaaatgcacacttctcacagtttcttgcctagtagaatccaagtaaatacagttttccgcccacagataactcttccctctggtgccctcatggtttatctcatgttcttgaccacatgggttaatggtctttgttaggttgtactcagtgatccccaagaggacaaatggtgggaattatggaaattgaggccagaaggaaacctagagttctgtgcttttacttccagtagggatctgtggggtttagaatgtctgcctggtcagcagttctcactttgggaacccccccacccccacccaagaccttttctggagggacatctgtaagatcaagattatttttatggtaatactaagacattatttacctattccattcccattctcttccatgtgtacagcggagtttttcagaggctatatgatgtgtgatgatattgtgtaatgaaatgtgtcaacttttggaagatttgcataattcactgaactaatataattttccaaatgaccagggtatgatgttacaaaatcatgcatagctaaagatccatccaaagttcaagatagactaatgaattttaatataaaagaatacttagagtttatttctatgcttcagattccatggtgctgctcccctttaagaaactaccacttattgagttttggtatgatataaaaaaagaatatccacaattgctgaaactattggccacatcttctccacatacttcaaccaaacaacatatcacagaaaactgaattcagaggcacagaagagaatttaaccattttccattaagccaggcattaaagagagctgcaaaaatctaaatggatctcactcttgtcactaacttttttgttctgaaaaatataattattttttcataaagatgttatttcatgtagtatgcaatgggtatattagtatttctattaaatgaactaatgaatattttacatttttctcaattttgcttctaatatggtataatagttgttaaatatgatctacctaatgaaaagttccttggggtcctcaataaattttaggagtatagaggaaactttatactcttaaaatttattgaggacccaaggagcttttaagtgtgaggaccaaaagtgtgaggaccactggcctagtctggtcagtgtctacaccctgtgtccactggtttcacctttcttctggaaaaagtgttctgtggtaaaatatattttgggcctagatgagtgctttctcccctcatagatttacaatacacatgaacatatgagaccctccaaagtctttcccaaatttatcccaacctttaaaaacaaattatcccaacctttttttatcctccttttaattttggcacaacataatgttccacaatggaatataacatcctatggaacgtaccggctggtatatgatatgggctgccctctttccgttaacaaaaaaattaaaagcaagacattttccttcaaatccatactttatttagagagaggcctataaaattcacttgcgaatctgattgactttcttaaaaaaacatactcttcattcattgtattatgccattttgcttatactctttgaagctgtttctacttctgtttccaaatgcatatgtttttttaaagctctgttttagacatttttgtgtgttaattagtagcatctgctccatgtgtcataagacaaagtaatttcatccccacaaaattgtccaaattgcaggttaagtggtagcagcctagctgttgagctgttactactgtttggtatttttaaatggcaaaaaataccttcggtgatgcatcacatgcctttaataaaacacagtcactttgggtaacagaaagatttagaaatggcagtgggttttgttgtatttctttttatgattctttctttccagtgctttagtttccattggttgtgggtacaatcctaagagtcagaccaaaataaagaatattccatcagtatggatcaaaaacatgttcctggccggacatgatgggtcacacctgtaatcccagctacttgggaggctgagctgggaggactgcttgagttgaggagttcgaggttgccgtgagctatgatcacaccactacactccagcctaagtgacagagcaagaccctgtctctaaataaataaataaataaataaataaataaataaaaaattaaaaaacatgctcctggctgctgcgtgatgagcatcatcttcctaagacatgagactgatacttgcaccacccagcaccagtttcttcccggcacagtgccattctaaatttgtattgaggcaggagtgcagcgagaatttctttctccttctgtatttcacatgtctatgccacagaaagaatagaaacatcttaatttgttataataattatagggacaatagtcactgtattttatataattcaaaagttctttttaaaaaattttttggtcttgccggttcctactgaaacacttcgtacagtttgaatccttagtgactttctattgccaactgaaaattgattttttcctatattaaaaaaaaatccagccgggcacggtggctcctgcctgtaatcctagcacttcgggaggccgaggtgggtggatcacctgaggtcaggagttagagaccagcctgaccaacatggtgaaaccccgtctctactaaagattaattagccaggcatggtggtggacgcctgtaatcccagctgcttgggaggctgaggcaggagaatcgcttgaacccgggaggcagaggttgcagcgagccgacattgcaccattgcactacagcctgggcaacaagagcaaaactccatttcaaaaaaaaaaaaaaaaaaaatccaaacagaaaatactgtggctatcttattcagtatcttgttcttttccttaccactgagtagtttcagggaaaaccctttacaattgcaaaaagacattcagtttataggactatttattacagcgttggcaaatggtgctggaaattctctaatagttaaatgacgcaaattaaccagactgaaatggaagaaccatactgaggttgctcttcaaacagcaagaggctacctttctgttttctttgacaactgaatatagcttatgatatagttaaggtatcaaagatgcaagaattgtagagctatgtggcaggttaagaagcctgatgaatggccgggtgcagtggcccacgcctgtaatcccagcactttgggaggccgagaccagcagatcacctgaggtcaagagttcaagaccagcctggccaacatggtgaaatcctgtctctactaaaaatacaaaaaattagctgggcgtggtggcgtgtgcctgtaatcccagctacttgggaggctgaggcaggagaattgcttgaacctgagaggcagaggttgcagtgagctgagaccacaccattgtactccagcctgggcaacaagagcaaaactctatttcaaaaaaaaaaaaaagaagtttgatgaagatgcagatgcttcattgcttgtgcaaattgtgtgattttagcatattctacagtggaaagtcaaatttcaggcatgcacacctaaagtaggaaaaatggttcttaaaggggtagtgtgatgcagggattaagaacctggtttctggagtcagatggcctgagtttgagtcccacctctaccatgtatgtgtgctgttgaacaggtgatttaacttctttggggctcagtttctcccactgtaaaaagtcatgtaaagttcccagaagagtgtttcatacattgtaactgtagtagttatctactgctgtgtaagtaattactccaaatcttagtggcttaaaacaacaagtgtttattatctctcagtttttctaagtgtgaatcactgcatatcatagctgggtgtctctagctccaagtctttcatgaggttgtagtcaagttgttaacctgggctgacgtttcatctgaaggatagggtgggggcggtagggatctgcttccaaatccactcacatagatgctagcaggcctcagtgatatgccatgtgggcccttccacaggactgcatcacagcctggcagtcagcctcccccaggtgagtaacccagaagaggatgcaagatcccaagatggaagccaccatcttcatgtaacccagtcttggaaatgatctcccattacctttgccacagtctgtttgctagaattgagtcactaaatccagtccacactcaagaaggctttacaagggcatgaattccaagaggtgggatcactggaagccatcctgcaggctgcttataacagtaacttgtgctttaatttatatccccttatggtctattcctgacaatcagaccaaatgagcccttaaaatgtaaggcagatcatgatactactgcattaaaaattatctctggtcttcccattttacttaaaagtcggtatctttacaatggcctacaaggcctttcatgcttataaaattatttttctatattttgtaaaataatatatatgtataataaatgctatatatgtatatttgtataaacacatgtttatatgtttagttatatatctagaatttattttccatatggtgtaagatagcaatctctttcgaaacgaagagccaggtttcccagcactatttattgattacaatacccttttcctgggccaggtgcggtggctcacatctgtaatcccagcactttgggaggtcaaagcgggtgaatcacgaggtcaggagttcaagaccagcctggccaacatggtgaaatcccgtctccactaaaaatacaaaaattagctgggtgtggtggtgggcacctatgatcctagctacttgggagcctgaggcaggagaattgcttgaaaccagaaggcagaggttgcagtgagctgagatcactccactgcactccagcctgggtgaaagagcaaaactctgtctcaaaaaaaaaaaaaaaaaaaaaaaaccaaaacaaaataaacctcttttttccctgagttgatattctactgagaacctgtttgtctcttattatgcaatctgtgtctaattgttgcatttttgaataaagatatacttagtgggtctagtaaatcatataagatagttgtgtttgttatgattttatttgatttgaaacattcaaatacatgtaaaaacaaattataattgagaattaattatggcaaacatttaataagttcctttatttgatagattaggaactaattttatttaaaaggccgtgacttacatttaaaagtccaattagctacaacattaagactaaaaagtatatttcatgactcccaggtcactgtttataggttgttgatatcccatactttgctgctgctgctgttgcttataactgttcagaaaattttcaccaaaatgtctatcaaattggaaaaccctctggagtgagatcctttttaaaatatagccaactttcacatatgcaggcatatctgtgaatgccctaggcccctgtgctttctcttctgctttttgggcttttggccttatctttgcttatgataacttcaaatggtaaacaagaagggataggtgacagagattaaacccaagccagtttgttttgttgattattattaacggtattgataaagagtttgctgaaagagggaagcatattgaaattattgcttaaaaagaagtgtgtagaattttcagttgttttcttttgataagagttgcctcatagctgttgtagtatgtgcaaatgaaggtcagcgataaatcacagaatgaatcacttccaactccttcacatctacagatataagtaagaatggaaaatattgtcacttagatgagtccttattttttttttctgtatgaatagtataaaccttacttttctggacacctagctttggcagctggtgaaggttgttaaagtaacaaatgggaccattctgcctctcccagatcgattttgctgcaagatagttgaaaataatataatccagaaatgaatttattttcttatggcaaaaacaaaacagaaagagagtactatgaggaagtatcatgctactggtaaatttttcaaactaaaaccgcattacatttcattaaatgagtttatgtccattaagcgtcaatgagcatgagtggttgaacccagaatccagtcaaagtacatattaactttctgtatgactttaaaaagaggtatgtcaacctccctgggtcagcaggttcctttgcagaagacattggaatgaaacgtcaaggacctcttccaattatagaatacctcgagatatgaagttggtaacaaataagagaaatgcagcaagatatttttagttaaaaaagaaaagattgatacaagccagtaacttgcagtgaacttgtttaaatcctcctcctctctccaaattctgtttttaccaagccggtaaagtaaagacagtttgtcatgctttgaacttcctggcttatgttgatttctatcagtatgttgccttacacatttgagtgggagctgagttacataaaactaataaaatccttacaaccccattttctgtgggtactgatagcatccaaaaaataaaaaaggcttttgccattttcaggcagttgttcctccggctagatggaaaattgaatggcattatctcaactcacatgtttaaacattaacggagagacactttctcctcctcaaaagtttttagtgttcccaggaatttaaccacagatagacacaactcctcaaacgtcccgaaaaaaaggttgactattccataaagtaatagttacagaaggctttcaaggaattagttattcacacagtaagcttctgaggcatacgagcatatcctctttcttacaacttggtcacttgatccaatctttgatgatcaccgtgggacctttggagatttatggagtttagggttacaagtatgatgtggccaccatactcagggaactggatgacagtcagccgatgggttttcaacatagatgaggatgagctcataaaaggctaaaaaaggaggcagacacctttggaagactgtttctaggctctcaaatggccattgtcaaaaaacaaacagtggggtggatttgactaagcatcagaagatgctttaacaacagcctgtgacaagtgagcgttaaaagctcacaaggcagaaaggaacttttcagagtgaccttgtcagacgaggttctaatgtgtaggctttatcagctgctctgagtgggggtaaagaggcatgcatattttaaacattcatttcatattcagtgtgtaaagtaactactgcttttcagcttgggtggagaaagtatttatcaagaatcacacaagggaaacccatgcattacctacttatagggcaaaatggaaaatgttctctctcttatgctttatcttttttgttccatcttaatagctctttatttaaaaagtattcacatcagttgattagtctgagtctttcatttgaagcaaactttcttcactttctgcccttgatactgcacatcagtctttaatcacttagacgtactgaatttttctttattcacatctttcaatcggtaaacttgaaattttgcaagtgcattcccactggtgtacattctgattttcaagacctgctacctcccccagtgtcatgcttgttttttttttctttctttcttccttcccacaccccacctccagtattttagggcaccttatgtagataagcagtgagatggcttcatcctgataattaacatgcttgtttgaggttatgaaatatacatttgagaaaggccagggatttccccctgaatatccactaactgcttgaagtggcattttcattctgacttggtattttgttttgtttgactgcagcatactggagcatagtgaaagagtctattttgaagcttcaaacttagtgctgctgcagaccaggaacaagagagaaagagtggatttcagcctgcacggatggtcttgaaacacaaatggtttttggtaagtcatccaaaagacttgacatcttttagctttaaatgtcatcgggcatcacttcactggtgtaccagaacttcttcttcaagcgtattgctatttctctacatcctaaataacaggacatttgaaaaaatgttgtcctagtgacagagcactgagagagcaaccgcatttactttatgtgtttgtttctgaaacttgcagaatagtatgatctgaatagaatgtatttgtggttagaaaaaagaacaaaagcaaaaacaaagcaaacccaaacaactaaacacacaaacagcaaataaactacatctaccagatactccattttagctgaaaacataagggattaatcgcacgagaggaagtagattcaatttaatggcaagttttttgcgtcttgtgatcaaatacagtcatgtgccacataatgaagtttcagtcaacgacagatcacacgtattacagtggtcccataagattataatactgggctgggtgtggtggctcacgcctgtaatcccagcactttgggaggccgaggcgcgcggatcacgaggtcaggagattgagatcatcctggctaacgcggtgaaaccctgtctctactaagaatacaaaaaaaaaattagccgggtgtagtggcgggcgcttgtagtcccagctacttgggaggctgaggcagcagaatggcgtgaacctgggaggcagagcttgcagtgagccgagattgcaccactgcactccagcctgggcgacagagcgagactccatctcaaaaaaaaaaaaaaaaaaaagattataatactgtattttggttgtaccttttctatgtttagatgtgtttagaggcacaaatgcctaccattgtgttacagttgcctacagtattcactacagtagcatgccgtccaggtttgtagcctaggagcaataagctataccgtatagcgcaggcgtgtagtagggtgtaccatccaggcctgtgaaagtactctgtgatgttgcacagtgacaaagtcacctaacaatgcatttctcagagcatatccctgtcattaaatgatgcatgactattgtgatgggcaaggtgaaagatgatgggggtttccaagtcctgttcagcaaacatttactgagtaacttttaagtatacatgggcccttgaatgacagtcttagtctgggggttggaattcaaacactctaaactataaataaatgataaaaccattccagagcatacaccaacataatgtggacttccaggaattttttttttatcaaccccgttcatgatattacctggaagcagagtcctcaaattgaagcctaggtctgccccacctatcttggtcaccttggagaacttgctcatcatcttggaacgacttgcctttaaagatgtatgtgcctaactgatctccaaggtctcctgcaaatttataattcagttccctctagtgcaatgaattaaataattatccacttcagttcttgcccaacagaatttctgtgtaggcttggtggtcatttgcagaggggctcattgtatcaaccagtgtggaggaaaggagccaggtcctcggggggtccctcctggccccatttgcccatttgacagccagccctttggtcaaacaggactgtcagcatctgcagtaaataatttttttgttttttttttttttgagatggagtcttgctctgtcaccaggctggagtgcagtggcacagtctcagttcactgcaacctccacctcccaggttcaagcgattctcctgcctcaacctcccgagtagctgggactacagatgcgtgccaccatgcccagctaatttttgtatttttagtagagctggggtttcaccatgttagccaggatggtctcgatctcctcacctcaggtgatccgcctgcctcagcctcccaaagtgctgggattacagatgtgaaccactgcacccggcccgcagtaaataatttattcccttgcaacattaaaaaaaaatgtggcacagtgctttatgaatattatattcatttttatgtatttaattttaatttatttatttatttatttatttgagacggggtttctttctctttgttgcccaggctggactgcagtggtgcaatcgtagcttgtgctgggaccatatgagactgggactatcctggctgtcattcataaagtcttcactgaatttttaggacttcgctgactggtctctctttatgaacttctgtcacatttagggcctgcatcatataaaatgcactgctatgtgttgttctgttagtgtttgtcatcacgccatcaggggtacacacagcttcagggcaggaatcatcatcacagaccagtagccgagactacaggcacgcgccaccatgcctggctaatttttccatttttttgtagatacgaggtctcgctatgttgtccagactggtctggaactcctgggctccagcaatcatcctgccttggcctctcaaagtgctgggattacaggcatgcaccactgtgcctggcctgaatattatatccaaataagtgagataggcttcttttgaaatactgtcctttgtttttctttaggggatctgactttttccttctctgtgcttgccgtcattgtgttactggttaccggccagcctgttaaccctgtggatccccacactttgttttacgttgaatagcatttattattgttctttcttactaaacatcccctttctgaagcagagcttcagaaatgatgctcagatgtcactcttgttagcagctggctttctgccttcaagtgatgcattattggggtttcataacagcatttttttttctcttacaaatattaaattatgaagtgcaggaaaccacatgaatgtggtagaaagcaaatgcaaacacagtgttatctggaagtgctagttttgtgattctcctggtgacagtatccttcctgtaatcaacataggaaccctctttacctgtttgctggtggttttctatcctgtatcttcctctccatttatgctgtatgccatggccactttgtcatgctgaatcgggaggtttgattaagacagttgcttggggactatctctatcaaagttctgcctcaccacaaatcctggctgtcacttacaaagtcttccctgaatcctcaggacttcactgactggtctctctctctctctctttttttttttttttttttttttttaaggcagagtcttgggtctgttgctaggctggagtgcagtggcaatcttggctcactgcaaccttcgcctcccaggttcaagcaattctcttgcctcagcctcctgagtagctgggattacaggcatgcgccaccgtgcccagctaatttttctatttttagtagaaatggggtttcaccatgttggccaggatggtcttgatctcttgatctcatgatccatctgccttggccttccaaagtgctgagattacaggtgtaagccactgcgcccggccctgagcagtctctctttatgaacttctatcacatttagggcctgcttcttacagaatgtactgctgtgcattactctgtgagtgtttgccatcagcacaattgcacatgggttgcacatggcttcaaggcaggaatcaaatcacagaccagtgtttcccaagggtggtctaatcccagtacctcctgcttccgaatctcttggatatgtttattaaagttgcagattcagcaacaccaggcttatgaatcagaagttctggggatgtagaacccaggaaactcaccttagttaacttttgcacactgaggtttgagaataactatctgaaaataattgtgcatcctcctctttgcctcctctcccacagcaaagggtccaggtctgagcctatggtaggtgtccaggaaatatttgcttgttgacctaagcaacatcaagccatgagggttgcattccctcttcagttgccaagctttttcaggatgtgaggtcagcatattctctgaacctttagaaacccactttcttccaaatacgtaaagtgttcccctagggcagaggctcttttggaaatctttttttgtctctttatcttttgtaatcactaactctgttggtggtaatgacaggagcccctgactaagattgggatagtggggacatcagctatgaggagctgggctggagcagcaggctaggagaaagatctgaggataggaaccggactgtgctaaactagaagctttatccttggctcccaaagccacacctgctacccttggcagtttattctgagtggtatttctttcagctgttaggcctcgcaggttgtcagttttggtggcagaagagcggtcccgctgctgaaaaggatcaagtttagctctagtggacgcacatcaaagcacctacagtgcacagtggtggattcaggatttgaatccaatgttagcagactgcagtggtgacacttggccctctccttccgtccgcctcttgttccagcaagggcatgcctggtcttggatgatccaggagagatttgcagggcgttgctgcttctggtgcacctcctgaatgcccttgctggtggctccagccctggtagatggaatccaaacagaagaactcacagaagcttagctagcctagaaaggaaccagcgtggccatcaggacatttattagctgttaatctaaccactaccaaatgcattaacacattttttttgacaactttttctcttttatttggctgttgcttagttcagttttgcttggagaagttgtggcaatcctgaattcagtttgtgtgaaaaagcaagcaccttcaagcccagtgttggagaagtatcttctcccaggtctctattcagttttgactaaaggaggtttggcgagcagaaaggtattaccgagtggattcttctcaaattctcatctaagtgaaggaaaaaagcccagtttgctgaagccatgttaagggcacattaggcttttaatatgtgcttcatggagaccttactagattttcctctgcgtagttctttccatctgatgggagcgagggctgtttttgggttgcagaaggcaagagccaggttgtcagctacagaagagaaaggtgccattgtctgcataattgactttgagcctttgtctaaaaggatgtcaggtggaggagtaatgaggggcgagatttttaaaaaattatagagtacaggattttagcaaaatgccagatgttggcatttctgttttggaggtctttagtggtccatgtaaactatttccttgcaagtaaccatccatggtaggaaaacagaaaaaaatgattctaaaagagcatttgtctagttagaaactgtgtcacttgtatcgtttaccgtgaggcatccttgagaggtacatgatttccaaacagccacctaaatcataggtactgcttttggaacagatgtaaataggaaaagcgccagtccagtacccccactaaagaccatcgttagaaagctctcgcagtgctttccagcttagaggagtgtagttcccttcaggtacttaagccagtgttcggtaaagcagcacccaaaatgccttttgttaaatgtgttctaactcgttcctcttgctgatgctatcacaggctaatgattgtctaagtccttcagagaagctgtgtggttttgtatagctgtgagtaaaaccacacccattcaggaaatgcaatgtactttcttctaacaggcatcatcaaaacagatgctgatttacatggtaggtccccttctttagtgacaatttgagagctttgaagggaggcatttgccgtgcatcagaagaaatcagaattaaactggcacacgtgcacattgttggagtaaaaaggaaaagcagtgacctagagtttgttaccgcacatgctttccctgaaggcatctgcaccatcatgatgtcctcatcaactctgcacacacaactagtatttctgtctctttctcttcagagtttaagctcaatgatttccaacttcctcccacatgactccagctggatatcacataggtgtcttcaatttgaatctaaacctgactttgtcattgtcctacgtttatgggctccagggtcactagctcaccatttgttgatgctggacacctcctcttcctctgcttcatccctagctcatatgctggagttctgccttttttttttttttgagacagagtctctctctgtcacccacgctggagtgcagtggcaccatctcagcttactgcaacctctgcttcccaggttcaagggattctcctgcctcagcctcctgagtagcttggattacaggtgcgcaccaccacacctggctaattttttgtatttttggtagagatggggtttcaccatgttggtcaggttggtctcaaactcctgacctcatgatccgcctgcctaagcctcccaaagtgttgggattacaggcgtgagccactgcccccagtctgagtttggcctctttaatatgatagtttacccactcttctccactctcgggcccctgttctgttgcagaccttcagcatcacttgcctggactgctgcagtggcttccaagaagccccttgcttaaagtcttttctttctgtgttccatttattctactcttttgagaattctcatatgaaagaaagggtctgattgaattactcctacacttgaaaatccttggtagtatgtggaaatatggaaaagtactcataatctaatgtgttaaaagaaaaactttagacaaattaaatttaacagagtttaattcagcaaagaactatttgcaaatcaggcagctcctctctactcctttcctcccgaactagaatagattcagggcatttctgacatgctgttgtgtggttggagaggatttatagacagaaaaaggaaaacgacggacagaaaacagaagtgaggtacagaaacagccagattggtttcagctcagcgttcgccttatttgaacagggtttgaacgataggctgcctgtgattcgccgaaacccagagattggtacaagaataggttacagcctgtttacacatccaggtaggttacggttcactgcatgcggagaaacctttaggccaaacttaaaatatggaagaaggcagctttcggctaaacccaacaaatgttaagtataaaattcatatttcaaaattgtgcaaacacattgattacaaagcagtgacaaaaatctatgcctatccacaaaggctagaagtaaagaaaacaagaatgaaggtatttttaatattagggcaattcatgtgtgtgtgtgttttttaatactcctttggtagcaaatgaatatggtgaagtaaaatgaataattgaaaggattttgttagctttctgctcctgataaggtaaaatgtgaatttcactgcatggcctctaaggcccctaggaattccttatcaacttaccatttaaatctcatctcccgtgactcccatcccttccatctctccatataatatttgttttcttcttaaacatactatgtatataataaccatgcacctgtccctgttgtttcttctcgcatgagactcttgttctctgcctggtaaactcccactcattcgttgaggcctaattgaaattcctggccaagcatggtgtctcacatctgtaatgtcagcattttgagaggctgagggaagaggatttcttgagcccagaaagtttagactgcaccattccactccagcctgggcaacagatagagagctcgtctcaaggaaaaaaaaaaacaaaacagaaattatcctcttgctgtgttaccgctattatattgcaattttctgctcatatagctatcttggtaaatgattcatgaagacagaaattgacttatcttaaaccttgtattccaagtgttaagcccattcctgcatataatacagtttaataaatatttacaaaggtaagaagaaaggaaagagcccatttagaaatacagaaataatccttcaggtaagatattaaaaatgtttttggataagcttagtactaattactatttcataaaaattacaaaaatagatgtttttggttaaacagtttttacagtaatagttggattcagcctcacatcatttaaactaaactactggcgtatatctttggcattagaaaattctaacatcagatagaattgcttcagcttcactgtaagccatatttatgaagttactaaaaaccatttttttaaactgttttatgtcatgcataaccatgtcggccaaatcagaaatccaaataaatgacacatccagttctggccacattttgtgaatatctggtatttttttcttaagggaatttaaaaagactgggtaacattaaagggttgatgtaacattttcaattctgaaaggctactctgctctaggaatatacttgttactattttttttttcatttctaagaattctgtttggctaaaataccaaaagagaaaaaaataacttggcttaaataaaatgaaaagtcatctccaaaattaattcggctcctcaaaagttctttccaaaggaaggaataggatgctatttaatattacatgtcaaaaacaccactaaaaagaaaatcatcatttgtacgtgtgacaaggaattcagaatggaattttatgaaggctagtgtgtgaggcacgctgctcacatcttttaaaataatattttgatatcggggaagattatttaatactatatattattttatattatatatgtatgcatatgtgtatatacatatataaaatagagttttttcctattaatgctttagagtcaataagttgtaatggggaatttcagtttgagatttgtcattttttttgcatgatagccttgcccagccttcagttttcttgtttataaagtcatgccaaaaggtgaactgtcactggattaactaattaagaaattagtcagtcactaacatttattgattgaccactgattggaaacattaaatacccacatcattttttagcatttcatgtaagttgatccttgtctgttttgcagagtaaagaaccttagctgaatttcatttttgtctgtcctgatctttgcattcatttaaaaacctgacccttcagctgtttacaagatccatcatgaaatataccatggctaaggtgaatgtgcagactcccagtttccctttagctattctgttgcactagccatggggttgcaaacttttttggtgactgttacagttcattcatcaggaggtactgactatattttgttgcactttcatgagagccagggctcagaagcatcctaagtacctagtgacaaaaactcaggaaggcaattagactatgacgcttttcattacaacctaaggtgcctctcaatatagtaggtgcttatgttgaactgccctctgcagactgtatgtgtgggtccatgtggtgatattgtggctgtaccctctccaaggttgcctagtgttggctgtagcaggaaaggaagtgtctgtaagcaatagtagcttcaatgaggaaggatataaaagagaagtgaactagtcctgaaatcttaaggatctacatacagaccagagtaccttgatggatcccaaagttttattttattttattttgtttttgagatggagtttcgttcttgttgcccaggctggagtgcaatagcgcaatttcggctcactgcagcctccgcctcctgggttcaagagatcttctgcctcagcctcccaagtagctgggattacaggcacctgccactacacccagataatttttgtatttttagtagagagggggtctcaccgtattggccaggatggcctcaaactcctgacctcagatgatccacccgtctcagcctcccaaagtgctgggattacaggcgtgagccactgcgcccggccttattttatttttccagcattattgagttatgattgacaaaatttgtgtacaacacgatgctttgatatacatatatattgtgaaatgtttattatcatcaagttagttaacactttcatcacctcacatagttattttttcttgcatggtgagaacatttaagatttactgtctcagcaaatttcaagtgtacaaatatcattattaaccatagtcactgtgctgtatattcaatccccagatctcaaagatttaaaatctagccctgagacaactgattacagccaccatatgttttcttaggtagttcacaataaatagttataatgctgctgagaaacagtatgatgtgttgaaaagtgtaggttcttgaggcaaacttcctgggtttgaataccgaacttccacttaatggctgtgtaatgttgagcaagtgacttaatctctttgggtctcagtttatcaatccatgaaataagaaaaataaaacaggccaggcacggtggctcacgcctgtaatcccagcactttgggaggccatggtgggtggatcacaaggtcaggggttaagaccaccctggccaatatggtgaaaccccatctctactaaaaatataaaaattagccgggcgtggtggcaggtgcctgtagtcccagctacttgggcgtctgagacaggagaattgcttgaacctgggaggtggaggttgcagtgagccgagatggtgccactgcattccagcctgggtgacagagcgagacttcttctcaaaaaaaacaaaacaaacaaacaaacaaacaaaaaaacctaaatgagtcttgatgcacgtaaagctttcaaaaaatggtagctgttattatcataccactttcatggaatttcgttagttactcagtttgtggtaaaatttttccagtgtttattcttcatgccttcctacaaacttggtttaggaatttacactgttaggggaaacatgtaggtgaacccagctagggaaggcgaagcaatgctgtgggaacacaaaggagtgggatatttagtctgatttgggagtggtgaggacttggaggaagcatcagagctgacttggaagaatggctaggattccacctgacagagctgggagcaaggcattccacacgggagggcgtgtgcccaaaggtgtggagaagggagagtgcagagcagagcatatttgaggaaagctgtggaccagtttgagcccagggttaaggtgtgtgaggtggaacagtgggagactgggaggaagatagtctgatttaatgataatgatgataacggtgagtgtgaactattcactgagtggtgccatatatcagattctgtggttggggctttacataaattagctctgattacaactcccttcaacatagctatccacattttacagatgagaaaatgggattaattccattttttcttaagtggcggagagccactgaaggttgttgaataggagagggtcatgatcactcttagcaggaatttacttatctgctttttcacttccctggagtggtagacacgtcttttgttttgtttaagagacagagtcttgctctgtcacccaggctgagtacagtggtatcatcatagctcactgcatccttgacctcctgagcccaggtgatcctcccaccccaacttcccagagctctggaattagaggcatgtgccaccacacctggctcatttttaattttttttttgtagagatggattcttgctatgttacccaggctgttctggagccctgtgttccagcaattctcctgctttggcctctcagagtgctgggattatgggcatgtgccaccacacatagccttggagatacatcttgcaccatcctgggctccccagaggagtggtattagactgtcagtatggtgaatactccataaatactggtggagtctgttttcaaagcttccttaacaaaactctggaaacatgttttgtacaatttcctttttaaagaagaaataaactggttaagttactgagcaactcctttttgcctgtgcatgtttcatctcatttgatccccataggaaatcttaaaggtagagagtgtaatttttgcatttcaattatatgttattaatattataatggatgaggtcactgggactgaagaaagtaatgctgcttggagatggtaaagctgggattcaatctgtggctccctcacccttggtctgtagtcggccaccacccctccctctattgaacctctcttttattgctgttttccagtctccactaagtatttcttccactggtttaagtccacgttgctaagcaagtacacagttgcttttaaggaaacgaaagccccacaaggacccagtctactttgcagaggttaaatggaaatagattattttcaataatctgtcctcaggaccagaattcttctaaatgatgctgctggcagctggccatctctgggagcccatcagacaaaccacttgtaggagcccagcatcctgcattgggtcagaatgcaaagtcaactaactcttcacagtagatgcagtttgggcgtgagtacctagcaggaaccctagatatttggggcaagcactttgcttcttccatctggtggaacccacgtttattatctaaaagacacatggcaacaggcaatgcagtgtttgcttccaaagacagcctggaatttggaatgacatttagtgaaaggggaaagttcaatttcagctatcaaaggtcatggccagtgaacctacaagcacatattatgtaaatttggcccaaatctgtatttattagcttgaacagttttggagtggttatctgctctacaaaaatgatctaccgttaagagtctcaaaaatatcaagtctgcttgatgcatttaaatcaggaagcgtaaatatttggcatccatgctagtgctgattttcagaggctttgctcacctgcagctgtgctcactttgcgaaaatggacatggtgacctctactttcctggtgagtggccacgtcagtatcatcccttcccgttcctggcaccactctcacccactttggagagccagcatagagcagcacgctgtgtctcagggaccaggctatccatcagataccctactctgaaagtgtccttaatttgatttttaaaatatatataaatatatagtgtgtgtgtatacacacacacacacacacacacaccataaaatttaccataaatttaccattttaacctttttttttttttttttgaaacggagtcttgctctgtcgccaggctggagtgcagtggcatgatctcagctcactgcagcctccgcctcctgggttcaagcaattctcctgcctcggcctcccgagtagctgggactacaggcgcatgccgccacgcccagggaatttttgtatttttagtagagatggggtttcaccatgttggccaggatggtctcgatctcttgacctcgtgatctgcccgcctcagcctcccaaagtgctggggcgtgagccaccacacctggcccagtttaaccatttttaagtgtacaattcagtggcattatgtacatttccagtgtagtgcaatcatctccactatccatttccagaactttttcatcatcccgaacagaagctctgcattcattagacaataacactccattctctcctcccagcccctggtaacctctattgtacactgtgtctctatgaagtttcttattttagggaccacatggaatcatacaatatttgtccttttatgtctggcccataatttaatttttaataacagtgtttcaaatatactgttcttttccaaagtatttgttatcaatactttattatgtcagtaattatcaataagttctcattctaatttcagaaactgggttgtattggaatatgggcatagagaagatacagatttttttttcttcttaataactgaagagaataacatttatcaaacaaacgatcgaactctttctgagacatagtttcatgtgcctctttggagttgatttcccctcactttattttaactcctatttggcccgaattcttctcagaatttctgcaagcaggctcatagtcctgcgttcttctcttctctttttttttttttttttttttggcagggtctcactcttgtctcccaggctggagtgcagtggtgcaatctcagctcactgcagcctcgacctccgggcctcaagtgatcttcctgcctcagcctcccaagtagctgagattacatgtgtgcacgacaacacctggctaatttttgtattttttgtagagacgaggtttcatcatgttgcccaggcttgtcttaaactcctgggctcaagcagtctacccgtcttggcctctcaaagtgctggaattacaggcgtgagccaccgcagctggccaggcttacatttctgtagtgcctgttaggaagagttcagaattttttagacacaggcatagctcagagatattgtgtcttttttttttttttttgagttgggagtcttgctttgttgccaggctggagtgcagtggcacgatctctgctcactgcaagctccgcctcctgggttcaagcctcccaagtagctgggactataggtgcctgccaccatgcccagctaatttttgtatttttagtagagatggggtttcaccatattggtgaggctggtctcgaactcctgaccccaggtgatccacccacctcagcctcccaaagtgctgggattacaggcatgagccactgtgcctggacactcagagatattttgggttcacttatagaccacagcagtaaagcaagtattgcaatacagcaaatcacacaaattttttggttttccagtgcatataagttatgtttacaccatactatagtctattaattatccaataacattttgtctaaacaaaagtacataccttaattttaaaatgctttattgctaaaaactgttaacgatcatcttcattgaaccataatcgttttgttggtaaagggtctttacgttgatggctgctgactgatttagggaggtggttgctgaaagctggggtggcggtggcaatttcttaaaattagacaacaatgacgtttgccacatttattgactcttcctttcatgaaagatttctctgtagtatgcaccattgtttgagagcattttacccatagtagaactttcaaagttagagtcagtcctctcaaacctgtcactgcatcaattaagtttatgtaatatttcaaatcctttgttgtcattttaacagtgttcacagtatcttcatcaggagtagattacatctcatgaaaccactggtttttttgtttgtttgtttgtttgttttgagacggagtctcgttctgtcacccaggctggagtgcagtggcgcgatctcggctcactgcaacctccacctcccaggttcaaacaattctcctgcctcagcctcctgagtagctgggactacaggtgcgcaccaccacgctgggctaattttttgtatttttagtagagatgggtttcacaatgttagctgtgttagccaggatggcctctatctccggaccttgtgattcccctgcctcggcctcccaaagtgctgagattacaagcgtgagccactgtgcccggccatgaaaccactttctttgctcctccatagaggcaactcctcatctgctgaagtttgatcatgagattgcagcaatcaattcagtcacattttcaggctccatttctaattctggttctcttgctgtttccacctcatctgcagttccttcctccaccgaagtcttgaaaccctcaagtcatccatgggggttggaatcaacttcttccaaactgatgttcatgttgatattttgacctcttcccatgaatcaaatgttcttaatgacatctacaatggtgaatcctttccaggaggttttcaatttacttttcccagatccatcagaggaattactttctgtggcaatgatagccttacagaatgtatttcttaaataagaagacttgaaaataaaaattactccttgatccatgggttgcagaatgggtgttgtgttagcaggcgtgaaaacgacatgaatctccttgtatatttccatcagagctcttagatgagtgacgaagtgcattgtcaataagcagtaatattttgaaaggaatctttttctgagcaattaagtctcaacagtgggcttaaagtatttagtaacccaatgtgctttcatccaggctttgttgttccatttctatagcactggcagagtagattcagcataattattagggctctaggatttttggaatggtaaatgagcattggcttcaactaaagtcactagctgcatttgcccgtaacaagagagtcagcctctcctttgaagctttgtagtcaagcattgacttctcctctctagctatgaaagtcttaaatggcattttcttccaatagaaggctgctttgcctacgttgaaaaatctgtagtcaccttcatcaatgatcttagttaaattttctggataacctgctgcagcttctacatcagcatttggagaagatttctttccttaaatctcacgaaccaacttctgctagcttcaaacttttcttctccaagttcctcacctctctcagccttcatagaagtgaagagagttagggccttgatctggattaggctttggcttaagggaatgtatggctggtttgcttttctattcagaccactctaactttgtccatatcagcaacaaggctgtttcactttcttaccattgatgagttcactggagtagcacttttaattttcttcaagaacttttccttagcattcacagcttggctaacccttcagtcacaagaagcctggcttttgacatatgtcagctttcaacatgccttcctcgctaagcttaatcatttctagttttcttatttaaattgagaggtatgtgactcactcttcctttcacttgaatgcttagcggctattttagggttattaattggcctaatttcaatattcttttttttttttcttttttgagacagagtctcgctctgtcacccaggcttgagtgcagtggcacgatctctgcttactgcaagctccgcctcccgggttcacgccattctcctgcctcagcctcccgaatagctgagactacaggcacccgccactacgtccggctaactttttgtatttttagtagagattgagtttcaccatgttagccaggatggtcttgatctcctgaactcgtgatctgcccaccttggcctcccaaagtgctgggattacaggcgtgagcccccgtgcctggccaacttcaatattcttgtgtctgaggaaacaaggaggcccgagaggagggagagagaacagccagtctttgtagcagtcagaacacacatgacatttactgattaagttcattaccttatatggggtgtgtggttcatggtgaacaaaacaattataatagtaacgtcaaagagcactgatctcagatcaccataacagatataacagcgcaaaagtttgaaatactgtattaccgaaatgtggcagaggctcaacatgagcacatgctgttggagaggtgatgctggtggagttgcttgacacggggttgccacagaacttcaatttgaaaaaaaaatgcagtatctgcaaaggacaacaaagtgaaatgcaataaaatgagatgcgcctgttgcatctttcaactgatgtgtcctttcttttcattaaaaaaaaataacgttctgtccatctgcctctgtccaacaacaggcagtcacatgtgatgcctactgttggagaattggtgaatcataggcctccacttctggtgctattactcagagaagaagtatttctttctgcatagaaggaaacattgtaattttactgcagcaatgaaattgtagtagaggtgaacataattcttctatttacatctttaatgagccacaattaaaagtagtgagttggcatgtcagagtgaatgtgttattttcagatttctgttagaacaatggctgctgctggttgaagctgcacttccctggccccttggagctccaaaagccttaagaaagaaacccaggggccgggcgcaatggctcaggcctgtaatcccagcaccttgggaagctgaggcaggcgaatcacctgaggttgggagttcaagaaccagcctgaccaacatggagaaaccccatctctactaaaaatacaaaattagccgggtgtggtggggcatgcctgtaatcccagctacttaggcggctgaggcaggagaatcgcttgaacctaggaggtggaggttgcggtgagcctgtgtctggagttggttccttccgataggtttgtggtcttgctgacttcaagaatggagccacggaccttcacagtgagtgttacagctcttaaagatggtagggacccaaagagcgagcagtagcaagatttattgtgaggagcgaaagaacaaaccttccacagcgtggaaggggacccgagcgggttgtctctgctggctggcgtggccagcttttattcccttatttgtccctgcccatgtcctgctgattggtccattctacagagcactgattggtccattttacagagtgctgattggtccattttacaaacctcaagctagctacagagcgctgattggtgtgtttttacagagcactcattggtgcattttacaatccccttgtaagacagaaaagttctccaagtccccactcgacccaagaagtccagctggcttcacctctcaataccacttctgcatttaattatagccaccgactagctgcactatgatattaatctgggctacttgcttaggaacctgcagatgggtttccataagctagacattgctgcctgataaatgactgtgggatacaggttttcctgatgaggtagtaaagccacatattggaattcatttaacagctcgacaacataatttgtaaacatttctatttagtcacgtgtactcagcaaaaatgtatactaaagtgtttaccatatacttggcattgaagggaattataatgaaatatgttgatcttggtcatttataggtgttcccaccactgtgatgtgtgcatgcattgtgggccaggaggttttatctggaagctagtgacacttcagcgtcaaggcgtctcgctcctgcaggccctttgtaagaccctgtacctaattttatgttgataattttgtgcagtttttttttttttttttttttttgaggcagcgtctagctctgtcatccaggctggattgcagtgttgtgatcttggctcactgcagcctcaacctcccaggctcaagtgatcctcccacctgagccttctgagtagctgtgagcagatacatatgccaccatgctcagctaatttttgtatttttttgtagagatgggggtctcactatgttgcccagttttgtcttgaactcctgggctcaagcgatcctccacttcagcctcccaaagttctgggattacaggcgtgagtgaccatggctggcctttgagatcttttcttaaagaccctaacaccccatacacactcctctaccccttgactagttttataaactgcagacctcacagactggatccacccctgattatgaatatgtttaaactgtgcatatgtatgcattaattaaaacatatttatttctctttcatactagtatgtgaaattccaaaaaatctgctagcccacaaattaggaaaattaaagggctatgcctacctctgccagctgtttccaaggaaatttatatcttggacatttggcagataataatatcatgtttgactgatagtgatcatgtcctaaatttcccaaactgatgagtcacaatcgtgattcacatatttctgggaatcgccccccaacaacttgcgatttgcctggcgtagctgtagtatatcagagttttttaggtgtttagcagaactgaactatatagcttcttgtcccatgccaattcaagaaaattaatttaatagctattttatgaaacattttttcctaactcgacatggatattttaaggtgattttccctgctaagaattcacttgttataggtgactctaattggagaaacagctgttgacttctagtgtgctcaattagtttctttcttcctttttctttttttattttattttatttattttttattatactttaagttctagggtacatgtgcacaatgtgcaggtttgttacatatgtatacatgtatcatgttggtgtgctgcacccattaactcatcatttacattaggtatatctcctaaagctttccctcccccctccccccactccatgacaggccccggtgtgcgatgttccccttcctgtgaccaagtgttctcattgttcaattcccacctatgagtgagaacatgcggtgtttggttttttgtccttgcgataatttgctgagaatgatggtttccagcttcatccatgtcccaacaaaggacatgaactcatccttttttatggctacatagtattccatggtgtatatgtgccacattttcttaatccagtctatcattgatggacatttgggttggttccaagtctttgctattgtgaatagtgccgcaataaacatacgtgcgcatgtgcctttatagcagcatgatttataatcctttgggtatatccccagtaatgggatggctgggtcaaatggtatttctagttctagatccttgaggaatcgccacactgtcttccacaatggttgaactagtttgcaggcccaccaacagtgtaaaagtgttcctatttctccactttcttcctttttcaaagagttcctttattattcccaggccgtcgttaggtgtaaaagctaatttagtttagattattttttaaagtgcacctggcattcaagctatgacatttcctgttgaaacagcactgctatgacctgggaagaaaagatcccaagaaaatataactgaggaatcaaatatttgtctgtataaaaggtttcatattaattcatgataccatttattagtcacttaccttttatgttagtagccataaggaggtgtgatggcatagactattcagggcgaatgacagttgtcatgggcagaaggtgcccatgcatcaggcagagcagggtgaccacaaagtggggagtggccaaatatactttgtcctactcaagacatgagggcctgtcccagtggcttgcttgagaacaaagctcatcctgatgactcagcagccacagtgaagggctgcctgggggctgggggagaaacaagtaggcagatgaggtccagttggaaactaaattgctttgggaggaggagagtggtcacacaatgtaggtttcagttccggctgcactgctaattttgtaaccttgggaaagttaccaacctctctggaatctcagtttcctcccctatgaagaagaaagcagtagcccagatcatccttggaggttccttcccttcagctgtgacattttgcatttgaaagagtaagagaagtcacaggaccatgggaaaggaaaacagaaatgatgtaagggaggcaggtcatggggagggtggtcaggaacacaggttggaagtgcccgtggtgtcaattcaggtgttcggtgatctccacgggcgagtgacttttattgggagaactgtgcactgcctgaggttagggttgtgctctggggaaaccggaaccttgaaaacaccttgtagggagccgcgtttcccttgcacggactgtgctgcctgtgcttccccagcacagtgggcgtcgtcgctttgtgtttgtgctggctgctgtgcggggttgcctgcctccccagcccacacctgctcagccttcctccactcatgttttcaggatgcttttggatgcttctggctacagtggattttccttctccttctgaagcccttttgaaattatttctctgcagattcagacatatttatttatctggtcaatgtcctgcctaaagaatcagataacgactgtgtttttgcctgaactcacacatatgaatgagcttttgtaagcggcagcagcagtgtaggtttagttggagctgtctgagcccttgtcaggttgctacttagttgtttagttagctctcgttgaacttctgtcacatcctcagtttctgggcagtgtgtaagaagagctccttctctctagaccagtggtccctaacctttttggcaccagggactggtttcatggaagacagtttttccacagactagggtggagcgggggatggttttgggatgattcaaatgcatttatattcattgtgcactttatttatattattatgttgtaatatataatgaaataattatgcaactcaccataatgtagaatcagtgagatccttgagcttgttttcctgcaacaaaacggtcccatctaggggtgatgggagacagtgacagatcatcaggcattagattctcataaagagggtgcaacctacatccctcacatgtgcagttcacaatagggttcacgctcctatgagaatctcatgccgttgctgacctgacaggaggcagagctcaggtggtaatttgaacaatggggagtggctgtaaatacagatgaagctttgctcattcgcctactgctcacctcctgttgtgcaggaggtctgtagcccaggggttgggaacccctgctctagagcttaataatcaactggtggagaccagtgcaattgtaaacaaaagtgacaaaacgatagtaataatgccaatggtaatgaaagctacagacattttcagagtgctgtgtctccaagtactgagctgagcactctgcactcatgaaatatgtatcctcctcacacacacacacgcaaaataaatgtttaatggaatattgatcaggaaaaaaacaaccagtaagcaaagtattaatacatgctacaacatagatgaacctcaaaacatcatgtgaattgagagaccacatacttcaatttcatttatatgaaaggtccagaatagacaaatccatagagacagaagttagtttgggggttgcagaggccggaggtgggagaggaatgcagagtgactgctaatgtacacagggtttcttttttggagaagaaaatctaaaattagattgtgatgttggttttacaaaacagtgactatactaaaaaacatttgagttatacacttgagttatatgtaaattaaatcttaataaagctgtttttttaaaaataaatgtttaattctcagaaacaaccctatgaggtagggagtattatcctcctacagatgagaaaaccgaggcccagaaaagaggagaacctgctcaagattacatataaggcatatgtaggattaactttttcattacagagaaatccatggtagtgcttgctaagtaaatgctaaatctattgattgcatggatgccagaactagatggggttagtttagatggattaagggaggaagtggtttaaactgtgttttctaagaagaaagagtagtgattgtataaagaagacaaaagggcatttcaagctggagataattgcttgtgagagttaaacatcaagaaaccagacatctaataggtttgttcaactggagtgaagaatagcctttcatatgacaggtaggtaatcagaagcaagtgaatttagagttatattgttagctgtagtgcgggcttgctgtaattagtagcaggccgacaccttgtaacatctctctggagtgtaaagacatatttctaacagaaatgtgttagtctgcaaagcaaataaggtgcaagcgtaaatgtcctttttccttggactgtctttaccgaatgacatgagcttcacacccttgccttgagctgtcactatcattgcttcactttctattaattagctcggagccttggttctatagtcaacttgaaactgctctggacatatttgctctaatcctcctggacaacctgtgagatgtgccttttcctacacttctgccttgccctggcagccacatgacacactctcgcaaggcaggaacctcagggaggggaggtggcggtgtctgttggcaagtactcagctccctttgaggctgcagatagtaggcattggttaagagtttaaacttgggcaagaactggaagcaaattgggaggacctggaattgtgggtgcttggggaaaaacattacaatgaggactcatatgggtcgtgtggtcatgtttgtttcaagggctttcccttccaaaactggaaaagaaaactgataaaacaaacattgggtggcatttttttctaggcttgtcaatgggtgacttgtttgccgaattaattaaataattaattaattaccttgtttataatcttccttgttttgaaaagatttatggcagtgccttaaatctgtaaatctacccaacaagagaatcttatgaagtaaacaagttaacaggtgaaacatgcctccttttaaatgtttctttataacaaaatgaccatatatcaataacagactgtaacaatgcgtagcaaatgtatttatgtttctcatctattttccactttcaaaaatgtgcttttcccttaaactccaaattgtcttaacaatttcacattttcatttctttcttttcttttttttttttttgaggcggagttttgctcttgttgcccaggctagagagcaatgacgtgatcttggctcactgcaacctccacctcccaggttcaagcgattctcctgtctcagcctcccaagtagctgggattacaggcgcatgccaccacacccggctaatttttttgtgttattagtagcgacgaggtctcgaactccagacctcaggtgatccattcacctctgcctcctaaagtgctgggactacagatgtgagcctggcccaatttcacattttctaggttctgtagaggttcatgtttgtggcatggtaattcttgttttttgcattttttttttcttaacccccctcctggcttttggagcactataaacttagcactggtggggccacatcttgacagcgagacccttacagcccccaaccccgcatcccagtggggcttcatgatctggccctgctgtgctggtggcatggccccctcggggcttaagtgattctgggtcattgacaagaatcttgcctgtgtgaattcaaatcaaaactttggagagcaaagattcagtgttttccttctgcctaacaatctcatggaaagcacagtggtacctagcatttagctcatgtgttcatttagcaggctctaagtcatcttgtcacatgtcatcctcatgtcagctctgtgtggtgttgtcgacccacgagcaaacgttgcaaggtcccctttagggtgacaaggctgattcaggatgtgtctcactgccccaggaaggatgcctctaacatgcggaacatggtgccagtggctgaggggattagttggggaagaagagtgaatagggaaaggaggttgttacatgatccacccctcactggccagagaggaaaaggaaggcatctcattaagagcattagctgtagcctctcatttaaacctcctcactaccccatgaagtaagcattattgcttttgttttacaggtggtgtgagacaaaagtgaaggaatgagactaattaataataagaatccatgccccaccatagctacgatgcagtggagcatggattctaaaccagctctaacatcacatgccctattttcgagcactagtggcttatttctgagctcttctcttcctctttcctgttgatgcttgagttttagttatatcatggcaaattgaaaaattcttcaaaaaacatacagaggaaataaagtggtgggatctgaaacaaaactcttattgattagccattctaatgaagatttgtggctgagatgggagttttgcaatcaccttgggatttcagaaccctgcttttaataattagaactaaagaagggagagtcctatagaagtgtgggtcataaaaccaaggatgtgaatgaggagtggcaagacaggtatcctggagactttatttcagtgagacttctggggcagagttgggactgatgggggacaagtcagctttggaatgatacagaatttttggctgtgacacctgtgtgattttagtgctttgcaccatatcaagagctgagcagagtgtggcaccaatattcaagggactcaaggggcaaatataggtgtcagtgagtgaaagcagatagcgagatttgcaatgcagtgtccaggagtgtccatctttctagacccatttctacttataagatcactgcataccctgtgaaacattatattcatgaagccacagagtttgagccactgtgtttacgctgcaagtggaaggagagtgggcatggagtcagaaagactcaagttcaaatccagcctccataatttatcgtctttaagaccctgggaaagttgacctaagcctctgttttctcagctttaaaacatgaataataatcctgcctcacaggactgctgcacatacggcagtcagcgcagtgccaggcacacacgagtgtcttattagttattattattatcaacaaagagcataggtgatccttcttatcatgattataaaaactgtggcttaccaatgaaagggtccttcataagccaacaaagagacatccctgaaattttcactatagcagaaatgcaaattattactgggtacatttctggcagacacatgagccatttacataatgaaacctctctaatattatttctattaatagcaatacttctgagtatcaatctgaccattttgtatttagaatcattctctctgtgaacagattccttttattgccatgtcgtcttaatatcttctgacaagtatcattatctctttgctgcatattctaatgtttatgattgcatgagttttaaagtgttcatttactacctgagaacctccattttaataatgcattgctttaatgttggtgtttgggaggtaaggttgttgcttattttctcagatgccgattcacagttgagcagatgatgacttgcaggaggctctcttgacctgtcatgctctgatatcatcaatgcattggagtggtcacttctgttagcttttcctccatgaatcccctgttgatcagcccactaagtgactcagcatatgtctgtgcacacctttggaccacattatcatccactcacttaggcccttgaatttttttatgggtatgtgggctatattgctaagtgataaggctggttctgtaaatggacctcgcaacttcagcataacaacggtatggctagtgtcctcctctaggagggactccccttgagggcagatacaggtttttcctgtttgcctcaagagagtcatacaatgcagaagtgcccaagtgaatgttgggtgaatcagtgagtgtaagagggcacccaagggaatgcccacagttggaaggaagttgcctgagaggaggagtcctcagacccattctagctttgtgattctgcccgtacagacatgatttatatgacaggaaaaacatggcaggcccttgggaagcattttcatcttaacctttataatatctaataaatgggcaagatgttaaaaaaaattgccctttccagaagaaggttatacagactctaagaaggcaacattaagaaatttttgaatttttttttttttgagatggagttttgcttttgttgcccaggctggagtgcagtggtgtgatctcggctcactgcaacctctgcctcctgggttcaagcgattctcctgcctcagcctcccaagtagctgggattacaggcgcacaccaccacgtccagctagttttttgtatttttagtagagacagggtttcatcatgttggccaggatggtctcgaactcctgacctcaggggatccacccacttcagcctcccaaagtgcagggattacaggcatgagccaccttgcctggccgaaatatatatatttttaaaaaggttattttcatcccagcactttgaaaggccaaggtgggcagatcacaaagtcaggagttagagaccagccttgcaaacatggtgaaaccccatctctactaaaaaatacaaaaacaattagctgggctggtggcgagtgcctgtaatcccagctacgcgggaggctgaggcaggagaattgcttgaacctgggaggcgaaggttgcagtgagccgagattgcaccactatgctccagcctgggtgacagagcatgactctgcctcagggggaggcggggagaaggttactttcaaccccatgaaaaagtgagcaaaggacatgaacagacacttttcaaaagaagacatatggccaataagaatatgaaaagcagctcaatatcgctggtcattagagcaacgcaaatcaaaagcacaatgagatactatctcataccagtcagaatggctgttgttaaaaagtcaaaaaataaccagttggatgctgatgaggttgcggagaaagggaacacttatacactgttggtgagtgtacaaattagttcagccattgtggaaggcagtgtggcaattctgcaaagagctaaaagcagaactaccattcgacccagcaatcccattactgggtatctacccagaggaatataaatcattctaccataaatttagacacatgcacgcaaatgttcattgcagcactattcacagtagcaaagacacagaatcaacctaaatgcccatcaatgacagattggacaaaaaaaatgtggtacatattaccatggaatactatgcagccataaaaaaggaatgagatcatgtcttttgcaggagtatggaaggagctggaggccattatccttagcaaactatcacaggaacaaaaaactaaatactgcatgttctcacttacaagtgggagctaaatgatgagaactcatggacacaaagaagggaacagcagacactgggtcctacttgagggtagagggtggaggaggaagaggagcagaaaaaacaattattgggtactaggcttagtatctgggtgacgaaaccatctgtacaacaaacccccatggcatgagtttatctatttaataaacctgcacatgtacccctgaacctaaaataaaagcttaagaaataggttattttaaagactatcctaatgcatttgtttgtgtgtgaaatatggttttgctaattagtattctttattgccagtaaaagtaactcactagagggagcttctaagaaacggggattttgatgagggcacgtggatatcccatggattttagggacgggcacggctgggccttggggaaacaaaacaaaacaaacaaataaaccaaaaatcaaaaccaaaaattcacattgaatttggagtttgggtcatattgtatgaacaggactgcttccacctgcattaataggcaaattccagaatactgggtgctgaatgaacagtccagtatggatctgtacggaggctgtaccaaggattggtgtctgtttatttttatttgtgctgctattgaagattttctaatcattagtgctaatattgcaggagaaaataattaatgaaggtgtctactgttctattgtagtaatttctgtttgcagggctcattaacatctttgatcagaatgagcagctcttttctggttggaatagatgaaaattatacaatgtatggagccattcttcaccttgtccttgtttcttcttcatgttgcttcgacttattgctcacaagttgacctcccccttagagctggggtggtccagcagggctgcgttgtgatgtgtattccttttgtgataggagacttgctgagagaggatcctgtttttttgtttgtttgtttgctttgagatggagtcttgctctgccacccaggctggagtgcagtggcatgatctcagctcactgcagcctctgcctcccaggttcaagcgattctcctgcctcagcctcccgagtagctagtatgacaggcgtgagccaccacacccggctaatgtttgtatttttagtagagatgggatttcaccatgttggccaggcaggtctcaaactcctgacctcgtgacccgcccacctcggcctcccaaagtgctgggattacaagtgtgagccaccgcgcctggccgaggaccctgtctttaatgggatgttgggtgatatgtatgaaatggttcaagaagcagatgggaagtgtttgggaggcctactgccagtggctcagtgtagccagggaaaaacagacacacctctgtgccatctctcacatcttagaaggtaacattgagtttgctgcatagaaccatacagttctaggtcacctgaaactcagagctcatgtgatctaaacttctatatttaaaggaggaaagagactcagagaagtaaaaatggcttgaccaagaagtcagactggaaccagaagtggacatatggactcctcattcctgttccagtaccgttgctgccagttcacattgtctttctaaaatagccatttatagggccacagctccatctcaaacaagggcttagtatctgtcagtttgcgaggtctaccataacaaagtaacccagactgagtggcttaaacagcacaaacttattttcttatgattctagagacagtaagtttgaaatgaaagtgtcaggaaagttggttccttctgaagtccttctccttggcttgcagatggccatcttccccctgtgtcctctcgtgggcttccctccaagtctgtgtcccagtctcctgttacaaggacaccagtcatagtggaatagggccctttcatatgaccttattttgttttaattacctctcaaaaggtccaatttccaaatacagttatattctgagaaactggaagttagggcttcaacacatgaattttgagtggttgtggggggaaaaaattcagccagtaacagtatccataagttaacttgattcattagttgattaagtatgattaaaccagctgggcgcagtggctcatgcctgtaatctcagtactttgggaggccgaggtgggtgggcacatcatctgaggtcaggagttcgtgaacagcctggccaacatggtgaaaccccgtctctactaaaaaaacaaaaattagctgggcatggtggtgcgtgcctgtaatcccagctgcttgggaggctgaggcaggagaatcacttgaacctgggaggcagagaggttgcagtgagctaagatcacatgcaccactgcactccagcctgggcaacagaggaagaccctgactcaaaaacaagaaataaagtaaataaataaatattattaaactagattatattggttaccaagtctttacatgaccattttaatagccttttcagatgttaactttgcaataatatgcagccagctaattgaaaattctagtgccataaatgtttttaattgcttactatgtgtcaggcgttgtactaggcactggggaaaactgtaaataaaagagacccagttccttcctttttttcaggttgcagtctatcaggaaaggcagacatttaaaaagggtcttgtgaggactgttatgaaacaggaagtacgagtgccatttctataccttagtacaatcactcgttttaattcacatcttccatggtggcaagtttgcctcagtgtcagccggtcaattgccactcaaggggatcagaacatttatgtatctggaatgcttggtacctagagttctgaagatcactattctcattccaaatatgttttttcattgccagaatgctcactcagtgactggattagttatgtgtactctgcatttttcgaagaggggaaagctgctatttttatcatctagtagcattctgatgactccttgataacatggttactatacggaaccccatctgtttctctgctgggaccacatcttagtcatatttttgtccctaatgtctggcatcgtgcctggcatttagtaggtcttcagtaaatatttgctgaataaatgtatgctgattgaaaaattgcctgctattatcagctctctgtgcatgataaatgccttgcctctccaaagcgattgtaagcttctgagcaggaacaccatggtcacacatggtctgtctaactcagcgccttgtaaataataggaatgccatccctaaatccctagccccctccaggatggcctgtcttccttgcatctgggactgttgaagattcttaatgatggaaaaatcatatacaggttattgcatagacatacattaaaaaatgtagttcgttcagtgtatccctagtgggcctatggccataaattaacttgctcccagggtaggtagtactctcttcttcacttctgctgtaatcacagctgccttcattatagaatcatagagaagtgaattaaggtgaactttgaaagaaggaagagatgcagctcacttgatcgatgtgggagtgggagtgggaagatttttctaggcataaggatggcatcaaagaggcttggctgtttttccattcccagtaatcgttgacagttttttatttaacatttaaaaaagtgtcctccgaaccttaggctgttcaaaaacaagtatttcatggtagagattacgtcaaatgataagcgatgcattctgcgatcagtggcagaaacaaaggttgaagctgcagtttgatgagaatttaaacatacagaagtcaaaaaattcaggagttgaagttaaactgcaagtgtgactcagtcccctcgggcatatggtagtagcattttctgaattgtggcatattcagttaaatttaagcccttgtttttgcagagtcgttgtgtcaaggttgcaatgtgagcagtaactttagactttcacaattttttatattctcacccacagtatgtgctgttatagcatttgtgcactgaaatttggtatagcttataaaaataaaaaaatggtgcaatgctcaatctatggtgcagaatgtatatgattatgaaggaataacccttctgtttgcttgaacccgacctaatactgaaacaaaacaccgccacttttgcttttaagtaaataaataaaccatacattgtggcaaaaggcatacactataaaattgaccgtcttcaccatcaagtgtacattcagtggtattaactgaattcacattgttgtacaactgtcaccaccatccatctccagaactcttttttttttttttttttcttgagacaaagtctcgctctcatcccccaggctggagtgtgatggtgtgatctcagttcactgcaacctctgcttcctgggttcaagtgatcctcctgccccagcctcccaagtagctgggattacaggaacctgccacgacgcctggctaatttctgtatttttagtagagacagggtttcaccatgttggccaggttggtctcaaactcctgacctcaggtgatctgcccacctcggcctcccaaagtgctgggattacaggtgcgagccaccacgcccaacccagaactctttttattttgcaaaattgaaattctacccattaaatagcaactcttcttttcccttctcccccaagcccttggcaactgcttttccatttctatgacaatgtctactctagatacctcatagagggtgaatcatacagtatttgtccttttatgactggcttatttcacttagctgctatattattaataccagctttctggggatataattcacaaactgcagaattgaatggtttttagtctattcacatcggatatgtttttgaagagacagtaaaaccaatccttttttccttagttctcagacacacacatgcttcttatctggcaagtcccgttataaaaatgccatgaactaaatgggaacagaagattgggggaaatatctagattattcttagtttggttcagattaattgagatagccagaatatttttgtaagcatgtttgctttaatttaaatgtcttcattttgcttcctggagccagcaatatgtgattacttattgttgttcttatggggtattgtttgcttgcgtagttgattgtgatgagttggctagaaatttaacagaatggaaatttcttcaagtctggatttgttcaaagaacagtttgaaattgaccaaagcgatagatggaactgacacttgacttatttgagatctggagttcccagtaatgaatattttggtccaagtttgaaaaatggcatttcatgtttatgtactgctgataggaatattcattggtacaaccatttagaaagacagttaggtattatccagttaacaaaaacaaatgtgtataccctgtgactcagcaattttccttctaggtgtttcctagagacttctgtactgtataccacgagacatggaggctctccagcacagctttatttgtgttaataatggtttaaaaaaataaacccaaactacttgaatgtttattaaagtgaaataaacaaattatgatatgatcaaatgacagaacacaatacaacaatgaaagtgaatgatctaaaactatataggagcaatatagatacatttcagtaacctgatatgaagccaaaaaagttacgttgcagaaaaattcaaaatatgaatgattatttttgtaaaatttcaaaagtatgcatcattaaacaagtaaagtggaatttcaccctgagacagttaaaaaaaaaaggctagaagcttagaaagacatggattagaactcgtttttctctgttctgagagtacatgtggaaatgaaagctaccagctatttctgccattttaaatgctcatatgaaatttctaagtaccctgcatagtaagtctttaaaatatcacatacacactactggcaggctaaaaaccaacagaaagatggctgggtaaaaagaaatcatgcatgcagaacactcttacttttaaaaatttacattcctgaaatagaatttttggagagaagcttttcttgaatgatgttagattgaaggatataactaaaaatagaactgcagtctttaataaatgaaaattagtcaagattctaattagtacttcctgtgttcgatactaattttgtcagttcatttctttacttaatgtgggctgtacctattcgcacatcccttgtactctttgcttgtttggttatcgttatgagaccaccaccaaccaccaccaccaccaccatggtcatcatcatcatcaccatctcctagagcacatggttttatgagccctgagctaagctccttaccgtttaatgcaaacatgttcctccctcagggtctttgcattactctaaaataacaccctcatcagtttttatccccttcaccggtttaatttttccttattgcacttacacatacttgtttgtctttctcatttcactaaaatttgagagtgatgttaagtctgtggaagcagagcccatgcttacatctgtcacttgtgtatttccagtgtttaaaactgggcctgtcacacctagaagctcactgatcataatcagtgatcatcaagtgaatgaatgcctgaattagcccaacaactctttgaggtagttattgctgttactattctacagatttttaaaaatggtggcactcagatagattaaactactcgcccacatttacccagcttgtgggtggtggaggctagaattcaaagccagtgtgcctgacaccaaagcctgttgtcttaactactccacttttctgcctatcatctgctgctagttctcagtgactttttatttatttatttttgcatagagcatcttttcttcttttcgggctatcaactcatcatttgtttaattctttgttttttgtttttgagatggaatctcgctctgtctcccaggctggagtgcagtggcacgatcttggctcactgcaacctccattgcctcccgggttcaagcctcagcctccctagtagctgggattacaggtgtgcaccaccacacccagctaatttttgtatttttagtagagacggcattctccatgttggccagggtggtcttgaactcctgacctcaggtgatccacctgccttggcctcccaaagtgttgggattacaggcatgagccgccgggcctggccttgtttaattctctgtatgcacctttttgataaatagttgtgtctccttttagggctatttctgttttgcatatacaaagactttactcatatttcaggttcagccaatttcagcctcttgcagctaacgcccttgccgtgtttagtgctattgtctgggctctgagactgaagcaggtctgtgagagcagccgacaaggtgtcaagaaggaaggatgcaataacccactgagctgcgttatctcctaaatgcatgtgtctttatgccattgctaatggcatctaatgaccttgggctccgaacaggtgctgccttgtaatctgcgctcatttgtctctttctacactgctagatttactgaaataacatgaacagggaaagcaaatgctttcatggatgccaggaatgctttatttatcttttaattttctttcatttgtttcgggatgtagaagcccactttggagttgaaataaaacaactaatgttcagagctgaggttgtcaccctttttagtaggacctcagatctagaaagggccccagagagttctcctttgcttatagaggagagtgtagtcctgtgggaccacatgtggtgctggccagcggagtaggtgggggtcctagaacttatgcagcctgactccctttctggggctccttctgaaacccagtggcatcctccttggcactttgcacacccagctgtaaatacacctgtgccatggagggctaaagccttttgggggggcatatatgggccaactgatgatcaacaacctctgttttcttagatcatctagcttctttatataacgtacctcttcgacttgggttgaccaaactcagatgatctccttaaagatgcatattaaagattgccccaatttcttaggatcctaggatatgagaatcttcatctctctctctctgtctgtgtgtgtatgtgtgtgtgagagagagagagacagagaaatttgtcctaaggaaacaaccagagatgttgaaaaaagatatatatgttcaagaagtccagcacagcatcactaaacgatagcacaatatctggagaattgaatgctagataaatagattatggttggaaattatagttatgttaaatattcacatattctgtgtgtgtgtgtgtgtgtgtgtgtgtgtgtgtgtgtgtttgagagacagagagagagagagagaatatgtatgtgaatatttaacattttgtgtttacagcctttgaagactactgcttttcctctagcatagaaataagatcaaggtttctcctactgtaaaagtttggttgaggggggttattgttttaaaatcaaaataatactaatatataatgagctcttattatggtccagatgctgtactaagtgctttacatacatgtaaaattcaattgccacagcagcccaacagcatagtgttattagccccatttgacagaacaggaagttgaggctcagagaggataagcaacttgcccaaggtggcagatcttaaagtgatagagctatgttttttttttttctttttttttttcccttagagacggagtctcattatgttgctcaggctggcctccaactcctgggctcaagcgatccttgcccctcagcctcctgtgtagctgggactatagtgcatgttgccacgcatggctatagagctatgatttgaatccaagcagtctgactccagggcatgccccagaaattgtttattgtttccctgatcacagaagggatgtatatattcatttagaaaaactggaaatacagaaaagaatgcagagcagatcacgcatacgataaatatgaacatttttagtgtctctagtcatatagattttttaactgggatcatgctgatttactgtttgtgagctagctgcctgatatttaccaggggtctgtatattgtaaacatgctgctgtgtgattttcaagcccacacagtgtgatcttagggcctatcgtaagttttacatcactcatagatactgtaatttccatccataatctatttatctagcatttaattttccagatattgtgctatcgtttagtgatgctgtgctggacttcttgaacatatatatcttttttcaacatctctggttgtttccttaggataaatttccagaactagagctggtggctcaaatagtaaggccctttataaggcttttgatatgtgttattaaattactcttcttgagcacttgccaaccatgacaaagaacgttcatgtgtctgcactctggacaacactaagtactgtaattaaaaaaaaaagaaacaaacaaaaactctgccaatttgataagttaaaaattatatcttgttttaatttgctttttttagtgtagtttcaagtgagggtggatattttccttatgtttctctgttttttacatttcttttttaaattggccattcgtgttcattgcttatttttgtcttagaaagtttttccttttactcacaattacatgtatttattttgtattaaggatattaactctttgtttaatggtattggaaatatttttcccactttgatattttcctttgaattttacttacgttgatttttatttacaaaatcaaaatatctgtgtagtcaagcatattaataattttcaaaaagtgttttgctttttttttttcccacagttgaatcctttttttttttttttttgagacggagtctcgctctgccacccaggctgcagtgcagtggcacgatcttggctcactgcaacctccgcctcccgggttcaagcgattctcctgcttcagcctccagactacaggtgtgtaccaccacgtccagctaatttcttgtatttttagtagagatggggtttcgccatgttggccaggctggtcacgaactcgtgacctcaggtgatccatctgcctcggcctcccaaagtgctgggattacaggcatgagccaccacaccctgcctgaattcttttgttttgtttgttttactttaagttctgggatacacgtgcagaacttgcaggtttgttacataggtatacatgtgccatagtggtttgctgtacctatcaacctgtcatctaggttttaagccctgcatgcattcggtatttgtcttaacactcttcctccccttgtccctccctccgacaggccccggtgtgtgatgttcccctctctgtgtccatgtgttctcaatgttaaactcccacttatgagtgagaacatgcggtgtttggttttctgttcctgggttagtttgctgagaatgatggtttccagcttcatccatgtccctgtaaaggacatgatctcattcttttttatggctgcaatttttttttaatttttttttttgcttttatacctagaaaagccttccattcactagggtcagataactatttacccacaatttattgtagttctttattatctcatagtttatatttatcgtttattttgatgtgcgatcttagacatgaggattcaatgaacttttgtcaaatattagatcagttgttctcacattatgtatttattagtcttttgccccactgagaggagacatcatctttattaagtactaataaaaactaaatgtttttagaaacatgagtatatttcttttttttttttttttgagacagagtttctctctattgcccaggcaggagtgcagcggcgtgatctcggctcactgcaagctccgcctcacgggttcaggccattctcctgcctcagcctcccgagtagctgggactgcaggcgcccgccaccacgcccggctaatttttgtgtgtgtttttagtagagacggggtttcactgtgttagccaggatggtctcgatctcctgacctcgtgatccgcatttctaagccttatattctgttatcttgatatttgttttttttctattttgcttttgattctatgagtttagaagattttaatataattagattctttcatatattttttttcagcatttattagctatttttagtctatttattctttcatgtgtacatagactaatttagtcagattttaaaacatcttttcaaaataaaatttaatttaatagattagatatcaattcagagagaatggaagtctttactgaactcttgtaatttttgatccatgcacaatgtttttcctttagttttttagtaatgcattttctgtttttatagaatctgagcagttcttgttttctttagagattttacagtgttggttataattgtgcacttaatctttattttccttatacagtagtccccccgatcaactgggggcatgttccatacccctggtggattcctgaaactgccagttagtaccaaaccctatatagattgtgttttttcctgtacgtacacaccatgataaaattcaatgtataaattagagattaacaacaataactaataatcaaataaaatacttatataaaaatatactataataaaagttatgtggatgtgatctctctcagtctccaaatatcttcttgtactgtactcgcctattttcagacagcaaattgaccaataaataaaaccatggaaagcaaaaccgtggctatggggagactactgtataagggaaattttcacctgattatcattgcgttttaggaaaactattagtatgtctatgtaagtgtgtgtggaggggtatatgtatatcttctagtaactgaccattatatataattattaatatataatatatataattttatattatacattatataatatattttatataaatatataaaatattttatatatagtatataatatattataaaatatattatatactatatataaaatatattatatatattttttgagacacagtctccttctgtcacccaggctggagtgcagtggcatgatctcagctccctgcagcctctgcctcccaggttcaagtgattcttctgtctcagcctcccaagtatctgggattacaggtgtgtaccaccacacctggctaatttttgtatttttagtagagacagggtttcaccatgttagccaggctggtctcaaacccctgacctcaggtgagccacccaccttggcctcccaaaatgctgggattacagatatgagccactgtgcctggtcaactgaccataatattgatctcagttctagagtctttcagctaattcccttagatattctaagtagacaataacatttccaataatgataattttgtctcctgtattttaatatttttaacttttatttcttctacagcatcctgatggtatgccaaataataatggaagagcagatacaaatacacttgactttattcctgaatttaatttttttttttcttgagacagagtcttgctctgtcacccaggctggagtgcagtggcgcacgatcttggctcattgcaacctctgcctcccaggctcaagtgattctccggccacagactcccaaatatctgggattacaggcatgcaacaccatgcctggctaatttttgtatttttagtagagacggagtttcaccatgttcaccaggctggtctcaaactcctgacctcaagtgatccacccgctcagcctcccaaagtgctggggttacaggcatgagccaccgcatgcagcctgaatttaatcattgactcttgtttttaacttttaatataatattggctactggtttgtggtaggtatcttttactgtggcaaatacatagtattctattctaattttcaaccctctttcccacagaatatttaagagaaaacctttttggccgctttgataatgataatttttgtctattgaatggtgatgctgtgattttcaggatgtatgtatcatggaaactggtagagaaagaaagaactgagatcatgctgaagtatactggggcccaccaagaggtagagctgagtgcaccaattgtcaccaaaatggcaacccgtaaaagagaaccattcttaagaaagagtcatgtaccatcaagcggggatttccagaagcctctgatagtaacagttctcccttccattcctttcctctctactttcaagatgcgatgatgacaaaaagactgacttgtcaaaaaaaccatgaaattccatacaaatgggcaagctgacatatagcagcttcggaaatttccacaatcgctcctctgagttgcctcaaggagaagaaaagtgagagaaaggaagggtacctttgcccccattaaggcacatgtagcatcctggaagctttgaaattacctgtccccaaagttattagaattatgtcattttttggttgttatattatgaaagcctccccacccctaaaagtttgtctataataatttttttgatcaggatttttacttcttaaattaatattaaagcattttaatgtttctagaaaatttgtcatttgtatttatattattttattttatttcattttattttatcaagacagggtcttgctctgttgcccaggctggagtgcagtggcacacgatcttggctcattgcaacctctgcctcccaggctcaagtgattctccggcctcagactcccaagtatctgggattacaggcatgcaacaccacgcctggctaatttttgtatttttagtagagacggagtttcaccatgttcgccaggctggtctcaaactcctgacctcaagtgatccacccgcttcagcctcccaaagtgctggggttacaggcatgagccaccgcatgtggcctgaatttaatcattgactcttgtttttaacttttaatataatattggctactggtttgtggtagatatcttttactgtggcaaatacatagtattctattctaattttcaaccctctttcccacagaatatttaagagaaaacctttttggccgctttgataatgataatttttgtctattgaatggtgatgctgtgattttcaggatgtatgtatcatggaaactggtagagaaagaaagaactgagatcatgctgaagtacactggggcccaccaagaggtagagctgagtgcaccaattgtcaccaaaatggcaacccataaaagagaaccattcttaagaaagagtcatgtaccatcaagcggggatttccagaagcctctgatagtaacagttctcccttccattcccttcctctctactctcaagatgcgatgatgacaaaaagactgacttgtcaaaaaaaccatgaaattccatacaaatgggcaagctgacatatagcagcttcggaaatttccacaatcgctcctctgagttgcctcaaggagaagaaaagtgagagaaaggaagggtacctttgcccccattaaggcacatgtagcatcctggaagctttgaaattacctgtccccaaagttattagaattatgtcattttttggttgttatattatgaaagcctccccacccctaaaagtttgtctataataatttttttgatcaggatttttacttcttaaattaatattaaagcattttaatgtttctagaaaatttgtcatttctatttatattattttattttatcaagacagggtcttgctctgttgcccaggctggagtgcagtggtgcagtcatagctcactgcaaccttgaacccctgggctcaagcaatcctcccgcctcagcctcccaagtagctgggactgcaggtgcatgccactatgcctggctctttttcttttttaacttttttgtagagatggggtctcactatattgctcaggctggtctcaaactcctgccttgagcaatcctgcctcagcctcccaaagcatggggattacaggtgtgagccaccggacctgaccatttctatattcaaaattttgttaacacagtcaaatattacatattttaaaaatttaaaacattctcaatatttgtgaatttattccacttcttatttttaatttggtttgttctctgaaacttaagattagctagcagtaagtcaatcttatttttgtatatattttaaaacattttgtatatattttaaaatatatgcaaaaataagatagacttactgctagctaattaatagccttttaaaataattttttttttttttttttttttttgagacggagtctcgctctgtcgcccaggccggactgcggactgcagtggcacaatctcggctcactgcaagctccgcttcccgggttcacgccattctcctgcctcagcctcccgagtggctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccaaaataatttttatctcacatttggatagttttatgtgcttttcctttatattgcttttcttaggtttatttccctttctttttttttttttttaagacagagtctctctctgtcaccaggctggagtgcagtggtgcactctcggctcactgcaacctccaccttacgggttcaagtgattctcctgcctcagcctcccaagtagctgggactacaggtgcgtgccaccatgcccagctaatttttgtatttttagtacagatggagttttgccatgttggccaggatggtctcaatctcttgacctcgtgatctgcctgcccgacctcccaaagtgctgggattacaaaggtgtgagccaccgtgtcccacccccttttctaatttattgagttgatcttttatttttaatttttcttaatgataaaaatactaaagatatttgcctctgactgtaagctgcctacactttgatacataattttctcattatctttattgtctcagtctgtgattccataatttattatcttttatactctacacctatttagaagaattctttttgaatgtacaagttaatttgaattgtttacacttctgtctattaatgagttttgttgcattgtggtcacagaatattgaaaggtagtaaaatttattttatgttccaatacaggattcatttttgttaatgttccatgagcccctgtatagaagatgcatgctctaattaaatctaatcaggcttatcttgtcatcagatctgccatatttatgattttatcctacttctctatatctttattaaattttcatctgctggccgggcgcggtggctcacacctgtaatcccagcactttgggaggctgaggcaggcgcatcatgaggtcaggagatcgagaccgtcctgactaacatggtgaaaccccgtctctactaaaaatacaaaaaattagccgggtgtggtggcgggcacctgtagtcccagctactcgaaaggctgaggcaggagaatggcatgaacccaggaggcggagcttgcagtgagccgagatggagccactgcactccagaatgggcaacagagtgagactctgtctcaaaaaaaaaaaaaaaaaaaaaaaaaaaatttcatctgcttatttttccaaggactgaatgcagtggggtagactttaacattattgcatgtctctcaatctctgttttattttctttatatatttccatgctctactatcttgacacatacaattttgacttaattctttggaatgtatctcttgtcagtaaaaatttcacccctgttgaatgctttagatatgtaatactgattttgtattaacagttgtaaaactgtcacttctaaatgtgcagtttcctggtattcctttgccccaatcttcttgtaacttttatgggtttcttgcagatagtctaagggcattcttaatttatgacaccatctgagattcttttgcttttcaaaacgaattaatacctgtcttcaatgttgatacgcttattctaatttttgtcatctttttattcttttggttttatgattccttgatatttccctcattttccattttgtgtgatatgatttactgtctgtaatactcataccttatatttaatcttctagttgtcttcttaaatttgactaaatatgacctatatttctgtatgagcaaagtgaggaagctggctgaccatacctcctccctgtataagataagattaacacattttattctcctttggaattctccttttcttttttaaagttagatatagacatatagatgttttgatccagtttatgattacttttaaatattatgtaacttttcttaataaggattatctatatctgtgttcctttttataacgatattcagttgtttgttatatgctctccttatatgtgtatatatttttctctagagacagggtcttgctctgtggtgcagcctggagtgcactggtgggatcataactcgctgcagccttgacctcctggctctaaaggatcccccacctcagcctcctaagtagctgggactacaggcacacagccccacgcctggctaactttattttttttttttttttttatagatgacgtctcgatgtgttgtcccgggtggttttaaactcttggcctcaagcaatcctcccacctcggcctcccaaagttctgggattacagggatgagcccctgtgctgggcctgaatccatattgtgaactgttttaaagcacaactaccccttttctttattgtttaaaattaaatttttgattgattagggagcttcttcaaatatattctatgaaatacattgtgtttttgttgctccttgggatccaagaatgccttttttattttttaactctcataccttagtaggaaagttggttagtttggaatttttgtatcagaaccctttgccattagagctgtgtagttgttttatttcttctattgtcagaaatctgattttttttccaccttggtgacctggttacctgtatttcttttcctcctcactgaatgcttatgagttgttttgacctcaaaagttgcaccagaaggtaaataaatagatggaagttttctttaatttattaatttatattaatatttatatcagttttcatttttttcttcttgtatagagtgagtttttggttggttggttggttggttggttggtttactctgtatttcttcagtttagaaaaattttctttcattatttctttaataattgcttctgtggtatttactttgactatgcatcaatcatgctatctctatgttggcttcctactttgtctcctgtatccattagcatctatctgatttgtttatacttttcatcttttttccagtgccttttgggagactttttcaggtttgttcttcacttgctggtttgatgctccaaaggctgtttttccttttcattgcatcgaatgtagttttaaataatactttggaaaatcagtcattgaaaaaaaatcctaatttttttttgtaagttggtgtttctttttgttttcatttacttgtcattcacgcctaagtctgggtctcctccccttctttttcctcctccttcttcaaaggtgcaaatcacatcttgtctgaaacttgtttctatttccagtagtaaatattttttgaaatcgtcttcttcctttatttcttggatgtttcttgttttgttaaccaagtccttataagcccaatgttgccagttttgggtctgctcatcattgaatgatgggagggctagcccgccctggaaattgttctcaaataatctctgtaccattagggaaaggttggactcctttcctcggtcttaagctgaaggctttgttcttaaaaatgtactagaccaggtgtgtttttcagcagctgcacaaatttgtagggagctggagccacagggcaatctctattggggttcttccttgcatggttgctgcttggcaatgggtgaagccatcgtgcaagagacagtggttctcattctgaacttctccctgaccctagcttcactccaagccccctttgtagcagaggatgcatttttctggcatcagagtcctgctatgtagagagacatctcacatcccaccagatggccatgggcatggaggacttatgcttggttctcttcttagtgccttccgaatgtgaatgccctggacaccagacactatctggtttgctagcctgctctcacctccagcgttcagtccattttaggaagatttctaaccagtgctctgtcagaatctcttcttgtttcttctcacagtgctgtgccaccttttcaagaaagagaatcccaacacacatttctgattcagccttttatgtgatgctttctctggtctatctaacaaaatgtcttaatgttaaaaatgctgggtgccctccttttttttcagcactggtgtagacttccccccatctttatatttgtgggaaatggatgttcagattgatgacgtgctctaaagacagagaggggaaatttacaaaacacaaatggagaggaatgtgaattttacaaaagtatttatggagttctctaaataatgaactccctcaggacacttagcacaccaagtaatgtaaaaagttaggcttacacgtagattgtcagacacacagcttttgtatattgtaagctacacctgtatccctgtaatggtccccaggagtatcacgctgcatggtccaattaggtacagaagaactctcaagtagcagccagtcactttgcctgtaataatgtttatgattcagagtggtgcccaattcaccctttgcacttttcccagtggcatttggcagctggggcctggttattcagcagattattgcttctccccagaagcttttgtgatccttgcaggcgctctcctactagggagagaagaatgccaacatattttaaggaaacaaagaataatagtgtcacacgtctttgaataagagtgaaaaaatagttctccccacatccaaacacagtgtagtcaaaattaagaagatagaaatcaagtgtgcatgggcagagggtaggtcataggcttaatgaacccagaagagctttatttattgacttctattttatcccttctcactggtccagctgcaatgattgtcaacaaaggtgacttagaaaaagagagaccttggagagagacagaaagagagagagctggataggcagacagatgtagagcaggtttgtttgcttggcagaacatccaagtcgcagatggttctagaacagaggtaatattgccagggttgcgtggaacagatctggactaaagctgaggcttgcaggtaaagccagtggctcccactccaatgtcattcagcacatagcaatttcagctggagatctgtttatagcataaaacagacactgcagacttttttctccatgagactttaatgtttcatttactaacaagattatatatgggaagtggatgtcataagaagactgtagaatcctattgtctcaccaccgattgaggggcctttgtctatagaccaagcacgtctttttcctcggatgccttgggcatttcagaccatgcccaaaaagatatgttgtgacctgcagacctgtggttgaccatattaggatctgtgatcaatttcttagagattttgggcataaaaaatgagcaaagagccatctttaggaatttggggatatgcttgacccaaggtatttttgttttctactaacacattttgatgtaaagcaagaagtggttttcaacagttgaccatggttgcctagagagatgggtacatattcatgtattttgacctatcagatggaaacaggcttcactcttagaacttccctttggatttcccacccaccccagacactgacattccattttgaagttacacatgaatataacactgacacattgggacatgctttccaagctcaattaccatgcagcgcaatatcaattaagtggatcatgaaacatgtgtctgattgtctcacttgcataatttacattttttgacaacacttaattctcccttatatgtccaggtttcctattttgtgatgcacataattgcagaacttgggagctagaatggaccttggagaggtcccttacgccaaccctttcacttcacagatgtagaaactgaggcttagagagggtataactttcccaaggccacaaaggactagtttacagcagagctgggcttatataacagggctgcctggccggacgcggtggctcatgcctgtaatcccaacactttgggaggccaaggcgggtggatcacctgaggtcaggagttttaaactggtgaaaccccatctctactaaaaatacaaaacattagctgggcatgttggcgcatgcctgtaatcccagctacttgggaggctgaggcaggagaatcgcttgaacccgggaggcagaggttgcagtgagccaagatcgcaccattgtactccagcctgcgcaataagagcaaaagtccgtctcaaaaacaaacaaacaacacacacacacacacacacaactcatggaactgtatactttcccccaaaattcaatttagggccgggcgtgatggctcatgcttgtaatcccagcacttcgggaggctgaggcgggcggatcacgaggtcaggagatcaagaccgtcctggctaacacggcgaaaccccatctctactaaaaatacaaaaaattagccaggtttggtggcaggcgcctgtagtcccagctacttgggaggctgaggcaggagaatcacttgaacccaggagtcggaggtcacagtgagccgagatcgcaccaccggactccagcctgggcgacagagcaagactgtgtctcaaaaaataaaaataaaaaaaaaaacccacaaacaaaaaaaccacaaacaaacgaacaaacaaacaaaacagggctgcccattatcccctgcatggctccagagctattcttaagatcctctgcactttggatcttaagataacattagatttcatagtatccatgaaataacttagacctggtcttggaaatacgtttcaccatccaggtacccatcacatgtgttcgcaggtgaggctttcttagcagcactatgtaaggagacatagtaaagaaatatttattgaatactgaatattgattgagcctatgtcctgtgctaggtgttctaaatatagaaccttatctcatcccataactctttgagttaattgtcattctttttgtttgtttgtttttgagacagggtctcgctctgtctccagagtgacacactgtactccaggctggagtgcagtggcgtgattgtacctcacagcagccttgaactcctgggttcaagcgatccccccacctcatcctcctgagtatctggactatatgtacgtgccaccacacctggctaattttttaaacattatttgtaaagttagggtctcacatgtttcccaggctggtcttgaactcctgggctcaagtgatcctcccatctcagcctcccaaagtgctgggattataggcatgagacactacacctggtcagtatcgttatcttggccattttacggttaagggaatatagacccggcaagtttctatagcttgttccagaccacatagctagtaagctttgaggctcatcctagggtcactgcttgaataacctgcatttttctactgtaccatatgtattctcctgctaatcttcttactgagagagatggtagttcttctaagtatcatatgatccaaaagttgcttaaccaagagctccagcatctgaatccctgagcatacctcttcccccatgcatcatacctgtttcccattctctttgaataattttgaattgtgagcaaatgttcttacaaaataaagaagagagtgtgtccctgcagcattgtctaagtgcagaggatcttaagaatagctctggagccttgcagggctcatgggcagccctgttatataagcccagctctgctgtaaactagtcctcttgtggccttgggaaagtcataccctctttaagcctcggtgtctacatctgtgaagtgaaagcgttggcgtaagggatctcctcaaggtccattctagctcccaagttctgcaattacacgcatcacaaaatagggagcctgaacatataaaggagaatttagtgttgtcataaaatgtaacttatacaagtgagtcaatcggatacgtagttcatgatccactaaattgatactgtgctgcatagtaattgggcattagtggaagcagttcacgtaaaagactataatttgtattacttttacaccattgcaacactttttattgttcctcagtccttgatttgttttctaatgtctctagtgtgtttaacactttctcttgttatgatatgcaccatacatgtgcatgtaatataattcacatatataacatgaaaacatctgattcccacatctaacagtcagacttccgttttcctcttttccaaaatccaggtggtcagctgggtgcagtggcttgagtgtgtatttccagcactttgtgaagccaaagtgggaggattgcttagggcaggagtttgagactagcctgggcaacatagtgaggcctcatctctacattttttttttttaatcagccaggcatggtgatgtgtgcctgtggtcccggctactcagaaggctgaagtgggaggatcacctggttccaggaggctgaggctgcagtgagctctgattgtaccactgcactctagcctgggcaacaaagcaagcctgtctaaaaaaaaaaaaaaaaaagaagagaaacaaaatccagttgtctgaagaggaacaacttcttcctgagacattttctttatttcttttaattttgttttcttttttttagatacagggtctctctccatcacccaggctggagagcagtgatacaattgtggttcattgcagcctcgaactcctgggctcaagcaatggtcctaccacctcagtcagttgagtagctggaactatagatgtgcaccacgtgccacgataatttttgtttttttttttttttttgagacagagttttgctgtgttgcccaggctggtcttgaattcctgggctcaagtggtcttccctccttggccttccaaagtgctgaggttacaggtgtgtgccatgtgcctggcctgttcctctttatctctttgtattgagaggttcttgagaagcatttccatctgctttccatcgttttctcccatgtgcagacttggttaaaagaccttgaggaatcccccctttacgaagccttatccatgagaggacaagataaggagacccttggtttgtggattcagcttccatggtcattcccatcagttcccaccacttctaggagagatagtatcactcgatgctgacctggaaaatcctggtagagacccaggaactcataggactcggtccccacaccctcatgccagtacctgtgtgacggagaggcgcccctttgcatggggtgctgcacaatgccttcgtcaatcttctgccactgtcctcatccccaccccagcctgctcacctcttcccctgtaccccacagccaccaggccagtttcacctggtggaacacttcccccacttcacctgctgtgcctcacctacttcctcctgcctgttctggtgaagcctcccgcgtcttttcttgtggtaatgctcttttctgcctctctaaacttctgccagtgtttttgtatttgatttttgaaattcaactcagacctccaaatgaggcctaagtcaagcctagcttttggcgagctcaccccatttatggtgggggcctgcctggtcacctgctcgtcttaaaacctgcctttccttatggaactgtgttttcaatgaggttctggccgctaagcactcaaggctgtgtacactcaactgttgggctgttggaggtctccccatgagaactttattacagaatggagtatggagcctggaaagggaaggtggcccagtgaggaatggtactgcattctcagtctctgggtgagttgaggcaggggaccagaaggagaggagggaggagtgggaaaggcttaaagcctcttggaaggagaaaagccaggggaaaggagaatggtaactgggaaatgggctaacctcagacctgcctttagcggacgcctggctcgagggcccaagacctcaagctctcagaaactggtaagaatcatgctgtcccaggtcccagtgaggtgactctaggtaggaggcccttagcagaggtggctgggtcaatcccagtcggctgcttttatcttttattttatcggcacttagaaagaaagtatggtgctccttctgagagggctctttaacattgcaatgggccaatcactttatatcattatctcataattattatattacattacattatattatgataattcctgttttgtaaatgagtagccgaagctcagttacatagcctgtccatggtcacagtggaacatgaacccagtttgtgatgtcaaagcatttctatctttatggcaagccttcataggaagcaaaagaagcttgcaaaagtaggagacgttaccttatcctctttccccgttcagaatttgggctgcggccaggctcagtggctcacgcctgtaatctcagcactttgggaggccgaagcgggtggttcatgaggtcaagagatcaagaccattctggccaacacggtgaaaccccatctgtactaaaaatacaaaaattagcagggcatggtggcctgcgcctgtagtcccagctacttgggaggctgaggcaagagacttgcttgaacccaggaggcgaaggttgcagtgagccaagatcatgccactgcactccagcctgggtcacagagcgagactccatctaaaaaaaaaaaaaaagaattttggctgctcactgatgttagaatttaaaagaaagtaaagtgatgcttcaattaaaaaaattaaaagcttaaaaaaattaaaagctttaaagtatggattttttttggtgggcggagcaaaaacagtgactgaagtgtattcatattgaaacactgtggtgtttcactggtgttcaagttgacagggcaggggtgggaaagaattacggagtagaaacccctggggcccaatggggaggcacctagagggcctaaggggaaggatcctacagatgaacttgaccttctttatgattttgcggaagacaactctgcttatctttcctctgggaccagtaaaatagctgttgggggcagatgctttgctgatgcttagtatacaaaagacagcttatatgggggcaatattaattttcttaagtcccttggcatggattctgaaaactttaagatttatgatttgagaaccctgactctaaaatacgtgagaattttctgcttgcaaaatagattacgcttgcacaaaatacgcttgcacaaaatcttctacttgtatttctactctggattgttgaaacaaattgattttttcttttttgagacaaagtctcactctgtcatccaggctggaatgcagtggtgcaatcttggctcactgcaagctccgcctcctgggttcacgccattttcctgcctcagcctcccgagtagctgggactacaggtgcccgccaccacacccaactaatattttttgtattttttagtagagatggggtttcaccgtgttagccaggatggtctcgatctcctgacctcatggtccgcccgcctcggcctcactaagtgctgggattacaggcgtgagccactgcgcacagctgaaataaatagattttaagtggctggctggctctcagattgcatcctgttagaaagtcagaatagaaaatagatgcattttagcagtgttggaagaataaactcaaagtcccctggaaatcctggaccccacccacctcttaccaagtatccagcaggaaccttcttccttactattgttataatacattctagccccagtaatttgttccacgtatctcattagagtgaagatagcaacatacttaaataagaatttcatttttcagttttagcttttgatgtaggctaaatgctctgtgtcacataacttagactacctacatgcctcatacactgataccctattttgaaattacacatgaatttaacactgccacgttgggacgtgctttctaaagttacctatgaaataacttagatccggtcttggaaacaccttttaccagctaggtacccatcacatagcttagtaggtgatggtggggtccttcgtttttttgactacccgtataatttcaggagcaagcctaattgttatgcctcctttgttattacctcccctagcctagataacatgccttccaaattgtattgagagtacacaggaagacaactgcagcaggcaaccagctctaacaactgcgtcattttctaagaatcaaaggaattacttgagtttctagttctggctttggcttgccagacatataccttaccccagcgaggtaaatgattcaatcatttgggaatgattgaagttgctgcctaattcataacttataggtgattaaacttgtaaagtattttgaggctgtttctttcattcatttattccaaacaaacatttgttgttgaatgggtagtgactttgattttaaaacactatacagacataaaatagtggcagcttgtagatagcaattttttaatttgctgtccttaaggaatttcgttaccaaatcctcacgaatcttgaaccttagaagaataatcctttcctttgttggagttttaaatttagaataatcagacaatagtgaagcattctgttcaaagcattccttttaggctacccatttattatacgctgctcttaagaggagatgaatttgattagcattgaacattcagtcagtgtttttgcatagctaatatcacggagaaattttcaaaaaaagttatgcctgctatttaacattattatacagtcaacttttaattatctgtattaatggaatgtaatcagtgatgtgttgctccaaaatcatttcctttggctttgagaagcaccggatgatgcttttattggtttgtggttttgcttagatagtattaaaattgtgccacatgtgtgcacatagctcatcttagggaggaagtagcccaaaagtatactgggggctagggaaaggtcaactggaatttttaaacctaccacagatacatatacaatggatgaccccaagattattcatcttaattattaaataaaaaacaatggccaagaattatataatggcagctgtgtaagaaaaaagacgcaatgaaccacatgtgagatttccatgtaggacacacattgtttcccacctttcccttttgaaatttcctgaaagtgaaacactctcataacactacagcagtgaacactgttagatttagtgatcctccaaatgcattttgctggtgctccaaataggcctcttgggggaacagaaggaacagaagggctgatgtcttgacatgttaatgtttctagataatgtcacctttaggtgtgatagctgttactgtttattattttttaaataaccctcttgttcccattcattcaagttaagctttttttttttttttgagacggagtttcactctgtcaccaggctggagtgcagtggcgcgatctctgctcactgcaacctctgactccctggttcaagctgttctcctgtctcaccctcctgagtagctgggattacaggcacgtgccaccatacccagctaatttttgtatttttagtagagacaaggtttcagcatgttggccaggatggtttcgatcttctgacctcatgatccgctcgcctcagcctcccaaaatgctgggattacaggtgtgagccaccatgcccggcctaagcttgttttttttttaatgaataacaatgatagaaggaaatctttggagggtttatcttcttagtagcggcctttcaaatttcaaaagtcttctcagtgcacaaatctgtttttgcatgaggctgctatagggccagcacttttagtcctctgtggcctgttcacctgagtgagtggtgacatttcttggttcataccttggaaggcaatgatggctggccctttagagtgaggtgaaggaagactgatccctgggtgtggaggtactgatgcataggaaaagaaaacatctttggtgacaccattgggtgtcagatcagtttttggcaagttggcaggaaagtctccaaatcagtggggtctggctgggcaccagcaagttggaagctgcattagttccttctgctggcatgtccccctgtcatctggccatagcctcatctgctcctactaccttgcaggtgcccttggggtaaagctgtccagatgcacatgaacccctcctcttttcagctggacaccaagccaggaaaaggagaggtgtgactttttgacggaggccagtttctatgtcagcagccttgccagtgaacactgcaaaatggtgtcagcctgcagcctttttgtgcactggagcagagctcccctcaccacatttgtgaaacaggttctgtcatggggcccaggtgtccttttctcctgccacccccactccagcttgctggccgccttatcattccacaccaggaagccagcatccttgagttgtccttacttcttatgacctgctgtgtagaaagagaggggaaaaccagtgtccgagtggctgctgtgggtgtggtctgggccgcgtagttttatatacgtaacaaccttctgagacaagcgttagtgactccttttacagcggatgaacttgagggtcaagccagtaaataatttcctcaaagtgacagagctggaaagtggtaaagttaggatcaatactcggctttgattttaaaatatgcatatgcatatattttggagatctggatataccacttccaaagtagcatattatactgaaatttcaaaagagaaaacatctttaaacaaaaggaaataactcttaattatggagtttcaggtatcaatgtgttgctggagggctgtgatcttaaaagcatgtcacattggcaacccgttccggcaggttgtgacaagctatgtagcatgcatgaaagcatcattcattttttaaaaaatgtcttcaccatttatttctttaattttttgttttaactttttatatttataggcaataattatgtatatttatggggtacagtgtgatgtttttataatgcatacattataacaagattcaatcaagctagttaatatattcatcacctcaccagtttatcattttgtgtgtgtgtaagaacattaaaaatctgtgttagcaatttacttcattcttaatggcagactcagcttctttttttttttaaatcctagactgttggcttctccttccagcagtgttgtaggactcagctgcctttctttgctgtccctggccagagatgtgtgcactcctggtctcctaataaaactttagcctatgctgggagccatggatttggcagcactgcctttagcatttaggaatatgtttctccttacatcaagaatagttttaggccaggcatggtggctcacgcctgcaaatcccagcaccttgggaggccgaggcgggtggatcacctgaggtcgggagtttgagatcagcctaaccaacatggtgaaaccccgtctcgactgaaaatacaaaaaaatagccaagtgtggtggcatgtgcctggaagcccagctactggggaggcagaggcaggagaatcgctagaatctgagaggtagaggctgcagtgagccaagattgcgccactgcactccagcctgggtgacagagcaagactctgtctcaaaaaaaaaaaaaaaatagatttatgctgcttgttgaggaccagcagtattctcaaccatgtgaggcattcttcgaacatgtgaagcagcattttcctggatgggcatttctgccataattgtgggcagaaaaaggtgtggtccacatatgcccaacagggccaaggggcaagggtgagcatgtacctatgtcttataccccggagattcttgcggctgacgaggttcccttacaaagcccaaaggaattctcctccttccaccggaggtgtttataacctctaatttgctcaccatgcttctagtggaaggagtaggagctcaatcccctgggaggctgcggcagagccagagcaggctggtgacccagagcagtggcactcccctctgagtgcatgatgcagatggagcaggagggggatgcaggtgggacaccctgcgccctgcaggtgagtgcacagccagcgagacacccaatcagggagcaggaaggctgtccctgtggcagcaggtaaaagagagagtcgctgagatgaaattcgtgggtgtgtgcttcagcttgtttgaacagctcctgtgcaagatcttatagtaaatgctgagcttctttgtgctctgtgcctgtcggtggaaggcatagcccttgatgaagatttctccttctacccatcttgcctttggaaagggctcccctttgacaaatgctgctgtagtatttgatgcagcctccatgaggtgctttgggtgggaagtggattctgacctcatttcccagaggaatttgaagtggaggggaaggactaattggtccctcattaaggacttacaatgaagtacagtatttctcctgaaaggataatctaagtcactggataaaatgcccaacacacttttaacgtgacataggaatccaaagtcatttttaaatcaaagatttttgtagttgtggagaatggctgtgttttaatgggatctttacatatcagcattacaaagggctccttcaaatgtgatgattttaatgtttttgctggggtttcacctgaggttccaaatacatatttccctatcatatttgcaggcatccagcacccgattttagatatgcaaatcagctcactttgtttaccaggctttggataggggagaaaaggaggtctgaggctgggcacggtggccacacctgttatccagcactttgggaggccaagatgagaggattgcttgaggccaggagttcaagatcagctttggcaagatagagacctcgtctttacaaaaaataagtaaaaattagccaagcatggaggcgtgcatctgtagtcccagctcctctggaggctgaggcaggaggattgcttgagcccaggagttagaggctgcagtgagctatgatcgtgccattgcacagcctgggtgacagagctagattcagtctctgaaaaataaaaaaacaaaataacggggctgcaaaagcttccttgacgaagaaggaaagtctctcgctcctgtttaacactgcctggctgggttccagctcactagcttaaaacgagaaggcaccaccactgtgattaaaataaggccctacttaattaaaacagtgtgagaatttaataagaggcataagacttcactgatagtcaccaaaaaatctcaaaaaggtgacttaacaggcattaatagcatatgttgcttgtttactctctgtcaacattccgttttccagagacatccttcgtacaggtgaaagtctctcattcctccctctcccctcactgcctgcctttcagccatttccttgctttttgtagttaaccagtaagaaagagaccataatggagaaagaacacactgactgtgtttcacagactgttgccctcatctccacttgtgttaaagaaggtaaattagttcccctccagattaacttcagcgtcagctgtggtgctttcctgacacttcttaacatttgaacagtaccacattctgtccgttttatcgttgtctcttctcataccctgtatttgccaattctgtactcatgcccagacagatctataggtatatgtaggaggatgatgaagaacgggccgattcgtagctcaccctttgagccaggaccaaaggtttgggagtcttaggctctgaccttattcttttggagaggaaagaatcattttcctttaagcctaagtctggcaaaatctaattacaaagtttttcgattttgctattttaaaataaaagctaagccttccccccatctaatcagccctctcttcctctgcttctaatagtgaaggaaataaagaagtctctcaatttcacaagcttgaggtacttatatttgtacatgatttcctgttctaagtgggtggttttggcccctggcacttcatgtacgctagggcatttttggacacttttggtatccaccttgcttaagaattgaatgactaggaaagaaggtcatggggagtcttcaaattattaaccctcagtccaatctaagtcattagttaatgccatgtttgaaggtggtaaagtaaccgtcatcttacgaagtaactctcgtttgttatgcttagtgctgaacaaagtataaactcaccaatgtgagagacagggacaggatgcttatttctttatggatatttagaatttgagcctgtaggctgggcacggtggctcacgcctgtaatcccagcactttgggaggccgaggcaggcggatcacgaggtcaagagatccagaccgtcctggccaacatagtgaaacctcgtctcttctaaaaatacaaaaattaggtgggggtggtggtgcgcacctgtagtcccagatactcgggaggctgaggcaggagaatcacttgaacccaggaggtggaggctgtagtgagccgagatcgtgccactgcactccagcctggcgacagaatgagactccgtctcaaaaaataaataaataaaaaaaaaaaaaggaaaaaaaggaatttgagcctgtaacaccaacttcagcacaaatagatctctttcttgattctgaaatgatttatcagttttaaaaaatggtggggtgcactgctggtgggagtgtaggttgatatagtcatttgggaaagcaatttggcactattgtttaacagtgaatattcatagacccattcctaggcaataacccagggaaacttatgctgatgggtattgttcctaatggacacagcattgtttctaatagaaaaaaaaacgaagctgaaaaaattttaaaggtcgtcaacagacatatatatatatattagtctaatatatgacaattagactaatatatatattaattagactaatatatattagcttctatccctgtagactaatatatattagtctaatatataataattgaactaatatgtataatttgactaatatgtatattagcttctatctctatagacatatattagtctaatatataataattagactaatatgtataataattggactaatatatgtattagcttctatctctccagactaatatatatatatattagtctattgagaacctttatatatatatatatatatatatgcacacacacatatacacgtacatacatacatatatataattttttgcttcacagaatggaatattatacagcagtgaatatgaaggaactatagtagctacctgtaacaacatggctaaatcttagaaacaatattgtgtgaaaaaaactagtcacaaaagactatatacagtatgatagtattataaagtttaaaatcaagcacaattaaactatgtattttagagagtgatagatagaaaatttaagatagtggttacccctggagagaaggcaggaggatggcttagggaaatagcaaataggtagatggatcaaaatacccctaaatgtctagttctcaaatagggtggtcggtgtatgcctgttcattttattcttatgcttcacaggttacgtacatgttagtgcattcttttgtgggttacaaacattgcatgatagaaatatttttaaagtgatagcatgtcagaattatggcttgttttttccatctctatttcctaacattctctttccatagtccccagggagggggcttgagatcacacaggagtaattagaaggtctgcttctgacagtgtcgctccttgagtggtggaggttttagggggaggctgacagtaactactgagtggaattgagaggtgaagccagctggacttcctgggtcgagtggggacttggagaacttttctgtcttccaagggtattataaaatgcagcagtcagtgctctgtagctagcaagaggtttgtaaaatgcaccaatcagtgctctgtaaaaatgcaccagtcagtgctctgtagctagcaagagatttgtaaaatgcaccaatcagtactttgtaaaatggaccaatcagcagggttctaaaagtaaccaatcatggggaggattgagaaaagggcgttctgataggacagaaacaggacatggacgggaaaaataatggaataaaagctgccccccccaaccccccacccccacccgcaccagccaccagtgcaacctgctcagattcttttccagctgtggaagctttgttctttcactctttatgataaatcttgctgctgttcagtcttttgggtctgtgccatctttaagagctgtaacagtcaccgcaaaggttagcggctccattcttgaagtcagcgagaccacgaacccaccagaaggaaccaactccagacacagaatcagctaggagacgtgggtgctttctgtatagtgcttcctaccaaaagcctagaaaatcttggggcgtggagaaaagaaaatccatcaagtaaaggcttgatcacctcttggaaaacccatattcattgtcccaacagtgactaatacgtctaactgtgggcctgggtaggatattatgagaaacctgttcttttggtgcccacctttcttttctgagcaacacgtggtcttctgagtgaggcaggagtccggcatatgcgtgatgatgtaatatgttaggcagccaggccctcaccttttcaaaggttcgatcttgaaaaatcaaaggtggatatgtgagaaataagcccatataggaataagaatgacaatggaagtggaaaatgtaagttgggactgatgttctgctgctttgagtactgaaattctctgctgctcggattcatcatcactgaagtgctggccagtactgggaggggggcagagctctcccgggagtcgtcgcttattctgaaacagctgagcagaataatgagtgacaggctggtggtggggaggttgagtcttactccggatttccattaaatgagtgcatggaatcaatagctaactgaacatttgtctttagaacacccaggggcccctggggaatttggtattttcagtctaattctcagacaggaaaatgcgcagcatgactattttttaaaatagtttcaacatcttttatgtaatgctgatgcatctggaagtgaaaacgctaagagtttcatttcactaaaaaatggattttttttggctttaacctttaagttgaaatcacaattagtggccttttcaccatagtcataagagtatcaaagtgtgtgtattcacccacacatcaaaccagtgtttactgagagtatattctgtgcaaagaattgtgcagtttgttatgaaaaatacagagacctcgctggggcccctaaggagctcatagtctagaaagggagacagatcattacacggcagggaaaatacaatatgtatgggagcatgtcacaaaggaagtgacatcgagctgaatcttaaaggaagagcaatgcttgaatgaatgaggacatccctgattgaaggaccagcataatgaacaaagaattttgccttatattactaagattccatcagatgttatgacgcaaacataagcatcatggtaatgaaattaatagtaaatttaaataaaaatgatcaaattaagacttttttggttttgtctattctaccttctcattttaattatgttgcaaagaaccatatacttagggtaaactggtcaatagctgtggccatggaatagaattataattcaatttaaaaggagtttaatagtctcatggtaaatgaataggttacagctgggcactgtggctcacacctgtagtcccagttctttgggaggcctaggtgggaagattgctggagaccagtagtttgagtccagcctgggcgacatagcaagaccctgtctctactaaaaaattaaaaaaatagttgggcgcagtggctcacgcctgtaatcacagcactttgggagaccacatgctggtcgagaccatcctggccaacatggagaaaccccatctctactaaaaatacaaaattagctggacgtggtggtgcatgcctgtaatcccagctactcaggaggctgaggcaggataattgcttgaacctggaaggcggaggttatggtgagtggagattgcgccattgcactccagcctgggcaacaggagtgaaactatgtttcaaaaaaaaaaaaaaattaaaaaattagccaggcatggtggcgtgtgcctgtagtcccagctacccaggaggctgaggtgagaggaccacctgagcccgagaggttgaggctgaagtgagctgtcatcacaccactgcactccaacctgggaaacagagtgagaacttgtctcaaagaaaaaaaaaaaagaatgttatgaatttagtatttttatacttcccctacaactctagtatctctgaggaaaagcctcaatcagaaaaatgatttgctttggggttttatcttttatcagtgataaatgtgaattgagaatagaaatctcaaaatgcaataatgatagtactttatatttcagtaggacttaatatataaaactctaatatgcattatttaaatttggccaatatgcaagagaaaagcaacatagggcagaattatgagtttgcttcgtaaaataactattaccagttcattctgttcaactatgtactggtagcatttgtaaacaattcattcttattttttttccaaagtgcattgcaaaatagtcttgcctgtattttcctgtttgcagtctatttcattaaatttctgcaattctaaattagaatagcatctaatagaccacatatgaaatgtgcttgctattaattcagacattttatggcatattcattagtcaaatccttagtatttatttatgaagtcacattactctgtccagtaattaacagaagtggatgaatatgcatctctaattttttttttagcaaaagaaatagcttacagtaagtatttataattacgtcagctcaatgtttacagcacttgaatggcgatatgtgtagtttctgtcatttagacttcatagataatttttgtacagaaatgctttgttgttgatgctttgcttccttcacacatatatcacagattaccgaaacaatcattagtccttcagttgcaacggataagactcttctttatccttaattttctgagctcctttctaggcattttatgttcttacacagatgctaatgctaattaatgctttaatatgaaagatactggcaaataaaactgttacattttacccataagttgtaaattcagcttagttgccctaacaatactgatagtgataatggctgtacaattaatatttatggagtgcttccagtatactgagctctgtgctaaacattttacttatgtagcttagttaactctcgtaacaaccctgtgaggtaggtgttattagcccgtttcacagatgaatttgtaatcattatgccttaccacatttaataataacattctctattaatcgtatatttcagatgcccagctctggaactttgcagtatgaaacgtgtgtgtatgtgtgtgatgtatatataatatataagtatgtatatataatatataaatgtagattatataatatatatgtgtgcgtgtatatacacacatttcttttttttgttgttgttaatttatgtgccacgctgctgtacgaaactctggggtactatgatgaggggatacctctttcttgcctttaagggacttaggttgtggtgggagagatggacttggttaaggaacaagtacaggaaaatatgataattgctttaatagggataggtacaggggttgtagaaaaatgagagaaaagggcccccacttcccagaaggtgtcagggagtttttcacagagaagcgtccccagccctgagacttgaagactgagtgagtttgaaaagatgatgtgtggggggaacagaagagagaagggtgtggagatgagggaaacaagatggggtcagggagctacagggagggacttggaggtgctgagggtcaagtgcagcaggaggagagacccggctggctggggtcagagctcaaggagccttgcatgttacccaaaggaatgtagatgtcatactctgtgtgctggaaaacgatttacagatgaatccaatcaacactaattaaatcagtatgattaagggatgaccttcctttcttcctaccttcctccctcccttcctccttccctccttctttggctcatttattcactcagaagattttattgagtgcccataatgtgcaaagctttccattgaatcccaaagatgaaaggaggggtgagagtggacacagttctccctttctggagtttattgattcgtgggggaaaacaagcattaatcaatgaatcaaccaaaaaatgtaaaagttacaaaatgactactataaccagggagggtcattctatacaagtgtgtcctaggaggtggtgacctggctgaggaagtctcccttgagaagaggactgagctgagagctgaaggagaaaagaatacaaggtcatttgatagaaggggtgggtgatttgaggagaagtcttagcaaggaggaagtcatgtgcaaaggctttaaggcctgggaaagcaaggtccttttaaggaattgaaagtaagccagccatgctgtagtgcaagttggaagagaatgcaggttttgggggccatgtttagaaatggaaagccactgcaatgccttaggcaggagccaaggaaggtagtagggtggcagggtggacgcggggagacgtgttagggggccagggaaagagtccagatgagccagggtggtgccggagaggagcggagggagttgaggagtatggctgcatggttgaatatggggcataatttgggagaggaagacgtcagagtgatgttgatgccatcactgagctaggaaacgtaggtgaggcagaatctattctgcttagatttccagaaaacattaggggatagatgaggatgacatcacaatggaatttaagctatttaagctcaaggttggccttgaaaaatgagtaggaattttctttttttttttttttagacagagttccgctgttgatgcccaggctgtagtgcaatggcacgatctcagcttactgcaacctctgcctcccaggttcaagcgattctcctgcctcagcctcccgggtcactgggattacaggcgcccaccaccatgcctggctagtttttttttttagtatagatggggtttcaccatgttggccaggctggtctcgaactcctgacctcaggtgatcctcccgccttggccccccaaagtgctggatttacaggcatgagccactgtgtccagctgaaaaatgagtaggaattttctaaatggcaaggagaggcaaagcatgttaatcaaagggagtgtcatatgcaaaggcagaggcataacaaaaatagtgcaaataaatgcctacacatatacaaaaggagagttattgtgggacccatacataattttgttgatttcttgatatgctcatatccattttgtgttgcagtgattctaagatctgtattagtatgtagactttgtgaacaggtaaacatgtttaagaattttttaagacatggctgtattagatatcgaaattcctctcttcattttcatatctttactttggaattcatatatgccttttgatgttatcatctgacttgtttctaatgaaatttagccgcttaggcaggacgtggattttaggtttctgcttagtgttttggcatctggatttgggattacttagcatttttaatttactaaaataaccaccaacttacactcagttgaaatatgaacatgtcggtttcacttgagcttgggaattaaaatcaaagtacagtcaaatccaaaacaaataatagtaattttaagactaggtgacataaccctctgggaaaaatgaggtgatagtgatttgatactttttttttttttgagacagagtcttgctttgtcaccaggctggagtgcagtggcatgatctcagctcactgcaaactctgccttccggttcaagtgattctcctgcctcagcttcctgagtagctgggattacgggcacgcaccaccatgcgtggctaatttttgtatttttagtagagatggggttacaccatgttggccaggatggtctcgatctcctgacctcatgatccgcccacctcagcctcccaaagtgctgggattacaggcatgagccaccatgccccagccccgatatgttttaatactaactacagaagtgttggtagaaagatcagccttgaagagatggtatagtactagaatcctaagcatgacctctgtgaactgttggcttaagtactggctttaacatccgttggctgtatttactgtcagttttcttgtcaataatgcagaggtaaacatgattcctggccacctcacagactgcagtggagtggggcaatgtgtgtaaagcccttagcacatggcccagaacatagtaaatgtttaatcaatgttcgtgatgaccttggccatcactgacatcatgtcttaactgagttattaacaaagaggcatgtgtagtttcaaaagtgaaagtgaggccggaatggtaaatacatgcactgaatttgcataattttgtggctagaaggagtcttagagaaagagagcatcaaattcagcaatgtttctgacattttctatgaagaactgactgcttgttatttcttagaaatcttagaatcattgagcagggaaggaggggcaggaacgggattattttgatagtggtgtcctcaaggggaggagatggggtgggaagcaacccctggccagaacccactcatccctggggatagggacctgctgtgtctctgcctgctgagtttttgacattctgatttaaaaaccttgtgtgtgtgtgtgtgtgtgtgtgcgcatgcttgcgtgtgtgcatgtgtgtgtgagagattatgcaatatgatgtttcccgtttctgtgacttcagcgaatgtgaatgaagaccacagaagcagcctaactcagtgagaatattgtttttataattacaggtctaggcgttttacactgagattctccactgccaccctttctactcaagcaaaatcttcgtgaaaagatctgctgcaaggaactgatagcttatggttctccattgtgatgaaagcacatggtacaggtaaacatctccaaaagctttaaaggaaaataattatcattgagttgtaaagtccccaagatagtggtgggggtgtatacatatctggtcacacaaacatacacacacaacatacacatgtctattcatgtagactccattttttcctactgtctcttttataaaaatggaacccttgcttttttatgggaaaggaaataacttctacttattttgaggtcactagttaggatagatgacaaggcattgctgataattctgaaggcatttataaatttatagatttataaattcacttagagagacaaacatcaaatggtagtagagattgtagaagtagtagagattattaagagtattgttcctcttaacaatataattctgaacatctttcatagcaacagatatttttctaccgtatagttattaatgattagtataccattgagtaaacattctaaaatttatttaatttatatcccttctaactggacagttagccgtttctaatttttttgcctttttattttcttgagatagggtctcactctgtcacccaggctggagtgcagtggcatgattttggctcattgcagcttccacctccaaggctcaagtgatcctcccacctcagcctcccaagtattaatagctgggactacaggtgcacatcaccatgcctggctaacttttgtattttttttttttatatagtgatgaggttttgccatgttgcccaggctggtctcaaactcgtgacctcaagcagtcttcccacctcagcctcccaaagtgttgggattacaggcgtgatccaccacacccagacattttattgctttcatgatgccaaaaatattcttatagctctgtattagttcccattacaaattatttccttaggctaatttcttagcagcatactggtaaatgtaagagttttcaagttttacggcttttggtaacttgttgccaaattactttcagtaaagtcataccagtttgtatttccagaggcagtttatgagagcgtctacttaatacagttttccaatgctgagaattttgaaaacaaaaagagttttttgctgactgattatgcaaaatggtgtttccatgtattttgggttttgggggtggggggggtcatttgtaagtcaagtaaattgtactgttttgtagaaccttcctccattagacagcagcatccttgaaacttaccagatttcgacatttcagaaataatattaaatccagaaggagtagaagggtcctagggaattttaagttcttcctttctggccaagtatttttagacaactatgaaatcactagatacaatcatttttcagtggaaagcataatttttcatttcttaaaaagagcaaaaaggtatttaataaaaaaattttattagatatgtatctgaagttatactgctcattagtttaaaaatatgtatgtgcctatatatgtatgtgtgtgtgtatatatatatatgtgtatatgtgtgtgtgtgtgtgtgtgtgtgtgtgtatatatatatatatatatatgtccaatatcgggaacatgattaaatataactatgttagtgccatatgatggaaaagctgtagataagattgcaagcttcaggctgcctgggctcaaattccagctctgctgttttcttgaagtgtgacattgggcaagttactttgcatgtaaaattcggataataatagtacccttctcccttgggtgttgctgcaaataatatatatgaaatgtttaaaatcgttaaaactcctatttcaggagtatttaatcatttgagaaaatgatcaatatagaagtaaacaaatgtagggtattggcatgaaccatagtataatcctaatcttccaaaattactttgcctctctttcctccctcttttcatcctcctctagtatctacaaaaagggtttagcatacttctgaatggatttaatttgtattagtggagtaatcccagtcctggagagacttcctgattcaagttttcaagtcagagacccatttttcacagagctttgaaaccatggctgtctggatcacctggctgggggcacccttggagcagccgttgggtgagagcagagcttccttcccagccagggctgcctagctcctgtggtacagcaagtgccttgggcacagagtccctcaccgtctggcaccatatgtgagctgccctagttggctcatctcttcccgtcattactaaataagcttcatttcactaaataaatgaaagagaaggtagatgaagagacccccccgccacacccagctcttaggaaacgcatgctttatcctacagatgcatgaaggggaaggctgtaggtttgtgaatctcttgaccctttggctccatcgtaacgttgaaaagtgaaaggaaaagtggtcaaagaatcatttggcatgaaggagacaaacacagaacgacgtgtacggcttcagcctctgcctttcactggttaccctgctatgagcttgtgtatgtagacgctgcattcgttttggccctaatttctggtctaatttgaacagctctgtatttctcagcagaagaggaatatctgaattcctaattaagacatgttagcttaagaatacctccttaatgtgtcataaatcattcccctgtgactatgaggatgaataagaaaacaaaacttggatttatacacacatgtatattatttcaacaaaattaataagttcatagagggagagaggacaacaaatgtgttagcaaatataggtcaggaaaagagttcataatgttctgccagattctgatgaggcacctcatgagtgtaggtagaaggcctcaagtaacggtagtgggaatggtaataacactaccatatggaacatttggtatttgaatagcacttagcttcctcccaaactacaaaatcaataaagactcagagaggaagaaaggattctcttgctgtggatcactggctggtgtgcagaaatgcagacgtgttggttgtcaagggcttaccagaataaatttctctagggagacaggagagtgggaaatacttaaccatattaattgtgctgtgacctcagatctgtggtcagcagtttttggttgtttccatatactgcacatggttgcccacaccatttttgcattcatgtacaagacctatctgcaagaccaggcagaatcattgttgaaatcttagttcgcaaagtcccatggggactttggggtgtcttaggattttgccagcacaaagttaaagcacaacttttgaattgtgagaaactgagacaaggtctttaattttaatcccattcagtcattcctcactcatttattaatttagcaaaggcctttttaggggcagctatgtcccagtatagggctgggcattgaagataatggaggaaaacaagattgacaaaagactggccctaatggagtttacagttctcagggagatacagtcaacaccatcataactggtttgggggaacaggggagatgaactggaccattctaaaaggaggcaagaggtgcatctgaaattggaaactggagaaaccaggggagacagacctgttgatctggaaggcatagaacagaaagaaccagagaatagtcagggactgacaatgaggttgtgattgttgacagccggaccaggccaggaaatgaagaaggtaaggagagaagcgtactgtctaacacccctcgaatgcacagttgctagggccagtaaagatcatcgggctactcatctctcaatttaggtaatgtaaatgatgcatcttattgacaatccatatccttaagaaattgtgaaatgagtcttttactttttataactctacaaacatgttagaaagatggatgtcaccgtgtctttatcacagtatggtgatttttcttaaccacccaaaggaagaatcgaggtgcaccagaacacgtgtaccttgttctcttattaaccatatcctttttcttactttacccactataattcacctcagagagtgagattaattatataattaatcctaccttttgtgcacatgcataattaactttatttagttcactttaaacagattttaggttccagatctaaataatagcccctccatttgtcacatcttgacctctttactatttggtacccttccactcagcattgtttgtgggattgtggttcttcttaccttcctccctccattcctgggtgcttttagtggtctcttaaataacaggctctgctcagagatttcttttatctccttaggccttgacctgcatttggtaaaggctgcatttttagcttcggatttactgtctttgacgaacctttttctctattgtatccctccctggtcagctgctctcttcgggccctcaaacatccaccacgtactctacccagatgttttcttctttctttaacatgtccagttgagttgcccatatcatcccctactccccatccacacacccacccagcacacacacacacacacacacgcgcgcacacacacacacacacacacacacacacagtgcattctcgaacatggggtcttttccccttcaggcaccgtatgtaacccaccccgcccctcagctcttaggaaatgtttcctttatcctacagaaacacaaaaagaaaaactgtagggttgtgagtccctctcaacccttcgactacatctatatcataaggttgaaaatgaaatgaaaaaggttgaaatgtacatttctaaggttaagaaaatcctactgatattaagtatttaaaacacagacttccccaaaatttatctttcagcataaatatgcccttcccttttctcccacccttccttcaatctgtagatagcctccataattcatagccagtttgggtaaaggcattattttgagacatttaatgatttttttaggaaaagcgaaaaaatgtagggtcaaagattcaagagtatattgtgttttatatgtaggcgtagcttttaaactattttggatactttaaagttttaaaataacttaccaggcttctttatgaagcattttattctttgaaagttttataaataatatgatttctggtgtcagtatggaaacattcacatagttgtaataactctcatgaaataaggtagactattccatcatctgtgtttactcttaaaacacattagaaaatggttgatatcaaagcttacaattttgtctttcttattgctaccctaaagcagactgctgcacagaccttcccctgctacactaatgctgctttcaatgttggcaaaccatactactcaaagtgcgggcaaaactcgaggtagaaatccaactttcatacagctttatcaaaatgacagtattctatggtacttttcaaatcactatttttttctcttagaggttatcaaatgaaatgaagcatttaaatatgttttctaaattcaggaatgtgagataggagagcttttgacattataggattcagcggtggaagagaaaatgaacatccagttccctttctccctaactcaagatctgtgctccctgaatatcattagtgcttctcatttcatcagtgttcaaatagtgaatcattcattcactgattgttgaaacaactgttataagatttggaaataatatacagaacatcttggaagtactttttttttattagcaagaagcagctatatgccaaaagtattaagaaggatcatctcttcagaataagtgagaagtatatcactggtaattttttagatttttgctgaatgttttagtaaaatttgggaaggtagtttttttttgagttggcaattatatgctgtccctcttgttttctcttccaaaataatcattcttctctctctctctctctctaaaatgggagccacagagccactgtcagaattgtatacatataaacctgagaacattgcctggcctggcacatagtcaatgctcaataaacatttcttgctactgtatctactgtgttctgttccccctctgttcaacaccctgtattttttcctggtggagattttcctgagtacctaaacaaataaacatagccaaacaaaacaagaattcagtgctgatgccgtgtgctttagaagctgggtctgtgcttgacttgactgacggagatgtgatactctgagtgtgtctgcagataaagccaaattcaaaattcaagtgaaacgcccttggacttgggaatgaatcggcgggtggggggggggggctttgaccaaggtactcagtgaccctgtgcttccaagttctccatctgtaacatgagtggtttgctctcagaggtttcttccacctctaaaaattaccatcattttgcaaccttgatgctttaagactttgaagtccctgtggaaaagaacctatgaaaagcggtcactgtttctgttttccccgtgcattttagtggctgcatagagtgttttttggtgtgtgtcttccatcttgctcaggtggagctaatgacctccttctccaggatagacaataaaacaaaccaaaacaaaaacactctgttcatgcacaaaggcaaccctcttccagatgcttaaccccttaaatgagtatttcgatgacacagagggatcatcacttcacttgccactgaaatacagccatctctggagtgaaatttggcagctgggaagtagtcaagctgcagtacttatatgacagtttggggaaaaggagtgagacagaaatagcagattccaaaataatcccattaaaacagcagggaaagtggaattgggcaataagatgggaggatggtttgccccaaagtctgactgtcctgtttagacaatgcggacttcagccccagaagctctaacttgtgtcactgctggaatatagtgaccacagtcaagaatcccctacacacaccccaaaaaggggggcttatctaatgtcccattgatctatcgtcttgtgatttttttttttttctctttttcctgctactctagttatcaggctgtgctggcacataaatggatctgtctttttaaagctacctcttccttttgccccctgcataagatagtgttgtaggtaagcatgttataacatcagaaagtactcagctgagaaggagtgatgttaaagcaccctttgggctggctctggaaggatgaactgactgaccagaaaggaaaactcttctgtttaattccaggatcttgggaataacagtgacagagaaagaagattcgagaagtagatgtggttgagtacaaatgtagaactcttcagattttctggaatggggtagccattgtgataaatattaggatatgagcgtggaagtcgtagtggataaatttgaaagctactcagcaatatgtgcagcaacagtttttaaaaagcaaaaggaagatttgtcaacatagttagaaatcctcagatcctcagataatggaacatcatatctctcaaaaggaagattccagggaataaagaaagcagatgataagggaacctgggcattttagtttaaccagaaaatagaacgttaccaaaaaatttagagattaaagagtcagtttcatttagaagcacataaaatgtttatgtaatgagcagaatttatagagtctactattataaaatagaaccaaaaatgaattcaagaaaaatgtaataaaattaatgtagtgggagaaaatgaaatacaatatcagaaattctagttttgaatctcagttctgcaacttatcagctttgtgaccttagggaaatcactcaaaatctgagggttttttccgcatctctataaaatagaaataattataatatctgtctcacaggggtattgtgatgatcaaatgagataatgcattgaaaatgttttgtaaattgtagagccctctacatatgctatttctataactctgcaatttcttatggcatggagtgagctctcagagacagtaatcacatgtggaaatagcttagagaagcagtcatatcagaggcaaaatctattgtataaaaatttaaaaattcatatgaattattttttctgcttctcatttttctggctcagaaattcttctatgtttacagaatttttccaaaaatattctggtaagccctgtaacagaattgtccactctctgttaagcggtaaaccacatgattttttttccttttttttttttttttttgagacagagtcttgctctgttgcccaagctggagtgcaatggcacgatctcggctcactgcaacctctgcctcccaggttcaagcaatccttttgcctcagcttcccaagtagctgggactacaggtgtgcgccactgcacctggctaatttttgtatttttagtagagatggggtttcactatgttggctaggctggtctcgaactcctggcctcaggtgatccaccctcctcggcctcccaaagggctgggattgcaggcatgagccaccgtgcccggccaaaccacaagattttatagtaaatattgcctgtgagtaaaccttgaataacaacattaaagcagaagactgctatcttgtgtcatttgataatcctaatttagggaggtctgggcagagaaaagcggggtgtgtctgtggtctggggacaagagtaatgtaagtagcatgccacatgatgaagactgaaacggagacagtgaagcacggtaaatctttactgagtgtgggctggtgtgctgaagttccctttatgcatcagcccatctgtctcattagcttctctcttaatcacaggctccatgaagtgtctacttgtctttttttagctttttatgtcaatctcctataaaagcaaaaggaagtcaactggcctttatgctgtttgtgtatactccatgcatgctcggggtggggccagctgtatttataaatgcatgctaacatgggggttactctgtgtgcataagagcttatttgtatgtgcattcatgaatatgtgtacatttgggcagatacacaaagacacaacacatatgtgcctctgctgtatgctctcttacatggaaaagacacattgacattaattagaaaaggtgatatgaaacagtgaaagtaaaattcctttcggcagtatttactattgtaattaaagtgcatgatgtaacattatatgtgcaggagaatttgcttattcatcctttagaacaatagtaggagttacatattaacaggtttaagtgtcaataagtgtctgaatacagattctctattgtgtgcagttcttgtaataaggcagtgtattttccttgtgtctttgcttgcttggaattgaaaatgctttggatgaagaatgttgcagagtgtaatttgtggcagaaaatatgcccccactgtttgtttattattcctgaggacatttgctgggctgaactatcatatgtagaaaagaacagctttgtttggaaaatactgtaagagcagtacaagaaaattgaattaagtaaagagacttagggagtccatctttctctgatgatattccttatttgctcttcattattccctgtgaaggaataaaaacgatgaaattggatttgaagactggattaagacaaatgacttttcagatttttttttttttaccttagctgtttccaattttcctagaaaagcacatagtcactatataaagagtctgagtttattgcattaaatcttcctaaatagtgtgcccttgaggtttgatgtggggaattagtttagaagattcaggggcttggagtacctgctaactgtgtgatggcgtgtgtctctagaaattttatatgcccattgatttttatagagcaagcagtacaatagaagggaagcaggatgctgcttggtcttaaggaagtctttcctgcctaccaattgccacacccctttttctccaggtagagttgactatgttttcttctgggccattgctgtacttgcctaatacttttaataaggacttgcaaatgtgcctgtaggtctcttctaactaggctgtaaaccactcggacagaggaattgttttatttcttgtaactctaacacctaacacaaggccctcaagataacctgtcaaatgaatgaacagatgagctgaatacccgctgtgtgcctgttcttgtcttaagacatgagggacaacctgtaacacaggacacaatgtggctgtgtctgctctgaaatggtagaatatctagctacagcttagaataactgggtaaggaaataaatgctggattataacccaaagaataaaatatccaacgagtccaatgaataaataaataagggaaaaggaatgactcttccctgcagcagaatttcagttaataaacaaacgaggaaggaagcagtatgaaaacatcattagaactcatagtaagaattgccacgagaaagtcccaccgatggatgcattagatgggcagatgtggattagatggattagaatgagcgggcaaaagtatatgcagaaacaggaaattcgtagaattttaaaatatccctaccccaaacatttagtaattacaaggagaaaaataaaagtttacggtgaagaatcctggcagacatcaccttaactgagtgatcaaggttaatgtcaccagtgatacatattgacatcgtgtgtcccactgagaagggcgtgtcatctctgatatcctccctgaaaaggcataatctcactctaatcaagaaaaaaatagcaaactcaaatggaaggacattcgaaaaaataactgacccctccccttaaaattgtcaaggtctttaaggataaggaaggattcaggaactgtcacagattagcagaaactaagaaatatgaccacataaaattctaagtatgatcctgaaacaggaaaaaaaaaaaaaaagcctgtttggtgcaaaaactggtgaaatcctaatacaccctacggtttgttgagtagtcgtgacccaggttaactttctagttttgatcgtggttctatggctttgtaagctgttaatatagggggaaactgggtggaaggtacaagggagctctgtactatttttgccgctttctgtaaatctaaaattatcttcaaaaaaacctagttgacacttaggtaggccgaggtgggcagatcacttgaggtcaggagatcgagaccagactggccaacatggtgaaaccccatctctactgaaaatacaaaaattaggccgggtgcggtggctcatgcctgtaatcccaacactttgggaggccgaggcgggcggatcacctgaggtcgggagttcgagaccaccctgagcaacatggagaaaccccgtttctactaaaaatacaaataaaattagctgggcatggtggcgcatgcctgtaatcccagctactcaagaggctgaggcaggagaagcacttgaaccccggaggcagaggttgcagtgagccgagatcgcgccactgcatgccagcctgggcgacagagcgagactccgtctcaaataaataaataaataaataatacaaaaattagctaggcatggtggtgtgtacctgtaatcccagctacttgggaggctgaggcaagagaattgcttgaacctggaaggcagaggttgcagtgagctgagatccggccactgcactccagcctgggtgacagagtgagactccatcaaaaaacaaaacaaaacaaaaaatctagttcagggcacaataccaatccacaggaagcaattatagagcaatccatgacaacagacaactgagaatttgtaatggggtgccagtgtcaggttcagaagaggaatgagaaatggctggggattggagtcttcaggaagagcttcctatgagaagcaaagcctgacagggaccttaacaggatgtgtagtgatgatgggtggaggaaactgaggggtcattgtaggcacagtggcagcagggacaaaagcatgaggaagggacacagatggcctgcatgggatatgttggaggggccagcggagttatatgtgcattgctggagattggtatgaaagagaatttgacagctgtggggataacagagctaaaggatcactaagacctggcggaggaatgtgaagttaatgcaggaggtgacacagagttcccagttcttgtttatggaaggggctcagtgagtttgtgtgtatatatctgaaaccggtgacaatgtatgtagggtggccagagttgggagaaacaggggacaggcgagtcaggaattaaagataggtaatgggagcctattcgtttgagggtgttgggaggatggcaggaaaggaaaagggggcaacatattcaaaggtatttgaagggataaaataatataacttagtaattgttggatttggagaatggagaggaaggagtcaaagatgatttctgggtcatatttactggacaggtactattggtgtccataactgaaataatccattcagcagatatttgcatgcctacatcgaggaataatgtattctaggtgaggaaggaggattaaaaagaatgtcaacacagcatctgcttacgctggaatgtgggccagaaagcctgtggcttaggctagactgaatgaatggccaggtcagcctacttaaggagtccctgccctccacataaaaagaagggaaagattgccctactctgttcctagcagtagccatgaacagtgttagaagatctttcaaactgacacttctgtcctcttgataaaaatgtcaggtctactgttggaccatactcataaaaactctgttaaatcaccattctacttaggaaaaggccattcatgccccacttaactctgccaagatagaggatgctgtgttcccaaggtaccaaaactgaaagttaaaatgccataaaagtatactgaactttatagaagaaaaaacagaaaaagtgtatgcatgcttaaacctcaaactcttgatcttcaggtaccatgtcttttcaacgtagataatatcacctagtgagcacaccctgaagtcatgctctggctggctttgctgtgttctttttgttttctcttgggcttgtgtctcactctgtgttgggtaggaaagggtttctgtagcctttatacccttgttttcatcacttatttcacgaatttccacttattactcaagaataaccatatttttttatctctatgacaagctgaaaacctccctgtcagcaattatagcctgttagccctcacagagtcagtcttggggaggtatggccttgcggttcaggggcagaaccgtaggtgtattcacctgtggaagacttagacatacacatttgattatgggtggcagtaatcagatttatgttttgaaggtcttcgaagatctccgtccctttctcagtcaacattatacatcattgtttcttaacagttgagtccttataccttttttggtatcagtcggtcattaggccaagtaaacattttattgacaataggcaactgaggagaaaattaaccctttttatagttaattgtaagtggaagttgcttgatattcttaaaaatatgaaattgtggaagttctggttctagtctgagaattgagcattgagcatcacctttacaacatgtagacttaaacttcaaatacctttatgatgctgagaactccccatggaataggaaccggccatggcatatctaaaacatgacttacatagcattgcacgatataatatgaatgcatgtttttttgtagaatttagaaagaggctgaacgtgatggctcacccctgcaatcccagcactttggggggctgaggtggaaggatcacttgaagccacgagtttgagaccagcctggacagcgtagtgagaccctatctctacaaaaaaaatttaaaacttagctgagcatggtggcatgagcctgtagtcctagctacttgggaggcttatgtaggaggatcacttgagtctaggagtttgaggctgcagtgagctgtgatcgcaccactacactccagcctgggtgacagaacaagtctttgtctctttaagttttttttttttaattagctgagtgtaatgttgtgagtctgtagtcctagctgctcaggaggctgaggtgggaggattgcttgagcccaggagttcaaggttacagtgagctatgattgcaccactgcacaccagtctgggtggcaaagtgagaccctgtctctagaaaaataaaataaaagaaaataatgtataaaagaatgacatcttttgtagagcggacattggaaatggcagaatactccatgaagtagcctctagattccctttatgggcttgctgtggaagcacatatgttcacattggcagaataaagactctttttatgtccttttaaactaatgtattgacttcagtattttttttatagggaacatatttcaaaattgtaatggtagtcaatggttctatgtaaaaatactttgtctttccacagacccatatataccagccaggtcaccttcattctcagagtgcctgatgagtagagtgcattcaatacaatagctgtcttgtttttttagcagcagaagtgggagtcacatgctgaactcgggaaccattttgaatttattctcatagcaattgcaaggtaaaggcaggcagaatccttgctgtgtaaccctcaacagagctccataaggattgggaaatcaggccatgctttgtcaaagagagggtgcacacaggcatcaaacaggtcacttctcttaattcttaggccaccacacaggaagcacataattatttaatccctggatctttctagagatgcaacaaagtgatgagggtggacagctccagaaaatcgctgtgcaaggagcaagggtagaaagctagggttttggattagacagactccatttcaaattacatcttaacttagtttttattgtaccctctaacaacttatgaataaaataaggggaatatatagagagttaggcgtggggaatggttacaacttatttctcttcttcactttcatctgtctttcttcagtctcttctcccctcttccattaaaggtaaactgaataaatgaatagtgaatgaatgaagtgagcaagctgttttcaacaaagttcacttggtgccacttccatggatttagttataaaagtgatatgatcctagttatcttaggcagaatacatatttctgtgaccctaatctacgtgggtcctacttgaaacctggaaatgataggaaaaaccttcttgggaaggagaaaaatgaccaataaaaaaattctgaattatacttatagatgaagccctggtgaacccagagccctgttgactcacaaggacactcaaagtaagattagtgattcaacacattcacttcttcagtttcccaaatagattagaaggaataagagggctttcttgggttaaacttactaaccacagtgaaggaaggagaaaacctataaaaacttgaagtattataaaatctcagcggtgtgaggccatttcgtttgaggacaaacaaacctagtggattgtccagggcaggtgaatgtaaaggacatttcctgagatgcaacaaagagatgatggtacaatgggcaaggatgttgcaataacaagcaaccccaactcttcagggtggaacacagtagaagttcctttttgatggtgttacggataacttggggtgttctgcagttggagagggcgtctgtatggtggtgattccctgacccagggtccttgtatcgcaaggctcagacattccctcagtgttgggagaccctaaggatcttctgcacctggcagaagagagaagtggggaagcgagagagtgagcagtctcctgggaggtttgttggtgaaattggcatataccacttccttccatgttcccttgaccagaatttagtcatgtggacatagtcaactgcaggtaaagtggagaattgtcagcctgtatgtcaaggagtacagggaaactgttttttcaacaactaaccagtttctgccacaactggataccttcctgacgtcatctttactcccatcccagccccacccgagatttggccatgagtaccctgtaatttgcagggcattatatctctgtctcaggaacagcaggagaccactgagtcaatcggaactgttttttttttttttttttctgagacggagtctcactctgtcgcccaggctggagtgcagtggtgtgagcttggctcactacagcctccacctcctgggttcaagcgattctcctgtcttagcctccccagtagctaggattacaaggctcacaccaccatgcccagctaaattttttattttttatttttagcagagacgaggtttcaccatgttggtcaggctggtctcgaactcctgacctcaggtgatccgcccaccttggcctcccaaagtgctgggattacaggcgtgagccaccaccacgccaggccaggactcttcatcttttaaaccacccgggtctgaactgacagtcccttatgttatcttcatgggaagaagagcaggcagtcatgtgtggctccccatgaaaaggcaaggaaccttctagatactgccgctagaaaccaggtgtgggatagaagccctgcctttgatctatacctgttggtcaggaacctgcttctactttacttcattcatctgcacttcttaggagctgggtcctgttcttgtttaccattactaaattacggggaaattcctgaaattatccagtcctcccagatggttcattctttgtgtgtatacccagagcttggtcatgtccccattcctctctctcaagattagatctgctgtcaaaacctagaaacaagtctttactgaactgaactctttattagcctttgattgccagataactggacttgggaaggggagtttgggaaaaagggttaactatattaaatttttttggtgctctcttatatgggctgggatgaagcatttagacagtgggagaagtataggagaggcagacagatgccagaaaaaaaaaactttggttgtttccaggtaccgaaaaagaaagttcatttgtaagtcacccacctcctcatgatttcttcacctcctgtcccctgctcatggtactagagtttgtctatattataagctctatagctctttttgccttcctgcaaaactaagcactatttataacactgtttctctgagaaaatgtgtttggagtttcaaataaatgacttacaaatgaactttctgtatacaactcattcatacattgagaactgcctgtaccgggcatgtaacctggagataacttttatctctgctttatcaatatgggcttgtcaggttgacttatgtgtacttctctctgccttcgttttgatgatagcctctctcttaaaatttaatactctctttatgtttggagaaacattccctttggcagcgtttcaaatattcttgcgaattggaatagtgattttattttatctcccaatgtatctttaataggattcatggctatgaaaatcttttgcacagtccgcctataaattgtagaaaaattgagaactatttaaaagaagggggcgcagaaataatccttttctagtattactctgggttgtcagatatctttgcaatataattactgtgttggtttttaaaggttaaaagagctctgacgtttataattctcttttgtgtgtgtgttctacacatataaggggaaaatctaacacatggaaggaaaatactttagttaacataaaggtcctgagcattttatggtttttcaatacagagacataattcatggattttatatttgcttttacagatatctggtgaatcagttatttgctctgtggaaccaatttgcagtttacacaccttgtttatttctaagctgtgtgcatgggtaatgtgtgcacaaaaatactcttgctgacattagattgtaaagtaaaaaggcggaacactggtcctggagatatgccttctcagggaacttactatccatatacaagtaaaaatttctcattgttagcagagcagctgacagaatatgatcacaaatgttgctgatgctgttctgttaggaggtagaaatagaatgcctaggactatgcaagcttgtcagagttagattgtcagggtgatgtgcttccatattaaaaagaatactttgttcccccctcacacatgcacccttgcagtggaaagaaacatttatttcagaataagcgcaagttattctgacttgcactcacaggctcagactttgatgccagtgtagttaaaatttagtgaataccagtcatgtttaatggtctttcccttctgtttaaaacagtactgcagcccatgcaagaaacatttccctttaattttatgcattttgtggtatcttttgatggtttttctctactgtcaaaactgtgagaataatttcaatggcatgttttttctgccatcttcagttggcagtcatatccccccagattgtcctcatagattccagatcacctttatgtttaatcttcattaattgacaagtacctttgaaagggttttgcaaaaattgaactgcaaagctgtgatttaatacaaggaaggctacatcagtgtgaaagaaagcactttatgaactgtagagtactatttaaaggtgaggcattataattaaatatgctcaggttgttactgagcattgaatgccaaagcatatgaaagacaacttacgatgccaggagtttgagactagcctaggcaacacagtgaggacccacctctacaaaatgtttttgttgttgttgttgttgttgttgtttttgagacggagtctcactctgttgcccaggctggagtgcagtggtgtgatctcggctcactgcaacctttgcctcccagattcaagcgattctcctgcctcagcctcccgagtagctgagattacaggaacccaccaccatgcccggctaatttttttttgtatttttagtagagacggggtttcacagtgttcgccaggatggtcttgatctcctgacctcgtgatccgcccgccgtggcctcccaaagtgctgggattacagtcgtgagccaccgcgcccagcctgtttgtttgtttgtttgtttgttttttaattggccaggcatggtgagatgtgcttatagtccagctactctggaggctgaggcgggaggatcgcttgagcccaggagtttgagattacagcaatgttatgagagtagctagaagttacaccaatgctgcaggagtttgggggaatccagagttgtaaaatgccaacaaaaattattaattaaggggatctcttagccgtctctttgaccctacaaaaaacatggtggtactgagttttttagcctcacccaagcaaaaacagaatagggcattgtatttcttatatctggatgcaaaaacatgaaatgttaattgtagattataagtcattaagtgtcacggatttatgttttatgacaagttggagtttacagatttctaggctatttttttcacatagagatacatgaaagctttattcttgttattcaacgtaaatcttttataatctgctctcaatttccagtatcctgaaaaatcctttttctctcttttttgagacccttccctccccctaccatccagagtcatgcagttaacagttctgatagtgcttggattcatttgtagattgtacataccaaatggagctggcacctcttcatggaaattggacccagtgggctattttacacttgccggatgtgctttcctcagtagaagtttatattttatagctgatactccattgaccatagtaacctgttataaaacatgatgttttatcatttgttctgtgtcttcagggctgaacattttatggagagactttattaacatttaaagagactttattaaccctagatattaacatggtttacctggaaattttttgagcaatgttttcatttgattcctggaatgttcaaatagcaaaggcagtttctgttggtgtgcatgtgtgtgtttgtggttaaaagccagcattacccagagaccttctggttcatgtggaaattattattattactatgattattgttatttttgcaaatgaataaattgtcattctgatttttttaacctcaacgttcctttaaaaacactgttgatttttatggagaaggttgatttcctggaagtaataatatgatgttagagattactttttaggcaatattttggcatgtttatcagataaatcaaacatcaaataaatagattatggggaatgatttttcagtaatctctttttgcagtttcttccctaaacaaaatgatgtggcctattaggtggattggtttggaggacaattgcttacagggaccctgtccttatggtgtggagaagcagaaaaaactcacagtactccagagtagcccccttattctttttcataaacttcaaactaggtatgaaagacctgtccactttaaagctttcgcctgtgaagataaagcagagattgatttttaaccactatgctcatatggggaaacagaatgcaggagctaagatttaaagaagcagatgggaagaagagaaataacctcctctggcatccacctggaaatgtctcctgagaaagaggatggacatcttctgatattcataagtcaaggaactgcttgaattctgtattccgtgtacagtattctacctatcaagaccctcacccagggaagaaagtcttgtttattcaggagatggggagcaggaggcattgaggactgcatagcttatttaaattaaaaaaaaaagtgcaatgaattgctttttagtgtatttacagagctgtgcagctatcaccacaataaattttagaacattttcatcacccctaaaggaaatcccatacccatcagcaatcacttcccattttcccccaatcctctaccctcagctcctggcaaccacgaagctgtttctctatatatagatttgcttgttctagacattccatataaatagaatcatgcaatatgcggacttctgtgactgacttctttcacttagcataatgctttcaaggatcatccacatttcagcatacatcagtcattcatttcttgttatgatggaataatgtaacattgtatggctataccttattttgtttattcatttatcagttgatggacatttgggttgtctccactctttcactattatgaacagtgctgctatgaacattcctttccaagtttttgtgtagacatagtttcatttctctgtgcagcctacttttaggtagttacaaattaagattgtaagtgatttttttttcattttacacatttgttcgcttcacgatggcctcctctctcttcttacctatctcactctcccaaaaatgatttttcttgagaacatagttgtagaagggtaagaatatcaaccaacttttgctaagtatgaatgcccaggcgctctgctaagcatcatgtatgtgttacaatgtttctcactttatagacgggggctgaggtttagagaggctgctaagcctggaggtcattcagctgaaaaggtagaagagctgggatttggacccacatcctgtttactcagcaaggtccatgctgtctgttgactccctcatgatatgatcccagatcatacacctgttgaaatcttagagaattctctttctattcgtgagcttctcccaattgtatcctaaaaagtaaggaatataaatcagatgctccgtcctaagcccttggacctggagcgggcatttgtgttccccgttgacaaaaagatgatgaaatacttcctctgtgtctgagtgcagcggcgtcatggaccggtgttaagtttaacctgacccttctctctgccctgcagttgcttcatctcctcaccttaagacttcacctttccttcatttcagcttcccagagatactgccacaccccggacctgtgtatcaacttgaaccctcacaccccccaacttggacctttctaaatcttaaaatctcagactctgtagttctctctgggcatagcctcctgacccccttgctttccctctcttcctcagaactcagttgtctccttattgtgagccctgactcatcccccactcttggtcactatagccactttcttcaggctccgtattcctgccccctaaccagcctagacctcatggcttgaaagtttaactgtgcatgcccaatagcttagtgccatgcattcctttccaggcaccaatcctgcatgatccccatcacctgcacagctgcttagaggcccccaaacccaactgatgggtcctgatgtaaattcttactgttaatctgaggagagtcatcattgcttttctagtgggctcatagtcacatttcttatgggatctattccaaacttttccagtctcttcaaaacttaccctcaccctcactttggtagaggaccatttattcatcttgcttttttaaaatcttgaagaatccaggcatgaatccttctactctctttttccctttaattctgtccgttgctcctgtctcacagttgcagacaagtgttgcatgctgtgctcacgcatcccagaggagcaagaagacctcccactccgcaaggctccaagacccctcgttttctggatccctctctaccctgacttctctgaggctttgtcacctaggttatctccctctcctgcttgatctttcattatcttcatcttaaccaaaaccttctcttcagtctatgaatgtgcctagtggtgtggcctgtcttttaaaaactaaaggagcccttattttgaccttgttctcctcaggcaatttccatttctctattctttctttaacctcaacatgttttgaaaacatagtctgtgttctattcatccagattattaccacccactgaagtcttagtcaccagttcttctctgtcatccaagcactggaaacttctcggcccaatgtcttcactggcctaagatggactcaaactagtaagcttttattcagtggttactcctagacctctgggctgtatttcctacggtggctgctgccagccatttcatttcttttcttttctttttcttttgtttcttttcttttctttttcctttcctttcctttcctttcctctcctctcctctcctctcctctcctctccttttctttcttttcttttcttctccttccccttccccattccccttctttcttctttcttcttcttctttttttttttttttgagacaagatctagctctgttgcccaggctggagtacagtggggtgatcttggctcactgcaacctctgcctcccgggctcaagtgatcttcccatctcagcctcccaaatagctgggactacaggtgcaggccaccacacctggctaatttttgtattttttgtagaggcagggttttgctgtgttgcccaggctggtctccaactctgagctcaagcaatccgcctgcctcggcctcccaaagtgctgggattacaggtgtgagccactgcatcagcctatttgtttctgaaaacactctttatctgcctttattttctcttaccctctactgctctgatcatttcttctttatgtcttccttcttttgtcccttttcgtacttattcttaaaagtagattctgcctaagtgtgtataaccacttttcttccttgtttacatcttccaggtcctgagggagtgttgtgacttggttacagcctaccttcctaaccttactcattgcagcccaggcttccccataattatatacatgttcctctcacacctcaagctcccttggttttctgcttctgttgcatctctggtttctttcacctaggatcatcctcctgcctcccctctctgcatttctatatattcttttccaggaccacatcaaattctgtgttctccttatgacataatctcaaatgaccccaggaagttatcttttttttggtccacatttttaatgggacctttcttacttttacttggttttcaaattatttgttgaaacacatttcttttaaactatgtactcatgagacagtatattgagaatttaacccctgtccttaaacacagtaaatattgtgtcaatgtttgctaaatgaaaggagtgaaaagtatggctctatgggaacttgttggtgaatgtcccatttttatttaccaatgaagaaaagcaaaacttagcaaaatgtatctgtggagaggtgggtgggagagggttgttgtatagtctgaaccaaaataattaactcctgtaattgcaaaaatattatcattgctcagtgcaccattttgcagttaatcagatagttttagggaaatattaaatgattctcaagcttggaaaatagcaatgagtgttatggcatcactatacagcccagaatgaactcatggatcctccaatctcttgtatcagatatactgcatactggatacccaaggcatcagggattcagagaaatttttccgaaggtcatctgggtaggaagcctgacttttatagaatatttcataaaattctttttattttatttttcaatagtttctctacattgtatacaaagcacactaattactcactcccattgtctccactaattacatcactcccattttgttctcctatgaacaaagaagaaaggaacaagaggttgttttttcattttgaagaggcaaggttgatatgtttgactaaaataaagttgggattacctgtgaatttcagccagctttgccctccggtccatcaggtggacagtggaaaattgactgtgatgctaaaaatggtcataattgggggaaagtaagctttaccacctcttttgtgatgctgaatgtgtcttcaagggaatcaaaaaagttgtgcttgacaggcaaggtgaaaaacccagggatttgctacaagaatctctgcaggagtggtagaatgagaagcttcattggagtctgggacattttagtgttgctggcccattaccctgaacactcttctaacctcctccaagacgggtgtctgagaggagctgggccctgcagaccaattctagtcttctctctccacccctgccccctttagaacaagcatattaaaggaatgtctgatgagctcactatagtctttgtcaggacattttattttttatttttttatttttatttttgaggtggagtttcgctcttgctatccaaactggagtgcaatggtgtgatctcggtgcactgcaacctccgcctccccgtttaaacgattctcctgcctcagcctcccgagtagctgggattacaagcacctgccaccatgcccagcaaatttttgtatttttagtagagacggggtttcaccatgttggccaggctggtctccagctcctgtcaggacatttttacagctgttttcgttctaaccctaactgatgaccattggaagacctaaaaattcagctacgcagaataagtaaaattggtctttttctttgcatcctgaggataaatctaaacaaacccctctcgttggcatatctccagctacaacagagggcaaatttgaatggattatgaagattgaattatccacttggtcttggaggtggtcccgtctcctgtgatggtggggtggggaggcggtgcagacatgtgtacaggaagcttagccaaatgcctctatttgggaaaagttgaaatcagtttcctgggcagtcaattttgagggtttaaaaaactttattttttttttattaaacatactaaaaataacaaagctatccaaaattagaccacgtactttgctccttttatatttcagtgtccttggtatgcttggtttcttttctttctttttgaagcattaatattgttttgaattgctagatatacagaaggtacgatagatgtacaaggaaaaataagcatctctcttatttctgtgtctaagtcacttgaattctcacctagaagcaagtaccattatcattttcttgtgagtccttttaaggatattttatgattatataagcaaaaatataggttttttaaaacaatgtttacaccccatacactattctgccctttacctcttttcacctaacagtgtgtcctggaaaacctttcttatcggaacatagaacagccttattcttttttagtatctaaatagtattcgattgtatgattttgccataaagtattcagtcccacattgatggactttttttttttttttggttgtttccagtcacttgctactatgaacaatgcttcagtgaacaactctctataaatagcatgttgtatgtcagcaaggatctctggaggagaaattactaaaggggaattgttggatcaaaaggaatatgcagttttaattttggtaaaccttgccaaattgccctccaatttggcattcgtcctattgtatgttcctgctagcactgtttgagtgtgcttttctccacagacgatgtttttaaacttcacgatctttgccaatctgagaggtgaaaactactatattctagtagctttaatatgggtttctgttattatagtggtggttgaatatactttcatatgtttaaaagccgttcctattttcttttctgggaaatgtatattcatcctcgttgcccatttttctactacgtttttggtttatcctgtgaattgacttttttttttaggagcatgtaacagctaaaaagattagtccttttgtcttatgctattttagtttaaatttttccgtttgtcttttgactttatgttttcttcatgcagggttttaaaaaattaaagtcatcttatttatcagatttttattttttggcttttaatttttttacatacttaggtctcttctacgcagtaattataatttttaaattgtctcgtattttttattagtattttaaaaataatagttttggccaggcacaatggttcatgcctgtaatcccagcactttgggaggccaaggcgagagcatcacttgaggccaggagttagagaccagtctggacaacacagggagaccctgtttttacataataataataataaatagccaaacatggtggcgcacgcctgtttgtactcgggaggctgaggtggaaggattgtttgagcccaggagtttgagactgcagtgagttatggtcgtgctactacactccagcctgggtgacagagtgagaccctgtctctaaaagaaaataaaaattaaaaaggttttattgagatatgattcatatatcgtaaaacttaccttttttttttcttttttttttttttttttgacacaggatctcgctctgtcacccaggctggagtgcagtggtgcagtcacagcttactgcaacctggaactcctgggctcaagcagcctcctgccttagccttctaaagtgctaggattacaggtgtgagccactgtgcccagccacaatgcagtcttttaataaatgggtttttaatctattcatagaattatacaatcatcatcaaaacctaattttacattttcattactccaaaaagaaaacctttacccattaagcacccactcccccatttcctctaccttctggcccctggtatccacttaatctatgttttatctctatggatttgcctgtcctagacatctcatataaatggaaccatataatgtgtggccttacacaactgacttttccacttagcgtaatgttttcaaggttctttctcatatttttatgctttcattttttacgttcaaatctttggtcaccttgggatttattttagtgcaggatgtgaattagggatctatatttttttaggtggccgtccaattattggaagtccttcctcccactaaagtgcagtgacacccatatcattcactgaagtccagtattcatttggatcgacctcttttctgttgaccttgctaagtattcctgtgcccatgcacactgttttactttctaaggctttataatatttttaatatcggtatggtattcttttcttatttctttttatatcattgttatggccattctttcctgtttatttttccataggaacttcagaattagctttctaatttgtatttttgacatcatataagtttatagataaatatagaaagaattattctcttgatattgactttctattcaagaagaagatagacctttgcagttgttcctatctcctcctctgtccctcagtagtatttaacattcttctttatgtagatttgttttttttttttttttttttgaaatggggtttcactctgtttcccaggctaaagtgcagtggcacaatcttggctcactgaaacctctggctcccaggttcaagcgattcttgtgccttagcctccccagtaactgggactacaggtgtctgccaccacacctggctaatttttttgtatttttagtagagacggcgttttaccatgtttggttaggctggtctcgaactcctgacctcaagtgatctgcccacctcgccctcccaaagtgctggaataataggcctgagccactgcacccagccctctttatgtagatcttgcatatagtcctccttcagtttatccctaggcattttatatttttgttgttatttaaatatgggatacctttttactggttgtcctttagaaaggttattgatttttgtatattcttttgtttcagttaccctacagaattctctaattaataagttgttcaattgacttgctcagatcatagcatttataaataataatttttctgcctgttataatttttatatcccttatttatttctcttatgcagttaaattggctaagtttaacagatcagtgttaaataacagagatgatggtagacatcctcatgttgttcctatttttaatgggatgcttctcatgttcccccattaacagtgagcctgcctttggggtggagcctgtttattgtccatttggcgtttgtagggcttttataatgagtagaaaacgttttggaaatgctgaatctgacggaattatttgcagaaaggtaaagtatgctgtgttagttctcccgcagtgataaaatagtagtctgatttttcttaccagcattgacaggagtttatgagtgggaagtctgtgctataaaggaagaaggcagcaattgtattttaatctcatgctatttttcttttgccaacgaagtaaaaagactaagaagctataggaatatgtagtaaaggcttttgctaagagagaaaaggaagaaaggtggaagaatgggatggaagaaacgagataaaagtatacctcattttcctcagcgtccccccagatcaagtcacctgataaaccaaatattactagggtagtttttttccccaaaatattattaccaaaaaatgacacaaaacactaattgtcaaccaaaatgataaagagtctccgaaaaggcttgcaagaaaatagtgaaatattttatcatttgtaagcaaaagataataatacagagttccaaatactgagaaaccacaagaggaaaaagaatgcctattgaaacatgtttatatgttgattctttttgatggtgccattaaagaaaaaagaatgttttgatctcttgcaaagaaagccaaactagagaggtattttatgagctaaccccaaacctgacattactctagtaataaataccaggacaggctgtcccttgcattagcagaactggaaaacaaaacaaaagacagtaacaattgaggctttgatgcttgttggaaacatctaacatacagagttagtgtgttgtggtcataaacaaaaggagtttaggctgactccataaattagggaaactgatgcgtcctgttgcttgggacacactacacaattatctgcatgacaggcaggaaagaaagcactggaaggcaaacagactgcagaacaatgtggccacccagttggttttagacacacacacccctggcctgcagaggtgtctatttgacagccggtctcatgtcaaaactttcttttatgtgattttccgattgtaggaaccactgggctctgggtgggtgtcttaggcgagtctgccttagtgttgagtttgacatatggtagcattgttaggtggtgtgtttaggagaagccaaccagggcctcagagccaaaagcatggagctcactggctgtgtgaacttgaccaagctactgaacttttctgagcctagtttgtcatctgcaagtaatgcctacagttcacggcttttgtatgtacttatgagatgttgtacatctagcacctcacatggggcttgtagagagcagttgctcaggcagtgtttgtaagtggagcacaggaagcaagggatggaaagagtatcacatcaggaccaaggatgaaggagtgtttgtaggaaagacctccgagatgatggttgagatggattatgtacaataaacaggaagcatgttcttgggaagtgcttctaagcatagaagggcagcattttcaaaggcatgggtgtggaggaatctttgaaacccagggaactgtagtagagcatggctcagtcccagggtatgagatggggagtttcactcattgagacaggacagatgagccagcgtgggattgagtggggactcgtgtatcctgttcagactatagtcacgatgatggagagtcgttaaaggctgtagacatggccaggcatagtggctcatgcttgtaatctcagcactttgggaggctgaggcgggtgcatcacctgaggtcaggagttcgagaccagcctagccaacatggtgaaaccctatctctactaaaaatacaaaaaaattagccgggcgtggtggcatgtgcctgtaatcccagcactttgggacgctgaggtgggtgcatcacctgaggtcaggagttcgagactagcctggccaacatggtgaaaccccatctctactaaaaatacaaaaaaattagccgggcgtggtggcgggcgcctgtaatctcagctactcaggaggctgaggcaggagaattgcttgaatctgggagctggaggttgcagtgagccaagaccgcaccattgcactccagcctgggcgacaagaaccaaactccatctcaaaaaataaaaaagctgtagacatgagggacagcatttcatttgcattttggaaatgtgacagtaatgtctctcgggtgggtttagagattggggaggaaatgagctctggcccagggtaatgatttcttccatattttccacaaatcttagcacagggctaaacgcatagtagatttttagggaaaacctcttgatggccttgaacaaaagttattgttttgccaggatcatcttttccatgaatcacttgttataccattagtagattattcttgtgtggagttgatcattttagcccccaaattatttttgtccctcgattacatcatcttaaacgattgtgtgttgtggcatagacatatcctaatctacttacaatttatggtgcaagtatctgtgtcataaaagatatcttcttctttaaaatatgctagcctagcactccatgaaaatggagactcacagtgctgccctgtccttcaaagatgtttatgtacaaagggataactgttcccacccctaaatgctttaggctttgcctatactgcctttcaaagctttccctattttaagattttttgaggccccttggatctctggaaggagaaagctataatagcttttggtttctgattgtctttaagcagagaaaactcacagtctcatttaggggcgtgacacattcctagtagggatggtcagtcccaggcaatagctgtggccatgggctgttgagggccatggtgagggcccatgcggtaacagacagtggtatgcatgctggactggggtgagtaaatagccattattcagaaccacggattctattttcaatcagtctgtcaactgatatttttgagagtctgccatgtaccaagcagagtgctaagttctgaagatactaaggtagacaagataaaaatggcccctacccacatggcactacattatagttattataggagagtggatagaacatatctagtcaattaccgtgcactgagaaaggtactgtgagacggaaatacaaagtatggtggaagcatcctggagtgacaactgaccctcacttggaaggccatgcaggacttccatgagggtcaagagtttcctgaacccggacaggagcaagatctaccttagagaggtttggggtgaaataacgccatgaaagggatagtctttaatctagaaggaaaaatggagtattacacatttgtaataagtgttcgagatagcctttgagtcatacagtatttggaatgtatgcttggctgtcagtgatcttataagacccaaaccacagttttctttatgctgtgtcctggcgctgccaatggccagctggaagggccatggcagggtagccacgtagagaggccacctcctagaggcgcatagcctgaacgaaagcggaatttgaacaacacctccgaaaagattggaaagtcatggtatctgtgcgattgcccacaaggaggtctcctgaagtcgaagccctttggttctctggcgttttaatgatttgctattctgtcatcggaaatacgtggagcagccacatccttagacagaagaggcccagccacgttgctctggagtagaatttagtatgagtgtgagtggaagttaaacagatgtggaagcgcagagtgcagctgaacatcattgacatggaccagcaggtaaacagacttcaaggtgatacacccccgtaaggcaatgttctggccagctccgccagtcaaggctgtacagcggatagtaattatttctgtcacagcgaagatagatgctggatgtgggcagatgggggtagacttgtgaaaagtgtgagtatctttgagtatcttttataaatttagtgagtggagtggcaacccacctacacttctaatttttgctgttggaagctatgtccagaaaagagaagagaaatttctctacctgataaattacaccttattcaaaacacactgtgtgaatgaaggtgctgcttcgtcttctctctgctaacgtaacgttgtgcacaatattttttcttttgaagcagcagaaggacattttaatagaaaaatacctttactcctgttaaaggagtatcttggagttcttcacctgtctttatgggggacactccccactacatggcttcataaggatttagggatgacttgctcattagacatagagtgagctggttagaaagacaagtgtgagttggggtacagtggcatagaatgtttaaaatattgagcaatttaggatccttattctggactttaattgtttctagagccagcctctccacgtgtgagtagcatctttgagtggcaagaaaaccattctgggttgtcattgagagcatgtgtccttggagagtgccttagcagtacctcctgtgtcctcccacgacacatatccacctatgcacacgtccaccatcctatacgcacacaggtgcatcttgcagtttcacagcccgagcacagccagagagaaatgactaacatagacttgatttttcgatttaaagacgctcctctttttgctcttcctcttgaatatgacttttcttttccttattttcagtgttttcaagggaaatgtcaaattttcagacccgtaacttctgctagaatcacagaccattagggactgtagagatctaacatgcccagctggaagcgccacagcaggatagctgtgtagagacgtgcagcaggcattcagaaaaacagatctgcatcttggaaagagaggtcagggctcgacttgtggatttcagagtcactcacttagaagcagtagacatagtacacatctaatgaaagcattcccctgctcggaaatcttcagaagtccctcagattttacagaatcaactcaaattactcagcaagacctttgacaccctccaccatgtaacctcttctttcctcctctcccacttctgtctccccacacacatacacctccaaccgcaatggtctcttgaacatattagcacacgtttcttcccactttttctcaagctgttttatttctttagcattagctcagattccacttccttctggaatctttctttcatgaattcagatcgtgaaagaccaaagggaatgttggggcctgtcatgaattagaaaatatattctctgttttcaccaatcacaagtcttgtatgacttgcctagaatagcttcctttatgtgttctaagggatatgggagcccgtctagactggcctccttcacagcgctgggatccgttctgcaaacccatcacagaaatacatgtggcttcttcctgcagtaaaatatgtaggaacttatccaagatttttctttttattcttcatttatgttattttatctccagtgttatgtctccaaggatgttaggttgaattatcccctctgaaaagccatactagtttttgaattaggatgcagtgattctaacttcaggtccactgtcaactcattagtttatttaggcaagttgcataacctctgccttaatttatcatctgtaaaatggggctaggagtaactcatgatttttataaggaaaaataagacctgaagttaaaacattttggaaaatgttttcaaatatggaatacaaacatgaggtgatattattgctaccatattgcttatagtcaagaaaaaaacttaatcctttttgataatctaatacagactgtgtcatactatatgttgcaaaaaatgtatagaacttgacattcgaagagatgagtattttggctctgtggtttattagctgtgtgtccatggctgacttacctaacctttttgagcttcagtttcttttctataaattgggaataattatgttactatttattagggttgttaagtaattatattctgcaactattatgcatgaaaggcacttttaaaactacagaagagcatagtcaacagtaaccatcatggtctcacttatggcctaataattatgcctactgtagaaatagatcaaaatgtatttggattcccttttctaggataccctctcagattgtcccaaatatacaagggatgaaagaagaaggaacaagtgtgggctgaatatgcagaagaggatggaaagttgacaggagcatgtggttggaagaggccatgttgacatgcagattgtgtgatagccacattgccagagctgagagggtgcaggagggaaggcaagagggaagccttggtatccatgtaaaaccagtgaccacttgctagggtgtgtccataagcattgcatgcctattctttttttttttttttttttgtattttatttatttattttactttaagttctggggtacatatgtagaacatgcaggtctgttgcataggtatacatgtgttctggtggtttgctgcacctattaacctgtcatctaggttccctcccctccccaccccagtccccaacagaccccggtgtgtgttgttccccttcctgtgtccatgtgttctcatttttcaactcccacttatgagtgagaatggcatgcctattcctttttttttttttttttttttgagacagagtttcgctcttgttgcccaggctggagtgcaatggtgcgatctcggctcaccacaatctttgctcctgagttcaagttattctactgcctgagcctcctgagtagctgggattacgggcatgcacctccatgccctgctaattttgcatttttagtagagacggggtttcaccatgttggtcaggctggtctcgaactcccagcctcaggtgatccgcccatctctgcctcccaaagtgctgggattacaggcgtaagccgctgcacctggccagcatgcctattcttgaatgtgccctttaagcagtagtggacaacctggggcatcggtggtatcctctgtgggacaacagacacctatatgggagctggttccgcttccctcacttatggctttttacagccatgtgccgcataacgacatttgggtcaacagtgggtcacatatatcatgatagtcccataagattataatgaagctgaagaatttttatcgcctagtaatgttgtagccattgtaatgtcctagtgcaactcattactcatatgtttgctgtgatgctgcaaccctactgtgctgccagtcatgtaagagtagagcacatgcaattcggtacagcacataatgcttgataatggtaataaacaactgttattggtttatgcacttactatactatacttttgatcattgttttagactgtatttcttctacttatttaaaaaaaaaaaagttaactgcaaaccaacttcaggcaggtccttccatagatgtgtaagaagaaggcactgttgtcataggagatgacaggtccatgtgtgttattgccctgaagacctctcagtgggacaagatgtggaggtagaggtgatatgaatgatcctgaccctgtataggcctagactaatgcgtgtttgtttcttagtattttattttgtttgctatttatgtatttatttatttattgagacagccttactttgtcgcccaggctggagtgcagtggtgcaatctctgctcactgcaacctctgcctcctgggttcaagccattctcctgcctcagcctcctgagtagctgggattacaggcatgcaccaccacgccggctaatttttgtatttttagcagagacggagttttactctgttggtcaggctggtctcaaactcctggcctcaagcaatccacccgcctcggcctcccaaagtgctgggattacaggtgtgcaccactgctcctgccttagtattgttttaaaaaaaaaagtttaaaattttttaaaaatgaaaatagaaaaatgtttattgaataaagatataaaagaagaaaatattttcgtacaactttaaagtggatgatgttttaagctaagtattattacaagagtcgaaaagttttaaataatgtgtttataaagtaaaaaagttacagtaagctaagtttaatttattattgaagaaagaaatttcaaaaataaatttggtgcagcctaagtgtatacagtgtttataaagtctgcagtagtgtacagtaatgtcctaggccttcacattcgctcaccacccactcactgactcacccagagcaacttccaatcctgcaagctccattcatgggaagtgccctatacaggtgtaccatattttatcttttctgcttcattttgactgtatcttttctatatttaggtatgtttgaatgcacaaatacttaccattgtaatacatttgcctgcagtattcagtacagtatcatgcagtgtaggtttgtagccgggaagcaatacattgtaccatgtagcctagatgtgtagtaggctgtcccatctaggtttgtgtgagtagactctacgatgttcacacaacagaatcacgtgaagatgcatttctcagagcatagcccaccgctacccaacacatgcctgtaggtgaggatgaggaggtatctgtgttaaactgtgtcccccaccaaaatgttgacaggctaaacctcccagtgtccatgaacaatggctttatttggaaggagattttgcatatgaccaagttcagatgaggttattagagtgggctctaatctgatatgactcatctccttgtaaaaaggggaaacttgggctcagagatagcctccctctgaggctattaccgtgtaaagactggagttatgctgcccaaagccaagaaacaccaaagatatccggaaagccaccagaagctgggagaggggcatggaacagattctcctttgcacctcctggaaggaaccagccctgcagacaccttgatctcggatttctagcctccaggactgtaagacaatgcatttctattgttgaagccccccagtctgtggtactgtgttattgcaaccccaggaaactaacacaggcaggtagaccatccacacacaccaccgcttctctctgacgcctggtgcacagcttgggtcttgtggtgagactccacatggtaggcatttgctggcggtggatgttaaaaatgacaagatttcctctggtttgacttttgaaagcaggtgcattgaaagccaaatctcagggtttggggttggtttagaatgggatttctgaaacattctaattgtctcattgccatcacctccccaaatactgtatctttatgtgcatttggaaggaaaaggagtgcaattgaacagtatatttccgtctgttaggcaaaaccttttatttgcttcttatttttccaggcttggacactttcgtgagaatatttgcagttctgttgtaagtccacttcggtcagggatttggcaagtccacaacaaagagagggaatgtttcttttcccttttcccactttccttgggcttgcctgttctttctctgaaagatgctagaacttccccaaggggagggcctgcctttttcctccttgggaaatgttgatttatattatatgaaacatttgtttttcatagaaacttccatttcagcatgttgaaatagttggttctaatttttatgtgaaaaataaataaacttgtcgtggcaatactctcagggtacagttacataataactatgtatgcctccccaccactcattaacataggagatctcacctcacggaagtcatctcatagtctaagctttatggcttctaacagcttttacgaaactccatgaaaataccttaaacataactgttacaagttgaaagtcaaccctttttataagtatgtcagaagtaattatatcttgtagtagcaatttcatatctctacttatagttgggacaattaaggctcagaaaaatggcaaagctgagattaaaattcaggattttctgatttctagccaatgtcatgctcattttctgtgttaattttatggctcagggtccagttaaaaacgtctgaagggagtggtaagtacaagagagatgggagttgggggtggggcttgaaggagagcacacctggccccaggtgacaagactgggctccagccctgcctcatcacagttggacatgatggccctgggtcatttgacttttgaggacctcaggaaaatgagggagcttaaaaaattctatggttcctaatgaaatacttagggatgaaattacagttctgggatttgcttgaagacacaatcagccatggtttgtcactgttgatgctgagtaatggatatttggtgttctattgtgagtctttggtacatgtttggaattttccatgaaaaaaccttctgcttctaaaatgcacaccttgattcttcccatcgccctcctactggctggtcctgtgcagctcactcatttctcaggaacagcagcagactcactactctgaaggaaagaaagccctttgctttggtctgttcctaatgtacatattattagagacttttccgacaccctccccattttttatttcttaacagctaatacgatagctgtgctttcataataaattcaaaagctgctctctatttctcaccagtttgaattgtagaaaagagtacaaaagattagagtactttaaaataaatctcagctaattatacatacaactgcattcactaaatgtgaatattttcaggctttctttgctaccaagtgccacctgctcatgatttaaatgggcacaaatttagttccattaaacaaaatgcagcaactcttctcctatagcgcaaactcctttaggtcctattttgaaactgagaagctaattccagtgttctcttgttagctctcggtccatgtcaaccaccccacaaggttgtttacttgaatagtttgcagccttgctttaaaagttctagtaggcaaataggtttgttgatgatgaagtggtttgtgttttataagagtccttatggtctagatggcatttgaacttgtggttccagtgattaccaggaccctgaattgaagaatacatgctgtggccttttcagctcaggaaactttttactttctattgccaaaaaaaaaaaagacaagaaatccttcctcaaaatgttatgtgttcttagcccatacaactgtctccccagaagtcactggactcaaacctccactttgctacttgaacatattaaggtcatttaaggagaattcattcatctcctattaatctggaacattcatgatcgctgtaagaccaaagaggacattttggggggtaataagaaagttaaagctgccttcaaatcaaacgtgaattatgaaactcttttccaagaagcttctattagtggcctcatcagctatgtttcaagaaaggaagttgaaaaaaaatcccacaacatggaatgcgtatttgccatgctcttagaaaaatggtttccttgcgaagactcctttgtctctacatacctggacctgaagaccttggtgttgttttataaccctggaagcctggctgtgatcatctattaaggaaggagaaggaagctgcttatctgtcctgaaagtcttatttctactcatcttctcgcctccttccacaccacctccccacctacacacacccttgccctaaattcctttccattttgtcctttcgaaaactcctccctcccttagaaaagctaaaaataatggtaatactttccagtgatcctcccttattaggatctcagatgcaagctgcaggcaaggaggaaagcctgcatggtcgctgctgctcacatctgcatggttacaaatcgtggctcactccagctctcatcttagatgttcatcctcacttgaatcccagtgccataacacgccaacgcgcctggaaaacacctgctgtctataggttgcaagcaccccacagcatcccagatgtagggtcatagactcagagaattgaatacacacccaaatcctctagctgtcattagggggagtttcacatgattgtagctacacccaggattttaagcccccaaaagttatttaggaaggattgcaggctcattcttgtgttcttaggagggtcccgacctgcggataaagacctagaggaagggggaggccttgaggcggagtcccccaagcagagccccaacttgtgtgtgatcctgcgccacaacttggccagccggcctggacagctggctctggttactgtgggaacaatgcaaggaaggccgttgtcacattcctctgaggtcaaaggcacaaccttcgtcacacactcagtccctgctggcaaagagaaagacgaggagcgtggaatcggagacctggagcatgcgagggacttgagaaattcaccaactcccttgttttactgattaggaaactgaggtgcagaggagagctatgacttgctcaggatggcacacccaggactggaattttctcttcatggtccaataccctgatgttcctctcatcatctccagtacttcagacttgatagtaaaaaaggattcttgataacattattatattttgttatgttttcccatgctgcaatcgagtctttaggttcgaagtgacaaccctgttacttttgttgcgagacccttgagtactcccaggacaaatctagccaacaaatagcatctttagtgaccctatgggaagtcattggcttctagccctaaacccagaggttagagttaatttttaagtgctcgcctttaactcaagcatgaagctctaaaagcatcaagtagtaatgcttgaaaacatctaaattcctctgagccctaggcatgcttaaactctctctctctctttttttttttttttttttttaggaaaatagctgaaatggtagtggttagaacacatgcaaacagaattactgaataaaattggtcacgtatcccctggtttaaggcatatttaggagttcaattcacatgtaattgatcattcttttttctcttggcatactttcctgtaagagtcttatgtgccctgcctttagcatatgtgcaagccgataaaggatgttcatttaaaatttttactattttaaaaatacacacagagggggaaaagacttgtcttatccccaaatgaaaagaattagaaataatacttttgcctgtaaacttctatcagttttcctgtcatgggaaagggaaccataaattactttttataaggaaagtggtggtgctagggccacatgtcccctcccgcacagaatgagaggtggtggtggctgcgggacggtgggaaggaatgagcgggacccaggccagagctcagctccctgggctttgcttgtctcgcattttgtaaactcaaatgtcccatcattcccaaaggccatttgtggacatgctgtgattttatgcatcaccttctggaaagaatgtgttccgttccctgtgaacttatccaggttgatacagtagttccccccaccccccatcttcggtgtcattttctgctgtttcaattacccacagtcaagcgtggtacaaaaacaggtgagtgccatgcaataagatattttgagagagagagagagacaccacattcacataacttttagtacagtataatgttatgattgttctattttattattagtttttgttgttaatctcttactgtgacttatttataaattaaactctatcatgggtgtatatgtataggaaaaaacatagtagatatacataaaggtactattcatggttttaggcgtccactggggtcttggaacagatcctccatggatgggaggacaactgtcttttgaatgtgtcagacacaattgtggcatttcttagtgtctttttcctactcgttagttgtatttggctgctgcaaacaccttgggctcccaagtagttgggaatgtggaaagctacatactttccctctagagagagccccagtgtgaaaaactaagatagccgtgtgtttgctgatccttgggacgagccagggaagggctccgggagcactgtgtgaattaaggctgtcaagaccaaagtaacataggagggagaagatgaaaatgcagcagcacgtctcttaatgtgatcgtttctctttccccttactgaagcatagtgctctctgctatttgaagagcgcaatttagatttatattaaggaatgaataaataggatgcggtgatgaaatctcatctggagtgaatgcagattgtggatgctaatgaccgtgtggctgtgcagagaacccattggaagcctgggcgcttctccctcctctgttcacccactaggcactcaagagcaactcaggcagtggggaaaaggttatctttttttaatgtctctcagtgttgcatcttgccttatagcgccttaaagcacttgacaagccttcaagtaattcttggtggtggcgttttcccccagaaggccttaagagatggttttaatagatacacctatcaatttattcccaacttgagcattttgctgtcttgcatcatttgacatcaccagaaagtcctttggttacttctgtagttcacattgtactttctgtcctttgagttttgggtgctcaggggcaagatgtcagaaatcctgagttttagttgtgccactgcgtagctttgaccaagtcactttacgttagcaggatacaatttccgtgttcattaaatgaggagactggactgaaagctcttagaggcctcctctagctcagacgttctgtaacactcagggctttctgcctcctctgatttggcggtgtcaggatacaggtccaagtgcggcactgtgccttgcaaaattgctctctctccctggccagcttttccaccactgtggaatgaagtctgccgcctggaagaatcccagatttctcaaaggcgtccagttctagggagcagcgtgcaaagcccttgagcacactttgacttcttctgccctggctggtgatgaaaaaccaggtcaccagaggttgccctgtttccagtgatcagccctcgggactgaaaaaggaacaaatacagaagagctccaaagaaagaaacagaaagagacgctcaagctgggaagctaagaacaggtccctctgctggggtggaaggagaaagaatcttaatcctctgccttcccccatgggtcagagtcgtaaatgggtgagacttgaaggtgtggttggtcaccctctctcaaagtttcagggctgggtcaggtgtcctagtagtgttgcgtggtgcagtagtgagtccccagcctgcattctgcaaagccccagaggctccccataaactttgaggctgtgggctgccctcagcctctattgaccggggcagcggggcagcttctccttcagctctgtgatattctgaggctatgtaaaatagttttcttagaaaggtcctgtggttaaaaaaaattttttttaaaccactggtttagttacgatgagctcatattcaaagcaatatgaccttagacaagtcatttgattttcccaaacctcattttccttatttcaaaacaagtttagtcatatattctcagcctgtctcccacagcaatttaaggattaattagagtcagttattcataccttcactctatgaacacggtattgaacacctttcagtagaaggctctgttgggagaggaactcataagtaaatacatgagacagccattccaagcagagggaaaaagcatgtgcaaatattttgtaaactgtaaaacacaacacaaacctaacattatgtaatattgctgttcttaaccaggcagtttaatatagtgactctagagcctaactccttggctttgaatcccaactgcagccatttatcagtgtgacttcaggcactttacctaccctcttgtgcctcagtactccaatctgtacaatgggaataataatagaactcatctcactgggctgttgggagagctgaatcagttccgggcgcagtggctcatgcctgtaatcccagcactctgggaggctgaggtgggtggatcacctgaggtcaggagttcgagaccatcctggccaacatggtgaaacccgtctctactaaaaatataaaaaattagccaggcgtggtggcacgcgcctgtagtcccagctacttgggaggctgaggcaggggaatcacttgaacccaggaggcggaggttgcattgagccgagatcatgctactgcactccagcctggtgacagaacaagattccgtctccaaaaataattataataataattaagagactgacacagagtaagcactctataatgtttattattggtgatttcaccaatgcactgtgaaattctgtttcttgattctcagcattgcagtcccctgtcattgcacttccagttttctcttccccagaagatgcatcccgtgttcgagcggaaaggcaagggaaacatcatgtcaagaaaagagttccgaacagtactctgtttctgtggcatggatcctctttcctctccttttctcctttttttgaggttggattggcactcctctcagacttaaacaaaggctttgctttgcagagaggatctttctgccttcggtgtgtcatctgcctctaagggtgtaatttgtttctgatgcatgcagggtgcccccttgagaaggctttgttgatgttgtgcagaggtgtcctgtattgatcggtgatagaactgttctatagtgggtgaatgaggtaattgtcatcaggttactctagtcggtgaccttgaggctgatccgatgactaagccacagaggtggatccctggttatagaatgtccttgtttaaaggtaaatcggtgtgagagtgactaatagttttaaagaaatgatggcaagcaaatggcatgccctttggtgagagacacagtctatatcaataagctctgaggccacccatatctgggtgagatattggggctgattttcaagggttcctttatctctctgctcctctcttatctcttttcattagattccaattctccataacttccatgaccgtgtataatacagtcactgccatgactgtgtataatatcgtcagtgtgaagttcagagcaaaatacataggcctctgagctagttggctgggtttcttttttcttttttaaaaaattcagcagtggggtgggacagagctgaagatgaaaagatgcttgatacaagagaagagagaaagcaagcgtcatgataaaatctgcatgcaaaaaaacccttgttataaaatgaaaagtggaatgaatcattagctatacatttaagctggatcaacacattagccctgtgattaagagtttctaaaacctacctgccagcatccctgctgttgctgaactggtcctttctgcatgggaatgggtagaagtctaaatgaacagacttagagtgggttggcaggtgaaggatagtgggggtaagtagtgaggagaggataggttagaatagttattttgggctgggcgcagtgactcatgcctgtaatcccagcactttgggaggccgaggcaggtggatcacctgaggtcaggagttcgagaccatcctggacaacatggtgaaaccctgtctctactgaaaaaacaagaattagccaggtgtggtggctcatgcctgtagtcccagctacttgggaggctgaggcgagaggattgcttgaacctgggaggcgtaggttgcagtgagccgagatagtgccattgcactccatcctgggtgacagagcgagactatctcaatcgcaaggacaaaaaaccaaacaccccatgttctcactcataggtgggaattgaacaatgagaacacatggacacaggaaggggaacatcacacaccggggcctgttgtggggtggggggaggggggaaggatagcattaggagatatacctaatgttaaatgacaagttaatgggtgcagcacgccaacctggcacatctatacatatgtaacaaacctgcatgttgtgcacatgtaccctaaaacttaaagtataattaaaaacaaaaaaaagattaaaaaaataaaaagaacaattattttggaatcattgaataacagtcagctctttgtatgttggtcaataaaagcaaacacctataatactgctctaagtgctttgtgctatattaaccctttaatcctcacaacttttgttatgtaaattttatatctgaaaacagtgaggttaagtgatttgcccaaggtcatttaaacccagatattggctctgccccggtgcccttaacacttatagcctctcactgtcctgggtggtgaaggtcttgagggcaaagagagaaaggaaattcctattttcagtggacatatttcttgtgccggtggaaggaatttaattattacaaggggtttcatcaagtgcactaatctgggaagttgccagcaagctgacctgggtttaagtgattctcctgctttgacctcccaagtagctgagattacaggcatctgccaccatgcctggctaatttttgtatttttagtagagatggggtatcaccatgatggccaggctggtctcaaactcctgacctcaggtgatccgcccaccttggcctcccaaagtgctggtattacaggtgtgagccaccgcacctggccaagacaccttttttagcttccaaatcgaagtctgtttttgcctgtatcatggttgtatttcagttagaacatcatttctttttttttttctttttttctttttttcttttttttgagacagagtttcactcttgttgcccagactggagtgcagtggtgcagtctcggctcactgcaacctctacctcctgggttcaagcgattctcctgccccagcctgccgactagcagggattacaggcacctgccaccacgtccagctaattttgcgtctttttagtagtgacagtgtttcactgtgctgaccaagcccatcttgaactcttgacctcaggtgatccatctgccccagcctcccaaagtgctgggattacatgcgtgagccaccgcgcccggccagaacatcccaatacataggcagccacttatgcactagagtccttctcggagggtgagcagagttggctctccctgtcggtggcatcacgttggcagaatacacacacttttatcctgtggcggttggcgaggccattgatttgctgcgtagaatagcaaggaaatactctagacaggtttaacatttgttattgctaatgaatttgtcaagcatcggaattcagggacggttgatgcacacttaaaatgctctgaaatagattttaccttttataaaagataataataatctcatgtttgaatcacaagaggtacgttttccttaaatcttttaattaactcctatttcaagaaaaacctcttatcaaaaaaaaaaaaaagattttacatttcctaaggccaagtaagagttgaaggtagaatgagtaaataaccaagtttatggaaattgtaaaataaatacatgtgttataaatgtgctatttaatgaaaatgtgtattgactagagcaataatgatgtatctttgaccatgataagtaccagtgctgaaatccatccaagccacaaaaatgattggagggtccatgtggaatataaagctctgcagagtctagagctcatatcctatatggctttttgctaattaataaacattggccttttgtctattatttaatagcctaattgcattgcacattgcagtagcacattgcaatagcacattggcaaaagtgctgcctttcactgctaaggggggcagttttctgtaaaagaggttaaaaggagaaatcagaagcctaatttttgttaaatgagatgtcccccaaaagtcagatacatgcatatttgggctaaataaatctttcctgggaaactcttctatgactgggcagagttgttcacgagagactttccccccaacattttattaggaaaaattgcaaacatacaagtaaattgtaagaattgtacagtgaacacccataaacttgccacctagattttgcaaataatattttgctatatttgctttgtcaggtatcaagccatctgtccatcctgcagtccatcatgttttagttgatgcccttcaagactagttattgtgtatcattactcaatcaaaataaaatattggctttagttcttgcttttaggtaaattttattttattttattattactattattattattattgttgagacagggtctcactctgtcgcccaggttggagtgcagtggtacgatctcagctcactgcagactggaccttcggggcttaagcaatcctcccatcttagccccctgagtagctgggactacaggcataggctaccacatccagctaatttggtttttggtttttggtttttttttggtagagtcagggttttgccaggctggtgtcaaacttctgggctcaagtgatccaccctctttggccccacaaagtgctgggattacaggcgtgagccaaccatgcctggccagaaaaacccaaattgagggacagtccacaaaatgattagtctgtactccttaaaattggcagattgtcacttttatcacatcatatgtgacctatcatgggctgttgatcttgatgacctcagccgaggttgtgtcagggtttgtcaactttaaagttactctttgtacacagacacactcacacacacccttttccatactgtactactcgttggaaggaagtcactgtgcacagcccacacttaaggggtgggcagttacgctctacctttacaagggcagaacatctgcatgaattatttagaactcctttgctcaagagatgcgtgttttcttcctcttttaaaatttatttatatcaatatgaactcatgggtgtttattttattctttaggttctaatccagtactatgttgtttattttgttgctctggttgttttagttctggccattggcagctctttgagaaatattaggaatattgtctcttgtcccccttttatatgcccccatcactgtggggtattgatttatctatttagcattttcccactttctgatactacaagatgctccatgctcatcttggatattccctgtcacagtactagaatcagccatttctccaaagacccctggtttgttttattggagaatggtgttaggaactaagttctgggtgctggggcttgcagaaattttatgcccaacacatattagctccccctcttccttttgtgggagtttggtgtgtgcagtagtgagtgccctgtgaaatcttcatgctacagattgactttagtccctcactgatcctagttcacttcaggaggagcctagctcactgtggcagactagacagaaggcagcccagccagtcaactcaacagatttcatttattcagctcaatccaagtcagacttggtgctgtgcttattcctgtgggcagatgccctgccctcacagacccctgccctctagaatcaaatgacaggacagtaacagagaagtgctgtagaaaatcagaatacagaagggctggtgcgacctagcctaagagcattcaaagaaagctgtttatacaagagcagacttaggaaggtttattccagatgaggaggctagaagcaaagacatggaagtgggaacagatagtctcttaaatatctatggataagaagaaagccgaaaataatgaaggactttgcttcttgggtttattttaggtaggaagtagggtttactgatcttggtgggatgaggaaatggaccagtggtgtagtggagccagcttgcacttttatgagccaagtgttaaatgttcagaaatttggggagcatgttgacatcatgttattaccttgaaattggccatggtgggagtgtttacactacagaagtctgcaaatgctacacatcaggggtcctctctcccctcccacttttattaaacatttctgcacacaccactggcttcagctgtctaaatatctagtatgtacccttaccctgaatttatttttttttcctctagtagtctttttcaggtacacatttttatttggtgctttgaattctctaacaaaactgtcaaaaaatggttacagtagagatgtgtgcccctgattgaaaactgcattttactgcatattggttaaaactcttaacggtcagaaaattttttggttaactgggttatttgggaccctctaatggccattctcaataactgagttggaaaagtgcatgattcaaatgtactaaaccattacccagccttctactttattttggcagcatggggaaacctgttgtcacctgaaggtagtcatcagtgtcatatatatgtggtcataggatttatggttgggctggcttggaggtatcttctgattcttaccaagaatataggaaaaaacgatatcattttctttcagctgagaaaccatgactcaacgttattctgcttgtagtaggcaatgcaaccctgtatcagtttgacttttgcaaggatgatacctgagtaatccagggaatagtgctatgcaaatagggacagtttccatgaagtcacctcttgtgcatggtatatggtgttaagtgttatgccgaattagactcagagcagcttacatttcaaacgagtcacctaaaagcagttatatgcgtgacgaaggagaatggttagggaaagaagaagacttctcttactcataactggagattgtgagttttcactgtgatcctgaaagataggttggctttgccttaattacagggatttcttttacctctttgccctttcctatgtccctccatcaggtatggtaaattttcctagcttttgttcctattagtgactttactcctgatccactgccaaattgggtctctgaggttgtaaaactcagaaaaggatattgcaagcattctggccatattacaaatctcatgtgagagctcactctgaatcaaaggagctctcacattcttttttagtccaagtgattcctagatgtggaagccgatttcctggaacactcaaacgaggtcacagttcatcagctgcctcccataaaccaaccctctcaagtttcaactctcatttgaaacttcttgggatatcttgatccaaacagatcacctgaaaagctcccttataaggtcaagtgatcacaggggtcttcttcttcttcttctttttattgtgataaaattcatcatttttcccatttttaagtgtacagttcagtggcattaagtacattcacattatattgcagtcatcaccacgatccatcttcagaacgttttcatcttcccaaagcaaaactgcatatccatgttgtagcatgtgtcagaatctccttcctctttagggctgaataatattgcacatatgtatcacattttgtatctattcatccattgatggacacttaggttgcttccactttaggttattgtgaattatgtggctatgaacactggtatacaaatatctgttcaagtgcctcctttcagtttttttgggtatatacctagaagtggaattggtgaatcatgtagtattttttaaattttttgaggaaccatcatggtatttttcacagcagctgtaccattttgcatttctatcagtaatgtacacagagttccaatttgtccacatccttgccaacatttgttattttcttgttttgggggttgttttttttgttgttaatcagagccatcttaatgtgagtgaaatggtatgtcattgtggttttgatttgcattttcctaatgattagtgatgttgagtgtcttttcgtgtgcttaatggtcatttgcatattttctttgaagaaatgtcaattcaagtcctttgcccattttttaatcaaggtatttgttttttgttgttgctcaagagtcttcttgcatgcctagatagtacactacttcaagaggctatttagcatttatctggggttccatggggcagcctgttccctttgcacatatgtaatgcagagatgaatatgtagagacttaccactggaaaactgcacctggaattctcagatttgcccatatctgcttatcatggacgaggttcagtggtggatgctgcagaatataccaccgactgcttttggctactgtgtgacattgtcatctaacttttcactaagaaaaataatctctttagaggaaaggaaggaagttgagagtccatcttataatttttcagtgtaataatattctagaccaggtattgacaaactggaccatgggccaaatatcaccccagcctgtttctgtaaattaagttttattggaacaccgacatgcctgtttgtatgagtatcttcaattgctgcttttgcacgacaatgacagattgagtagttgcaatggagatgtctggcccacacagcctaaagcatttgctccctggtcctttatagaaaaagtttgccaacctttggctgttctaggtgtttaagaaatactatttttagaaccgtatatataatgtagtgatgttgactgcaagctattcactttgaaaacaataaagcttatgtagtagatattactgttttaagtatttactgaataagatagacccctgttacattactgcttttaagtatttactgaattccaattttgtgtccagagctgtgttctttgcctttgttttttgattggggcaatggctttcatgtccttagcaccactggggctgttaccagatgtgaccaaaaggtttctaacatgggtagcactttttttttttttttttttgagacacagtttcgctcttgtttcccaggctggagtgcaatggcatgatctcggctcactgcaacctccacatcccaggttcaagcaattctcctgcctcagcctcctgagtagctgagattacaggtgtctgccaccacgcccagctcatttttgtatatttagtagagacagggtttcgccatgttggccaggctggtcttgaacttctgacctcaggtgatccactggcctcggcctcccaaagtgttaggattacaggtgtgagccactgcgtcctgcctgggttgcactttttaaagtcacagaatctgaattctgcctttcctctgtgatatttcctattcgtactaaactttggtgaagtagctctgatctttagctgtggtgagaggagttatggaagagggacctgccccgaaacgtagaccacaggcaacttgctgcctggcaccctaaagatggtttcctgcttctcttcccctctatctccaggtcagagatgcagctttgctaaggcagtgattgccaatttgggaattttgagatactgtggatgtgctgattgttttgtacaaattctcttcaataccttgaccatgtatacagtaaacttatgctagctgttagaggacttattaaggtgtatggacactgtctttgaagagtttatatggtatgttttggcagttgaagagtattaagcattgacttaaaaaattatgtataataagcattgagataatgggaaagaaatgctacacatacacacacacgcatacccacccgtgaacacagacacccaggaaatcataaaacctgattgacttctatgtgtggatgttttctttttttattcatttaacttatattttaagttcagatgtacgtgtgcaggttcgttatataggtaaacttgtgtcatgggggtttgttttacagattattttgtcaccaggtactaagcctagtaaccattagttatttttcccgatcttctttgtcctcccacctccaccctccagtagattccagtgtagatgttctcttaagtaaaacgatggggtagtcgttttgtacagtccaaataagattccgacaatggatgaatctgctaagaggttaccttttgctccagatacaatatttatctaaaaggaaaatgaacccttaacccttccatggaatcgtactgcttcactaactttttgagtgaagtgatgggcattgatacagtattgaaaactttcaggcccttttctttactttttgacaatttgaccttttttcacccctgaaatatagcaatcagtatttctcttctggatctggttctacaacctacgttgattttaattactttccttgaaaaccattctcaaaatactctctgccccttacattttaagctttaatgttgaaaatagagctttggtaagagtctccttgaaaatgattttcttcagccaatatcagaggagtatttccttatttttatatttatatgttttaattccttaagaacagatatctaccaaatttcatggtatagatttataatcatcttttcaattttagacaaattttggaattcagatgttgctctttgaaatgctggtgacttctccaacttggggacattcacggactcaataagcatgccttttatttatgattctctgaggattcattcatttctgcatattttgaatgtctgctacacagagataaatgatgtaaaatccaggctatcagagctgggtcacaatttagtggagaagatgagtacgacaaaaatttaccatggagtgtgaaaagtgctcctcatagagacatgtacatcatgccatagtaagtttagggaatttggaaactcacttaagtcctaactcaatttaaattgtgttagactgtggataaatttatccgacgagaaacacataataatatgtatctactctgaggtaataaatgaaaaaagttggataaaataaaatacatctgttataaccaatggcccccagcaaggccagtgctcttgagccattattattcctgcacattctttgtgtttgggttattaacattgcgcttaggtcagatgagcgggtgttcaatctgccacactttgataactaaagtaaaatgctgatggagatcatttaagactgtctctatgctgttgattgcatgcttgtggctcataatcagaatgatgcaaagtaattgttagactgacttgccaaggctacattttgtgtcgttgccactgtcagcactttggtcccgctgtgctgcctgaagaacgcttgcctggcacctgttgggcactaatacacaactttccactgaatgtcatgggtaacttttgttctcatatcctcgcttgctatcttcacaaaaaaaaaaaaaaaacaaaaaaccctgacaaagatttttttttttttgacagagtcttgatgtgttgtccaggctggagtgcagtggcacagtctcagcttactgcaacctccacctcccaggtttaagcaattctcctgcctcagcctcccaagtagctgggattacaggcacacaccgccatgcccagctaatttctgtatttttagtagagatggggtttcaccatgttgcccaggctggtctcgaactcctgacctcaggtgatccacctccctcggcttcccaaagtgctgagattacaggtgtgagccactgtgcccggctgcaagtgcttattttttgtttgtcagaatgcttatgtattgagactttaatctctcgtgcatgttgccagggagctcatcttttctctttgaccgtgaaacccagacaaacctagctttgtcacttactggtgaccttggttaggttacttttcttgagccttattttcctcatctgtacaatgaggccaataaaacctattttacagagattttgtcaggattaaagataatagataaaaatgtgtccatacaaattagccactcagcaaatggttgtggcaaatattaaggaatttaatacttactcaggatgatacaatacaacgacaagacaacatttccaaaagttagtccgaaaatataatgataacgtaactgtggaacatgtagtatcagcacggttttactgggcaagtcatgtttaccagagacacacaattggatttggatgttaaaatctaaaccgcatggttttatggctagatctggaatacatgatatgttatgggccctcccatgtataccttcagaggatatggagctacctttggaagcaatgtatgatttagtgtttttctttttttttttttttttgagagggagtctcactctgttgcccaggttggagtgcagtggtgcgatctcagctatctgcaacctccacctcccgggttaaagagattctgctgcctcagcctcccgagtagctgggattacaggcgtgcaccaggacacctggctaatttttgtatttttagtagagacggggttttgccatgttgcccaggcttgtcttgaactcctgacctcaagtgatcttcctgccttggcctccgaaagtgctgggattacaggcatgagccacagcacccagcagatttagtcttgatggtgtaaaaaagccattgtatagcacacaacacagcctgaccatctaatgctcactcatgtaaaagcggtgaccacgagagagttgggcaaagcaaaaactctgtccctataagaagtgcattgttagatctggaaacatctcaccaggtcctgaattgtactatgaaaagagatttgttaaaagtagctcagttcatattccatgatattgcaaatgcctagagtgaattgtcaaagaaatgctctctctgactccatccactgctgacatttaaggtctgtgttcttagttcccaacattgattctatttcacatggtcaaaatgtaatagacatgttttttctaagagcatgacccccaccacaaattaccactccccttaaaaattgcatcggctggaccagggatgaagcatttagggagcatttgttgtaagggactgtcacctgccattggttatggaccttggtttcacagatcagactctgtgttgctctactttgcatctccgcctttgatctcgctgggattttgcagccagtatctatctcctttggcatttctttgctgctgctatgtgttctttctccctctgctgctctctgccagccccatctcctgcctgattcatggagcagtgttggatacttagaaaaggttaactgcattcgtgtctccatggctggagacacgatttccacacactctgcccattgcggggatatgctcacttccccagcctcccctcaaaagtgagattttcctggaatgtcactagtcgcggggggaggtatggcacccttaattgagggcaaggatgtgtcatgtgacttcagcaaatcctatcacatatatttttaccaaaccaaccattctctttgagaaggaacttagattagaaatattaacactgaatgaatattttaatttttgataccttctaaagaaatatggtaagtcctgattttttttttttttttttaggttttcaccttcaaatagtgatttaatttctaggatcactcaagatcatacagttttttcagttaactttcctctgtatcattaagtaactctaccatgattgggctgaaacaaggacatttgcttgacttcagacttagcgatttaatacttgatctagccatccctattcacccattatcccgagtctttaaaattgagtcctttttcgatatgttgaacacccactgaatattcttttttttttttttttgagatgaagttttgctcttgttgcccaggctggagtgcagtggtgcattctcgactcactgcagcttccacctcccgggttcaagtgatcctcctgcctcagcctcccgagtagctgggattacaggcacctgccaccaagcccagctaatttttgtatttttagtagagacagggtttcaccattttggccaggctggtcttgacctcctgacctcaggtaatccacccgccttggcctcccaaagtgctgggattacaggcgtgagccaccgcgtccggccacctactgaatattctaatgtgtgattctattccctgtggtatatgtgttagtttgtgttcttctatgctacacccactcaaaccaaaacaactttttgctgttaaggctttttatatttattcagcctgcctttctcaatcttgaaaaatgtagaagaaaaagaaccacatgctaccacaatatgtagtcacttcttataaacttgggacactttggtagactctgtaaattcaacaaataaatatgtattggttcattccttcaatgtaatactctttcagtcctcaaatgttatgatgttgatacatctattgatgttaaaggaggttttcaatataattaataagtaaaaaaaatgagacagcaaaatactatgaatactatcatagtacattataaatagattgtatgtatgtatatatatatatatatatatatagatttatttctatatgtatgtgtacaatatactctgtatacttgggcataggagagagtctggggtcatataaccagactgttaatagtgattattagtgggacttctgtggatttgtattacttgggtttttctatttatctaattattatacagtgaacagttttattttgttctcatttgtctcatccactttttttgactgcatagtcctgtaatttttttttaatttttaatttttttgtgggtacataggtgtgtatatgtatggggtacatgagatgttttgatacagacatgtaaaataaacacatcatgaagaatggggtatccatccactcaagcatttatccattacaacaaacactccagttatactctttattttaaaatgtacagttattattgactatagtcactctgttgtgctatcaaatagtagatcttatttattctaactactttttttgtacccattaaccatccccacctcccctccagccccctactacccttcccagcctttggtagccatcctcctactctctgtgtccatgagttcagtaggtttgatttttgaatcccacagataagtgagaacatgctaagtttgtctttctgtgcctggcttttttcacttaacataatgatctctcgttccatccatgttgttgcaaatgactggatctcattcttttttatggctgaataatattccattgtgtgtatatactatactttctttatccattcatctgttggtagacatttagattgcttccaaatcttagctattgtaaacagtgctgtaacaaacagaggaagtgcagatttttcctcaatatactgatttcctttcttttgagtatatacccagtcgtgggatttctggatcatatggcaacttgtctcatttacttgtgaggggtgaggaaaaagggaatacagtacaggtactcacattctggtaatttttgttgttgttgttgttgtttttgttttgctcttgttgcccaggctggagtacagtggcatgatcttggctcactgcaacttctgcctcccgagttcaagcaattttcctgcctcagcttcccaaatagctgggattacaggtgcatgccaccatgcccggctaattttgtatttttagtagagatggggttttaccatggtggccaggctggtcttgaactcctgacttcaggtgatccacctggcttggcctcccaaagtgctgggattataggagtgagccaccacgcccagtcacattctggcaaattattaagtcaccaaagtctctcctgtgtctttcctccattgttacagatatatgaacatgttgtgtgccaaatggtgataatgcctttttgttttattcagtctcttctgtgtaccaagcgccacactaaaaactagaaacattctatgaagtcgatattgttattgccattatacaaatgaggaaagggttcagagagtttaagtaactggaaccacacagctcctctgtgactcagctgaggctcagactgaggtctgactttgaaatcagttttcgtggtctcaagaattcgtactgtagacgtctcgtctgttgttaggatgaaaaggtcaatgcgtgtgagtggattataaagtgttgctttaaaacgaagaagatactcagagattttgccagtatctaccatttttcaatgtttgcatggctttctggcagtttttttcaattggagcataacctttgtctttgcagccccacctagcctaggatagtctgactgcatagtaagtgtcatgttaaacacttgtgggctgctctgtgggacttggaggagtgcccttcagattctgaggaactgagtctgggaatcttcctgcaggctggtgggccatcctgaaaaagctctatcctgccctggtggccggccacatgccgtccacgtcctctgatgaaaagggcgggaaagctgtggccttccacagctcatagaatgaatcccaaagatgctggaatcctgggaaacttgcccacagaacatcaggagctggaatagctttgcctcacagcctctcttaaacctgcaaaggcgtctttaaaatagtctctggagattattgttgagttggatcttgaacttagttccttgtgtggtgtagattaaatagtctgttgccgtcgctcccttatctccctttctttcaggcttcctctgtccaacattcacatcatctctgttctttcccacactttgtttggcccgtcagtatctcagacactgtggcttcctcacgggattactcagtcagcctgatatgtggcctccagcgcccctctgccaagtccacattcccatatgagcctaattacatacagatcactgcagggagtgaagctgtgggtataccattttgggaaagagcaaagtgcaggaatggggtactttggttatttattaagacttcttcacagcctggcaatgtagcaaaactccatctccgcaaataaagaaaaaacacaacattttaatccaggtgtggtggcacatgcctgtagtcccagctacttggcggctaaggcaggagtttgagtctaggagttggaggctgcagtgagctatgatggcatccccatccacggtcactgaattcccccatgagagggactttggagggaggatcccagggtctgagctcagctctgccactcacagccatgtgcacgtgagcaagtggctcagtcccctgggcctcagggtttccagctataaaatgggcacggatctatgacaaacccgggtaacaaagcaagaccctatctcaaaaaaataaaacacggctgggtacgatggctcaaacctgtaatcccaacactttgggaggctgaggtggaaggagcgcttgaggccaggagttcaagaccagcctgggcaacatagtgagaccccatctctacagaaacattacttcaaaaaaatacaaaaaaagacttcttcaataagcatcatggtgggcatggaggacatgacattttaagaaaggcacctaaaaaattgatttcttgggcaccacaatatggactccttgtcacaaggaccatacatctcatgataaatgaatcatgcctgtgattgttctctacatattgattgttcaaagctctgcttttaaaattcatatagtcagccaaataatcacgcatctattgttcttcagacatttattgtgcacctaataaaggccaaagtgctaggggctggaatttcttatcacctctaggcctgctcatttggactgatttagagaatggagttattaatttttttaaaaaatctttttttctattccagttttccaaagaaattagaccattttcttcgtgagaaagaaatcgacgtgctgttttcatagggtgagtgatcctttgaatctttcatgtatttttacccacatcaaaatattatccaattactatgatgcaccaagaaaaagtgtgtgacagcatgcactctctagttttctcctgcttggaaccaaggtatttttcctattctttgactctcctcatcactgggtcctttggagaggatggtttcccttgtagatttttctgcgatttcttttttgccgttcacatgctttgcctcgtgcgaggtcatcattgttgctattaccttgtccagctcacagaaaggaagtttctttccctcagcaactggtgcacagagatacagctgtaggcaagggggaaccatccagtttcaagtgactgtgatgtcttttgaattccatgaccaagaataacaggatatgagcaccagatgagacctgagagcttgtctggcaaaggccctatgtacagatggggcatctgaggcccagaggctcacatcacctttatggggcttcatggagagtagcagagctaggattttgatactggtgtgtttggctcctagctgcatgatgtttgccctgcacaagtctggttttggaatctgcagattctttttgaggctgtagagttataggtagtttaacttaatgtggtcttggtaatctaataatgatcacccctaaggcaagggtcaagactgatactgatagactatttgactttctcataatcctagttggctactaagtaaaggggttggcagagtgagtgcacccagaacacttctgttatggatgtcatctgagaaagcttattttcttctgcgccctttccaaaccactgcatctgcaatgccacgttgtcatgtgctgagacttggtggtacatctgctttgcagctagaagtcatggtacacctgcaggtgtgtgcagtccagctgcagacccacacacccgactcgcggttgtctgcacctgcagaagaatggctaacagggttcctatattgaagtacaaatctgaccttcatagagacttttgagaaacatttattcttttattttatttgtttatttatttactttgagacggatctccctctgtcgcccaggctggagtgcagtggcacgatctcggctcactgcaagctccgcctcccgggttcacgccattctcctgcctcagcctcctgagtagctgggactacaggtgcctgccaccatgcctggctaattttttgtatttttagtagagatgggtttcactgtgttaccaaggatggtctccatctcctgacctcgtgatccgcctcggcctcccaaagtgctgggattacaggcgtgagccaccgcgcccggccccatttattcgttttttttaaagttatgttggtttttacataagagtgcagttgtgcaataagatggagagaagttaagaatatgattctcagttagaatcccagaaggtaaacttgactgtgtgtgtggtttgtttgtttgtttgtttgtttttttagacatcctaggttaaatctggcttcaaattgtgttcatttaggttggtgaactaagtgcacttatttccaaaacatttcatctcacctagggagtggtcaaagggtagtattaagagcttgtgtttattattttatccaacttgtcagcttaatcactttgtcttcttccctaactagagtcattattgcggaacttgatcatctccttatgtacatacagacgtaattggtgtctaccaacatactgaatggaatgtagaacatagattgctgatttgtgagggatcatctgctgagttaccctaacattgatcgctcctgtccacagagctgggtctacacgagttagcattcattagaactgtgaaggtttccattttcctgtcttatctgagaaaagcccaaaaagtttattctcagagcacaccacagtacaatgtgggtcactgacacctgttgctctctggggactgtaaaggtctctttagagtcaagagattaattagactaaaagaagggggcaattaagggccttgagaaagtgaagaaatgtccatttccatgcttacatcataggattctttgggtaaagaataaactggtagagaagggtctgaggcaagaaatggtgaaggaatgaaagaaggactgcctgaacccatgtagaccacttgtggctactttggtttccttctggggtcatgagcactttgatgttgacattcaagagggcatcaaattattatccaaaatattacaagccgtaatttttttattttaccaaatgagaaaaaactaaacacagatagaagccatgagtatttttctccctaaaaagaagctcagaagctggcccccacatgcatatataccttgtaaaacgtgagtccctgggctcagtttcatggtatgcaatggggctgggtcttgggaacaatgctgctgttgtttctaagctcaaacagcactcaccatcaatggtatctctttaagggaaatccagggaaatgctcttgccagcgctgtgattttatttgctagaggccaggtggcaatgacatgcattggttccatagcaacgtgactgtgctgccagaaaacatataatgactgtgacagccagtgtatcctgggcaggatgagggcagccctgataccctcttttatttcccaccttatcctctcttgcctttcccctcctggggcctgtgatatgcggagaatgtggttttcgtaatggttactatctactcttgctattaacacttgcctcctgtctcggtccatcttggaacttgatgagagacaaggcaatgcctgtaggagtgttctgcaggcctctgaatgggtcagcagggttggcagcacctgcctgtcttagcaattgaaaggaggtggagagtctgtgcttttcatcctccctgtgtgtggcacagcggctctgtcagaatgacctggtggggagggtacttcctgggcatcgtggtcagctgctcctggctgaaatgtgtgggtagtgacatggagcaatgtgaaatccagggaaacagagtgctcatttaatatgctgcagattgaggagacacctaccagtggagcctgcaatgccaggcccagtaggactgcacagagaaatgcaatacccatttctcatcttctgggagctcttaccagagaggcagtttctaattgcagtttctctactgatgtgtggttggggctttcacatttctctaatgtttcctcatctatataatccttgatgaaagaattgtaagaactcttagttccaacggatactttttttcccctctgaactcctgaagcatttttaaaaatctttaccatccatttgacattgctcttgtatttccttttttcatatatattgctttgggggcctgagtgttttctaggtcgaggctaagcccttcaaggatacgaaacatgtatcttcttcttcctcttaaaaaaatttctctaatgctcacaactgagttctgcagatagtaaccatgacattaatatttgttcacgacaacgttatattctcactccatctcccaaggaaattgtgaggcaagtgtgtaaatatattgaaaatgttgttcagttcttcaaagaaaagataaactcaagaaattattttcctaatgtggtttttttaatgcagatataaagtcacaaggtaagaatatctaaaggcttcatatttcctcatcttcctctttctggctactgaccatagcatatacccctgggttttatactggcaccaaaatcatcctttttcccacctcactcccaatattcactgtattgaatttgtctttgggatcagacttctcagtctagcgttttggactattaagtaagagatttgagggatttttccattaagatgacagatagattaggtttgatagattaggatagtgattcctaatttggttttgaggtctgtttaggggagggaaggtttttatcttatggaaacttttatcttacaagagttctcttcccgtcccaagttctgagcccactgagaaataagacaagagtattgaggcagacgggggccagaatgcaactatgtgactgagggcaatgagctaacttgacacctgcctgttccccagtctagcctggtcgcaggccacctgcaggaaagttttgagtctacaggcacctgtctgtgtgaagagggaaggagaaagaggcccaaatccctgctaaccctgctcaaaattatatagattcaccctatccaaggagggggcataggccacgttggctttagccccagccgggttactcattccacacccttggggaagaaaaggttggagcaagaggtcagagggcataagggaaatcctcccccatagaaagctggggtggggcgtggcgtttccttcctgctctggccatatttctgctccctgcaccccatcaggcctacccgcccccagctcactcaagccttcttacctgttgttttcttcgtggcgcttgggcttctgcatccgactgctggtttattgttagtctcctctattagaattagctcagtggaagcaaaagccttgtcggtctcatggactgcatgtatcccagtatttaaaactgtgccaagcacataggaggcatttgatcaatatttgttgaatgaataaacacatagatgttgtttgatgcctctgctcacactctttaattacctggacatccctggtgccctgtcttgtctggcaagtctgtaggagctagttcagcaatcgtggtctcttcttgctctgtatgtagctcatcagttggcagtagttggcatgtgtgcatgtgtgtgctctcatgtaggtgagtgtgcatgtgtgtatctttgtatgcatgtgtgtgcacctacatacctgtatccttttgtgcatatgtatttgtatgtacttgtgttctctctctctctggctctgtaatacttcacttatttgtttacatatcttttacccttactagattgcaaatgcttgaagaactggggaacctgttaatcattcttgttcctctaatatctgccatgtagtaggtgctcagtatatgataatattagcattctaagcacttacaacatgcccagtactgctttattttaaaatttaaaataacttttatgtatcttgcatatattaacttgtgtaattctcacaacaaccttacaagatacattttaaactcgttttgtgggaaaggaaactggggacatgaagaggtcaagtggctggcccacagtctcacagctagcctgactccatagctttttttctctgctacctctcagaaactgactactgtatttgtgtgaatgaacaaatgactgaatgagaattttagaagcccagaccaaaatcattaaatagacctaaagacattagggtcaacacaaataagtaaaaatgatgagccatggttgacacagaatcaaggccatggctaagataaattcacagatgaatagctaatgccttcttgtagccattgcacttaattcctgatgatccatgcctgcatggtggtattggttaatgcaaatgaataattgttattacgtattgggaattatttcctagtgggaaaatatcaagtcatcagttatgagttaagcagctactgcttgcgaggctcacaactaaattttggggaaaatgatgagaggaaggaaaatgtgagttggagggtgaaaaggtaagccctgaaagtacaagccaaggtcactgtcttcaagaggctcttgtctcattaagtggcaaggagtgagtaaaagtgacattaaggcaattaaaagatactgagggcagtaaatataaagcctagcacaaggcattgttagacatgattcattaccaaatggtaataatagagaaaataaaagctattgtattagtcaggataggataagcttttgttgcagaaaggtcaaccctaaactttcagtagcttagcaaaataaaagtttatttctcattcatacagtgaccgctgtggatgcagtatctctccaggacaactgtcctccatgcataactccatgatgcagtctgctttgatctttttatccagccatctaggggcctctttcatgatcactggaagagagaaaaattggaaaattgcaccagcaattcaatgcttcaaagctttggcctagaagggacacttgtcacctgctatgtcctaagcatggcttttagctttttgtataactcccaacgtcccagtcctctcacacagcacacagtaggtgctcgataacgtgtagggtaaaagaatgaatgaacttaagaatgcattgtgacttgctcctgatggtgttgtagcagtaatatacctggcagcccccaaagcccaggcttggaacagtcagatctggctcaaaaatatttactaaaattaaaagagcattaataaaaataacaacatagttaacattaattagctatggtgatgggacaatcataaggacacgggcaaattaaactcaatttagcaggtggctaaacttacgctaaagccccggcctgccagacattggccttgtcttagacacatcactgtctaacagtccagagctcaactcacagttcacaagtcatctggtcccatcttgtctttctgaccttgttcctcctgaatgagatggagatcattaggcttgttaaaaattaagaagctttattaaggcaaagttaacctgtctgggatgcttccatgattccatcccaggtgtatggaccaccctataccatccccctcctgcatccgcttctctcatgctttcatctttcatctggggtcctggtgaacagaccacaattcagctccagatcaacgaagaggggcttccagacaggggccacgcatatgctgaggaaaacacagcaatctaacatgtaaagtaagtgggaagctccgtgtaggactcaacacggagaatggacagctcatagagagaaagggggagactgccttggacagggagataggggtcacaccacatgtgtcagaccaaagaatggggacccctcaaccacattcgctacgtgtgtattatgtggtgaagagaaacctgcctgcgaggaggactgagtcccagccactgacagattcccaggacacggtgcttcttgttggtttgtggtttgggggtggtagtggtagggagggaggagtggtcactgtgtaaatgggcagtgctgtggggaggggtcctgaactgggggttggcagtcactggagatttttcaacaagttggggatgtgaagaaccatgttttagtgagatgagctttacagctgtgtccatatcccgtgagatggtggagaaaaaagagactggggtcccagagggaaggcagttgcaggcgtaaggagataaggttttgagaactactgtgggcgtgttacaaagggaccgatgtggaggacactacaaagaaagagttgaacaaactgagcaactgggtattagaaacaatgaaaggaatggagtcagagataacccaatttttgagcctaggtggctaccgaaggtgtcctgtgttgtactttatggatattattattattaattattattattattattattttgagacagagcctcgctctgtcgccaggctggagtgcagtggcgtgatctcggctcactgcaacctctgcctcccgggttcaagtgattcacctgcctcagcctcccaagtagctgggattacagcctcccaccaccacgcctggctaattttttgtatttttagtagagatggggtttcaccatgttggccaggctggtctcgatctcttgacctcgtgatctgcccaccttggcctcccaaagtgccgtggatattattttaataacagtgtcatcccatgagatagagagcctgtggcagaacccagggattgcctgggacccagatatgcccacgtgagtatctgagttgccttaaccccacctcccttccttcgagccctccctccccaaggtttaggatcaaatcttaaatcagcagcaaaactgccaggctgaaatttcatctccatcctggccctctagtggagataaaatggtttgaatgtgggcgagaaagtaaaacggaatgtgtggttgctgagtctagctgttgataagagagggttcaccatccacccatgagaactgtctctctcctgctggtgtgcctcgctctcagacgcagcctccctatggctctgggacatgaggggtaatgtcttgccggttggtaaaattcttgcaagctgacagtctttttttgtttttcttttttttaagctccacaaggctactgcacattgcgttcttgctctttgtgatccaacaagagggagtcagttttgatttgggagaaaggaggaagaaagctgtttgatgggcgagaggaggcatgtattgattgcattcccgttttgctttctggggctggctggtcatgtcactcttcatagctgcctggctctagtggtagaagagagtctaatgagagacgctacggctgtgtgcagcttgcacacagcaactcttcagctccaaggaatcagagtgagctcctgagctccctgggattcagaggtgcctcagccccaaatctttttcccctgcatttaggctagaacaggaaagatgctactgggagagaagagaattcctgacatcttgcctttcttgtctgctttctgcttgggtctgtggagcagccacctctgggcagaggtgcaggaagtgtgacagaacaggaaagctttaaagtcactgtctccctccctcccatgccctaggctacccttgctggtcagaacctcctgcttactctggtggacagacacctgagttgctgctcttgatgaagtttctcccacttcttcaaaccagcaaggcataggaccccacttggcttggaagacacgtgacgctcttgatcatttcagtcccttttacatccccataatatcaccgtggcctgttagattgatttgtgagtaagattccttgcaaatagcaagatgatcggaagcctctatcttttccgggggaggtgcatatttaaacagacagcctaagctatttatagattgtaatgtattgtgttacagggaaaaggtggaagtcaacagtaatgttctgttccccatttcctatagtttcaagcatattttcttgctagtcctagagactttaaacatttagaatctccagtgatatctatattcttttgatgtactttgtgtagaaactcaagcacgagcaggcttcagagtcagctaaccaaagaatcttggggcttttgatcactttccattagcacaaacagtgatctctgccctgttgtatattgtttgaaaggacatttgctgtttaatgaagataaacatgttgctgggtttttaatatgtcttctcaactcaggagctgaaaaatgcatacatgagattagttctgttggcgtagaagggattctgcgtgccccaaacattttcctagccgttggctgaacttttgaaatgtgctttgcactgcaagaacagatactgaacagatattttacttagaaagccttctgtttcaatggtgattcccaggggccactcaaccacatcttactaaataatatttggtcaaaagagaaacgtgagtgcaagaaggacacatgatcacagccactaacaaattcctagaaagtgctgcttgttgtcatttctggttaggaggtgatggtgatggcaggtagagggtctaagccattctcctgtctctcttttaaagtacattcttctgttgctgtagctcctggcattggctgtcaccctcacttgcaggagggagggaatgactgtttgttgctgttggtgtctgaaaatctgtgggcagaacttttagaaaaagcagaccacagagcctgctatatattttgttcagcccattctatttctcttcactttttaaccgattgcgacaaaaaaaggggcctgccttctaaacttgtctttatctttaaaagagaataccttttataaatgcttagaacttggagatgctgttgtttttatttagtatttgaaaagctaagtatgctgacactgtcctgggagtgcaggcccctcattgagagagaacagtaaacacagcaatgactttgcttttaatttgaaatgcgttactcttcttagagctgaggggtgatttgagatgttcctgttttcacattcagctatttcctggttctgtgatcataataaattccatagctccaaaacattagagcaaattgtgtcttctgtaggagttatttacggatactcaaacaaatggtgctttctgaggaagaagaactgtgtatgaaaactatgtggtaaagcctttcatatctgccgtggtggcagaacttctgaggagctggctttgagggtaatgatatctttatcaccctgacgctgaatggaggcggggaggcctttgtgtgttctgttgccaactaacacctggctgcctcagggcatcctgcctggtaattgaacccatgagtatgtacaaagattagagggaccgtttgaggagaaagatgggggctggagaggcaaggttagtcttgccattataagcttaggtgcagaaggaagccaagctacctggaaggccacctcgtggcaaagacacccactaaggcagggcggtggcctgggactgaccatcaatcacttcccgctcattctcctcagaactgaggactgttgtcttcagtcttccccagcctcgcttatcttcctcctgcttcctgaaggaaatatccttttgcaatgggtggactatcaacttgaatttttagcaagcaggctggagaagtttttggaagttttggagacatggctggtcttgaattcctgggctcaagcaatcctctcactttggcttcccaaagtgctaggattacaggtatgagaagtttttggaggtttcggacttgttgctaggttgattctgagggagaaaagacctctgttattcagaaggttgtggacttctgaagaatggaaatcgggcaccctgaaggaaacatatgtcaatcctagtcctggagctagcatggctcaagtttattcccttaaatgtctattgtgttaaaacataaaaagagtttagatatacttccacatctttgcagttgttagctctctggacatttataaagggaaaggaagagtgaagcagagccccattaattcccatgcatggtgtctgctgtttgaatcctggaaatcaggatgattttattcacatgttaatgccctctagtggctagtgaggtgccctctaagcaggactttccccagcttccaccccttcctctccctaactaaattaagcacccactttacagtagttgagtatgtgtcatatcaagtctgtattttcttactaagattcatctaccacgtgggaaaaaaaaaatcaaaagctttgttacagttcaaagaacgtagtgctgttgctacatcaagtgaggataaatcttccatctgtagcaatctgtattataagtctactggatgtgacagaaaactctttaaaactttgatgcacatattttcacagccaaccgatttcattaaagtgggagaagtgtactattggcaagcagtttttctgctgacttcccacccttaaatagacaagctttataaaaagacaaaatcttcccagatctatttggttggccaaggtgacatttgtcttcctccctcagaaggttggtaaaattaaccttctgctttctgtatacctttactgtatttttatttctatttatttatttatttatgagacagggcctcactctgtcacccaggctggagtgcagtggtgcactcacagctcattgcagcctcaacctcctggggttcaagcagtcctcccaccttagcctcccaagtagcttgggactacaggtgtgtgccaccatgcccagctaatttttgtatttttggtagagatggggtttcactgtgctcctctggttggtcttgaactcctggactcaagtgattctcccacctctgcctcccacagtgctaggtataagccactgtgcctggccctagttttatataggtaaagcattagtcactcacaatgatctttgaatgagttatgtaagttatgtttggtttctcctactttgttttcctagtcagttcaaccagtcaagtatgagatgagtggctgctgtgagcttgatcaagtgggtcggaatcccctgggaatattgttaaaatgcaggttctgatcctgtcggtctgagatagggcctgagatgctgctggtcccaggaagacactttgaggaacaagttgctaggtgatgcagaagacagaagccatatttgattttcaaaaatcctatgatctgaaaaggaactaggagaagtatacaaataagtatggcataagacagaaggtgataaactgtatataaaagtaaaaacacgcttcagagggttaaagatagaagtgatcacttctgattgggaagatcaggccaatttccacagagaaggtgatttgggaatgggattttagtttgcaacagggattgcggggaggcgtgcgagggccattgagaccagagacgcagattctggaaagtgaagagtacgttctggaacaaggggccacccgtatgcctgtgatggggaaaagtgggagataacagttgggaaggtaagtggaagccatattgtagactgtcagacagtctgggatggaaactctggacttaattcaggaagcgaagaggaaccagcaacaagagattttgaaacgagaaagaagattgaaactgcagtttagaaagattcatctggcatgtatatgtaggatagacgggagtggggagtgacagcccattccaagagaaggagtagtagataggacagatagcatgattactcttagcaatggggaaaatagagactagatgcgatacagagagagaaggatcagaaggtgtccaggggctgtcagagtttcagtcctgaatggctacagaattaccataaataggacagtcagaatgagctatcgaatgcttttgaatggaaaaatgacctgaatgagtgcacaaatgtcacctccaagaggccttccttgtccatcctatctaacatagtatgccggtcttcttaccctgctttgctattttcatgacactttttactgtgacattaaaaggatggcaagaaaaacagggaggccaggtaagaaacctgtagttgacaggatagaaaatgacagtggcttgggcttgaatggtggcagtggcatcagagagaggtagctgggttcaagatacagcctgatagtatccagtatattctcgttgtgcatccagtctcagctgtttgtgtcttgcaaaactctgtacccattagacaataaattcccccttcccccttccccctccctcctggtaatcaccattctactttctgcctctatgaatttgactgctctagggacctcctatgagtagaatcacacagggtttgtccttttgtgactttttgtttagcataatgtcctcaaggtcatccatgttgtaacatgtgtcagaatttctttttttaaggctgatgaatattccactcttgtatatatcacattttgtttattcattcatctgtccataaacacttgggttgtttccaccttttggttactgtgaataatgctgctatgaatgtgggtgtacaaatttgaggttctcctttcagttcttttgggtatatacctggaaatggaattgctggatcacgtggcaattctatttttaaattttttatgaactgctgtatcgttttccacagtggctgcaccactttgcatttctaccaacagtgcacaagggttccagtttctctatgtcctcaccaacagttgttattttctggttaaaaaaatgtatttgatagtagccatcctaataggttggaggtttgagacctttttttaggggatatttcagatagacagttgagtcttcaggcctgcagctcaagaagtctgggcctgcattataccatagaagttcatatttatgccatcctttatcctttcaatgaattttttggccagtttgtctataagcatttaaggatttagagatttctattaaaccatcagatttgtgcttaaattatttaatctcaaagacattttaaataatatatacattaatttagacatactgctttcttccactttcatattatatgaaataattttacttacaacttttatctactatatcagtatcttcctcacgttttgaactacatggcaggtcatgtagtatcgttttccaaagcacatcatcttgacgttcatctactctgtgtttgatgctattaccagaaatttcatcctaagccgcaagtgcccattcctatattcgttggttacatttgttgagaccccattggccaaaaaaagacatatagccaagcccacagttaatgtgagcatggctatagggaggcatcctacattggggaccattattgtcacaatatcctaaaccatattattaagagatgtttttcttcattcttcctgtgagtgtattttgatgaactctgcaacttaaccacttactgtgttgcttttaaaagtaatctttaaaatgcttttttatttatagtgacatccagtgcttgcaactaggaaagtcatacttccaagaataattactagtcaaatttgttttcttccattaaaaaacaaaaggaaaaacagttctgttaggtggctgttatataaacatgccaaactagcatttatcaaggtagttttaaggtaatatgtcttccataaagactactttatttaagagaccaatagatacaataaactttgtaagaactcaaaaattaagggtacttaggcttttctgagggctttctttggagaaaaattaccttatattatattaccttttattcaggcatacataataattgtaaatttggctttggagacttcagtcaaagaaagagcttctatacaggaaaagcccttaaacactaatatagtgattgagcccattgctcataaatgtttgctaagaaaaatacttgtctggcgtattcaaaggtcagtctttcctagaggcatgaggaacgtttcagagttccttcggacattgcagtgctgtggctggatgatgccacttacccatctatttatccatttatttattcattaacttcaaacaccttctatagtgcagagaatttctaaataccatatattagaaaatctttattttatgagtttggctgacaagggtaggaataacaacagatattaaaccaaaaagttttgcattactgaaaaaattggacaaattcatattaaaagttcctaaccaaaaatctcacagatatgatgcagtaattgaaatccatcatattctaaggcttaaagcatgatgatctgcttctacagtgataatttgggtaagaaggacagtgttctaaaaaagcagccttaatatataacacggaggagtatatgtattttggtcaccggccatttgtctgtccatccatccatctgtccattcatccatccagctgtacatacatccctacatcctttggtttatttcagtggtgtcaactcattacatggcgttgaatgatgttatcaataatcattggcatgccctttactcccttagggtagaagagaattaggtaaaaggtagtactgaaaaaatgttttcccctcttgctgcaaagttataagcttttgtttcctaatcaggcccactagaccacattttgccagtgagcctccactgaaacaaataatgataatgttcatttcacatctttgacctgggaattgcagagtgatttaccaacattaactcatcaattctcctaacacttctgaacaagacattataatatatcattgaattcatcatgtaaatggattctgtgttttccagagaatttcaatatcctggccaccaattacatagggagtgaggagaaaaattaaaacaaaaattacccttttctgaactactgtcttgtggcctgatctccatcagaatgtcttattttctggaaattttaaaagggggaggtcagaggagacatcagctttgcttatgtaaaactattaaataaaatcatactagagaaaaatcattagaaaatgaccatttcccttaaaccactttcttcatttgactcattgcttaataaaatgatgaacttgaaacgatgctgcctgctccatgtcacccaaatgatgagtcacatcatgtgaacaaatggaaataaatcaccagcgaaaaggccaaacttctgtgctaccctagaaatattttctatttttccagggcttccaatgatcttccattcctgtttaactcagcttatagtaagccctgatgccaagattttctgagttccctgccaaaaccatgatgctctcagcctgggcctctcttctaggagggaagacactgccctccagatgaagtgaaaaggagaatcacaaaaagaggattattccttatgggaggaaatgggacacgtgctgcttattgtaacatcattcgccattcgttgggtatatggaggcttttatgagaaagcagaggtttttataactcatttactctggcaagtgaagcaacactaaaattacttaagtgtttaaaagatagacgcatagtagtttatgttctcagtcatcttattactgagaccctaatttgctttcgttaaactgtcggttctccctgagagtgctattgttatcggagcctcataaccgtgtacacgggtcagtgatggtacaatatttccggaaatttaagtcctccataagtagtcaattgcaggttgttttaaggaacaaagactgcttttccagcaagcctggcttgtgttcctattaaggccccttcttttttattgcaaggggaaatttcaaaatctcattgctgtatttaactttctattttagtaggctgccagtgcacttaaccttccatataaagcttatatgcgtttatgcgttctttcccttattaactttttaaggtttgggatgtcagcctgacctaatgatagaatatgcaaaaatagtcctgataccagcaccctgagcccacctaataagggacctttttcatactgtttacttatttctgagtaacagaaagtctgatggtttggtgctggctggttaaattcaacacatggtaagcttgcctgttagtgaagaaggttgagatttgggctgccggtatgttttcttctttcaggcaaggactgagtggcttccccatgtgtgcctaggtgtccagctgaccacagctgagagggataagcagggattgtgtccagctgagtttgggcccctcactcagtggcctacgttcctcggagggtgtgtgtaattagctgctgagtagtagaaggcagtagccatgatcccagttggaaaatagaagtagagctaaagctaaaaaaaaaaaaaaaaaggaaacaggagagctgattgcaggaggaggaggaggtgggctcttgctattttctagagcctgaaccaaccatgcaaagtagaatagcaggtgttgcagctctttcccccaggaggactcctgagcctcgtaagaaggtcagagagctggttgaatgttggtgcaggaagcacgtcaggaacagcttaacactggtttaattttcatttcccctgtgttattttacacatgaggggagtctgaggctgagcgccgtggagaggtctttgtggggagcagttcacgtcagatccaggcctggtcacctcctggcctcatcccattcacctgagtgacttgtcacccttttcaagtccttttccttctttgctttttgcttctccaagtgtgagattggcaatgtgatcattatatgaaaaacatttaaaattaaaaacgattctgtgcaaatatgaaatagataccagttttctttgatttctgtagtgtcactgatgataatatgcactgtagattaaatgattagtttctgggggtgggggtgctaccactcttttatgtaccaatcatatataaaataagtcctgagttcagaaatgttaaaatgacaaaaatcacatggttgtcatatataagctatgtgtgttgtatacaggctgtttgacacacaggccctgttctttacaaggcatgctttctggaagcccaaaccagtcccaggagtgaaagctggctcctagcaatacatgcgagtaggagtcagtgagggcttaggaaaattatccaggaaattcattttgagcagcccaaactgctagctagtagctaagctagtaggcaggagtttcattgaccacatgtctcaaccacatttaccacatttcttgctaaagatgccctaagtggggctgaaaggcacaagatatatagcaggtgggggcaagggggaagtgaagaacctgggtaccccacaccctagatcattcaattacatttttaagaattttttaaatgtacgtatgttaaaaagtttcagttttgcaaaatgaagagtttggggggtggatggtggtaatggttgtgcatcattgtgaacgtacttaatgccactgactgtatagttaaaaatgtttaagatggtacattttatatttgtgtagtttaccacaatttttagaagtatatatgtaatatatatgtatatttacataaatatttttccctagtttgatgaaagtatattgtcatgtcatccactcacccatccatctttattcattcattcaacaaatatttatgaagccactgttaggtcaacatctgtgttccaagctggaatataactatgaatacattttctgtgcttgtgttactctgaggttagtttaagtgaaagccatatgaacaataattaccagccagcgtggtgagccaaaaatgaatgtgtatgtggagttaagactgtgtccagctgtgcagagttgtggggtgtcttggcatctgtcaaagagaagatggacataaagagatcacctgccaagggacagcatggacaaagcacagggaacaaacagcatggtgcagtgtgtgcagggaacagtcagtactccattggtggtaacttgtcatgaggccaggagcaaaccatagagggtctcataggccatgttaaggagtacagactcctcagctcggtggaggtcagaccacattctccagtagcctgaggatttctcagtctcccaacctctgccctgtgaacctctgtggggctgccttcagaagtacttggtggtgatggatgaggagtaggaggaaccgataaaactagatagtgtaagtagcctcaattttatttatcttgtgtattagatttctatataagattttgtttgaaggcagagttctggcttttaaaaaacacatttgaaaatcattgctgttggcaatgaggaatcataaaaaattattatagttggtgacgattagcttagtgttttaaaaatcaatattctgcattcaaagcaataaaccttctttctccatttctgaacctcacctcacagtactttgcacatactaagcattcaatgaaatgttcagtgggaattgttttagggctatgacttagggatattttcattatactactgtcataagggtccacttaaatagaatgttgcccagtaactcaaaaggaatttgtagaaatataaactatataacttgccttttattctcacttttctttgtgtgcgattggactgtaataattattttttctgagttttcttgtctatttctgagacatcaggttttataatttgatgctttggacctggttgacaattccgattctgtatgtaggattgaactttgtgggaaatagcagttaattgtattttttaatgcttaaaatgatattctgggcaagttttgtttctttacggtctatagccagaatcctactgtttttcaatttgtttaaatgcaacagcttatacagcatatgtacatgttcagttgaagataaaggatatcattatttttagcctattacaaagaaaaccacattttctcttaaatgtcttgatataaagtaatttgaacacaatttctgcacaaatcattttcaagagattggctgtcaagtgtatttttttaagtagcactttcataagaaccaatgaaactttgcaaatttagatagattctaagcctgaaatgtggttgaagatgtcagtttttaaacagcactttgagaagtagttaacttaaaagtatagcaattcagagcatactgagaatgattttgaagagtaaagtcttgatacactgaaaagaaagttgacagattcactacaattaggagacaaggaggtacaactcccacttgtgaaaacttttctcatctaaccaacttctaatacttgcctaagaaaatcttcagcaaatccttactcctttgcagctcctaaatctattgtatagaattcttccagtttcctaatagatgctggcgaggctgtggagaaataggaatgcttttatgctgttgggggactgtaaattagttcaaccattgtggaagacagtgtggcgattcctcaaggatctagaaccagaaataccatttgacccagcaatcccgttactggttatatacccaaaggattataaatcattctgttataaagacacatgcacacatatgtttactgcagcagtatttacaatagtaaagactggaaaccaacccaaatgcccatcaatgatagactggataaagaaaatgtggtaaatatacaccatggaatactatgcagccataaaaaagaatgagctcatgtcctttacagggacatggatgaagctggaagcctcattctcagcaaactaacacaggaacagaaaaccaaacaccgcatgttctcactcatagtaggagttgaataatgagaacacatggacacagggaggggaacatcacacaccagggcctatcggtgagtggggggcaaggggagggagagaattaggacaaatacctaatgcatgaggggcttaaaacctagatgatgggttgataggtgcagcaaaccaccatggcacatgtatacctatgtaacaaacctgcatgttctgcacatgtatcccagaacttaaagtaaaatttaaaaatattttaaaaataaagaattcttccagtttccttatggcataataatggaaacagaataataacatgacaaccctcctttccttgttttaaggaaaagtaagttgttaggcctgtgaacaatggcagaactgaaatggagtcttcactcaagccttgtgtgtgattgtgtgtatgcatgtgtgcatgcgtgcatatgtgcacactcacgcacatgcacaaacctacacatttgagtgcaccagtttaaaataagagaaaaaagtgacatgaaactcacttcccaatttctaccatcattaataatacattttaccaattctgatttgttctactattgtgtcaaggctagttaatgtgccccatgcattggcagacaagatgatattatgtggaaattgtgtcttgtctattataagaacctgaatatttaagtatgggagatttttgcctgatattcttcagtcttgtcactcactactgattaagctttgtaatctatatatgggcattagatgaatccataaatgaatgaattggtagtttcctcaatgttttttttttttttttttttttatcataatgaagatatttcatgaccttttaccagtcttatcacatcttggaaagaattactacatctctgaaaaccctacccaggtaccttcttgtagttgggccatatgtttctcaattcagatatacccttgaggtccactttccttaggtggacatacacttatgtacactcacacacccacatgcatacaatatagagaaagaaaggtaaatagtaaccgacagaggtagtgcctgctattctcttcagcgagttgttatcccctcgtcccattccacaagatgggtgccacattgaagatgcaaccaaattacatgcccacactcacagtggttggcccttttgaaattactgggagattataatgatacagactgtggggttgaaacaattgtattaaaatcaattttctgccacttccaagttctgtgatctagggctgtcgcttaattaatctctcagagtttgtttcctcgtgtgtcatatgggaacaataaacttactttcacacggttgttgagaagagtgaatgataactgatacaagaaattcaagttttgttagttttaatcggacatcataagacttttaaaatcatgtaaatgtacatccctaattgcttgcaagtggtgcaaggtgacaagaggagccacctttgtgggaggagtaggtggcaacctctgatgacttcaggacagtgactctccaccttggctgcatagtagaatcacttggggagctttccaaaattctattgcctgagccataccccagaccagttaagtaaggatctctgtgggtggaacccagacattagtactttctaaatctctctgggtggtcacaatgtgtagccaagttggagaactgatgctttagggggatttaaaagtcttcactccttgcattggctgaattgatgatagccagaattctacaacctacactgtattctttttgcttaagataaacagagtcttaggtatcatgccaaaagtctattatttctcttggttatacacgatttggcatgaattagtttattaagttttctccaaagagccaatcttaatgggtgggtgtcgggcttggaaagagaacagaggtctgtggatatctgaagacaggggctgttcactagaggggcacaaacacagaggcaaatgcaacccaaagtcagcaatttcaagctactgttgcttttgaaaattagttcttgcaaaagcaccacctcaagaggtggttggcttccctgaaagctcagcatcatggctctggtgggtcatcattcatgaaaacttgctgcatctttaaaatgtgggatgaggaaaaacatttaaatagtggctgaatacagtcatagtgtaaccaaaagccagaaaattaatttttaaaataatgtatatttttaaagttttgttttttcaagagaaaagactaaaatcacttcatactcaaaatctctcttacctcttttcaacaattggtgctgagacaatggaaaaagtcacctgggacacatgccagagaaagaagttgaacccttacctcacaccatatacaaaaatgaactaaaaatggatcaataccctaaatgtaggaactgaaactataaaacttttaaatgaaaacaggagtaaatcttcatgaccatggatttggcaatagattcttagatgtgacaccaaaagcacaaacaacaaaagaaaaaaatagatgcattggacttcatcagtatcaaagcctttgtgaaccaaagggcactgtcaagaaagtcaaaagacagcccacagaatgggagaaaatatttgcaagtcagtatctcataagggtctagtttctggaatatataaagaactcttacaattcaaagagaaaaagactaacaacccagtttaaagatggacaaaggcattggatagagatttctccaaagaagatatataaatagccaataagcttatgaaaagatgtccaacatcattagtgtttaggggaatgcaaatcaaaaccacaatgagataccactttattatggtcacccattatgatggccataatttttttaaaaaaggaaaataacaagtgttggcaagcttgtggaaaaaatggtaatcttcctacctggctggtgggaatgtagtatggtgcaatcactatagaaaacaatttggcaagtcctcaaatagctaaatacagaattaacatatgactcagtagttctgctcttaggtatacactgaagagatttgcaaacaggtattcaaacaaaaacatgtacatgaatgttcatagcagcatgattcatagtagcccaaatatggaatcatcccaaatgtccatcaactgacgaataaataacaaaatgtggtatagcctacaatagagtattattgaaccaaaacaagaatgaagtactggtacatgttacaatatgaatgagccttgaaaacattatgccaagagaaagcagccagacacaaaaggccacatattgtatgattcagtttatacacaacatccagaatagacaactccttagagtcagaaagtagattagtctttgccaggggctgagaggagtgggggacagggagtgactgtttcatggataagggggatgatgacaatcttctggaattagatagtgatgatggttgttcaacatgtggatggagtaaaagccactgacttacacactttaaaaacagttaaaatgctgaattttgttttatgtgaattttatcttcattaaaaaatacccctttgaccccatctcttctctaatcctgcacatatagccttaaaccagtcattttaccctttgtgattccattttcatcttattctgttttttcctctaatgttcaacttctgcaaagagacatctacactggtcttcatttcctttccagcccttccattcatcactccagattctacacctgacctggaaaggtctgtgttaactcaaacagaagcttgggcacctcttccttactagaagggcattccagtgattgacattagaaatcaagttcccagcatggccctgccaccaggctggactcgtccattgcactgtcaccaaggaatgttaagtcttggaaacagatggaggaacttgcacggcgtttcccagcaggcacaggcgattcctgcaaacttaggagagtgaaagtcacacgaacaagaatgtaaatttgtgtgagaagacgtgatgctgttactagcagagttaaagtgcttttaactttggataatggatagtctgctctgattgcctcgaaggtggatctccaagcccacagaacggtctaaaagtggaaggaagctgtattaatcatttatttaattttctttctttctctctttttctgctggggtcagcaggaatgggaatcttttttttttttctttttacatcagtcttattatgattatgattatactgaaagacctggatgggaggaatgctgcaatctgaattaaaaatagcattttctgtcctcccacacacaacacttgagtgctctgaatgccttttataaatgcagactttctgcctggctagataaaagaagctgtcacttcatttccataacgaagtcattcccgggagaattccattgttttagcaatagaatttttgtaaaaggcctcttattttgcctgaaaaaggtaacaaaaatgaacttttgagagcttattcgacaaaacaattaagcagtgaagagagattttctccttttttgatatattaggagttgtaagtgtgagaatcccctgagccatgatactaggataaacccctaaatctgcaagatgaaggaggaggggagaaatcctgttattctttctcctaatagaaatggggatatgctcttccccgagaatatgtgtcctagagccaagtgacacatagatgatgctaattctaaagagttttaaatatttagtcttaaagagaggtaggaaacttgtagaatgctcatggtgtaaagaaattccttggggtttttaatgaaacgcgatcatcaggtattttaactgagtttcaggactcttaagacaaaccacggctgcatcttgccagcgtcctttactcataaaatagtagttgatatttttctttatttgcattgaaattgcagcaagtggagtacagggtccttcatgatgcagtgtgacctgtagcgagctcagacaggcctgtggacatgtggtcacactcagcacccctctcctgtgtttccccatccctccacacgatggatctgtgctccaaatatggtatcaaatcttcagcgccacattcatagaaagaaagaataattgtatttcttgttacttacccggccctgcgtaacccacatcaaagtatacctgtctttggtgtttcaacaggtaatccctagatataatgccaagtggcatttctgctacatggtattcacagttaagaccattgaaatcccagttttaagctagaatgcttttatgaagcctcctccaaaaaaagagaagttttcaatagcacctttgtcttgcaatactttgttctgattgagtcagaaaattgtaatatttaaacaaggaggcagttactcggaatagtattaaaaaaggagtttaaagtatggagttgttgtatctgttggcttttaatttagtaaaacaagtagaccaaaaagaaaatgagtgctgttgacgtaatattattatggaaagttctgtgggggcaaacattatgcaaaagtagttaaatctggcactgattttgaatttcagaaaataattctgttgtttttgagctttgaatggcttttactaatataccaataataactttttttttttttttgagagagagagagagagtctcactctgtcacccaggctagagtgcagtggcatgatctcggctcactgcaacctccgcttcctgggttcaagtgattctcctgcctcagcctcgtgagtagctgggactacaggcgcctgccaccatacctggctcatttttgtatttttagtagagacagggtttcaccatgttggccaggctggtcttgaactcctgacctcaaatgatccacctgccttggcctcccaaagtacagggattataggcgtaagccaccacgcctagccccaatactaattttttaaagcatgatttgatgtcccagctgtagccatgcaattttgcatggtagtagttcataaaaagaaaaggaagttgtggctttgataggatgcttccaaggtcgtgtttttaatacttttggtaaattctgttacttgtgtctgttcaaaaggacagaggttgggagatgcatatgtggattctgtctcttcattttatcttcactccccgtttggtactttgtgaagtcaggccaaataaaatagttgaagatactatcatataactctcaatattatggcaaaaagagaatgagaggaaaatatttagctatttcttttttaggatttttactaattgtgttattaaaaaggagcaaatagagcaggaactgaaacagacttaaagtcagaggactggactgcacacattagcatcttgcagaccttagctgctcatgatttataaatgcttcagaaattatcaaagcatgaggcacaggctgtgtttcagccttccccattttcaccaagcacttctgcaacacctaaacactgaccttttcaagcaggcatgaataaaactctcctctgggcagaaggtgcgtgatgactcatggcaaccagaaaggggatgtgtaactcgggatgtggagtctctgggcttctagacccagacctccctgtcttctggcccactgttctttctgttgtgctacagcaatacctgaaggacctgcgtgttgaacaaataaggccaggaataagttgtcaataggagcacatgacatcttgtctttaaaatactaatttcctgagacgtcgttctacagctgctcagcacagattgggtatttatcatctatatgttcaacttacattttattttcattttattcttgatatgcagacatacttttctccaatgtataattatatttcatagcaaactttgcactacgtccataaggagatgtaacctgcatacaaatacacacagcagcagtctctgtatgaataaatccttacctttatgtgataagccatgctaatgataagaagcagtgacatggatcaacatgaaatataatttttttaaaaaacctttgaggatagacatttttccagcatatttatctctgataatgtgttctttaggccggtactaattttggattttattccttgaacacaaaccagttaatatacacagagaatattctgagtgcatgctaggtatccaaggactgccagtttgtaagaaattttacaatggataactcccataaatgatcaaatgttgactgaacagggaacgcatgatattgtgaataaatcatattcttcagaataccttgagttttggcctacctcccacgctgacctccctccaactcttcttgaggtctaactggactctcagtccagccctgcactggagatgcctctcagtccagccctgcactggagatgcctctcagtccagccctgcactggagatgcctctccatgggaaaggggtgtttttggcccagtttgcctgccacttaagctccttggtgggcagggtggagacagggctctgcaccctgctgggctgagtgtgctcattcagaggaagcatttctgaactctgcaattgccagcagccctggcagcttctctttattcctcagaaaggaaatacaaagagttacctttagttctgagttggaaaaagaggctgttgtggaacatttcattgagggactgcacagtttccttagagacttatgtgatgatttttctccaagtcacccaaaagggtgttcttccatttgaacacctgtcctcttccatggaggacagagactcaaagacatataacgtcttcaagtataatgtaatataataccatgttatcaatcagttaatcaacaaatattgatcaaagagttatcatttgcgaaagccccgtgaagcttacaaaaagaagacagacataaaccctacctttacggaagttaccacattccacttggggagatgacacctattgtaggataaggaataaaatggttagtaacataaggaaaatgaattttaaaaccataggcattcacatgcaaaaacaaaacaaccaaaaaaaaaaaaaaaaaaacttctgattgagaaagttgtagaataagaggataaaagagttgtagaaaaagtgggatttgagctggtcttgggaggtctggcttacattttgacacgtggagtagaaatgcgggctctcagagaggaagtgagaagctcactgtggctgcttcagtgtgcatgaggggagaagtagaaatgaagttggaaaagcatgctggggccagattgtgaagatcttcagcatcaaataaagaatttcgaagatgttcagtaagctgtaggaaccaatgaaggtatggatggcacggggaagttgtgttatatctactttaggaagttcgatccaacagggatgactcaaatggtttagagagagaaagcattgacaagaagaccaatgagcaggctgctgtgagaggaattcagtctgagctagcatggggcggtgaagatagaaagggtgcagaattggtaggacttggaaaccgatggaatgtgggagaaagagtagaagatgatgatgctgtcagcttccatcagaaattaaagaggaggagctgggtttggagcaagggactgggaaagtttgaaataaacataatttgtttccactgcatatatccaggagtttgtagggggagataccagggaccaggatacagatttaagaacgataaacagtagaaggaaatcattatagaaagtgaatagaactgagcagatagccttaggaaatctgtcccctagagttagaaagaacagagagagcaaaaaactgcagaggggccataaggagtaatataaggaacccaagaaagtaccatctcagagaaattaagaatatttgtttattttggttacaatagacaaattaaactcaaagtgattcaagcaaaaaaaaaaagaaatgtattgtattatatgtggattggttttctattgctgtatgacaaactacaaatatagtgacttaaacaacacctatttatttttttttgtgtgtgcatcttttctttttttattttttatgttattattattatactttaggttttagggtacatgtgcacaatgtgcaggttagttacatatgtatacatgtgccatgctggtgtgctgcacccattaactcgtcatctagcattaggtatatctcctaatgctatccctccccgctccccccaccccactacagtccccagagtgtgatgttccccttcctgtgtccatgtgttctcattgttcaattcccacctataacaatacctatttattatctcacagtttctggaggtgcgaagtccaggcatggcttagttgaattatctgttggaggtccgaagtccaggcatggcttagctgaattatctgttcagggtttcataagactgaaattgaggtgtcaacagggctgccttattatctggagctcatggtcctttttcaagctcacatggttttttgtatttagtttcttgtggtcgtaggaccaaggtcccgttccattgctggctgtgagctgggggccactctcaggtcctggcattcaccttcagttccttgccatatgacttgcctcctccatcaacatgtcctctctcactttgaatctcattcctggtaaagccccatcccttttagggttctcttaattagatcaggctcaccaagataatctctctattttaaggttggttgactttggacctcacttatatttgcaaaatcccttcacaacagcagaaccttgattactgtcccactgactaactgggaagaggtgtgtgtctggcaggggacatggcaatcttgtgggctacgttagaatttggtctatcataatataactaaaaattccagggatcaggccgggcgccatggctcacacctgtaatcccggcactttgggaggctgaggcaggtggatcacttgaggccaggagttcaagaccagcctgtcttgaacatggccaacatggtgaaaccctgtctctactaaaaataccaaaaattagccgggcgtagtggctggtgcctgcagtcccagctactcaggaggctgagacaggagaattgcttgaacctgggaggcagaggttgcagtgagctgagattgcgccattgcactccagcctgggcaacaagagcgaaaccttgtatcaaaaaaaaaaaaaaaaaaaaaaaataataataataataataattagccaggtgtggtggcatatgcctataatcccagctactcgggaggctgagtcaggagtattgcttgaactcggagtcagaggttgcagtgagtgagaccgtgccactgctctgtctgggtgatggagcaagacttcgtctcaaaaaaaaaaaaaaaaaaaaaaaaatccagggatccgtctaacttctggcatggctaaatccaagggactttactgtcatcaggactcagattttctgtctttcagcttttctctgtactgggaagcttccttctccagtgggctttctgtaagaggtggctaaagaaaccagctgttagtagcatcatgctcccgtggtctcactaggaaagagtgtgttgctcctcttagttccaggtagtctgagagaggcctttgattggcttgccttgggtacatgcctacccctaggccagtcactgtggctggagggttgttgtattacgattgcccagacctgggtcatatgtccatcttccaggccaatgtgtgaagtcatcccagcccagataacagccaaggggagagatcattccagaaaagatgctgttcaggcaaaaatgctagtctactaaataaaaggaaaagaaaatggaaggaactattactagtgaactgtatcagacattgttagagaagttaagaggaggactcagcaaaggtcactgcatttagaaggcaggaaaccattcttgacctttggaggagaaggaaggttactaacacagagaaaagtggtggaaatcaagctccagagttttaagatgtaggcggtgaaatactggcattgaatgtatagtacaactgtttgttggtaaacagaagagagaggacagccatttgggactgtattagggtatggataaattcttttaggaatagcagtgactgagtatgcttggagtgtgagaaatttccagtagagaggaaaaagactgaagggaagttgggagcagagttgaccccagcaggatctggaaccagtaggaggagaatggattcagactccaagtagagaggccacacacagtgtaataacctgggtaatatagtgtgtgaagttttttgttgtttggtttttggtttttttttttttttttggtcatttgtcgcttctttgaaatagacaggtatcattgctttcaatgtagctatcaaatggtgattaaatgtactcaaaagatcctcagcatctctctggccctgtaattgacagaaacatttaaccttagagaagtggttctcaaagtctggtccctggaccagcagtatcagcatcacctgggaacttgtcagaaatacaaattatctgaccccaccccaagcctactgaatcagaaattctacagatgggtcttagcattctctgatttaacaagaccctctagccatttctattcgtttctttcctttttttgagtcggagtcttgttctttcgcccaggctggggtacagtggcgtgatcatagtgcattgcagccttgaactcctgagctcaagccaccttcctgcctcagcctcccaaagtgctgggattacaggtgtgagccactgcacctggccttctccagccatttctgatgctgcttcaagtttgaatatcactgcctcagaggtctgcatctcccctccacatgccatgaaggtttccttaatagtggctttgagaagctatgagagctagtgatgtaagctgctggtgatgaggaaatgggggagtttgtaaatcttgaaaggagatgacaactgttcaaattccactaatgacttaagatgtaatggattggaagaacagaatagaaaggctaagttgtaatttaattttttttgagtttgtggagggctgacacatgatgatgataggcatcatcagactttcaagtccctggaagacagagaaaggtgaaatgggcttaaagcatagctgtagactggtgattcttttggagtaagggttaagtcctagaacaggttttggatatggatcatttaagttaaatccaggctcttccactagatgctgttaggaggttgcaaaagaagggcatggcaaggtttctttcatcagagagcttagaaactttttgagccttcaagacttaaataaatccagtggagtataaaaagacagtataacaaagtgctgaactgaaaaggaccttgggtcagaatgtgtggtagagactgtaagtgctgtgggcagtcaggggaaggagaaattggcattgtgtcattttctcctctaggcagaggatgaaactgacagcctggcgtaatttcccaggtccgatggcaagatattggacaccttggcttcaggaagtgctttttcttgttctctctctcctttctgagtgtgtcaaagttgccaggtcaaagtgaaggtttatactctgagactttgaatgtggaatattgttaatatttttgtttgtataagaagcttgtaggataaattacattttatcttggacattttaaatggaaagagactcaaatagaagtttggcatatttgtttcagacaggctttcagacttactccattcatggggagaacatgaatgagcctgttggatgatgctttaatgttgtaggatgaagaaagcaaactactgattttccttagtggaagaattaagttgagccagatgtgggatgatagggaagaagaaaacacttcagatgaacatgacatttccactgcttttaatttctttgcaccttgcttgcggctcatgtgggtaagtaaacagaccactgaaccaagaaccaagagagaaggttgacggaacactgttaacggtgggcataaaagctgtttaagtccaagagagaaatagtaaaaataccgtaatcatcaaggggaagccagaaatctggtacctgatccaaggtcctaaagatgtttttcagaagtctacaagtaatgtgatctgttttcagtcctttttgggggagggttttcttaacttcagctgtggcatgcaggtgtcaacaagagagcttccttttacttcactgtgataacggagtgacttggggtgcattagagagcagggtcattatttgctgtcacatcaagaataatacctgcatcaggggtgttcctctcaccgaaattaatcacagagaaggtgtgtgttgctctgatggcctagcagtcagaaagatgaatcatctcttatttcaaggtatggagaacagttgtgtcactcatttctttttcaaggagactcagttgaaatggcaaaataaaaaagagagaaataacagaacacagttgtacatcactagatcagttcgtataatacagactgtttcctctacctggaaacctgatgcctggctaacttctgctcatttttgactttcctgttcgaatgttagttttgtaagagaagccttcctgagaccctccttctaagtgaggtacccccatcatgactacaaatcacaatgttcatttttccttcatattgcctatccagttttcaaattttatgcatctcctaaaactcatataattatttaattctgtccctcttgaggcagtgagctccttgggtgcagggtcctgggctattttgtttaccatgtattccccagttgaacacagagcctggtggatttagcaagtaccaagtaaaattgtatcaagcgaatgatttaattaatgagaaagcacttggtaaactgtattcattatgaaagtgatggttaattatgtgagtagcagacacctcctttctctcttctgtcccaattttgtctctccattttttattagttctttattttgagatatacttgtcagtgtgttaccaattccaaatctaagatttgttattattcattcttgcctttttttagagataaaggaccactcttttttgttttttttcctcagaaatgctattaatgacacccacaatgctaatactacaactgttttttctgtgcatgctcatgatttgaaaggaaaaacatgactggcctttgtcgatgatgtatttgggaagcaacaagattctagtgtagcacttaaattctgtttcttgtcatcctcaaagctgctaatacaagttcctttgcctcaagtgtgcttctcaaaagtatacaaggcgaaataagttgatagtatcgttccaggagaagctgttcctgggtcagccttgaaagggggaaaaaaatcaagaaatccaggtgtggaaaatattaatgatcaggatatgaataagtcttttcattaaaagcaacagcaaataaacaaaaagttatccaatccttttccagcagggcctcgctgtgccactctggtgggtgtaagtgttgtcttcggtgggcggaaatggcagacagccaagtggaaaatttcacagtgtcgcaaacattcagtgcacgaaacgctgcaaaccagcaatctgagggagccgtgtaccaaataaccacgctcctgcatgtgccctactgcccaccttacactctttctcctagcttcctgcgtgatgccttcactttctttttcccggagattccagattcttcgtttctgttcctattctttcctgaaactcagcacagtagggcatgcagacgtttggatgctcccgggatagttgatgattggtgccttaccagtgctggcttttgtattctggctccagagctcaggaacaggcttatgaccaccaacaacgctttgcattaacatagtggatttcttctcgggaactgtgtgtgctttgcaagaatgatcttcttgatcttctccatgacccagtaagatatgacagtggcagaaggtgctagtccttgcctccttttgcagaagagtaaagccaagtggcctgttttgaggcttttgcaagtttgcatctcagctaagattgtgtctgaagtctcccagaaatggcttcaactttggggtgaggagaggctggctgtaccatgttgtgttctttttgggaaaagagcaagaacattgaacttcttttttaagaaaatggtctttggtgaactatcaattcgtctaattggtcgtgagactgtatttgttcagataacaagtgatttgatgatgtgtttacctttttctttttcttctgttctatttccatgctaggtatttctcacttctctgtgaaaggaagaaagaacacgcctgagcccaagagccctcaggagccctccagagcctgtgggaagtctccatggtgaagtataggctgaggctacctgtgaacagtacgcagtgaatgttgtaagttaacaaccaagaacaatatgtgtagtggcttgccttgtaggattcatgaatcacttgatgtaaccgagccaggtgttgaaggggtattagcatgagctctaggtgatcgtccaattaatttctttttttaattggaagggaatttaattttttaagggaagaggtcctgtttgtatttgctggaacttgcctttctctcggcttctatggcatgctgcaaactatctacttcaggaataaaaggatggaatacagtgattctttcattgtaggaacaccttttctactggtacagtcaaatagtatcagatttagagcagcccctttaaactgggctgttgcagttcttttaggttggtgagtagggggtaaaattctccaggctaaggattagcaatcagagtttccatccagcaattattcttctgtatgtgcagttgatgaaaatgacatttttctctctggcttgtaaaatcttgaggtatgcaagttacaagcagttatgtttggtgcttcccttacttaaaatgagctgatttactggttttgatcagttactggcttgggattttgagattagtaaagtttgttcccacatgtcacctgatggccgccttgcatgagaagttttagtgtcaggtaatggaagagatgacatagtgtgacttcagggagcccttccactaggaaataatgcaaaggtgctcagccctcctactttctagagaatttaccttgttgctggactgtgtcacaaaacacagttaggagattttgaccaggaaagaaaatagctacatgaaacccaggatggcctatgaatacctctgaggacgagaagatattatcttcaaattttaggaaatgacaagccaatttcttctaggtttttgttgttgtttttgtgtatatataaatacatatatttctgtaatatatatgtatactcttgtttatgtatgtgtgtgcgtgtacacacacacacacacacacacacacacacacacacacacacacatatatatttaggtttccagcttcttaactcagccagaaaacttttttgaacatgtattacctattttttttgcagttgcctacaagatttgtaaagagcaaagtgtagcatatatcagggagaaaagtattgacaaggaaaaaaaatgttcctaatttttttggtttcatagatttctaaacatttgtattaaaatatgcatatgtatccatatcatctcctcagggttaaataatcagtaatattaatatgagcttattaaattcaaattttcccagtgcttcattgaaagcagacagtgggagacactgaagcttcattgtgtttccattctgtacacgttgggtctagtggaaatcagtcagcctggaatcagctgacctgaatcctattcctactgttgagatcaagtacactggcaaccttgggcaagtcgcgagcccccataaaacaatattttgcaagtctgtgtattgcttcatactaccttattttcatttttttctttttaattgaggtggtgccttactctgtcacccaggctggagtgcaatggcaagatctcgattcactgcaacctctgcctcccaagctcaagtgaccctcccacctcagccttcagagtagctgggaccacaggtgcacaccaccatgcctggctaattttttgtatttttggtagagacagagtttcaccatgttgctcaggctggtcttgaactactgagctcaagtgatcctcccgcctctgcttcccaaaatgttttgattacaggcatgagccaccatccccagcccatactacctttttattaagcaatcagcatcttggtttagggtcctcataaggggaagagcattgtgaaagcactattttacttatttttttaaaaaaaaccttattgtaaaagtttctgtcactatcaaggaataattgtgggccatgttagatttgggtactccagttacagtgtgttttactagaaatcattttcccaatcaggtaactgttagaatgcacttctggtggtattttttaaagcatttttatcctaggaaacaagtgtcttatgtaaaactgctttaggtttcaggctctatttaaataactcatgcagttaccataatcaagatagcttttgtttcaaatctagtgggggttttttgttgttgttttaaccgttgctttgaactgttcatgtgacaccctgtcagacctcaaagattgagtgaggttttcaaaggacttctgaagtgtacactttaagatgccacatggcagacttgaagtaattttaaaatccttctgtaaatggagtgtgttgagagagcaaggaaataccaaattctagtgaactctttgtgcatgctaagtactttcttttcaaaaccgcatttgcttggtaggggcagtggggggttcctagttttcttagtaaactgtgatgttggtaacctttcattatctgggcacatgtttacaacactggttttctgtcttcctgggtttagtgtcctgcatgccccaaagcctgtgccatggagaactgttgcagtagagaaggcaggcaattttcaaagaatgcatgtttgcacataaacagggtctaggagtgggtgtataaatgtgtgagtgataatcacagcagccattggaagtagtggttcccatgctcagcagtccttgcagatgttactcctggcattcattcctgtgcatgtcccattaactgcctctcaaatctgccaccacttgccagcagatggcctttgcccctgaagatgtttcagactggctgtaagggctggggggaggggggatcttgtacaagaagagaatgatgctgacactgaactcagagttagcagacctggattttatgcacaatgctgttgttagccatataaccttgggtcctctctaccatggggactcattttatgatggacaacttgagaaaattgagttaaatcacctccagtggtggtttttaccctaagtgtctcaagttgcataaagtatcagccttagatgaggccaattgaacgtttattttaccttcttgggttcctaaaaatcaatgatttggcactacctcatttacaactgtttttaaaacattgagcacagtcttagggttaaaagaaaaaaagagttattacatctttcactaccatgaaaccctttccacaagaccctcctgggcaccatatgacaattcaaaggtatttatttgagactgtccttagactatagctttagctgtttaaatttagggtccacactcattggtccttttgaaaataaacaggaacgatttttgaacttgagttttctaaaaccacctctgtgctcaaatattggttagagtctaagcaaggagaaagtgatccatatttcattcctaagcttctctgcttccttaagtaggaattcttgagttaccttatcaaagcagccttccctgatctacataaaatagcatccaccccatccctctcagtcctctagccttctgtgtttttcttttaagcaccttacatattatatatttatttgttaatcatcagtctcctcaactagtctgcaagctctgcaaaaggagggatggtattcttatccttattctcattcttattcttccctggtgaatgaatagtacctaaaatactgcttgttcccataatgggcagtcagtaaatattcattgagtgaatgcctaaatgacattcactaagtgaatgcctctcatgtgtgggcctgagccattaggaaaaggaacatacatgctgttctgatgagaatgcttgaatctgatagcagtttaagggtgtggggaagggatggagagtctagactattttccttagaagtggatacttgatgtgtataaagaaatgtgaggagggaacaatttgtgtaaaaaaaaaaaaattctagacctatcagtagagtttggggattttctaatactttttttaaaagtctgcactgtctgtatttcctctccttttccatttgagtggtttgctttgtcacttgtttgtgagcatcctgccctggctttctgtgaacggcggtggttttgtctcttatcatcacatcatttcatcactgcttacgttcatatttcttttcaaagtagggatgggcctgaagtgctgtatctccctagaaaggggctgactgaataacacttcattctagtgcacaccttagaatgaaaaaatggtgtgctggtacaaatgaaacccatttaatgtctctgtggtgtgtgatgggaagttcacaaaagctttcttagggaggcattgtgctagttagcttttgaggacagcaataataaaggtttctggaattttgtgtgtctatggactcccttttcagaataactgctctgagtgcaggcattactttattcctaggaagaaatggagagactaaaataaatacctctgtacctgtgtaaacagcattatgctgtctgtgtaagtcttaaaaaatgggagctgaatttctcttactctgaatctccagactaagagaattgcacacacacgcacactctaataagagcaatctgggaatttccctctgtgtctgtcagtttgtaccttttagatttgccatctgtgataccaaattctccagcgttacaaaaaaaaaatctgaagtagataagagggtcaggagagaaggggagattccaccacttttggacaagtgagggagaacaatctcctttttcttaaatccttgcttgtaatgctcctgcagattgacctacagattgtaaaggcagagaggttatgactgagctcattccatccaagtgcactggggatagcttcaagtcttctagagttttctctttcacccatttctctctcttcctcagacttccttgaatggcttctgattgacagcttcactagttcctggccattgcccctggtgtgttatttgggatgggcacctttggcagggtctttgcaggagtcactgcttctaagaagtggtgtcagagctacctcctgaggcaactgacaaagcgtagcccatcccaggcacaccctttcccctcagcaccttcttcctcaagtactcagctcctcctctcagcatcttggagaggaggaggaaaatgcaaagaacacccagacgttgtggaaggaaaaaagttcatggatcttttacaacatttgtgttctatggggtgaaacaacatcaacagcctggtcaggctgctttgtaactgaatagtgccaaggtaaaatgcttttgtgtcctctttaagtttagagttcactcaattacatgatatttattaaaagagtgttgtgtgccaggatgttcttgagtctatcagggatccagggctgagtaatctgtacttactgccctttgagactctaggaaggtgctatgggaaggatgtacttggtggcggagtcaggtgtaccgaaagggacgatgggtaagagttgtcagcgctggaatttcagggaagacatctaaattgagccttcaagcagaggtggaatttcaacccaatatatatgtgtatttagagaagacaaaggatgctttgagaagagactaggaatagtattttatgtactacttctgtgtctgggcatgtgagagctcagagccagagctttccttccatcagaaattgtttggtttgaacactgacaaaaacatagcatgaggatttgtagcacatggccaccaggccaccattttcttcaggatcattttagatatttttttttttttttttttttttgcagatgaagtctcttgctgtgttgcccaggctggagggcagtggcacgatcttaactcactgcaacctccaccttctgggttcaagcgattctcctgcctcagcctcccaagtagctgggattacaggtgtgcctcacaatgcccggctaatttttgtattttttgtagagacaaggtttcaccatgttggccaggctgatctcaaactcttgagctcaagtgatctgcccacctcggcttcccaaaatgctgggattataggcatcagccactacgcctggcacattttggatctttatatgtaaaagttgaagcaagaacttgggatgcctaaagaatgatgcctcccagcattagtaagggcagtgtttccaactgaactttgtacagaaaaacccaaacaaaactaaagatgtattttttaggtggtataaattcgaagtgctcaatgttcaagaatccacaataaagaagggcagggatgactgaatagtgataagaactagttgacattgtttagtcatagaacccaaacaaaatctattggttcttaacaacacataaattactccttaggactaatgtaaacagacaaatagaaaggtaacttcattttttaattatctaaatttttcacttttgtaaaagaatcatattataccataaaaatattaaccatgtctccaacttaaattcatgttaaatttccagtggtagctatgtaataaattattgctaagtagaattgtagactgaaagaattaatccatcttctataaatcctgaagattatgttaaccttttccagacacctaaacaagtatgttacatgattcagaaaaagtcatttttgacaagtataaaatgattttgaggtgtgatagcaaattagctgtttcaaacctatgttagagaaattaagttttcagagcaatttttttttgtatttgtgcttatattcctgaaacaacttgcttaaggagagtctccttaaatggaaacataaatggtatacaaatggctatcctctatcataatcttttatttccaaaactcagacaggtttttatcatcatgctctttggactcttaaccatcttcttctacttttaaattctacttctttctcaatacatttttaaacagcatcttgtgatcatttcccagtcttgagtgcctggcactgggaggtgacctgcccacattgctgtcagaattcgctgctggacccctgcacaggtcccaggctgttggttacgtgtttcaatctgcacatcagccatcctcaccagccttcctttgtgcatctggaaataaaaatgctcttgataaaatggttttctaaagtttccattaggttgctcttcatttcatttttcctttcttcttcccaagcctttgtggcttgcatagaattgaaaaaaaaaatgtaatttctccagggctaaaatccaagactttgataggcagtcttaatgcatggggctcctacgagttgctacccgttataagcattgtaaaactcaccctgcagaacaaagagaactgggcacaaagattattctcttcttcaaccatggcaagccctagttttccggtttcctttgccttttccttctttgatctctaaaagaaggtagaagagtagaacgctattgttcagaaaggagaaagctattgcttgtccaaacagattgttttttccttctgtttggcaacctcaatggctctacctgtttctggctgtcatacttcggcttgtgaacagccttcctccctaattttcaggaaactaacaaattaaaggtgcaaatgtcaggtggttactacatatctactggctcacataattcaaaacagagtcatgcagctcctatctaaagctagttccttgccccttctcagtcactaccacatcaagcacaaatgtagatgaaagggtagtgtgtcaaggtgagagctgcccactgggtagtgttactcggtcacttgctataggggacagattagctgccaatcagtatctcatcactgtcattggcgtttataatccaggttcctagccccactggtgatctatttctgtgcctccgcagtgacgccagttgtcctagcaacgtgctggctggcacttcgttaaaggcaagtaagggagtggtggtggaagagggtggcctcgagagggtcagaagggagttggcagtcaccttgctcaaagaggattttccatttccctcatctgggcaggcctccaggaggaaaacgtcacttactaagtgtatcatgggagtgtcacttactaaggatcatggaccacatggtctttctggtacagatagaatcccacggagaataacaaatgaattaatgggtagtccaggcagaatgtggggactgccgggccaagatgttaggcgatctcaaagcatctgatggtatcagtttttcttgtgaattaggttaatgttttgcttgtttatcagcactggcatgcagagttggagacatgagtagatgtttgggaggaatcagaggtcaagggaggcagaaggaagggaaacaccatgacagtccctcttggccccttttcctgttgacaggtctggcctgaaagccatccagtgtaacgagagccttcttactgagctctggtaatttatccatgcacccagccttgaagaggaatatggctcactttgtaatcttcttaattgctctcctctcattatgccacattgaattggcactaaatgactttttctgccattttccgatttggatccaaagaacatagaaatactgtggattgtatcttaaagtccctgtccaaagtggccttgcctagatgaaatctaaaatggacagtcaagtgacattggcagagctgggggcttccctccatggccacttctctgtggaagcccctaggcaatgggtttgggtgacattttctcctgagagtgcttcgtctgtgtggccctggagatgccaagacatttttcacgaagaaagagactcaaggtgggtctttgcaaggaaatggggaacaagggagactgatgaaagggtgtccccagagcattgaagacccacagatgacaggaagtatgacgtatgcattgttgcctttcccttcacgactaaaagagtttttgtagtctcaatgaccgttgtcatttgttccactgaatgaccacactcaagtcgagataattgcatgaaactgtgtgcttatgatgggaaagacatttagggtgtaactgaccatttctagcacgttttgtatactcaacagaaggtatattcactccttctaccatagctgaaataagggctggtagtgaagatctgggactggaattgaaagaaataatttttggaaaaagaaaaactccaagggtagctgttggcactttcagagcatcccatattttcaggatgttttgtatgagataaagtaaatcagttttgtttgacagggtgtagtgtgcccagccaggtcattattttaaattgacaaaatgatttaaatgatagaagacattgtatattcctgaaacaataaatacctattaagtacattttgatacagtggagaagtacagtttttgttttttgtttttttttttggattattatataactgttaattcaacacttagtgtttaaatactcatcattctttatagtgcacaggtcataaagatagttctctcatatgaataagaaatacaactaatgtgaatggcattaaagttagaagcttcaaattcttctctgggtttgatggttgcttttttagaagaaatttggtaaagtagatgatagaccagttaggtttcatgaacttcgtgcttcatattcttttcttttcacaacctagctagatacacagtaaataactggaagcatactagagtagaaagaacccttcttcctgaataagttgtcgttgatcacaggggtaggcgttaatcaaaatattaatgactaggccaggcacagtaattccagcactttgggaagccaaggcgggtggatcacctgaggtcaggagttcaagaccagcctggccaacatggtgaaaccttatctctactaaaaatatatataaaattagctgggcatggtggtgcatgcctgtagtcccagctactcgggaggctgaggcaggagaatcacttggacccgggaggtggaggttgcagtgagccaagatcatgccactgcactccagtctgggtaacagagtgagactccatctcaaaaaaaaaaaaaaaagtaatgactaaggagaagatagggacaccttgggctctgtccagtagcaggaacctcaggctaagaagggacacctgggttctcttcccatccctgcccttttagaccagtggcaagctactctctatctgggtgcctctatttccttatcttccaaaggaagatcattatcactgccacttaacagcatcagatttaaagtattagttcatataagagactctttgaatcacatttgggttcagatttcagacctgccacccagtagctgtgtgtcctttgggaaattgcccaacttctctgagccttatttacttcatctataaagaaggtctgaccacacctaccctgatgacctgttaagagagttaaatgcgataaagtctgttaagtttttagcccagtgattgctccctaataactgtggcagccatgatgctgttatgataaatttcacacaacaaaatctatcatgatgcgttgctgaagtgaacaggtgagcagttgcaacttgctcatctctttgttgtagagacatttctgctataataggagttgtcattaactgtcattgtcattacactgacagtgaattcggttatgtattgttaagaccttctgcttccttgacatgtatatagtagaataattatgacagtgaaggtgacacatttgtcagaattatccatgtgcatatgctgagggcccttggaattttaggtgaattttatagtattagtcaaactgaaaggcacagtgagtttggaaactataatagtctcatctataaaaggagtagggagattcccaaaggctgttgatatgagtagaactctgaaaaagtaaaacattaaaatacattttgatgtggttaccgtgtctaggtggtgataggtaaaaacagtctagtctaattctttgaaatttaggatagaagaaagcctgaagatggatatctacattcttgtatcttctttcagcaaatatttacagaaagagagagagagtgtgtgtgtgtgtgtgtgtgtgtgtgtgtatgcacacacatatgctacaggctaggcacctacagtagttaaaggagctttcagtcactggggaaagaaatgagaaaacaggcaattcctttacaccatgaccagctctctcctaatggtacccacaggttgccatggatgcagaccagcatggcatcttctgggatcagggaagctttcatcctcagacttgaatgaggagtagatgttaaccagaaaacaaagtggatgtatcagttagcatatactgtgtaacaagccatcccaacagttaagggccaagaccacaatcttatgattgtgggtcacctggactattttagtctgggccagcttggctgggactggttaatccagcatggtctcactcacatagctactagaaggctggtttgcctgagagatgggtgatcttcagctgggacagcttgtctctgcttcaggtggcctctcatcctccagtagactagtctgagcttcttcactttgcaggctaagggttcccaaaagcagcaagaaagggcaagccccagtgcatgagtgcttttcaagctctgcttcaagatgcttgctaatttccctttaaccaaagcaaattacttaatttgttcagttcaaaggatggggaaactccagctctagtcacatgaggacaacatgagcaaagctcaaaggtaagagagaacatggcatgttggaagacagcaagtagtttggagtggctggagtcaggcatatgtgaagtctcatgaagaaaaagccagatcataaagtgtcttttcagtaagttctgctgaggagtttagagtttatcttgaagacaggggagtggtcattgaaagagtttaagcaggatgttgacatgatcaatgagatgtgtagagacatggttaggtggtagaagcctaaaaacactcgttagcctagacaattcaggaagtttccaaagagatgacccagggatagcataggagaagatggaaggacttgactgagaggtggctcaaagctgacgtgtactttcagaacaatgtgaccagaaaagaggttggaggcccttcaaggtagagcagaaaagacagaggctcaggtcatcagcaatatccgtatgaatctggtgggagaactccaccagtgttcctcacctcgctcctttgtgggatcctgccagactccaatgtccttgggttctaaataaacacctaccaaggggctgagtcaaagagattccagtctctggaagtgtcttcttgtcattgtcatcacccagccaaagactcttttccttccaacatgtttttccctttgacctcaaaataaacaatgtgttctaaaggctctggggcactctcaaaatgcttctctgacctcggataggaccatgcttacccattaatttccagatctgaccttttcactacacctttaagcataactctttcaaaaggcaaaaatagaaatgactgtttcatttcaccaaattcaagtcgccaagagtgagaacgtgtggttttcaccggtacgtttggggaccagtttgttgtcactgaaactgcctgatatcgggtcggagtggctgggtatttttcagtccttggggttataactcaaatgttggaagtggtatcttttataggtaaaattgagggaggggagcatcaaaatgtgtgcgatgcagataataatttgccaagttttctaatttttttcattaaaaaagaacatacagaagagtctacaagtagggcaggcagccttcattcctatgctcttttccttgagggacaccttccctaaccaaataattgaaaataaatgggaattgtgggaacagaggaagacaagaaggaaaactaaaaacccaggacctaatcttccaggggcaggcaggccacttttgtagctcagattctgaccttttctccaatcaaagagttcgaacagactgactgattggagtgctctgtcagcattaaactcaatgcagggttctgctctggcacctttaggggtggtggtttagaccctctgcgtgccatgtcttatcaccagcactgctaactgaatgggatgcattttcaaagacaggagagggtttgaaaaaccccagggcatgctcggagcctgcaggcatttgtttgctgctgagaaccatggcaagcatttttgacatttttatcagagtcttagttaaacaattatgtggaggactgataaagaagtgtgtgataggagacttcataatttaaagtgcccaaatttggtgagctttatactcatgtgaaatggaaatgaaaacatggcatgttttggaattcctgattctgcttatttgctttaatagcagatcattgcataaacactgactcattgcattctatactgaaaggaagatatggtttgctgtgttcaatctggtctggcttccagaacacagtatagaacaagtgccagaagaagggatgagctcagctttataggtgactggagagatacccaattccatgttttgtgctgtacaaacacatgaccttacatgaagttttgcataaaatattgaaacaatacatttctctttataaatatgtatgtaatctgttctagagtgtatggagtagacagtaaaaaaaaatagaatcttcttatttttggaagtggggtgaagacgcaggtgtgcatatgctgccacctgcgtgttatttcactgagttttgtcaggttcttttcttactcatctgcactttgtatgttaccttaagcgctgtaaccattctaagctgccagggacatgggtatgcaatcaaagtcaacactgtgattaaaaccacctcctgttgtttacctttttagaaattttaataatacagtcaagtctgaaagagcagaacttttctcaaagctacacacttggttgcctcttcttgattaatgcatgggggtggtcactgtaacctaaggtctgacagatggtgcggagattgatgaagttaaggcctgttaggtattccgagtgtcttataaagaaaaataggctaccttaattcaaattgttgttgctcttccaaccttctcttatgtaaactccctgtatattacaatgacagactctctctctttctgtctcacacacacacacacacacacacgcatgcatgcacacatacgcacactcctgacatgctctactgaaagctgcccagctacagagaggtgcgaatctaatccagggcacatggctgctttgcatttcactggctgtctagtgtcactctatgatataggcataaggtcatgactgtgagctatcattgtcacttatcttaatattaaaacccctctgatccaatctgtctgccttatctattacatcattcacatatctagattcttcaaacttaactactcattgcagcaaactcaggaatgccgagctctaaggcatctccatttacttcgttcatctcaatctcaaattactaaccatagttcagtttcaggatgacactgaaaattcaaaattacttcctgtgattaacttacattgtgatggttgggaattatttcgcagaagacctgttcatcttctgatgaagcccttttcaagttttgaattgtgtgtgtgtgtgtgtgtgtgtgtgtgtgttttaattgccagaagtctttcagatagcagggagattattggaatgagaaagcaaagcttgtatgaaaacttgtggcaaaaggtcatctgtgctgtgggggaaatttcaaagtaggcgcagtttgtttccagtggttcctgcctgtcctttcagtggctggtcactctctgttccctttccagacgaatctttcccctcttccaaatgcctcacatcagtctaggtaccttggttggcctgtggagaaaaacagtcttgttgagacactcacattaagctgatagagaccttggctaggataattgcatttttcaaaggctaagggttggaaggatttaatttttctcttaattattttttatagagatgaagtctcactatgttgcccaggctggactcacactccctggcctcaagtgatcctcctgtcttgacctcccaaagtgctgaaattacaagcatggcctgaatttttttaatggtgatttcagctgatcccaggggagatcttttgggtgtcatttttcaaacagattaggaagcaagcagctgtctacctaatcagtctaaactacccattctgacttctgtccaataactttccatataaaatagctaacataataataatcagataactttgcatgtaagtttcaaagctatggtatagttcaccaacataattttccagttttttttattatagtaaagtacacataacataaaatttactgtcttagccatttttaagtgtatagttgtacattcatattgatgtgaagccatctccattgtcttgtcttcacacctctttttttctggcaaaactgaatctagacccataaaatactaatgctctaccctccaccctagcccccggcagccaccattctacttgctgtctattattttgactactgtaagtggctcatataagtggaatcatgtagtatttgtccttttgtgcctggctcatttcactgagcataatgtccttcaggtctgtctgtgctatagcatgtcagaatttccttcctttttagactgaataatattctgttgtatgtgtagaccacatttagcttatccttcatctatcagtgggcacttgggttgcttccacctttagtttattgttaataatgctgctatggatatgagtgtgcaaatatctctttgaaactctttgaaaccattcatcaactctctctttttcttttttttttttttgagacagagttttgctcttgttgcccaggctggagtgcagtggtgtgatctcggctcaaaacctctgcctcccaggttcaagcaattctgttgcctcagcctcccaagtagctgggattacaggtgcccgccaccacaccaggctaattttgtatttttagtagggtcagggttttgccatgttggtcaggctggtctcaaattcctgacctcaggtgatctgcctgcctcggcctcccaaagcactgggattacaggcatgagccaccgcacccagtcttcaccaactctctttcacgtctttattagatacaagtgtttgaagaagccttgcatctacccactttgaaccttttttcatgatagaactgtaggtagactttctgcctagtagtgttatttgaagcatcctttctgctgacctctttcctgaggcctgaaatgctactaatagtagttcagtcctcaagtatcaagcaaagccatcagctagttttctattaaaatgcaaatgatcctggggcagaggccacagataagatattagcaccttggtgtgaatttgtttaattagatcctatcttagaagctttctttaaccccttgcctagttcttcactaattgctccctgataaggtcttgcattattactgcaagtatcacactgtattaaacttatttatatttttgcttctcctgatagaatagaagcttcttaagggcaagactcttgtataattgctgttggtttttcaggccctaatagaatgtcacagacaactttcaataagctactcactcattctttcatgcattcattcattcatttcactcatttattcatcaagcatttattgggtgcccacggtgtaagtgcattttaaaactctgcctttctagaaggtttggacagccaagggccagctctgttgcacagttttggcagattttagaaaccttaaaatctaacttcctgtatttttaggtgcagggacttggtccagatgagtggatcaacctctgaaatagttttctatcacagtcctaccttttttttttttctgcttctattcagaagaagcatcgatctaagtaagtttgtgttctgttcaaaagtaaggtgatgtttcaatgtatattctcaagcatctgaaaacttctctagttgctctaaatctcaatatttccaatatcagccatgtacagtttttaaatgcttgcattctcttaggacattgttaacaatctgcttagaaaggggagtgacttttgcctcttttggctaatttgctttgcattgatttgtaactgtgtacttcagtatataccagcaactcctagcccagggatagcatatactcgcttactggttccagtgactgttcattcatcccacagtggcttccctggaaacaagttactctgataacaatttgatggtacttccctttataaggtaataaccagtccgggccaggcatggtggctcacgcctgtaatcccagcactttaggaggccgaggcgggcagatcacgatgtcaggaaatcaagaccatcctgactaacacagtgaaaccccgtctctactaaaaatacaaaaaccaaattagccacgcgtggtggcatgcgcctgtagtcccagctactcaggaggctgaggcgggagaatggcgtgaacctgggaagtggagcttgcagtgagccaagatcgtgccactgcactccagcctgggcgacagagtgagactccgtctcaaaataaaataaaataaaaataaaaataataataaaaaccagtcctaaaccaaattcttactttagtctctagcctcagagtttattagttcttagtaatgttactatgaaggcaaataggagacaaattattattctggtttttattgttactgccactgcaattcctatgattattgctataattccctatttaataggtaaacaagttacaacatattcgatggtcactagatagaaatagaaatggaatgtctttaccaagagaatatccgtgttttacagagaacaggaaacaagtactaaatggaatcttcagacaatcttttggtcttcttgtaggcagtggttcagcttttttacctactaaaattttggacagggttgttaacaggcaatacagtttaaaatgaactgttttaagttttcctttctgactttttcatactcctacattaatgcaataggattgaaggctacaacaatgataattgcaatatgctgaaataatgaactacagtaaatagctatagtgaatgtatgcccatagaaaagaatggaaaacaaatggcttttgattaaaggtacttattgtaacagatttcaaggtgaaattgttagttcagaaaagatggtagatagagtctttaaaaatactgtcactgggatgcgtgttcttctataatgctccctccatcccccacccgaagaaacacacactcctccctcctctgcatgtaaagcagtagttttgacaaataaaaccaaacagtaaaacctgacactggtgattggaccgtgcgtccctctggtttgtggatgaggagcatatctccgtgatagaataaccacgcttcatgctaactcccggccacatcgctgcatcctcttcatacataatttgcatcatggggtgtttctgcatatgttgtgcattttgatgttatttttagctacaatttttaaaacaataacatttttttaaatagactaatcaagaaagcgcctccagagtcaagaaaacaagtgctggggatgtgtgggtgggggtctgtctccccgcccagggcatttccctttgctgctgttgttactactccttccattactttttgtgactttagctttttgaaatttccattcctttgttttcccttgtgcatcaggatgtggctgttgaagtcatttatgttatgcgaggctgcaccacagtcatttaatgcaaacactggcttttgtgtaaggcactgactattctaccctcagcgaggaagacgttattggaaacttgagttatgagatggaaagaacattaatcctttcattgaaaacattagtcttttacatggattctctgtaatagcttgaagagaaattaaggaaatacaaactagtaatattaaaaatctgccatgtcattattatctacctgcccatagatgttcaccaccgttagcatttgagtgtgttttcttccagaagattttctatggatatatatatatacaaataaatacatgtagctttacagaaatagaatcgtgcttgatctacttttccgaaatttcttctctcacattgcaaaagttgtgaatgtctttccatctgaattattacagattttcaaaatatttttctggctactgacttttccagtatatgaatgtaagagtgaaagttcttcgatttcaccagttggatatgcccccttttctcttttctgccaatatcaattgtactgccctcttgcgctatcctaaatatgatcagatgagaattctgaaagagaagaaatctaggaaccctacttgatagagagttatcctcttgggttccctcctgacatttaggcctttttttttttttttttttttttttttttttttgagatggggtctgactctgtcacccagactggagtgcagtggcgcaatctcggctcactgcaatctctgcccccgcctgggtacaagcgattctcctgcctcagcctccctagtagctgggattacaggcacctgccactgcgcccagctaatttttgtatttttagtagagatggggtttcactgtgttagccaggatgttctcgatctcctgaccttgtggtccacccgccttggcctcccaaagtgctgggattacaggcatgagccaccgcgcctggccacatttagtacttttaagaagttattcctcttccatctcagcttcctggacacagttcgctatgacttttcttggaaattatgcattcccttagaatccttgtattttctgtttactttccctcaaagcaaggactcatgacctcacctgtagtgggcctccccatctctcatgtctttatgtggcccggacttagcagagacacctcttggtacatcattttgattgcatcatgagctttcccagagtctggagtgactctgtctttcagatttcattttaacctcctaatcacaggctatctttgatgcacctatctttacctccagttcttctgctaaagaactggaggcttgtggctcttgtcttccggtcaaacatgatgctctgctgactactcttccccatgcattcatcccaccccagaccctgcccttgccctcatccccatctgaatcattgcatcctcctagttcttggccaaaaaactggctctcctctagcccttcaaaccttgcctgggagtcatctttatggcaccttccctgattttttgttttgttttgttttgtttttggaaatggaatttcactcttgtcacccaggctggagtgcagtggcacgatcttggctcacggcaacctccgtctcctgggttcaagcaattctcctgcctcagcctcccaagtagctgggactacagacacctgccaccatgcccagctaatttttctatttttagtagagacggggtttcaccatgttggccaggctggtctcctgccctttggtgatcaacctgccttggcctcccaaagtgctgggattacaggcatcagctaccacacccagccgttgcaccttgcctgattaattccacttggctctagctagtatctggaaggacacctgggaggaacacttcaaacagctgtcagtgcagtgttgttgttgtttttgttttttaattaataggcttttttatagaacagttttaggtttacagaaaaattgatttgaaagtacaaagagttcctatattcctagcctccccgacccctgacaaacagtgtccctactgctaacatcttgcatcttacatttgttgaaattgaactaatatggatacattattattaactaaagtctatagttcatgttagagttcattcttcctgttgtacattctgtgtttgacaaatagatgacatgtgtcctaacaactctttgtgctctgcttatttgttcctcccaatccccaaaacccctgatttttttttttttttttactatccctgtagctttgccttttccaaaatgtcataaagttggaatcatacagtatgtacccttttcacattggcttctttcatgtggcaatatgcgtgtaagtttcctctatgtctttttgtgtctggagttggttcctaccggtgggtttatggtctcgctgacttcaagaatggagctgcggaccttcatggtgagtgttacagctcttaaagatggcatggacccaaagagtgagcagtagcaaggtttattgtgaagagcaaaaggacaaagcttccacagcgtggaaggggacccaagtgggttgctgctgctggctgtggtggccagcttttattcccttatttgtccctgcccatgttccatttctgttctgtcagagtgccctttttttcaatcctccctgcgattggctacctttagaatcctgctgattgatgcattttacagagcactaattggtgcgttttacagagcacttattggtgcattttacaaagtgctgattggtgcattttacgaacctcttgtaagacaggaaagttcctgattggtgcattttacatcctcttgtaagacaggaaagttcctcaagtccctacttgacccaggaagtccagctggcctcacctctcaatcccccctctaaacaggacaccccagctgctgttgggaactgggtgatgactgctctagctacttcctgctggataggggtgaagaaggggccctgcagttgtagtgccctccagaggggaacactctaggccaaagggctggtgggtcagtccaggggtccttggtagaagttgtgagttgagctcatttggggttccatttgtaagaccatctgtagcttgatggtatcgatcctggaggaaacaaatttgacaaagaggttaaaaacacagggcccgaaggtgagtaatagcaagatggctgtcatgggacgtagaaaggggagaaaccatgttgcccaactctagaggttggtataagagtttgaaaggcattgtctgatttcagaagccttttcctgtaactgctgggcagcatcttgtactatccctgagtggttagtgtaaaaacaacagtcttctcctaagaaggtgcagagtcttcctttctcagcagtgaggaggtctaggccttggcggttttggatattcactactgccaaagagtctatttgggattgcagagtaaggatagattttgttatttcttgcaaactgtcttgagaaatcctttgagagtgtgtggtagtaggataatgaagtagataaactggctattctggttcctgtagcagtggctattcttaaccgtataagtaggggtattagttgtatggccctgtactgacggacctgagctttgaggggcactgatagggtctgatttcctgcggtaatgttaatgttgggacttaggaagactaaggtacaggtgcctgtccagttagtggggaggcagatgtaagttgaagttccacataagaatatgccttggctgggtagacagaactggttgtgtatgttaaaaaggtgtgtgagtttgttgttttcattttcccatactcctagagtacttgccaaggtagtctggtgagtggctggaaaggggtgttgggagcaaactgagtgactccctgtgctctattttcccattggagaaaaaactgttttgtatctactaggaaccattcaagagagtgattgaaagagaggatgagaaggtattccttagtggtgggggtgctgctgcagggggtccaggggtgaatagtcatacagggagtatgtttgccattacaaaacctggactgtttgttaagcagggaggaggtgatgatttttgggggccctgagaagcggacaagccatctgaatagagcggtttgggtgccttggaagttactatgatcatttggggcttgaagttggagagtgtaattacactgatgggatagtaggtgccccaggggcaggcctgataacaggttgcgttggatgcataacggggcttggaaagttaagatggtattcacggttacagggcttttcattgctcatgtaataggtgaggttggaaatgtaagagcgtaaaagctggattgcatgtaaaaaaggttgatgtgattaggatttttgtcccggcaggagctacagtatatagtcctgctgcaaagagaatggttagtatactgcttaataatgtgatgaaactgtaaaaggattccattaaaggggcaaggagtggtgttaaagattatgtaggttttcacttatcctttttaaataggaaagagtttttccttaggatcagctataggggcctttttagtctgggatgtttccttctgaaataggagacacaaatcttccaatggttcacaggtttatcgaggctggtctggctgatcttgggactcctgagctgatggtcctacaggttcttcagggggtgtccaaagtttaactcgcatgtagtgaatccaagattccactcctgccaccttaactgcagtgggggtagagaggattactgagtatggtccttcccacaaggaatccatagatgaggaggaagaggggagggacttgaccaacagtaaatctcctggttggaacaactctgttcccttgtctctgtgacatcctttgggtaggtttttaacgttttgttggtattttgccaaagaagttatatctttgaccaacttggccgtttcctgatcaagtaggaggtcatttgtgagaaaaggtcatccatacagcacttcatatggactgagccccattttgtgaggagaattttggattctcaacaaggccatgggcaagagagtaggccatgggagatgagtttcttgtgttcgtttccttaagtgcctcttgagtgtttcgtttgccttctcagccttccctgaggattgtggcctccaggcacagtgaaagtgatattgtatccctagtgccctggaaattccctgagttaccgtggctttaagagccggaccattgtcgttttgtaagctttggggaagcccaaatctgggaattatttcatgagttagtactttaaccacttcctgagccttctccgtcttgcaggggaaggcttctatccaatttggttggtcaacacagaccaacaagtattgaaatccccttgacttaggcatatgggtgaagtctaactgccagtcctctccaggatagtgacctattctttgttccccaaaaggggccttacgatggaccaagagatttttcctttggcacacctcacaggctttgactacttgttggatggtctggaggagatatggccccataaatagggatttggccatttgatgagtgttctcaaacccatgtgaaaagtttggcagggggtcttaagtattttccactggctggcttcggatatgagtacctttccctcttctgccgttaaccaccccaaggggagaaaactatgcccccgtgaaagtccccattctgtttcgatcagggagtactggggcttaatctcttggagggggttgttccataccatgggtccttccataggtatttctaatgggaggttctgcctggcagcaattttggcctcagcatctgcccagtggtttccttctgccttttctccttcacctttttgatggcttcagcagtgtaacactgccacctccttgggtttttgcactgtgtgcaataactccataatttccttgtggtatttaatgggggttcccccagaggttaggaactccctttctttccatattgcagcatgggcatgtaggattagataagcatacttgctatctgtatacacatttattcttttttcctttcccggttctaaggcttgggtaagttctgctaactaggcgctggtccgtggggggaagagacttactttcaagtactgttacatcactaactatggcataacctgcccttcatatcccattctccacaaatgaacttccatcggtatataggttaaggtcaggattagctaagggtacttctaagagatcctgttgggaagcataagtctgggctacaatttgttggcagtcatactcgattggttctccatcctctgggagaaaagtagcagggttgagggctgcacacgtgtgtatttcaagcaccagtccctgaatgagtagcgcctggtacctgagtaggtggttttctgatagccataaatttcctttggcacctggtatgccatttacatcatgagtagtctagatggtgagatcctttccttgtattattttgatagcctctgacactaagatagccactgccacaactacccgtaaacagtgaggccagccttttgctactacatcaatttccttacttaggttgtggggttccttccttactggttgtggggttgtcctacaagtctgagtaaggactccaagagctattcccgctctctctgtgaggtataaagagaagttttgtcctggggaaggcttaagtcttgagtttgtactagggcctgctttaaggttttgaaggctgtttctgcctctggttcccattctactagatgaatatttgccctctcggtctccttgattagagtatagagtggcctggccatctcgctgtatccggggatccatagtcggtaaaagccagtgatcccaaggaacccccacaactgttttaatgtgttagggcaaggacaagccagtataggctgtatttgttctttgctgagggccctggttcctctggctaggattaggcttagatatttgacttgttgtaggcagagctgggccttcgatttagatgccttgtacccttgattagctagaaagttcaagagatctagagtagcctgctggcatgaagcttccgaactggtagccaaaagtaaatcatccacatactgaaggaccagcatgcctggacttgagaagtggcctagatcttgggacagtgcctgaccaaacagatgagggctatccctaaacccttgaggcaagaccgtccatgtaagttgggttttgtggtctgtgggatcctcaaaggcaaagagaaactgggagtccaagtgcagaggaacgcagaaggcagcatccttgaggtccagaacagtgaaaccattctgcttcctttggtatttgagagagcagggtataggggttgggtacaaccggatatagaggaattacttcctcactgatgagtctaggatcttgcactagtctccactgacgattcagtttttgtactcctagaattggggtgttgcaggggctactgcattttcttactaagcctcgaacttttaaatgtataacaatatcctgtaatcctttatgagcttcaggccttaagagatattgcctttgataaggaaaagtggtggggtcttatagcctgatttggactgggtgggcattttttgcctttccgaattgtccttccaatgcccagacttcagggttgattccctcctcaagtaggggacaacaaatgggtaacttgttccccatattcatatagttaatggctccagctttggctaatatgtccctccctaataagggtgtggggctttcaggcataagaaaagcatgtgaaaagagcaaagtctcccaattacaactgaggaggtgggagaaatacctggttacaggctgtcccaggattccttggatggtaatggatcttgaggacagctgtctggggcaggagattaacactgagaaggccatgccagtgtccaggaggaagtcaatttcctggccctcaatggctaaacttgcccagggctcagtgagggtgatgacatgagctggtgcttgcaccaggcaccctcagtcctgttgttggatcatctggttgggggcttctggcccggagaacctttgtcctctggggcagtaccccgtctagtgattgccttggcatagtggacatgggtgagggagtagcttgtttcttgttggacagtcttttttaaggtgtccttgcaaaccacactgataacaagccctactgggtgattggcctgctccattttctgtcctctctgaaccaccaaggtttgtttgtctgagggccatgactgaggctgcggcctttctcttatctcgcttttccttttctgcctgttcctcttggttcctattagagaacaccgcggttgccaggtttaataatgcctccagattttgttcagggccaagggctcgcttttggagctttctcctgatatctcagctgattgggtaataaacatcttttaggatcaattgaccctcgagggagttgggtgacaggggagtatattttcttaaggcctcccatagctgcttgaggaaggcagtaggattttcttcctttccctgagttatggtggacatcattgaataattcatgggctttttcctaattctccttagtccttctggaatacaggtcaacagatgtttgcgactccagttcccatgatctgagtctaggtcccagtggggatccataatggggatggcttgctgcccattagggaatttgtccctttcttcggctgtcattttgtcatttacttgactaagataccaggtatctccaaattctcgggctgcagctaaagctgcattcttttcattaaaggccagggtttgatctaacaatagcatgacatctctccaagtgaggtcgaaggtttgccctggaccctgtaggacatctatatacctaccaggatcatctgaaaactttcccaggtctaccttgatctgctttaattcagagagagagaaggtcccatgttgggccaaattcccctccccctacagcttaaaggagacataactgatagcctgaggggtttggtggtcctttggaaatttctttgcttgtttccttctggatggaggagattagaggaggctcatcattaataggaaggggagctgtagggaggctaggatatggaggtaatctgagaggtcctcctgtggaatgtaaatcgccagctttgcatagttgtggattatccttcagtaaaaagaaagcttggacataaggtatttcactccatttcccttccctcttacagaaaaggtcaacctgcagaatagtgttgtaatttatacttccctcaggtgaccatttttccctattagagagataatattaaggccagaccgtagtgcagaaaaaataagccgcttctttttcagggtttgcgggacaaattggtcccaatggcttaggatgcgtttcaagggtgagcttgttgatgcctgggtgtttcccatctgaaagaaaaaaccgcctgcagttttttttttttttctcttctccctgcccaagaacccacaacagtccctggatcctgctgttcggaatagctgtgctcaccaaagcagcagcggaaacactagttttcctcctagaccacaaaaaggactgaggaaggtcagatttagtggcccttaccaatggattctcaaaaacctgcacccttgcctttcgtctttagaccacaaagaggactgagaaaagtcagatttagtggcccttaccaatgcattcttgaaaacctgttagagtcctaagtgttttctcctgttgttattaggaccttacccttgtactataaagataatatgcctcaaaatggagtggagggccataccctgagggaaggaagggatctccagggttggaagagtgatgcgttttgtcctcacttatcatatgaataggaaggatataatttctgagtctcctcctatcctagctttgggaatagcctttgttaggtctgctagtctgaggagggatcctaaaattccagatagtcccccacaacagggctttggacaaaaattatgtctttctgattggtgagcctgggtgcctaaagaagggagcagagtcctgaaatttatattagaaatcatccttataggagaaactggaagagcaccagggacagggagtggtttttagaagcaagactaaccttggagaagagaggcgggagaaagtttgtctgacaggtgttaggacccaggaggcaagggtcaggatagataggatagatgggtgagtcttgtttgggctatgtaactttgagagttctgctcatggctgcagggccaaccaactttttgttgagaccccggagctgaatggctttcctctctgtcgaccctaggcttagcccggaagtgcaggaaaagcagaagctggttccaggcaaaccaatgctcctgactccaaacagtcgggggttgttagtgagccctttcccagagagcctgacatccatgtccttagtcctgtggccatgctagttgcttttaactggctgacaggtgcctagttttagcccctgaattctaaggaaaaataggacagaatagcaagcaaaaggggtctgatggtactcaccacgttgcaatatctgggaggatcccccaagatgtgtccagagttggttccagccggtggattcatggtctcgctgacttcaagaatggaggcacggaccttcacggtgagtgttacagctcttaaagatggcacagacccaaagagtgagcagtagcaaggttaactgtgaagagcgacaggacaaagcttccccagcgtggaaggggacccaaatgggttgccactgctggctggggtggcccgcttttattcccttatttgtcccctcccatattctgtttctgtcctatcagagtgccatttttttcaatcctccctgcgattggctacttttatactcctgctgattggtgcattttacagagcgttgattggtgcattttacagagcgttgattggtgcattttaccaagtgctgattggtgcgctttacaaacctcttataagacaggaaagttcctgattggtgtgttttacaatccttttgtaggacgggaaatttccccaagtccccactcaacccaggaagtccagctggcttcacctctcatttttatggcctgaaagcttatttgtttttagtgctgaataatattctattgtatggatgtaccacagttcatgtacccattcacgattatgaatgaagctgctataaacatttgagtgcaggtttttgtgtggacttaagtttttagtttatttgtgtagataccaaggagcatgcttgccacattgcatgttaagagtatgtttagctttgtaggaaactgccaaactgttttcccaagtagcttactatttgcattcccacccgcaatgacttgagagttcctatggctctgcatccttgccagcatctgctgttggcagtgtgttggattttggccattttcataggtggtatcttgtgtttgttttaattcacagttccctagtgattcataatgtggagcatctttttatgtgcttacttgccatctctatgtctaatttggtaaggtgtctggtcaggtcttttgtccattttaaaaactgggttgtttgttttctaatagtgaagttttctacagctctgttgtgtggttacttcttttttacatcaagatgagtcttactacctggttagattgggtgttacttgtagagatgctctccttccttccttctgtctcctagagcatttgccacacttcagatcctcagtaaatacagtcttcccaacccaatgcctgccacatgtttcctgacctcaagttcatatatcctctcgcattccctttactcctttccatacataacagtggtggtcactgctgagtccccctgaaggtgagcttatctacctctttttatatccaagctgcttaattgctataatatccaagctcccagatcacagcttttagttctttttctgaatctgaactggtgataagattaagaaatctcttggttcttttgcattaatttcttggttttgctgtctactataataatttaatagcatattttaaaaatgtttctgatggctgtttagttttgtctgctgactacaaaggttgttttgacctcatcttgctgacctgccaaaagcactaagtctatggcagtaagagagtggaaagtctgttccagtctctgtataatacaattacatgtactgtgtagcaataataattaacatgggaggaaatcagtacaaattagggatattcctgaatcattggctacactgtagataatgcagcttctcaagccagtttgttacaaatgggctacaggtatatccaagtatggattgcctcagccctcaggcagccttgacccctgaggctacagagcccctagcagggggggttaaccatttatgcaattatgctgctgcccagatgttattttctatacaagtagttcctttagagagagcaagtgcaagccccaagcactggcacaatatggagtggggaaaacaatgattttgaattcagaagaattcagttcctggtcagctctctgatggcagggattttgtctgctcagctcactgctctatccctgtacctaaatcagtacttggcacactgtaagcactcagtaaatatttatcgatctaattcttctgtttttttttttttttttttttttttttttgagacagagtctcgctcttattgcccaggctggagtccagccatctcagctcactgcaacctccacttcctgggttcaagcgattgtctgagtagctggaattacaggcacgtgccaccatgcctggctaaccttttttgtagttttagtagagacggggttttgccatgttggccaggctggtcttgaactcctgacctcaagtgatccgcctgactcagcctcccaaagtgctgggattacaagtgtgagccatctcgcccagcttcgatttaattattgaagcatacttgaattcaagcatgttacttaatcctctctgcacctcattttccagaattagaaatatagtttattcctatacagcagatataaatttatgtgtagacagttgggctgttgttgtaacctaaaagtgacatatgcacaacctgtagcacaatgccaggtacagagtaggggatccagtgggttctttcttaccctctttcatttgaagtttttaaagtatcaggtgaagatgatgatgatgatgataatgataatgaaagtgatattttttgcatacatttcagtaaagttcattaccttacactgatgtaatcctcagagcaattcttagacaattatggttttttaccccctctttattttattttatttttgagacggagtctcactctgtcgcccaggctggagtgcagtggcgcaatcttggctcacttcaacctctgcctcccgggttcaagcgattctcctgcctcagcctcctgagtagctgggactacaggcacctgccactacgcccagctaatttttttgtatttttagtagagacggggtttcaccgtgttagccaggatggtctcgatctcctgaccttgtgatccacccgcctcggcatcccaaagtgctgagagtgtaccccctctatcaatgatgagactgatgctgagaaaagtaacatgattatgtaagattacacaagtgaaacacaccaaaaacagaccttgaacccagtttttttattttctcacgtcaacttttcctccacaccaaatctaataaaattttataaagaattactttaaagactaaatcactttcgactagcatgttgtctggatgcaaatgatggtgataaagtaagtttaataatgcttaaaggaggtaaacaattcctaaaccttttaaaaaatctagtcagctaaagtaggtttacgctaaactttcatcagaatccttaaattctaaatcttgaacttttaaatcagtaatagagttttaatgtgaattaattgtctgtaacattttcaaaagataaaagtgataaatgcacaaacctacctgctattataaaacttgttgtggtggaatgagacaagaatagatgtactataagaacaagagggatatgaagaggcaggtttatgtcgatacttaaaatacatttgacgccatccttttgacaggaaggaatgtctttaaaatctcacaccagtgagagtgggaaaaaaatcagccatatttctgctttttttaccctttcattggaatgctcagtcacttggtctactctggttttgattcacaaatgagttttcagaaatgactgtcccactggctttttaaaagaaaaattcagtttttcctctgaagactgacacacaatcactcagagatggataatcctaaatgttttccttttccagctgaatttaatcttatgctatcaacaaaatctggaaaggtttactttctcatatcattcattactagttatgaattctgaaccgtatttgtaacctgttcatcacatattcatccctgcatgtattcattccctaaatatttattgaatgccagcaatacaccctgaactcggagaaaacataatctttaccctcaaaaagctcacagtctggtgctcagttgaccaaacatcgtgtttcttttctaccgagttgcaggtcttctctctgtggatgtcattgaatgtcgtttgcagaattctacttgctatagtaggcatctgtcttgttcatgagccacattacaacctcgtgtgttataggcaaaaaggcaatctaagaacggcctgacattcggacgcctaaggggacttccctagtgagggcacaagacagacaaatcccagaatattttctatatgcagaggaaacttctctggcatcttagaaagacaaagacagcaagactgaagatagaaacaggaggatagcaaccttttaaacaacttgtttttgtgaaatttgtttctgtttgctttgagaatgggggaaaagagaactctaattacaaactccacgtttctttcaactatactattttctttctttttttttttttgagacggagttttgctcttgttgcccacgctggagagcaatggcacgatcttggctcactgcaacctccgcctcctgggttcaagtggttctcctgcctcagccttctgagtagctgggattacaggcatgtgccaccacgcccggctaattttacatttttagcagagatgaggttcctccatgttggtcgggctggtctccaactcccgacctcaggtgatctgccggccttggcctcccaaagtgctgggattacaggcatgaggcactgcacctggcctttttttttgagacggagtctcgctctgtcgcccaggctggagtgcagtggtgtgatcttggctcactgcaaactctggccctcgggttcaagtgattcttctgcctcagcctcctgagtagctaactaatttttgtattttcagtagagactaatttttgtatttttagtagagacagtgtttcactgtgttggccaggcttgtctcgaattcctgacctttggtgatccacccacctgggcatcccaaagttctgggattacaggcgtgagcaactgtgcccaaccagttatactattttcaatcctatataatttgtacagctgaagtggcaactgcttgcttttaaatgggaagagaagatgtccccatttaatgcttagaaaagattgacttcggtttaagccaaaggagcatcctggagaaccgaatgattcatgattagtaattctcaaggaatggccatgtggctcttcatagcgttggcccttgggggggtctactttaatctttgttctaacccccgccgcccctgttgtccttttaatcctcatggatcaggtgcgttcacagataaccactaaagtgaggctgaaagaggttaggatggggatggacacctgtatttctgagaggacctctccatgatgtttaggaatggggttgacatccttcacctagaaggtcctttcccaagattggacattgattttggtcgctggagcagcctcatcagcatttctacaaggtccccagaagggaggaagctattcattgaatacttcatatggaggtggttttatgttatttttatgagatattaaggaatcttcagaaactcatagcatctccatgttgcagataaaagaggctcgatggaatgggagtgagtcagttcagagttactctgctaataataaacgtgctggctttgaacctacgtctctctgagtaataagcccctgccctctcttccaaagcacattccttcccttgaatcagagagcactagatgggaagggtgatgggagctacattatcactggcagatggaactattcagctcctgtccttccattctctaagaaccatgcatgtgtgtaaacacatgttgcatcagtgattgttccaggctttgcctacttgctcccaaacatgtgaaaaagaagaggaagattaagtaagtcattcatatattacttatatctgagtgtttgcaatcatataggggagcatagttcccacaaggaccggtttttgtaaacttttgcttctctttcctgtatttaggcattatatagctatggcagtgatcacccacaggtacaaattctgtatcattcattgcctttacttggaggtttacaaatatttttagtctctacttctttttcaaacacaatcttgaaacctcaacatatgaaacgaataaaggaaaattttgttagcataatgtatgttagatttcagcgtgtaatgctgacttataaaatcaagaagaaagaacaatgaagctttgtgatgaacacagaaatttgaaagcagtgttagagatgacagctgcaatcttctttaacttcagtttccaatttattgccttttgttgttaggtatattttttatgttgttgtgcagtattgagaaaaccctgattccctaaaataaggagttgcaaataataatgagttgttttatttttttaaacagttaccttgcaagctcaggatatgttttcctttaaacttatccacttaaaacgtgttcacttaaaacaaaaggaagaaaagaaatggcttctttcaaagctgatatcgctaacaatgtgaaaccatttacattttttaattggtaagcctgcgatttggaggaccaatgatagcttcctctagcctaaatcttccattagagggagaaaacactttttaaattataacattaatgagatgctcattgatgtacttaaaaaacaagaagaagaagaaactcataagcctgagggagggctcatctctttcaattttagaaggaagaaattgtctttgctttgcatggtgggtccaatcttgaactttagatttaatctctgacattggctaccataagcatggtatgtctgacagtttaatgccaataatttaattttattacaccattttatactacatgtttatttattacataccaaaattcactgaggacaagaactcagggtgttttgtctggtcttggccgttaattgtccatgatacactcatgctgtactagggtgctcacttgtgaaatttcatgcaagtggacgtagggagaacttaagtttatatgtttaaaaaaagcaatggtagcgctacaacctttctacctgagaaacaggatgtcactgagatgacgggatacctttattttgagatctacacaagcctggcagtatggtctggcccattagtagttgtggcaatgccaggatggaagttacatttgattaacggggtaactaagaatctaacttcagaagaactcttgctatcccctttaaccctcacaacaacagcaacaaataaatcagttggcaaatcttgaagatgtagagccttactaacaaaatggagttaagaaaacccttcatgcaagcaaaaaagcttgatctctgctagggacatcaaaggtgcagtggtgtggacgtccagacacagatctgatgtaggctttcctcttgggccttagcctagctcagtggttttcaaattccactgtatgtgagcattgttgcacagggtggtataaacaaaaactgtatatagtgtccttgttgggcaatgtaagacacttttatttattgagccaatacttacagagtgccttctctgtgctaagactcataggtgctgcagtttgagcaaggatgaagagaagtcagttaatgggtgatacaaaaatacagttaaatagaaggagtaagttttaggattcaatagtacatatcacttgtacccccaaaatatgtacacctgtgatatatcagtaatgaataaataaggagcatcattctagcgcaggaaacaaaccaacaaggactttgtggtgtaacatcagctgtgatgaatgaagagaagaatcagaggggcgagggaagagggggcctgctcttttagacaaggcgaccagggagggacacatcacagcagagacctgaatgaagagaactcatttgccagaggagcattctaggtaggaccaggattgtgcctggatgtggaagggagtgtggaggccactatgctggagcagaacatagggaggagatgggcaggaaaaaagaggaggagggtttcacatagttggggtcagatcatgtagggccttctaagtcttgacatggaccaggactgtggtttttaccataaatgtaataggaagcattgaaaggtttgagtggaatggtattaggatctgatttgcaccttacaatttcaaggatacttttgaacccacacactctgcattgggtgggaactttagaccctagcccctgaattaagtgttattctactatatggcacatggagagcttttctgaaactacagttacttaataatgagaaattcaatttaaaaataaaacgcagatgctctgaagcccgttggtagaatctttggggcttttaaataagtttaaaagctacaagcttcaataaagattaaattagaaatcctatataaagcttctaagagtgtaactagcattttagtaatgcttactaagtgctggttctgtccctttctgctctcctattttttttatcagcgcctttgctattaggccaggcgcagtagctcacacctgtaatcccagcactttgggaggccgaggtgggaggatcacttgacgccagaagttcaaaaccagcctgggcaacatagtgcgattctgccttgataaaaaataaaaataggcagggtgtggtggctaacacttctaatcctagcactttgggaggctgaggcaggtggatcacttgaggccaggagtttgagacaaacctggccaacatggtgaaaccccatccctactaaaaatacaaaaattagctgggtgggtggtgggcacctgtaataccagctactcaggaggctgaggcaggagaatagtttgaacccaagaggccaaggttgcagtatgctgagatcatgccactgcactctaacgtgggtgacagaacgagaccctgtctcaaaaaaattaattaattaaaaatttttaaaaaatacaattaaaaaatacctttgctattgatgtctgtttctgattgtctgtcatcccggtacactatatttactttccagggaaactgagtcattcaacaagcctctggcttctagtgataagcactatcattagaaagaattatgttctgtgtgttaaggataagggacacattctttttggaaaatagtgcttgtgagtctaggaatagttgtataatctgggaatatatgctaatgctatagctgagttcaaatcacttttttaaaaatgcaaacttatcttctctgtcaccaagcatgtcttccatacaaaaggcacatttctgtagcttcatccatgttactctaggctatttcctctagtttattaaccacacgctcagcaaactgtagagagtatggtctgatccctttctcccataataaaaattttaagactatgtacttgttgatagatgacaccaacaggatatattttacagaaatgaaacaacaacatgtgaagaatattttaggtcactgtaaagttcctttaatagaaaaaaaactttagatttaactgttaaaccctttgaaaaagaaataatttatttcatgcaaatgactaaagcaaaatggagtgtgcagaagacctacctgcatactgtatgtaaaatacagttttctgggcttcactcccaggaattctgattcacaaatctggggttgggcagctttcaattttgagaagtgccccgagtaagctgatgtcaggaatgtgaattttaacaggcaccccaaaggaaggctgtgggaaaccacatttgagaaacactgccaaattaccaaaggaactttaactttgtgttatagaaatatcaaacacatttaacagacacttctcaaaagaagacatttatgcagccaaaagacacgtgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgcaataaagacacatgcacatgtatgtttatggcggcactattcacaatagcaaagacttggaaccaacccaaatgtccaacaatgatagactggattaagaaaatgtggcacatatacaccatggaatactatgcagccataaaaaatgatgagttcacgtcctttgtagggacatggatgaaattggaaatcatcattctcagtaaactatcacaaggacaaaaaaccaaacaccgcatgttctcactcatagatgggaattgaacaatgagaacacatggacacaggaaggggaacatcacactctggggactgttgtggggtggggggaggggggagggatagcattaggagatacacctaatgctagatgacgaggtaatgggtgcagcacaccagcatggcacatgtatacatatgtaactaacctgcacattgtgcacatgtaccctaaaacttaaagtataataataatataaaaacttaaaaaaaaaagaaatatcaaacacatttgaaagcagagaggtggtaaatgaacgcttttgccccaccaccccattcagcagcagagccaacatcgttttctctactccacctctgcacctggattattttgaagcaaattccaaataacagtattccctggaccttgcatcttcataacagattgctgttgactcaaaatatctataaaatattttactatttctataaatgattaggattcttcttctcatacacaactacaacatcatcatcacaccaaaaaatgcattaacagtcatttctcaatatcatcaaatatcccgtcagtattcatattttcctaattgacttattaataagttttattttatgttgtaggattttttaatagtttatttgaaccaagatccaaataaaggtcatttcggtctcctaaacctcttttacactactcggtatcacctatgtcttttttttattttgcagttttttctgttgagaaaccagaccatttgtctggtagaatttcccacccgtctgggtttggatgattgcctccatgtggtgttgctaagcatgtccctctgtctcctgaatttcttgggaattgctaggaagttctagaggcattgttttgtttgctttgctttgcctgactgcttcatagttggtgttgtgttgtgtatttccttcaggaggtaatggttggtggcatctctttttgcagtgagactgtcatctgaattcataaatttatcagggattgcaaatagtggtagtctaattctattattatttgttcatttgttagcaggaattattgttcatgaagagaaactccttgcatctgtaatttatctacccggtgcttcaggttttgtaggaaaagcaggataatatactagattctgtctatttaccaatttgcacgatacagctagttcacagtgtcaaaccaagtcactgtgttttgaaagcatgactgtaaattcatagattgcagcatatctgttgtgtttcagtccatgacagtgattaccctttttcatgttcagatggtcccctgtctgagcattgggatcctattcagtttggctactgagtccttttaatccaatactggctgtctttgatagttttcttgctttctagtataacactatgttccaggctcatcttgtacatttcttgccttagctctgggatcagcttttttccaaggagacctggtttctttcagtgagaaatgatatttggagaccaaagactgggccccaggggaactgttctcactgggttgaatattgtttttcctttccagtggacacagccagtgataggaaatctgtgtctctctagatatagatatagatcgattgtgtgtactttttttttttttttttgagacggagcctcgctctgtcgcccaggctggaatgcagtggcgcaatctcggctcactgcaagctccacctcccaggttcacgccattctcctgcctcagcctcccgagtagctgggactacaggcgcccgccaccacgcctggctaatcttttctgtttttagtagagacggggtttcactgtgttagccaggatggtctcgatctcctgaccttgtgatcggccctccttggcctcccaaagtgctgggattacaggcatgagccatcgtgcctggccgtgtgtacgtattttttaaggtaaaatacctcatgagtttatactgatgtgccacaaggcttttacttaacttcattcattttacatcagtattttctttctctcaaactgaaaatagcagttctcactcacaccaacacaatttactcatttactttctcccacactacacttgcaataatttccgaacaaaaatgccagtgacattgcaacaatatgcttactgaaaatgtttaaggttttttttattttgattgtttagttttgtattggtttttagtccactgggctagagatggacaattacattacaatatgttagggtcatttggaatagttacagtctgtgtgtttatgccaataactggatatacatttgagttcacttactttaatttgagacttcctaagaggcttttgaaaagtgattcttgttcaataattatataaaaatatttaaattttcctgaaacaaaacccacaaaacaaggtgaagtcgttgaagtctgtctttcatgcctgtctgctttattttctcctttttaccatttttaggcatatctttcatttttattataagcaatcatactatttaggtaggtttttttttttttttttttttttttgctccaatagatttatttatttatttagagacagggtctcactttgtcacccaggctggagtacagtggtacagtcttggctcactgcagccttgaactcttaggcttaagcaatccttctgcctcagccccccaagtagctgggactacaggtgtgccccaccatgcccgctattttttttgtttgtttgtttttccagaccaagccttgctctgtcacccgggctggagagcagtggcaccatcttggctcactgcagcctcaccctcctgggtttaagcaattctcgtgcctcagcctcctgagtagatgggattacaggtgtgcgccaccacgaccaggtaatttttggatttttggtagagacggggttttgccatgttggccaggctagtctcaagttcctggcctcaagtgatccacccgccttggcctcccaaagtgttgggattacaggtgtgagccaccatgcccagccttccagtaaaaatgtttagaataattccttaatatggtacccttcttatcccccaaacttttcttagctgttgtttattggtttccaactctgagtgattttgaaattcttagtaccctttctttcttattttcttctctggctataatttgatttaaggtaatatccttttactcccacttaacatctatgttagtgagattattttcgttcctttcatattcttcccgcgtgtttttttttaatcattatactatctatattgtcagggcacatagtcattatatcgttctggctatatgtaatattgtttccttgtaatcatctttcagtaacagacctacagctgattatgtgttaaatgctcacccagtctttgtatcagtgcctttccagccagactggttgcctgactcttctcccttgcagattactaagggtttctgcgaacaatattccttgggtccttgcatattcataacagattgttgttggctggaagatcattttggctgggtataagatccttggcttagttgtctttcctgagtgtcacgctactgacttttagcatgaagcctggctcttgaaaaatcgggtgacactctaattttctgtcccttataggtaactcagtcattttacctgagtgtccaaagaatttttttttgttttctttcctaggtcagtttttccaggtgcatggagtattctgtcaatatatagtttcaaatctttttctacttctagaatttgtgcttcagtcacgattttaagcatttgctgtttttattgcttttcttcttcaaaggctcttattacagtgttatgttgggttttctttgctcatgttccttttctgagtctttctcttgaattctatttctttcctcatttctttttgatgtttaacactttctcctttctattttttagcactcctcaaagattatctgttgtatgtattccctcttgtgttccttcttatttggtcttcatctagaaaatggattttcttttttcgttttcttcaaattctttcccacgttcttttgcctctctctatccaactatttcttttctccaatcacttcatttctgaatgtttttattgggattagtgttcctttatctcttcttactgcctcattttcttttagctcttttgaaatattaaagttttcatctgttttgggggcatgtctctgtggtaagaatgctactctgatttttcttcttataataactgtgcactgtatttgaccacaatcctattttgttactcatttttaagtggaatgagttttcttgtatttttagggataagggatgggccagaaaatattttctagtgtctaggccatagaactccgtcttctgttgtttccatggaataaaataaggcctatattttcttagcttcgtcttctctgcctcccttcacttggatctgccccctcccttcactttggctaaattattactgccatgttcgatttagattctgctctcaaaagtttcttctcaaggtgatttggtcgtggaaggaagcttagatttgttggtctcaagagtgccctggctccgtaacacctaagcacctcagaccttcccagggttccttgccctcaccccatgaattggattctgcaggaccccttgccaatgatgctgctgtgctcaaaatagctcaccaccctgctgaccgtgccgtaaggacctttggaagcttgggagcccgttgtgccaaaaccttcagatgcccactgcctctcctccaactttctcttgcacagatattgcttctgcctggctctgtcactataaatggttcggccacacccattcctgtcttcaggtttatggactacacagtaacctcattttgtcttgatgtggtccatgggtttttggctgtgtaattccaatttctctgtttttgttgttatcattgctattgttactggcagggaggaggagggcagggattctgaaaaatttttttaaactgtgctacctttgacactggtgccatcatcttccctgaattcccgctttaattttttcttttcttttcttttttttttttaagacagggtctcactctgtttcccaggttggagtgcagtggtgctattttggctcactgcaacctctggctcctgggttcaagcaatcatcccaccttagcctcccaagtagctgggactaaaggtgtatgtatgtattccctcttgtgttccttcttatttggtcttcatctagaaaatggttttttttttttcttttacttcaaattctttcccacgttcttttgcctctctctatccaactatttgttttctccaatcacttcatttctgaatgtttttattgggattagtgttcctttatctcttcttacttcctcattttcttttagctcttttgaaatatcaaagttttcatctgttttgggggcatgtctctgtggtaagaatgtgccaccacgcctggctaattttttgtatttttggtagagatggggttttgccatgttgcccaggctggagactcctgggttcaagcgatccacccatttagacctcccaaagtgctgggattacaggcatgagccaccgcacctggccccacttcaatttttttttttttttgagacgaagtcttgctcttgtcccccaggctggagtgcaatggcaccgtctcagctcactgcaacctccgcctcccgggttcaagtgattctcctgcctcagcctcccgagtagctgggattacaggtgcctaccatcacacccacctaatttttgtatttttggtaaagatggggtttcaccatgttgcccaggctggtctcgaacttccgacctcagatgatctgcccacttcagcctcccaaaagtgctgggattacaggcgtgagccactgtgcctggccccactttaattttttaatagtgcttgagaagatgtttctgctaaatactatgcctctggattaaacctcaaatacttcaaaatgaaaagtttgatttcggtcacagatttttagtaaatactttttagggacaagaaaactacaaagtgctttgaaaaacaaaacaagctcaattttttatttgtttaacatatgtagaaaataaaattaatacacgtatcttttccaaattaacacagtatgaaaccaaccactactaattcatcaaaagacacaatttagatcaagtttaggcttggttaggacgctggacgctgagtaaatggtagctctgaggctgaaaaaaaacccctgagtcactctggtacacattctgatgtcagcatccccaccccaccccaacccttattcccgccccgcccccggccccgccccccccccccccccccccccgcgaaaagaagtctctagctctgaaaattggcttgttataactttacaaatgtagttgccaaattgccattgacatcacatttttctttttggcttttagtagctagatagtaatactataaaggaactctctgctttttctattttgtcctttttaaattcttggaggcccttcataacatggaacacaggatgggcaaacgtgcttcttatagtgtaggttagatttagcaccttttgacaaagggccttgtttcctgtgcagtttaaatttagatccactgagaatctgagaaattcagtaatgaaagggtaactttggagtttcctcttttggaagctttccttattaaattctattaatgactctgttagacttgattcccatcttacacaagagattccagaatagcaacttgaattgcttcttagtccctcttacgaagtcactccttcatttggcattgatcgagtacctcccgtgtactggctgacggggcttatatacagagccactaccttatttttcattctgttattttaagagtttcttgatagtccatctacttaagaagtgttgctattaaatttcagtctatctcataaatattattctgagatcctcctggctggatttataggtataaatcattcttggataaaatatacaatataaacagtaagtggaccagttatctgattatacgtgctctgagtctacagaaagacaatatcttggtatgtttcaggagacttgtagagatgaggtgtaggacttctcatttctaattaaaactaattaaaatttactgtctacaagggagatggattgaacatcacctttacctttctcttgacagcaatgaaacctgactcaaagctggcactaaatgtattatttcagtatctgtgtcctattatgtgttgtaatattttggattaaaaaatggagaaaaaataaacaagaaatttttatttctgctaaaaagtcaacagagtccattgttatctttctttgcttttcagatggcagaaattgggtgtcaggtcctataacacaggggttcccaacccctgggccatggaccattatgggtctgtggcctgttaggaactgggtggcacaccagtaggtgagaggcaggcgagccggcattagccagctcagccagcctaagctccacctcctgtcagatcagtggcagcattagattctttctcataggaaagtgaaccgtactgtgaactgcacatgtgagggatctaggttgtaccttccttatgagaatctaatgcctgatccccctacccctagcctcatggaccagtgccaaaaagtttggggaccactgccataagaagtcccgaccagaagtgtcacatctttctattgcatgatgctgcttcttgaacacccatagtagccaaggccagaattagtgtggcaccctcttccccagacaaggtccatggacagtgcatttcaaaatacaggaagctctccttacactctctgctacctagcttccatggttatcaagtaattatactttatgctgagccaacttatgcatttaggaagagatgaagagaaattatatcctcaaatgggctggaacaaaagggaataccaataatttgtaagttaatcaaattataattaaagcaggaagagacacaaggagcttggattatctatgttttctgttagaaaataatacaacaaaagtatccagggagtcttatcagttctgtaggaatttggcagaacagtaaggttataagttgtccttttaattcccagccacctctggcctctgcttaccatggccctgccttctgacttgctgtttgctcagctccttagtgcatgggaagagcagaaacatcaggggaagagcgctgagatctgctgtgcacctgtgccgcacagcccttcccatgtagacatgtgtagcttttgggtttgccagtggatggaacttatccgcatcaagtagccttccacgggggtggtgctgatacgcactcccacccacagccgatacagcctaatcacaagtggaacaatcagagtggaaagtagcggaaagtagcagcctctggtttccaaatgtgagagagcctcagggctcagtcctcaaacctggtctgttttttgttgatgccttcaaaccatctcaaaactgacaccttctccagcctgggccttttctttgaacctcaggcttgcatatcccactgtctcttaactgccttcagtgggatgaactcttgatattctaccccaacctgcttctcccactgccttcccatctccttccagttactcaggccacagttgttgacgttgtccttgatgcctctttttctcctacacaattctgctggtccacggtgccaccatctcttggctggagttcatcagtaacctcctgagtagtctctctgcttcttctcagaatatctcctccatgcaacagccagcatgaactggtgaaaatgtagtccagaccctgtacctcctctgatcaaaaccctccagtgcctctcagctcactcagagtaaggacctcagactttattgtggctcaaagaacttgtcacccccaccctctgacttcatttcctgctccccaccccctttactcagtgccaggaacaccacctcgatggtgttcctccaacacaccacacaggagcccaccccaggaccttggtaccttctgttctttctgtcaggaaggctcttcccccagtcaccacattgctttctatttccctttcttcaggcttttccccaaaagttactgtctctgtgaggtcttttttgactgacaagcttgaaaaaatggtcaccagaccaccaccctagcccccttttctgcttaactttttagcatctatcaccatttaatggaaaatacttcattataaatcttttatttccatgaggataggtaattatttgttgttgggggtgtctttgtcagcatctagtacagtgcctggcagatggatgctcaataaatattgatttaatgggttatgagggtgttaatataaaattagcatttattcagcaactactatgagtcagccactgggctaagtggcttacatgttaagaacctcacagaaggccaggtgtggtggctcacgcctgtaatcccagcactttgggaggctgaagcaggcagatcacctgaggtcaggagtttgagtccaggctggccaacgtggtgaaaccccatctctactaaaaatacaaaaattagccagttgtggtggcaggcgcctgtagtcccagccactcaggaggctaaggcaggagaatagctggaacccgggaggtggagattgcagtgagccaagattgcaccactgcactccagcctgggtgacagagtgagactctgtctccaaaaaaaaaagaaaaagaaaaagaacctcacagcaacctagtaggtgagcactgttactcttgttttacaggtgagaaaattgagccctagagaaataaagtaacttgcttcaggtctcatggttaaggggaacctgggccctaacagtccacttcctgtaccttcaaccacggctctaccgcctccgctaggagatggcccgaggacattccttagctggcttcagcttgctctttttcccctgcggtccacccctgtctcctgcttggtcatcagtgatttccatgccatcccatgtcattggaccagttgtgtgtttttaataggagttctcatctcactttctccacagctttgccaattctgctctccccctcctgtctaaataccttcctcccttggcttcctgaacaccactgtcttcgggtgccatcatccctttctggcccctccttcctaagtcttcaggtgttccctttctacctgctttctacgcctctaagtgttggagttcctcatggcttagtctctagaccactttgcttctccacttaagtgttctgctagatgatctcatccaaactcacagtgccttgatggatccatgactcctgcatccatgtttctaggccagacctctcatcatcttcgggcctgtgtctccagctacctactctgcacctcctttggggtatcacaatgtcacctgaactcagcacgttcaaagtcaaagttataacaatcaccatcccaccaaacctcatctacccaagaattccccatctcagccattggcatcatctagttacccaagacagatgcctaaaagtcctccttgaagcatttctgtccctcttcctctgcatctaatgtgtcaccaagtcctactgatgcaatctcctcagtgtctttcgaatgcactctctctcttccggcccactatcaccattctagtcctaaaacctaccttctttctaggagccacagcttctctggagtttttacacctcttccaactgttcccatcaccccgttcttttctttgacaacattttttacatataaaaataggtatttatgtgattatatcatgaatgtcttttctccccaactaagaagcactatgagagcagggagcttcctgtttctccccgttcaatcctcagctcctagcagcacagtgcctggtgtatagcagattctccatcagtatttgatttgttgagtgaaaaacttagatgtattaaatgacaaactgagatcaagggagaatgaagaatcaatcagaagcagatagaaaattatgctgtgtggtatggcaacatcatgaatggactgttaccgataatacacactgagtcatcaaagaaacattaacatgtattctctattttaaaagggaggtacataaatatagaaccaaataaacagatctcaggaacatttccattcagtaagcaaagttttagaagggaaagagaaattaagttcacatcatttcccaataacacagatgaatgttttccatccaattctgaggacaaagatagcacctcctcgcccatccatgccaacggaggctgaggtagcacagataattgaaattacagtgaagaaggaaaggggttgattgatttgcatgccatctcttttctttaatagtggaggaattgccaaaaaaggctaaaaatgggcaacaggaaaagggagaaacagtaagaatcttggataatcttccactagataattaagacttaactgggtctgttttgatgtgtgcacatgtttctgtacatggagaaggatgaacccacaaatattataaatgccaatttccgaaggcttttggaaaatgtaacccatagcatatggtgtcaaattaatttggggttttacttgtttcagtctgatttgggcacattgaattatgagataatagtttggcatccatgtttgctgagtgcttgttgtaagtttctcaatttcacaaaaattctctgaggttagaggacgcgtcgtgaccctcgtttggcaggtgaggaggtagcggcacagagccgatccgtggctcgcctgagctccggcaggaactcctgggcggagctgctgagacccaggtctgcagactgtcactctggcttcactatttctggccttcctttgagcacttttcttacttttgttctgtttcatgcacttaatgcacctgtttcatcatgctgcctgtcacagttaaaggaatttaaaacagaatggatcgtatttgacagtaaggagctgtacagctgaattccatcaagacaatgtgcttgtagccccaacggcattaaaactttcaaatgatgctttatcacaacttcctctgggctgcacgtgacaaaggggtgcttaaccaggagggacatctctctttgcttgtaggggcaggttgctgttttttgcccacctctaaaatctccttggagcactcagttcttcttatcctccttaaagccaacaactataaaatttaatttaatgttgaacagctgtttctgttgcggtccaggtgaaatttgaggtatcagctaattgtgctaaagttcccaaaaagaagtattcagaaggtgtggatcaccaattacctcttggcagagctgtgaactaataactagtagcagtagataatgtactcagatgccacatgaaatgcaaaagattctatgctttattccataaagcatggctataggacattgtctactatgtaactaatatttaaatatttatagatttttaaaagatttcttcaaccttcttttctcaccctgtttctagatctgatgcacaaaggaaaataataatacaaaacccataacctattcattgtattgttgcggtagatcgagctacatgctgcacagcaaaagaccttctttgcacttctttcaagcagaattattgctgtatattcactctgaactgagaggtgaggattgaactgtgtagtgcctcagaaaatatcaagagttttaaaacattagttttgagagattgaaatacatagaaacttggaatgtttgaatgtcagcccagacattggcaggcttccatgcagatttcattgtgagtaaaatgtgtactcagtggctgggttcaagcccttcatagtttataagcaaatgtctctgcttcttctagatcattgcaaaaaaaaaaaagaagaagaagaagagaagaaaagaaaaaagaaataggttaagcaaattttgtggtggtgcttatgtgtgcacagacatgcatgaggcctccgcatcttccaaacttggaaagcatattttaacagcacaaatatatctacatgtttgatctacatcagagcctctttttttccctcttccttgcatgcttttaaattatatagtttaaatgttttaactattaaatctgtttggtcttcaagctgtaaacatcacacacagctaataagctttaggaaagaaaaggaaattgacatttagtatagaggttctacaaaaccaatgaaaaccatgcaaatgagctatggaacagagagatttgcatatcctcgttgatttcatgatgatattctcagcatgagcctggcagccttgcctttttacctcttgggatgatgcatgtactggtggtagagccctgcagggtcaatttaacgagtgtaacattgtgattttccatgcggtttctcagaaccactgagcaaaatgcagcaataaccagtgacagaggaaatcgatttttgaagtaaatacttttggaggaggggaagaaggtacattcccttcatatttaatgttgccaaagtaggttgaacaagtttttatattagtaccatttggtatttcaaaataaatagattatccaccatttccatcactctctggataccctcacatgtttaccaccaaaactcctgcgcagagactggtcctcttttgcaaactgcctttggctcccccgcgatctctcatcagaaaagcaggctaaggaatctgcttttgcccccatcctgttagaatgataaatagtagcctgatggccaagttgtatatttatttaatacatcgtctgtattgatagtttatgatgtcctggatatgaatacacgaaagcacagttgcatagtggcgaagaaggattttgatatcgtggagatctggatttgaactcaactctggcagttctccctgccttagtttcttgcccgtaaatgggggtgatgaggtagttgtgagaattaaatgagagactatgcaaattgttataatactccctggaaaatagttaaatacccaatagatagcatcactattttgaaatgctttcaaaattatactcgagttttacttctgcaaaatcaaggcagctttcttcagaaaagagagaaatgaacttcacccctaaaatgtacttggagaattttagagggtcttttccaagttgttataaagcacttctgaagtgaatttgcccatttctgcccacaccaatcttataacattccaggaataaaatctgcactcgagtttaaaaataaaacgggtggaacaaactgaattagaagtccttggcagacatcccccccagcagaatgttctctcaattggtggtattgcaataaaagagatgtatattttttagtctgctcttcctccctgataatttcagccagttgtatttctctattctaaaaacctggtatgcttggatttaatctcaccactcctatctacgctcctgctcctacccccacacccatttcccccaaaaaaaccccacatctgcacagaccctccttcccaagaaaacatggaggcgggctgctctctgataccgtacatgtgcattccggactgtgctgaggaaggtcatagaaacatgagagggctctgctgttgtcagttgtaaagactgccaagaaagaacaacaaaaaaatctcaaatgcattcacatttctcccgcctcttttttcttctgtaaatattcaaccctttttagagaggcttttgataatgtgttatctcagcaaacaccacgaaccttggatgtacgcagtactccctaatcccataggaatgactcagtcaagagagttagatgaaatatggttggcaagattgggtggggaatcttgttactacacacacatacacacacacacacacgcgcacacacacacacacaccagcagcaccagccactgcacccctatcatcgccatagacattatgtaaaaactagacattctcctctcccttacacagtcagttgcatctttcccaaaaatggaaggggaaaaagctttctttggctgagccatatgcaaaaaatcatggaacatctgtgtaagtaacaacatacaacaagacaaattattggtggtaaaaggcaaagcccttgtttcaaaaacatgtctggaaatagtgtgtatacagaaccttcctttgtgctaattactcataataactgtcagctttgtgtaccacaggctgggctgttaataactagtggtcgcagtacggtgttctttttctttccctttctttttttttttttcctatccttccttccctctttcctgccttcttttcattgttgttgcacaaatcatatagccttattccaatagttgctggaagaccaaatcagagatgtgggggattcagggactcgcgacatcttggagtatactagtggataaatgccacttcacccctgatgtggccgtttccctccaacacttgtctaaggagtgcagggactttggggtccaagcaatgtatcagtaaacttcagaatttttttcctaacatttaactctattctcagtctcaacacccgccacaaaaataatgtcactccaggcaaatttagtcgcttacggattctgagtcttattgtgattttgcctgagtggcaagcttttcaggcacgtgtacttaaaaatgtgatgtggtagaatttgcctccagctaggaatccacagacttgggtttgagctccacgtcccacagtcaccacgtgatcttcagaaaagaatcactgaactgcctgtgcctccatgcccccgtttgtcaagagggaggtggtaatacctgctgcggtttttatgtggatcgaatgggcctaaaactcatagaaacacagaatgcttctatgataagagaaaactccagccaggctcagtggctcacacctgtaatctcagcattttgggaggccgagatgggtggatcacctgaggccaggagtttgagaccagcctggccaacatggcaaaaccctatctctactaaaaatacaaaaattagccaggcgtggtggtgggcacctgtaatcccagctacttgggaggctaaggcatgagaatcacttgaacctgggaggcggaggttgcagtcagctgagatcgtaccactgcactccagcctggaggagactctttctcaaaaaaaaaaaaaaaaaacgaacaaaaaatactctgatgctattgctactggttgtttttttttttaatgctaaaaggactccaaacatcctgttatcacccactgtcaaatttctgcatatattttgcagtgccagtgagaaacttggggtctctacagtcagtaaggaaaaaggagtttgaaagaactaagggatctctgtctatggggaagaaatagtagggcagagaatttaaatttagggttcttaggaaatgatgcaccagggccaccgcacagccctcatgtctcctctcttcagtgtcctctctgcctccatcacctagtgaggagggaacaggtgcaggaacaggtcgccagggtgtccagcaggtgacctcccacccccctaccctcgccgcccccactgctccactggcagcctatgtcccaaccaaaccttacttcacattgtaattctaatgttctgtgcgtgttcatcgccatatttccctccatctgacccagcccgtcaaaatccttcctctacttcagggcccagctcccatcccctcttccgcaaagccttctaaccgcaaacccattaacctctccccacttggggcttctgagtccctttattatttatggttaggagaaagcatcacgtcggtctggtgatgtgtagtgagttgtgtgaatgtgttagcagagcagggtggccctgcatgtgatggttgggtgttagctggagtgagccagcctgggttcaaatctccctctggcatcagcttgtgctgtaattggggtaagtgctgaaactctccctgtctcctttcctcatttgcaaacttggcttaataatgatagctacctcaaaaagttgttgtgataattaaatgaatgtcaagctcttggaacagtgcaagcgcttaagaaatattatgttggtgcaaaagtaattgtgattttgccattactttcaatggcaaaaaccacaattacttttgcaccaacccagtatttgctattactagtcctggtcagctgagcatggtggctcatgtctataatctcaacactttgggaggccgaggcaggtggatcgcctgaggtcaggagtttgagaccagcctggccaacatggtgaaaccccgtcgcaactaaaaacacaaaaatgtgctgggcatggtggtgagcgcctgtaatccctactactccagaggctgaggcaggagaatcacttgaacctgggagccagaggttgcagtgagccgagattgccccattgcactccagcctgggtgacaagagcaaaactacatctcagaaaaaaaaaaaaaaaggcctggtctaccagagacaagaggccatgtcttgtccatgaaagccttgcaaccatattttacagatagaaaagacccagtccatgaacattaaagtcagtatcaggtacatttatcaacataaaatctgttcctttgaatcagctcaataataaaagagtgcagctgagcaccccctcccacagccccatgcctctagtcactgaaaatctgtgaggaatttttatagagtgtttcagaacagagcatttcaagacaaccctagagccctatggaatacattttcaatcatctttctgcgtctgctttcttttttgggtgcacacagcagacactggtgatgaggcatgtgcctgtgtgcactgttgttttatagaagctgaatgaaagcctgggagttgtatctgcctgaaaacttccatcctggcttctagagctcaacacctgaaacgctggaggcagttgaggtcactttgaaaacggaacccttgatgttctgctcaaactttagaggcatttacaacaaatcaggcaaatgaaagtgtggaaaaatcagaaacgaggaccactctgtcttagggattttgtcattgtatcgtgtgtgtgtttatgaatgtgagtgtgtgtcacatgtgagtgcatttaaccttcatgcaataagagagtagttttccacttagaaccagccaactctctataaaatttacctccgtgattctaattttgctccctccgccgtgggcaagttggcaatgtctgaatgtctgaagtcatttttgcttgtcacgactggggaggagctaccagcatctagtgagtagaagtgaggaatgctgctaaacatcctgcaacacacaggacagcccccaccacaaagaatcatccagcacaagatgtcaacagtgccaaggctgagaaaccctggtttaccttaaccttaaaagaacaattcgaatgcttgggaagggatgtctgccacatctgtactggagagaagcatggcccccagtcaaggacatggagagttccatgtctggatctagaccgtgtccatccacaaagatgcctcctgctcttctccgacatacaatctggtccatgagaatagactttattggtgagggggcggggctttaggtgagcggcattgaagggcttgttctgagcttggcctctgctggcagattattttctggccactttaatctcgatcctgcctctacttggtctttttttttttttctttcccccagtttttggatcttatagttccacaggacaagatacatctaagagatgggggaaaaggttaaagcagcaaggggatgctggatagagggggagggaaacaagaaaggaaaaaacaagacagagagacagagatagacagagatgtacaaatgggggctgcttggttaaagtgtcctggagttttcagcaagagattttgctgccagtgtctctccatccttctctctgcctctctctctctctctcacacacacacacatacagacacacacacacacacactcggccccaccaccacacacaggccaggtggctctgcttacatacatggcttggcgcttttactccttggctaagaccatttcacacatgaacaacacagcctcctcctagagatttgtcatccatctgcttgcagaagagctgtctgtttccctctgaaaattggtccaatcaacattttcctttggccagggtagcttaccagcagctcctccataaggtccataattgcaatttctcattctcatttgcctggctggcttcacccttctgtcctctctgcaccttcccacaagtgccccaccctccccaccagccctctcctccttttgtgttaataagccctgtcaaaatgaatgacagaatcaacttccttctcccaaaatggctcattactcataaatttcaagcaatattgccttctgtcctcaaaaggtttgcagatttttttcccccaactgatcccctttccagagtgaaatagcggatgaatgccttgcctagcaccctctctaagctctgcctctgtggcagtattgtgggccaatatgccaacgagtctttccttgtgatctgctccagcctgtcttgtgccatatgcttgtggcagacagtggttaatatcagtctgtgagcatcttgaggctagctttgaagtctaattctaatgtcatcatgcttatagggtgcacactttgtttgttctggaacagagggtcatctgctacgggatgtggaacactgaccctgatattgcagccgtgtttgtggttgagtgagggagcaggtgatgggcataggagggaaccaagccctgagccgtgtttcagggatgctcggtcccatcccctttctcccagatgacttcttattcttaaattttgaatagtgagtaacacaagcaggaggtgggatagcatgagaacttaggaaatcttcccatctctttgttacttacaagataaatgtctatactgaagctttagggacccagattacaactgaattgttttataaatgcgtctgaaatctgctgttttgaaggacaaagtaatacctgaagaatgattaagaaggcttagagaatccgcaggctccaaggtgtgtgaataatacctttccatggttcactaccaggtgatctggacctacagccagtcttctgtgtttcagtatattatgttgggagcattcccagacagttaatgcgtaaaatgctattcaaattctcctttaccgaaaggcattttaaagtaatacacgtgggtgaggaatacaagtgcctggtgggatacttttggtaaacaacgtggcacagtgggatggagtagggtctactttttcccaaatgtgaagttagtagctacagaggggtcctgagacagaaagcatttgtaaatattaatttgtgctctgtttcacagaatctgaaatcaggcatctgtgcactttaaaatatgaaagaactaagagatctagtgtttggtagcattttagagggaaaaaaggccatagctcaaatattgctctgatttcagttggctgaatttatgtgtaaagggcatgttagggaatagtctgcaaaggtaccagaaactgccattcatggaaggccctgagtgcaaaatgcagcagtcagtagttctgacccatgccattagatggttctggaaggtcctcagaggagacgcaacaccaacagtgacactgcttccagctcaggcaggctggagctgttctgagtcttcctgaaggttctgaatggtccagcccttggactcccttcagagagtcatggagcacccacatttcctttgcacctgaaacacttctttgtttctgtcttcaccctgactcctcatctattcagagatcccagctgatcctctctttcaaagccaggccagtgagctcttacagaagcttacttcagcattccttccaccgtcttctgagtagcagggcagacagagacagcaatggagaattccagttgattccccataaaatggccactttgttgtggggcatgagctggtctgtacttgtttgtgcctggcagtgcacacactagaaccctgggcaaccctggatgtaaatcaactagatactattattaaatagccgaaggtttgccagtgcagcctggagcaaagagagaggggtaaaatcaggctcccaacagacttccccataggaaacctctcctctgctgtgattttccagatgagctgcgtaaatggctccaaatcaccgaatgtttgtgcacgcaggctccattcatgcgcatgcacacacccggcttgtgtccttcttccctctcgtcccttgaacccgtagctcttgattctgcctgtaggagcaatgatgttgtagcaaccatgacaaaagaaacaaaatcagaaggcagatccaggccgctccctgccacctgccctctgtctaccttagacagatcacttaggcccactgggtcttgataagacatggtcttttcacacctgttcttccagtcttataggattacctggaggatcatgtgatgcgaaggatgtaaaagtgctccaaggggttaaaaggactttatataataaattcctacaaactgctataggcacagccatagctctgaaactagcattctcgtaaggctagtccaatccataagtttcgtttgcttcaagcagctcagatagacactctctgaagataaatgatgcataaaaacaccattgtttgtgatcagaataatcaggtaccactaaatagtcctgcatgtgtatgcatgataccagcagcctccaacttgcttctccaggagcactgtacttaacttggaaacccctttatttaatttctgtccactcacaaagcttcaccttgtcttctctcctctctgtcctcccgaggttaatccttgagagcctgtaatcaaggctaggccctgcccaccttaagtcaccctcccctctctctaggcctccacctcactggggagcgtcattgcagccagtggcaagaagctgcaaaattctctcatctgtgaagagagcccctaaaaccccaaatcccggaccagtagaggaaaccattgctgccctaatatcacatgttacaagtcttcgagcccatggtatctgagatgttaggagctagcattccttgtaattaaacccctggaacatcacaaggacccagttcagggggcttggttggttgactgattgatgacagcatctcaattatgtaggagatttctgtaaagaggagtgactggaaggaaaagaagataaccttcatttatatcatgagaccttgcgtagtagaaggccgtgaggatgggaacaaagtgaaatcatgaaaaacagcctgatgcaaaatgacaaagaagaatttcagggtcgttgagatcacacttgaacaataactgaacagagccagcactacagttttcagacctgatggctaacaagtgaaatgtattcagagagaggtgtgtgattataaagactccccctacccctggtgctctattccactgactgtccctttatgaaaaatgaattctagagttccctttctgaaatttcttacctgaatcagatcagatatgacaattctattttttaaagcaccttactgaaaataaagtgcttttcagtagtaaacctttaagattcctggtttccctctgacttgtgaaaatatgaaagaactgaaattagaccacattggcccaggttgggaaaacagatggcagagataaggcagatcaaagaaacatctctctgtgggtgaaggagttcctggttgtcatgtatccattttttgtagcgttttccctacttgaggaggctgttgtgaagggcaggattcttcactgaatctttattgtaaaaggcataggtgtgtcttgggtggattccagttctcaggttgatttgcttgacaactcttaggaaggaacaattaatactgctgcccctcaactagctagggagatttcactgtggaggtagaagtcggattcactgaggcagaattgccagggcttgagacccttcatgcctctcttttccaagtctctctctccaagaaagggtgaacttttcaagtcaaagagcagggacgtaaataaatgcagttatggctgtcttaggaggatccattcacttaaggcaaaggtcttagaagttacagaagaggagagagaatgggaactactgtggcaccaggatgtctggagaagagaaagtgcgcttactgtgcacagcttcctctccctcacctgcgccacggtgaacccacctatatctttctgctggcaaaaacatttgctcagtgtgtcgccggagtacttgagtgtctgatatttctcaaggcagaatctacctcactgtctctgaaacctcaaaatatgtggccctctcgaaggataacagttggcagcaacctaaggctgttctgctccaacttggaatgaagaggaatatgatttggccattcttcttagcacagaggcaaataaaaaaaaaaacccttatatacttcaaaagatgaagatcttacttcttactggctatctttgcaccaggtcctgggattggcatataataaaaaatgcatatgcagtggccatgaaatgggcttaaaggtcaatcttggctgccagtcgtggctaaactgcattgtattccatgtttttttccatattgcccctgcagtgtacatatacatgcacagtcatggcccctgcacactgtgtacacactcacgcctgcacacatgtatgcatatcaacgcctgcacatgtacttgtatgcacactcacccacacatgtgcatttgtgtgcactcacttctgcacacctatttgcatgcacgctcatctcccacaaatatgtatgcatgcacactcacgccccccccaccctcccgtgtgaaactctgcacctgcttgtctttaccctcacccttgaacctgtgtataacctcataaagtaggaagaagcccagtgttgaactctacagccttttacattcaaaatggttttgaaaaatgcccattcagaggaacaggaaagcaccaaacctaaaaggtctgaggacctttccatgctttctgtctcctaatctcagagctgtaccaatctgttatttaaaaattagtcattatttatccaaggcaggaggggacaaatgtaactgttagttcagtaaatgatttcattcttttttttttcctgtgtcctttctactgttaaagtgacgaaaatgacaccacggtttgatatgtggggttggtttcagtttgaataatctcatccttagctgcatgtgaactcatgtcttctcacactctattagataaaagcctaaaacaggaaggccagaaacaactgtttttaaaaagctcatgctaccctggcaacttaagttggaagaacctaataaataaatacaaagctgcccctctgtcctaatgtacttcttctgaattccagctgggcacctcatggtttcatgcctgaatcacaaaggcgagtgccagtacccagccagagcagttttcctaccataaaccagtaaatgtgtgtgtatcacatgtaagtcagggtcagatggggaaaatcaactacaaaaccgcagagacattatgcaaaattggattacgtacatgttttcagttttgtctcttagcagtttaagtctttaattaaaatacacacgagagagagagacagagagagagagagagaatctgtaactgttagattttataggccccggttatgagataatagccttccaagtaatttttatgggtcattctatctagtggcaacttagactataaagccatctcccagcttcccaaaagtaatgtctgttttctcactttctaataattacttcagatttgaaagtaaggagttgtcacagtgaatacaaattagagtcagcttcagggtattactaaatgtggattgttttgttccgagttttatccattttaggcagagtaacatgatcatttatatacatctgcctctatgcaggctgtgtagacatactcagaacaccagcttcacctcttcagtcttctaagacagtctttctaatactctatattgtctaatagctaagctattgttaaataaaaacacgcaaatgtttgcagttaggctcccccctccattctcaacctcttaagtgatacagacagtaaatgcattttgatgtttatttagaaagttggcatcctgggactgttcacaagatagctaatttgtctgaaggtccccagagacagtgaaagtcatcccaccatctctctagctgccctcataccggggaagtaaaatgcagcatagaacactgcagctcacgttatggagaacagtggtgctatggtgatttcctttctattcaaatcatttagtgaggatttacataatttgcattaacgtgtgactttcgatcacttatgctgcagcagagtattcgttgcctatgttctctaaggcaccagtgtggtggttcatgtgtccttgtataaaagattactgtcctccccatccccagtctttgtatctgtgcaccagaacaaaatgccctcggatcatggccacccaggccagagaatgaggacccacactttaaaaaccctgtagatgataggatgagcggtcctcatccgtcccctccctgagagtgaggttgggttggagtagaaggatggactctgccaaatgatgacagcagccctgagagtccttctcacaggtggccagctctgtcccctccagcctcaccacacattcccctagtacacaaaggcagacccgggcagccactcagcatgcacatgtagcagtgtcccctgtacactggtaccctcaaggcctccctggcacctttgcttgttacgttggctgatttcttcaaagggaaatatgggatgtggtgcagcctggccctcacacactctgaaaatagcactgcccagggccaggccttttcctttgcacactgccatacccaccctggaaagtactccatggttgtatcacaagaaaacagccatttgggcattttaaattactcaaaatattataaaaatatttataaaatatattaatgtatatatttataaaatacaaagagtatatgattaccaggcaaatgagtagacagtgatagaactatcataagaataggattggctattaattataataatgattggaatagataacatttattgaacatgtattatgtgccaagcactgtgctaaaatatttacatgcagcagttcatcaaaagctcatgggaagccatgtgcagtgtcatgcacctgtactcccagctacttgggtggctgaggcaggaggatcacttgagccccagagtttgagcctagcctaggcaacatagcaagaacccatctcaaagaagaaaacaatacaaaaagctcatgacagttgtaagacatatgtaccatcattacccttattcaacagaaaaggaaattggggcttagggtgggtggttaccttacttgtacaaagtcacacagctagtaagtggaggagttggttcaatgaaggataaccagggaagcatctgtgggcatatcgaggcctgaaaataggaacaccttggccaaatttcagaccatgacatcaagcgaatgcttgaaagctaaggaacaaatagaaatatgttgtatcatttataacaaattgttaccattaacacctacaattattagcgttaggagtattgcggtgggaattgaacaatgagaacacatggacacaggaaggggaacatcacactctggggactgttgtggggtggggggaggggggaggggggagggacagcattaggagatatacctaatgctaaatgacgagttaatgggtgcagcacaccagcatggcacatgtatacatatgcaactaacctgcacattgtgcacatgtaacctaaaacttaaagtataataataataaaataaaataaaaaaaaggagtattgcatggtcagactgttcagatctcatgaatgctccctgcttctctattccttctttgatttgacatgtgccaggccatgtattccagtggatttctgtactttctactttattccaaaggctaagcattcctgaaagccacagagggagttgatgtgcttaaggaaagaagtatcgcttaatgtggccaaaaaccgattccatttctgtacaaatgcaaggagtttttgccaggagccagggattaatagtctagaggaagggactaattgtacacaggaacaatatttacttttataatgggaatagtttgagacagtgcatcttctagacacaaacattcagtaggaagggttatgcattaattctttcatttaatgagcattttaagcacctattatgtgccaaatatcttttcgtagctctacaacagtgttcacttctcaatcttttgctacaccagagcgttgggaccatgctcccattaatcaccctgtctcaaacaacatgctttaccttcattcgttgatttactcatccattccttctcatagtttttaacctcaagagctctgaggttcagggtggaataatatggagggcctttgagaggctaacttttgaaccaaatcttcgaggatgaactagggtagtggcaggtagaaaactgcctttatatttagccttctttggtacctggtcatggatttcttcttcaagcatgaatggcatcagttgtctgggagtgagatacagtgttcgtatgctgagaaacagattaggccattaaaaaaaaagttgtggccacgtgtggtggctcacgcctatagtcccagcactttgggaggccgaggcagggggatcacgaggtcaggagatcgagaccatcctggctaatatggcgaaaccccgtctctagtaaatatacaaaaaattagccaggtatggtggtgggcgcctgtagtcctagctactcgggaggctgaggcaggacaatcgcttgaacctgggaggcggagcttgcagtgagccgagatcgtgccactgctctccagcctgggtgacagagcaagactccgtctcaagaaaaaaaaaaaataagaaacttgtaactccctctctctacttgatgaagtagacatcaggaaagactttcttattctgctttccattaaaagccataacttggaaattattattgattgggcttggtgtggtggcttgcgcctgtaatcccagtgacttgggaggctgaggcaggaggattgcctaaggtcagaagttaaagaccagcctgggcaacatagtgagaccctgtctcaaaagaaaatttttttttaagtagcctagcatggtgatgcatacctgtagtcccaggtactggggaagctgaggtgggagaatcacttgagcccagcagttcaaggctgcagtgatctatgattacaccactgccctccagcctcggcaacagagcaaaacctcatctctaaaaaataaataaaataatatcttaggggaagttgacaaaacattagaaatattgtagggttaggtgcctgttgagccccaggatttattccattattcactcatatcttcatgtatccattcaataaatacttattaaaagcctacaccatgcaagataaaagccacattctactgagtatgcaatgatacacggtatggggtttctgctttatggaaactaaaggcctactagaggaattcaggaattccagtgtgtaccagctcggctgtaacacagtgaggaagagataggaaccatgaactaagcggtgaaaatgtgatgggattcagaggggtcagaggtattggatacagtgagattattttaaacgtttagggtgtacgagcaagatgagtaggagatttctttaggaaacatctccctatgaaataaaagtttatataaaaggaataataattacagttgatatttatgaatacttaatctgggccagggactatacttagtacttttcatgcattgtctgattaggtcctcacaacagccctgtaaggcaggtattgtactttcttatattttatagtttgcactattgtgtgctccatggttatagcaaaagctttgtctgtaaaaggccacagggatagaaggcagagaggaaagtagatgtgtgatgcagtattaattattgagccaataaaatctctctaatttagattttttaggaggaagtcattttacattttacattaatttaatctatattgagagatccttctaagaaaataagttgcattacttcaagtatacatagccatataaattattgaccaattttttttttccaattcatagacattactttccagaaactagataatgaccatttgttatcagcacactgactgcaaaatggatgatgaagaaagcctgggttttttttttttttttttgaaagcttggtagttcttcttgtgaataaattaaacactttcctgacgatcctgtttgcattattgacttatatgtactggctcatatgtagctgcccatgtataattctccccactcattctgaagggagggaaaaaaacgattaaaaatttcccctccttctttttcctgttttgagattatttttgctcccagcagaggcgcggaggagggagctctcagagccccattctgttccctacctacagcatgaaggatccagataaccgcagaatgaatgaggtttgagcatttgtttttgctataagtaagatggtttcccattaataaaagtggcactcagtttactttgtcttcgccagacaggcaaagggtaaattaaggtggttacctgtggtgtcccagctctttcccaaggctggactagtgtgagccgagaaccaggcaggactcactcacaggtccctttctctgctacttctgctctggttttatgcgaagccctatttcccagctgcttcgggtaaacaaggacttctgtgttgaaataataaccacttgggctgggcgcggtggctcacgcctgtaatcccagcactttgggaggccaaggagggtggagcatctgaggtcaggagttcgagaccatcctggccaacatggccaaaccccatctctcctaaaaatacaaaaaattagccgggcatggtggcaggtgccgtagttccagctactcgggaggctgaggcaggagaatctcttgaacccaggaggcagaggttgcagtgagccgagatcgcaccatttcactccagtctgggcgacagagtgagaccctgtctcaaaaaaaccaaaaacaaacaaacaaaaaaaccacttattgtttcactgcctaatattaattaattggccaaatttctattttattatattccatatattttaaaataatttcttcttctgttgtacaaaccaagatagaagataatttgcccaagaacacaattggtaggtatcctagctaggaaagtgggtgcttctgaaaattataaaaatgaaatgaggtaattttctgggcccttggtacaatgcctgagatgtcatatatactcagctaattataagtgacattttgttctagaatccagtagctcaacttttagtccattgtgctgaacacaaatctatagatccttaaattgtatacttttattaatttaattttaaagagccagaaaaattgactacattggaaacattccagtccaccaacatattgagtagaaagaaggacaaaggccatattctctttcagatgctacaaattgtgtatattttcagtaagctgtgtctgcttaaggaggcattactgcattcggatagataaactcaaataaaaaggcctgagtgaagaggctctactgggtttagcgtttttttgttgttgttgttcagttttgcatgtgtgtttttaaatcagtttatggttcataagctgatgaagcagtgagtacaagtttgaactatgagaagcaggtttgaataagtctagacatttggttatcttctgtctagcattcatttgtgtcgtgggcgtcacactctggggattagtgtttcattatgcagaagctgttttatctttagctttcttataatagcttaaagtgaattctgagtggagagagaatgaaggccaggccttagtaactgcaagaatcataccaaaatgggttggatgggttttaacagtgaccgataagcattacgacctcactctctgatagttcagttggctcgatgctgtctcatcacctcatttagggtacaatatgctgaggaactgaccaaaggtccctgaacagtgagagatagggaagagcagaaatccgttcctgtaccaagtgtctaacacttaatataggtgagagctggcgtgagattatctgtgctgtggaaaaatgaggacctatcgatacctctaagtatataatcactgccgtgtcacattttaattagctccttgaggctatagaaagaagttcgcttcttatcctccaaattaagcatcacttttacaaacaatcaatgttccattttcaaaaccccaagtagagcaatgtttgattttccttactttccagctttgagaatgtttcatttttagaaatatgttataggaatgtaaagtaactcttgtttccccaaataaccacctccttattatctgttcccctaagctgaatcctttcaaaggaaattttgtcttcaggctaagtttagtggctgatggaaatcaaaattatatcaggtgggccattgcgtcagtaaaaaagcccagaccaccaccacacaggatttttctccagacacccaaacatcatgtcacaaagctcaaaaaagtagtgattaacatgcagtgctttcaggaggcccacattgccgattcagtcccagtatgggctcgtcagtttcactttcattcattcatttatttatttattcccccacccattgattcacattcactcatccattcattaaacatttgctgcacacaatatcactgttagacagactttcagaaatgattgggttcctgtattacagacatgagcccacggcacaaaggtcaaactaagagtaagatggatgtttatagcacaagcctataacaaaaagaatgggtcccgagccgcatcttcttccaaatgcacaaactatatttgtaccttaaaaaaaaaacaaaaacagtgtttccttttgagaggcagcatggtatatgggaagaacacggatttaagaactagacaggcctgggtttgaattctgcatccataatgtgctaactgtatcatttcgaggaagttcttttgagtttcagtttgtctttaaatagagtcatcatttctactttgtagggttgtgtgaggattaaatataaaatatgcagcataatgactggcacatttaaacgaagtgctcagcaagtgctatttcccttcccctttcttcatttctaacatagtttgggaatggtttaggatgactctttttcttcttgtgaatagatagagacctcatcaccctaacactagaaaactataggacagagaccatacttcttgctgtggccagccctcatccactttgatgatgcttgcagctcccaagagagacaacagcccccacggcatggccaagagaggagcaaactctctccccaaggcagtcactctggggatgccattgttccattgccaaactcatgacctttggggaatttggaaatctactactttgtggggagaaaaggacaaagaaagtcaagattaagctttatatgtaaaggccttttattttaatggtgttgaattgagtttggattttgcgtacccttcaaatttcttagggtgtgggtgagggcatcctaggagatttaattagctccttgagcggcactgaagtttgcgacattgaggcacattttcttctattgtccattgaagtgggggagcctggcaatgaaatttctgagaaactgacgctgttgccgtggatagaattgtatggatatttgaatttagtttagtcacttggtggagttttattttgttgtttggtttcttttggaaagagaaaattagtatagtatgaatctgagcagtctggttacatgctttaatgggcctctgagataaagcagaaaaggatgtagtctagtagtaaccctttagatgataagggacacgcaggaggctgtccaagacagtctgttaatcttaatagtctctcacttgttaagacctgatttatttcaaactaaatttcttgttttgagtttccgggtgaaagttctggactgaatccctaaaaacatgcacaacaaagaagaaggcttttagaaaggtttctcctattgacagggttcatattctatagttcacaattcagtgaatcaacatttatattaatttcatccgttacaacctcagaatttgcctacaagatccaatggcatttttactgcccttatttagcaagcctatacagtacttcatgcacttggtcatgtcttcaactaatatttattgggtgtcttccctaagcaagatagtgcgagagagagagctgagttaaaacattcaagataacctcaagaagctgacaatctactaagggagataagacatacatattaataagaacaacttaaacacaaaggacaagatgatatgtggcatatcttatcaattaaataatgttggacttcagagggtgaaggaattaggcatgaaggtatatctcaacagggctgtgaatgactggaaacaaggtcttctctcttcacactgtgagccagccacatccatactacggtgacattcatttctcccccaggccagctatgggcagaagtttaattatccttgaacgtcttcaatgatcctcatctttgcccttgttccctctttatcctttctttctccccaatgtcttaaatcctgatgcagccagggagattttttttttttaaccttcaagaaggtaaaaaactatgccagggcaaaatgccagatcaatgttgctattaatataatcagatataaactttttccagttggcaccaacaaccctgggccttctctgagtaccacctataaacagggcttcaatttcccatttttgcatacttactaatgtactacagatcttgcactgactttaattcaatatcaatattaaagtcatatgaggtagtagtaaatagagatagccataccttagagtcaataagacataaaattagttatgttattattattattaattatgcataatatgtcattttcctgaagagaacagactaatagctgatttcagcaagcatctttaggcttttgttttcaaattattttacatctttttcttttcttttcttttcttttttttttttttttttttgacacagaggtctcactctgtcacccaggctggagtgccgtggtgtgatctcagctcactgcaacctccgcctcccaggttcaagcaattctcctgcctcagcctcccaagtagctgaaactacaggcatgtgctactacacacggctaatttttgtatttttggtagagacgtggtttcagcatgttggccaggatggtctcaaactcctggcctcaagtgatccgcctgcattggcctcccaaagagctgggattacaggcgtgagccactgtgcctggccacccacctattttccatctttagcactggccgttctcattcaaaatacgtactgctacactaagaggagacttaacttcaaattcactttgctccacggatgttgtatatgacctgaatagatgtaattctgacaagcttgtagttcattggaggctcacaatttgaaagaaatgcatgattaagactttagaacataaagaagattctagtaaaacaaatgattgcacccttttggattttttgcatattatctttatgtagggaagggaatgatatgttagaaagaatcctcaaacaggtttagacaaatcactggttgaaccataatctccaaaatatcgctacatcagaaaaagcccaacatagcctctgaggtattcgtcagaaatcccagtgcaagcattaggaaagaaatgtactccctgctcctcacctttgtaagtcagatttagtcttcactgttcatttcaggttctctgcctccataggggtcccttcagcacttgtttggttctctaattggcttatgatagtgggtcttacatcatcaactggattgtaaattccttcagaaagagatgtcaattaagtacacagcagagtcacagtatttcaaaattggaagtcatagtaagggggaaggagggccgctagatgctgtgattcacacggcgtcatagtaagcaagaggccgaggcagtgccagcacccaggtagggctccggtgccaccctctgcttcatcctctgccaagcctatcacgacggtcgttcagctcatgctctccatgcacgtctggtgatttgatgctcatctttgccagcttcagagcatcactggacacatgcccagtcttgaagggttaattttcaagtaccaagcatgctttggacaaactcaaatctgttccttgttttcgctcaacccgcaaccagcatcatcagcccagacgcagcttccccagaaggccagcaggtggagcacagttttgtggaacttctctagaactcgctgtttaaaagccgcaaaccaagacatgtgaggctgtggggtggggggcaaagaagagccccagattctgcacgtctggaagcttttaaaattgtcttacaacaattttagacctacaaaagccagcttttgaaattgcataaacggcaagtcgagttcttttttttttttttttttgagacctagtcttactctattgcccaggctggaatgcagtggcacgatcttagctcactgtagcctccacctcccaggttcaagctattcccctgcctcagcctcccgagtagctgagactacaggcgtgagccaccacgccaggttaatttttgtatttttagtagagacagtgtttcactatgttggccaggctggtcttgaactcctgaccttaagtgatccacctgcctctgcctcccaaagtgctttgattagaggcatgagccacggtgcctggccagcaagtcaaatttttaattagacttaaaatgttggtgctcataacaactacagttactgtggttttttttttttagtttcataaagaggacagacgctaaggcaattgtgtggaacagagcagcttctcggggtaaccatctcctgctgatgtataaatatcggggcaaaactgagtaagttttagaaaataaatgtcaaagcaagtccgagtcatttattccttagcaggaaatatcgatcctgtgacattatttgattataatgactgtttctattaggttaaatgactgaggtatacttaaccagtttaggtgaagaatgaggctcattgcaccatttgattgactaaaccttagaacccatgtattctttttatttgttcagtcaccaatttttatgaagcacctactgtgtgccaaacaccctcttgggtgccaaggtaagaattaaattttggaattaagcaaagcatgatggctcatccatgtagtcccagctactcagcagactgagacaggaggatcgcttgaacccaggagattgaggctgcagtgagctaagaacatgccactaccctccagcctggatgacagagacctcaactctaaaaaacaggttttttaaaattggaattaaacacacttgggttcaagttctacttcagctacttattagttgtgagaaaataaatgtcaaatgtttttcaatttgcataagttatttaaccacattatccttactttccttatcattaaaaccctgaaaaggttgtaagtgacaaaatacgtgatacacacttagtgcctgtcagatgataggcctgagttactgttaacttttttttttttttttaccatcctcatcatgttcctcattctcatcttcttccagggttctcacttgatgaaggaaagtatttaagacaatacttctttaacatacttaataatggaatggatatagaaatgggagaaatcagtgtgaaagcaggctttggtgaggccactatttaaaataactatagtttatttaaaggagacacgaagtaactgagatttcacaaggccccagacccccttctcgaatgttattatcaactcccgtttctgccctgtgatgtcatgagggttgatgatcggttcttcttttattttgttgccaagtacagcagggatatgtgtcctctctattcctgagtggtgaaagttctcttctgagaccacaaaacatggtggcctcaggttctttatggccccacggtctcttcctgcacccctccccaaggggctgggttggtagatattcctaatgttatatcccctgttgttgacacccccatgcccccaatcccgcatgcctagcagatgcaccttaacccaaccactctgggtcagttccttcctcacacagcaagctgctaagaaggttgaagaattactggacttcagataccacatggcaccattatccctggcaggtttcctgtcactgcctgtttctttttcttccaggaggctcatcaaacaggcctccacacaaacagaacatccatccacttcacaggccacccagacgtatccagagatgcccagatgagacctgatttgcctgggttaaccgtgtgtctgcagctcagaccctccaatggggcttctagctacatagtctaatgatgaaaagctactggcctgggatttaagagcacagctttctagcctaactccacaactgtgcccctgggaattttagtctcctctctgcatttcaacttcaccaactaaataagtaccttttaatatctaattgaattgatatgctatataagcaaaccagatgttgtgagtaaaaccagcttcagcatccaaaagttgatacagatacttttgaggagcatgtttcaacatattccttaggacagccttactatgagaaggtcatctctcagtgatttcaatgtgccattggaagaagagcttctgccatttaaatgtccagttaggcactggtggacacagcagtatccttcccattcattccgaccatattattttgaatcataaaggcatatccttagaggagaacatttaaaaaatttaataatgtatttgtttcattaacatgaagttaagactttaagataagggtagtgcccacaacacaatcttttaaaatgaagccaagttaacagtcattactctgtgatctcaggcatgcccattatctctctgagctataacttcctcatggatgatcactagtctcctgccgctgtgaacttttacaaatctgattccatagtacacatcttaagtgttagaaatgcttgttctttggtgctgtaaagaaatagaccttgaacataaatttaatttcctcagcaagaccatttttactttctgcagaaagggtacacttgccagcagttttgccacaagagtacacggaacaaaggagacagggtcattataacctgacgcgtccaccctactgctatgtccagtttccattggctggaatgggacctcacattctgtatttgtcccgaatggctagcagcttagaactttttaaaagcagcaaaagcagaagagaacaaaggaaggaggaagtaacttgtgaaatgctgagaaaggtaaaaaaccttcaaataaggaagaggaacaggctatgacctaatgcttgcttggaccagtataagcatgctagggtaaatatttaggctaaattgtgggagctaagaacataaagtacattgatttctttattacagctagcagatatttaagaatgttagcacaggtctttgaataaattttgcttctaagagaaagtactattaattcctaattagatggggaggaaaatctttgaagaggaacctctactttactttttacattaaggaaatagggtgtctagtaatgccctcaaaagttatgaatgcccggtatccgttaggtttgaactaactgatcttcacattactttaaaaatagagatgactcaattattggttggctgtgagtaaaaccaaataaagctttatttaaagttttatttagattcttgaaaaaattatttaacttgggttctccttggtatgattaatttagagagaaaggaatctgagaatgctgttgacctcatcattccttcacatgttccacttttttagtctctcattttaacttaatgaaggaaagtcatagggagaaaaaagagagagaaaagaagataaggctgtgaagagagagggttgttttaagacctcacgttgaacaatcagctaaatctgcattgaaagcaagagaaatagctcaaacacaggtttatagtattttctttctgagagtgaacattgtgcagtaaaaggtccttcacatgctatggttcatacactggcatttcatgaagcagtagggagcagagttaaccccaccaagagcactgcagtgcggccttccttcccagcccccgttccagcacctctttccatttcccgacttttctttcaccgccagtaaatttaatgtcttcagctgagcactgatttcatgagcgtaaaggacattagcagtacttcgcacatggtatgcacaaatattaggcaagtccaaggacaggatgagctgcaagcagtctatgataagagtcaaaggcaggagttggggttgtagactcctccagccaaccacagcaaccaggaatttggatgcttcggccgccagagtgcttgcaagagttcatctctgaaatcgcttccattccagcgctaacattttatgaaacctgtgcttttcaaacagattgttttattgcttcctgcatcaccaatgtgttttctctttgctcccagctccctgagagcattttgaattatagcacagatcattgccatccacaaggtgcatgacatcacagtggacttgggggaagcaatgtcaaatgagactgagtggaatgggaaggagataggctggaaaatttaaataaaggtctttaggataaaatacagaatccagaatagttcctaactctcactacgtagtcgtttgtagcaaactgctaggactcttggcttttattggtgtgatatagatgcgctgctccttaatggtagagactgtgtctttaatcaaaagttggctacagagttgtttgtgcctgtgatatacttattagtccagagcagatatattttctgtcgtgtgtgctgaggagcactgatgtaaatccacttaatgttcatatcaaactctattctccaggaaaaggtgagggactgaaatgtacatacttgttggctggtcacatttgatattcagagacccaaatgagaaagtcttgcttctgagaaagtacccaaacaccaggacatcttccaagccccacacagtagcattaatgttttaggtgtgcaataaatagtgctgaatgaaggaagaaagtttcccaggctagaaacaggtgagtggagacgtgattattattaatacaaaatctggtgtgaggtgggggtgggaccctctccccaggctgtaccgacagccccttgctctcagtcggactcccaggctgagatccggccactaaagagggaacagtgacatttcacaggaaatgacccagaaaactaacaacgtggagtgtgtgtgcgtgtgtgcgcgcgcgcgagtgcgcgtgcatgtgcgtatggtgcacatgtggtgggggctggggacagcttgaatacaacccagggaccttaactggaggaaagactttaccaggcagactctggtaaaagtcgagcaggaagctgagcgtgacaggaaccccaagggtgtcaaaatgccccctcactcagcatctcttgagtcccatcaggacagaacttgtgcttagtcaggttctggacctgacagatgtgaaccagacgccctctcattgctgggggctctgggagggaaaggtgggatgaagagggcacattcctcccaaaggacaaagcaccttttagtggaaaatgtgaaaacaaaacatgctcagttcaaacaaggctcactttggtccagtacttcctttgttatgttcctgcctcttaaatctttctgctttaaagaactctccaagaaaatattttcagagtatacttttcagaggccctgtggaagccaagaataaatggcctccttttttgggtaaagagtcatatgtttaagatagttttatttgctccccccacctcctgccccgcatgcacacacgttgatatggttaactatcttctgctctgaatcagtattaagaatgggcacagagatgactaaaagccagaatttaccatattatcccacaaagcagtaacttttcaattttaggatacataatttcagcatttttcctatcactagatgtttagagctccctccagtgtctctatattgtcatatttactttgagatttttttttttcccaaagatcctaagaattcttttaaccatagcagggagagtatgttattgtctttaagcttacttcaagaacagaacgtgaaagccagaaatatcacatgcagccccacaacctatagattgtccattcctgctgtctgtgctttttttcaggatgaggagagttttggaggtagaagaagatgaagtggtcagaggatgggactcaggaggggacagggtaataaatatggtatgaaagttgctgcatttaaagagcttagggccgggcgccatggctcacgcctgtaatcctagcacttttggaggccaaggtgtgaggatcacttgagctcaagagttcgagaccagcctggccaatgtggcgaaaccccatctctactaaaaatacaaaaattagtcaggtgtattggcatgcatctgtagtcccaactacttaaggggctgaagcaggagaattgcttgaacccagaaggtcaaggctgaagtgagctgagattacaccactgcactccaacctgagtgacaaagtgagaccctgtcttaaaaaatttttttttaaagagcttgaataacttcctcttcttagaaaacgcataaactctgatgtgtcagctgagaagccgaggacctgggatttcaacctcttgcccgtgtgtttgtgattctggcgtgaaggtgatgatgcatttccaaagttgaacttggtctgctaggtttgggatgtggcagaattctggttcctgccagagtcccagtctttctgagtgtatgtgtgtgtacatgtgtgtgcatgtgtgacgtatgtatttatatccatacatacatacacgtgcacatctacatgtgtatgtatatataatcaagatgttcaaaattcaaagcgctgttttaagagagttaaaaaaaattcactatctacagatttgaattcagactgggttaaaaccaccttcctcctctggttgtcaagaggaaggttttggagttcgtgaattttttctgtggagttaagataacgtttgatgtaggagagcaaagctgcttcccatgcctaattccataaaaagcccagaacctctgaggcccatcttcagccaagcagccttgccctctggccttttctgcaacagtgagacaacagccctgggcacagcgggagttggttctgacaccagatgttctctgctcctggttaatgtcagtgagggctggaagttgaataaatgagaacaggagtggtctgggcccatgtaaatgatcctcccttgaaaggaggaacagctttcatcatttgttccagctaagccttgcatgcattatagatctggtgctaagcagtgggaaagatctcataagtaatgttttatgttctttctgtctctcctcttctgttgttcttggcttgtgggttgtgttcgtgttgttaactggaaaattgctataagccagttgtctcgtaagttttaaaaacgaattagaaaaaccataaaatcctctggcctatgcacattgtccctgttttgtgaaaacattaaagggtaaataaaaaggaaggagaacagtcaataatgtgcatcaaatatattctgagttctagagaaattaatgaccaagcattagaactagaagcaaaaaaaaaaaaaaaaaaaaaaaaaaaaaaaaaaaaaactgtcagtggttggcgagaagtcttgttttttccagccatatagatcaactgatgatatggtttggctgtgtccctgcccagatttcatcttgacctcccatgtgtgtgggagggacctggtgggaggtattgaatcatggggggcaggtctttcccatgctgttctcgtggtaatggataagtctcacgagatctgatggttttaaaaagaggcattcccctgcataagctctctctcattttttgcctgccaccatccatgtaagatgtgacttgctcctccttgccttccaccatgattgagaggcttcctcagccatgtggaactgtaagtccaattaaacctctttcttttgtaaattgctcagtctcgggtatgtctttatcaacagcataaaaatggactaatacgactggtggttgagaaaatgtagcagcctgagatttaagaaacaagtgatccctgagacagagcccttgaccctaaaggggaaaaatattcagttacactcatgagatataaacatagtacttttgttgtaactgctgagaactgaagagctaaaagtcaacattattttcctttttgagactcaaagtgtgtccaccaggagcactcttcccaatggaggcaaaatctgccaaagttgtttttgttgctgtctaaccttagaccatttcatctgccccaactaaaagtcctagccacagctctctcaagcgattctccaccctcagcctctgagtagctgggactgcaggcacatgtaccacacccagctattttttttaaatttttaaattatgttttttagagtcaagggtctcaccttgtttctccggctgatcttgacctcctggtgtcaagtgatcctcctgcctcagcttcccaaaacaccaggattacaggtgtgagcctggtcccccaggcttgacttggcacattgaatcttttatgaagaacaattaatgacttcccatgttgtgtaaagagacgggcaaatgtggcttcaaagcaagtcttgccaaccctcgctacaaccagactgtccctggcctaagcaagcccctcccatgtagacctggaaagccacttccaggtttcaaggatgagttttagaaaattaatggggtactagcatatgtgggtcaactctttattttaatgtaaggacactggacactttaaaataagttttctaatctttttaaaaaggaagggatattttaacatccccaaagtgaaaataatataatatcagagtaagtcctagaaatttaatattatggtacatttactatgttgtctttatttttcttcatttccacggattggccctggttctcagaccagcatgtgggaactactgggttggagtgttagccaataaaaatggccaaaaagtagaccatgaccttctttgagcttttctctggcttgtaattcccgaagctccttctagtgccaaaatacttctccctccctccctcttttagactgtaagctcattgagaacaaggacaatatggtaatcttaatatctttagcacacagtcagatatgaaagagacacatcataaatattggattaacaaatgaatgttctgaaggggaatgtggttgttgccactgtagaaaaggttcaggaaccaggaattcttgtgtaagatgtcatccacatagtcactggagaattccacagttgggttgagggcaaataggaatgccatgatccaggtacctagaactggcttgaaaacttgtaccttgcaacaataaatggaagccaatggccatgtggtctggccatggccacgtggtcagaagagaaggaattttcgaatgaggatagaggaagtagccacggagccctgaacaggggcttgggaggttgagctctctccacctcagagggctgtaggagaaacagggctgtctgcagggagccaaggttacagtctgggttggagagaatgttctgaggaaaggctgaagcaagaagagagctactttttactagattactgtgtattcagagggcagagtggaaataattaatactgagtgaatagaaggacagacagacctaaggataggtgagagaggtctgtctggtgcttctgaaagtttcaagtgtctaggaagcccccagcgttctagtggaaatgcacattctggttctgtcagtctgggtgggacctgagattctgcatttcccacatgctccctagtgatgctgatgctgctgggctgtgggccatggtgaggctagcgtttaggtcaaggaaacaagcatcttcagaggatgtcctccaggagcccaggcaacagttagaaggtcaatggaaaattctctggctgcagctgatcttttctgcttccctttagagcagggaatctcaacagcactgttgacatttggggcccagatcatcctatttggggaagcagggagatggagggggtggaggtgtcccgtgcattgggagaaatttagcagcattcctggcctctatgcgctggatgctggtagcacccggcagttgtgacaatcaaaaatgtcctcagacacttccaggtgtcccttgcagagcaaaattgcttccggttgagagccagagggttagaaggagaattatgtgtcttccctccccgcttgctgccacctccacctcttgtcttctagaaccatgaggcagaaatgacttaagtctgatatgcttggaacgcaacactcttttcgctatttctgtctttagaaatgttgagaaagtgtttgcctttatttgacggcctgattactttaaggtgtcctcggcatagaccagtgagcgccttggccctatttgctgacagttttaatagaacagcagggaaagtcctttccaagaaagtgttggctacgtagcctaacgtcattttaagtcatcaccatacacccaccaaacctctgagataaaatggaaactccatcatctcttgccagggtaatggtgttagtaattcactagtgacctctaagaatttctctgtgcattcactgccacatttaacttttgttacacggcctccaaaatgttttccagccacaaggtcagtccattgacaatctcaaaaatcctgacaaggggacagatgggtttagtttttgcctttgtgatggttagttctgcttaatgtgttgagaaaacatctgaaggttttaaccctggctggagtcgtgagacggaggcatgtttaatggaatagcacacgatcgtcctctcatggtgagtccacgttggagggcccaaagacccatgttgtacaatcggttcaactttttctgaaagccaaagaaaacctacctccaaacaggatttagtctcaagctagagcaaaaatgtacatcatgttgaaaagtcttctccaagtgctacaattcataagcagtgttgtgtttttactggaaaagcttgccatctagccaagcattcttcacatttttcccaggatttagtcataaaatcattttagacatattgcaaggataaaatgtgtacatatctgataaaaggcagggatttttttcttcttttttgctgtataactcctggaggaggcgaaaaacaaactagacacacacatacacactcacaaaacacacgtatttgtgcatatgtatgtgtatatagagagtgcacacatgttcatatatatacgtgtatatgtgtatgtatatagtttgttttccccctcatgaaatgtgtgtgtgtgtaaaataaactctatacacatatacatatatattattttcaccattaagtgcaagaacttggattctttattcacgattacttctatttgaatttaaattagatgccttaggcttctctttgggtttgaataacttagacacaaagtataaaacacttcctaatgatgcccacctgcctaggacatctttaggaattcaggtggaagtgtgtttgcatttgatttatctaagacgttgcagcagtggggatgtaatttctgcctttgggcaggaagggagcttagatggtggagttcgtatttgtaaacgtagatgtgggtgcctcaaagttggctgcgttgctaactaaaggaaggagagaagtgagcccagatgttgaccttttgaaaaaaaagtcccattttcatgacagattggcataaaagcaataacctgtggtaaagtctaaagaatacaagatttggatttctggatttgagtcctgtctatgcaacttactagatatgtggccttggacagatcacctaatctcacctgtcaaacagggacaatgaaactcaacatagcaatggttgcgaggagttaatgaggtaatccgtcaaattctgtggccgtggtgaaggatgatacaaatatccagtggcgtttttgttcttgaagatagtattcttgtgtgagttcttgccaacacacatacaattacatttctgagtcagactgatttcagtagcagataaacagagggagtaaatcagcaatagattagttggaaactctggacagcaatgatttggtggcatatggcttggtggtatgtacctgcacatgtaatcatggaaagttgactattcctactgttctcccctagttctatttcacttaagaaaaagttggaatggataccagcagtgtgctgataaaagtttagctactactggcggccgggcacagtggcactttgagaggctgaggcaggcagatcacctgaggtcaggagtttgagaccagcctggccaacatagtgaaaccccatctctactaaaaatataaatactagccgggcatggtggtgggcacctgtaattccagctactcgggaggctgaagcaggagaatcacttggaggtggaggttgcagtgagccaagatcgtgccattgcactccagcctggatgacagaacgagacttcatctcaaaaaaacaaaaaacaaaaaaacaaaaaacaaaacaaaaagtttagctactggctcgggaataacaggacgtttgatttgtagcatttactgatttctgtaatataaatactctcactgtgactaatttcaaactaccaatgtgacattaccaaccatgagattgtaaagagatgcacagtagcacaccaccatataggacagtcgtgcatcacttaataatgggaatgcattctgagaaatgcatccttacatcgtccttctgcaaatatcataaagtgtgttcacccaagcctagatggtacagcctgctacacatctaagctatataatgcagcctgttgctcctaggatacaaacttggacatagggttacgattgcctacagcactcagcaccttactgtactgaatactgtaggcacttgtaacacaatgttcctaaacatagtttttgtgcatctagacatagaataggtacagtaaaaatgaagtagaaaagattttaaaagggcacacctatatagggcacttaccatgaatggagcttgcaggactggaagttgctctgggtgagtcagtgagtgggtggtgagtgaatgtgaaggcctaggacatcactgtatcactgtaccccactgtagactttataaggactgtacacttaggctacactaagtttgttttttaaattgttctttctttgataataaattaaccacgctcagcttacttttttactttataaactttttaatttttaaaaactttttgataactttcataatagcactcagtttaaaatacaaacacattttacagctgtacaagaatattttctttctttatatctttattctataagcttgtttttgtagaaactaagtctcactatgttgcccaggctggtttcgcgcacccgggctcaagccatcctcctgcctcagcctcccaaaatgctgggattacaggtgtacaccaccacatccagtttataagctttttcttattaaaaaaagttttttttttttaagttttctgttaaaaactaagacacaaacacatacattagcctagccccacacagggtcatgatggtcagtatcactgtcttctacctccttatcttttccatctgtaaggtcttcagaggcaataccatgaatggagccatcatctgcgatgataacaatgccttcttcttgaacacctccagagggacctgcctgaggctgtttacagttaattggcttttttttttttttttttttttttttgagacggagtctcgctctgtcaccaggctggagtgcagtggcacaatctcagctcactgcaacctccgactccctggttcaagtgattcttctgcctcagccacccgaagagctgagattacaggcacgtgccactatgcccagctaatttttgtatttttagtagagatgggtttcaccatgttggccaggatggtctcgatctcctgacctcgtgatctgcccaccttggcctcccaaagtgctgggattacaggcatgagccactgcgcccggcctacagttaatttcttataggtagaaagagtccactctcaaataacaataaaaagtatagtatcgtaaatacacaaaccagtaacatagtcatttattttcactatcaactattatgtactgtgcgtaattgcatgtgctatacttttataggactggcactgcaggacgtttatatataccagcatcaccacaaacatatgagtaatgtattacactattacattggacagctacagcatcagtaggcagtagaaaattttcagctccattataatcttatgtgaccgctgtcacatatgcaatccgcggctgacccaaatgttgttatgtggtgcatgactttatatccactatacaagtagatgtaattaacctcagtcatacagataatagtaaaatagagtaaaatgagggatgatgatgagtttttgtttttgttcttgtttttttttttttttttttttgagacggagtttcgctcttgttggccaggctggaatgcaatggcgcaatcttggctcaccgcaacctccacctcccgggttcaagtgattctcctgcctcagcctcctgagtagtgtgattacaggcatgagccaccatgcccagctaattttgtatttttagtagagacgggatttctccatgttggtccgactggtctcgaactccccgatctcgggtgatccgcctcgcctcaggagtttttaatataatttattaaaccataagtttatataagttaatttttaacattggctatgttgaacgcttggctgtcaagcttaactgttagctctcacagacctggctccaacatgctactgtttctccttggctgtgttacagtacaaagttataccatgaattagcaagttcaggaccatcctggaaagccagcgtggaaaatgcagtcataaatggatttttatttctgtggactttggactggctgtctactcttggtctcacattctctactgcatatctctttggctaagaaaattagtattgaaaaatggtttatggatctagttattggagctagtattcaactttttagttacttaaaagataggacttaaacagagctgaattttatagggtcttttattttcttctttggtccttaagagaagactgcagaaaactagacaagaggaatttgaatgttctcataacaaagaactgataaaggtttgaagtgaaaaatatgctaattaccgtgaattgatcattacacaatatatacatgtattgaaacatcatactctagcccataaatataagaaattatcagatgtcaattaacaatggaataaaatgaaattaaattttaaaatgaaaacattctagaaaatattcccaagaagagatttatttatttatttttctggctatctatccttaagggttcgggaaaaaatggccggtggagaacaaaagattgaaattttagctcattcatgatgcacgtgaccgggaaggagtgttaagatgtcctgtacttccttccataatcacaggttgaggtgagggttgcctaaagtctgatcagccacattttgacagtggagactcagaggcctagttaggaacacagaaggaaaaatgttaaaggcagacctttataaccaaaacaatcaacaggtctaaaagccaaagaaaccagtatttcagaattgttaacttactcctagatgtgtgttaggcatcgggcttatcttaaagaagtgtcttagaccacagaaacatagacccatgatatttggaccaagcataggttaaaactaggggagggaggcacgaattacaaaaaaaaaaaaaaaaaggtgattccatgttagaatcccatgttgaaaaggtattacactttattgtaatacagacaagatttcactgtgttggccagactggtcttgaactcctgacctcgtgatcctcccaccttggcctcccaaagtgctgggattacaggtgtgagccactgcgtctggcctaaaaagcatattttaaaattagtcacatatggaagctaagtagtgcattttgtgtttccgaacaggacttaaaacgtcagtgccataaacactggtatgtattcagacacactggtcatatgtcatgaatttggtagacatatttgtaggcaaataatgtagagatagagtcacatattttaaactaaacaactcactatgaaccatcatgatggttcacacctacaattccaacactttggaaggccaaggtaggaagatcacttgaggtcaggaattcaagaccggcctgggcaaaaaagcaaaactcctctctacaaaaaaatttaaaaattagccgggtatggttgtacatctctgtagtcttagctactcaggaggctgatgtgggaggattgcttgagcccaggagtttgaggctgcagtgagctatggatgtaacccagaaagaccctgtctctaaaaaaaataaatatatacaataaaataaaaataaattaaaaatttaaaaagccactgtgattcttctctgtgatcattcgtaagtcatacactattttgtgtgggtgaaacatgtgatctgttagtgggtctgagaaaatcatatttattaagcaaaaaagtcaatatgtgcttgtgttttgcttatgaatttactcgaataaaatgtctgaaggtcttgaaacttcttaaaagaaaatggttcttacttcattttggtgtgtttacattaaggggagccatgtgacctcttatgagagttactgtcaaatttcaagtgcatgggcattgcctggaggacttgttcaaacacagattgctggaaagcccaagaatttgcatttgtaacaagtttacaggtgatcatgatgccgctttccctgggtgactcactttgagaaccactgtcttgtgagtttagagataaagaatggttgaggtcgtgtgcgatggctcatgcctctagtcctagcactttgggaggccaaagcgggtggatcacctgaggtcaggagttcgagaccagcctgcctaacatgatgaaaccctgtctctactaaaaatacaaaaattagccaggtgtggtggcgggcgcctgtaatcccagctactcaggaggctgaggcaggagaatcgcttgaacctagaaggcggaggttgcagggagccaagattacaccgcttcactccaacctgggctatagagcaaaactccatctcaaaaaaaaaaaagaatgggttggaaaaaatgtctgcacatcagtaagcacaaaataaccattgataaatagcattacaagcatccaggatcctaacaggaggggagaaaatcaggccactttagaaacacttttatgactggcagttatccagtttgctactaaggtcaggtctaaaagattgttaagactagcctgtttctgtatccatgggtatcagctggggaagccaagttctgtctttgtgcttggcagccctccccaatgccatgtctctgctgatgacattggaatttcctccaaattaaacagcctgacagcagccatctgtaaagaaggcagcaaggttacgagtgatcactggctagtgccatttctgctgccaaccaggcaggcaaagcttctggcatgttcttgaccacctctgagaagagttgatgtttcctttggggtatcatagagtttctgccacccagctctgtttctctgcctcctggtgcctgcccctaattattgcatagttgtcactgatcctggtaacctgactgctggatttttgctccagaaacctacagtaaaggagaccgtaggccaccagaagccaggaggaaacatcaggctgcagtcaagggcactgccttctcccctccaggctgctgggctttgagggcagagaaataaaaagactgaaagggattagaggcctggagtccacaacaaagccctgtagtcatccaccaccttgcacagcctcttcctgccatgcttacaggtgaaaagtctagttcataggacacattgcttttccagaaccttccgctgccttccagagccagcattcttcctgaaaactctctcttgccagttgtttgccttcagagttacagtttaaaaaccaacacttaaactgatatcctctgaagaaaaaaacagataacaaattcatgaatcatagttatacttaaatttcctccgtcacagagaaacatgttatttttagaaagtggatcccaaacctaactgatcagaatcccttgggggaaatgtttttaaaaaataccattacctgtgcactggcccagaaaatccagggccattagagactgcaaatgtctgagaatctgtgtttcctaaaaggcacaatggtgattctgatgggcagccatgtttgagaacctctgattgaattgtgcacaattttgatggtgctgctgttgcattataggtaattcaaagaagagcttcttttttttaaaaaaaaatagtaatctataaatataatagttttcatctgaatagtgttttcttgttttcagaagaccttcataactttttttttttttttttttttttgagatggagtcttgctgtgtcacccaggctggagtgcagtgacgcaatctcggctcactgcaacctccgcctcccaggttcatgtgattctcctgcctcagcctcctgattagctgggattacagacgtgtgctcctacgcccagctaattttttatatttttagtagagatggggtttatccatgttgtccaggctgatctcaaactcccaacctcagatggttcacctgcctcggcctcccaaagtggtgggattacaggcgtgagccaccacgcctggccataactattatctttgacaattttcctgggaggtggatgacaggacctgttactgacgccagtttacatctgagatgctgcagtggagaggaattggaactagaaccgacacttacggcttcttgtctggtgtactctctgctgttccatcttcattgcttgtgtgcatgcgtgtgtgtgtgtgtgtgtgtgtgtgtgatgtgtttatttgactccttgaatctatgttgtcttgtttttcgtaaatggattaacgccactaccacggatcatcagggagatatgacgctagagatagataagccaaatggaggtagaaaatccaaactgaaaacagggagagaagctaagatagacccaaggagtctaacaacccaagttctaaactagagagaaggccactgttcatctatttcagggatgggcagttatggaaatagtatgaactcaggcatcccaaaggcagtgcagtgtatgagagaaagatgcttgcatgcatactcccagcaaagctctcagtggggcccaagatgcagggcatggagggtaataaagattagccaggaaggtgataggacaacagatactgaaaacatggcaatgaaaaaacatcagcattcagaggtgagaattaccattgccagaagttcttgggaagtaaaacaagtacagagctatgggtcaaggatctcacagttagagtactagtagcagtagggtggacttgagtctgtagtttgggaccagctgctaacttaaagcctgggaagctcgtgttagccagacattacagatactttttatgtcaccttgaacaagcttcactatccttatatttaaaataaggagtaggcctattaataatctgtatgtatttcttgcagtaaggaaatctaattttgggaaatgaatagcaagaacatagcttggtgcagtgagtcagtgagaggatttacaaaaggtgaacgtacacaggactcttaatactgatcctgggctagtcatgtcattgcacatgacacctgctgttggaaggaacaggttaagcatttagttgtgtgcaatgaacctgtgagccctgtgggctggtcccacttatttgaaatagaacgattgcagtgcctatgtgagtcagggtacacctgaatgtttagttagtgctttccattaacccttttcaattttgcttctatgttttcttttcctccagaaggaaaatgagcagaaggtgtgtcacatgctcgctttttatctgctgcgtagttcttgtagtgaaaggattgtcgataagttcagaaaccaagactactgctgcctccccttcattcattcagtagtcttacagcctaaagaagacaagaaaattaaggactctcaaggcaaaaggaagtcaaatgaaattgggaagtgggtctacagtaaatgcaatatctgtcgctttcttttagaactgcataaaccacatggaaattttccgtgtatatttgctaccaagggatgctatcatctttttctttccttttttttttttctttttttttggagatggagtctcgctctgtcactcaggctggagtgcagtggcgccatctccactcactacaacctccgcctcccgggttcaagcgattctcctgcctcagcctcccgagtagctgagatgacaggcgcgtgccaccacgcccggctaatttttgtacttttagtacagacgaggtttcaccatgttggtcaggctggtctctcgaactcctcacctcgtgatctgcccgccttggcctcccaaagtgctgggattacaggcgtgagccaccacgccgggccactatcatctttttaatttaggcacatagtgctcaggaaaagacaaggatgatggatggtaattaagtaaatgaagacagcattggtcaggagggcagtataaacaaagtaaaatagaaagtctcttgttctattttttttaaataatgataattatatatttcttacagtcatatccagagcttacttgaatctaaagcagtatttatctttgcagcaagcctatgaattagctttacagactgtaggatgcagagacccttggattagaaaagttcagtaacccatgagcagaggcatgagaatgttaaaacaagtcactaaaggtcacatagcattccactagctgggctgtggttagcactcatgacctcctggggtctcatcttttctgaatcttattgaatcatgccagctttctgatatggtccataaaatgctgatagaaatcacatgtgaagttcccaactgtgaggacagcagacttcctttagaagataaatactagacctaatctaatacactttatttgacgtagcagaatttctcctgcatccttatttcaaaagcatacctgcctgtggtcttcccgggtcttaggagagtccatatgtctgatggaagcagacaatctagtgctactcagagaaaccaccacttgatcctcagtttttttgaggaatttcatgtgtttttatgtgaagaatcactctcaggaaagttctgtattttggtagcagagatcctgtcaagaaggcagtgagatagatacacataataagctgttcatcattactgctgatggaactcttcccaggcctgcagctgacagcattgcatgggacctgcagcccctttcaccgtgactgcagattctttggttaagagactgtcagtggtcaaggctctgccccggcttctcgggatcttcacactcccctgtgcatagtaggctttgggttattggccatcatgaaaaccaagattgtcgtttaatgatcacatctatggacttggggtcggaggaacctggattcacatcttggctcctccactgactggtaagttgcttagattagttgcttttttcctctctggctgaatttatgcaattgggagttttaaaaagtatccactaaattcattgttgttgttgttaagatttagttgtgtattgtacactacctggcatgtagtggatgtttggtcaatggtaactattaaaattattgcagatatcctcaggtattatatttttgacaggagatatctgatagcctgattcgatattttatgtggaaggaagaattaaatacagaagaaccctaagacaatgctatctgttctagagagtgtttcgttaaagttgcagtgtttcataacgaagcaggcaggacggccctctgctatgcagagctctcccgctcatgacaacacaacaagcactcccggttcatccctacctactcatcccaacaatgtttccaagttgttttaaggattcagaatggccccactccttttcagatgtccctgggagggtaacccctgccttgtttgagaatcacgagcaagcatagtctgagtttgacttctgtacccaagtagcagggcaccacctccctctcagtggctgatggagaggtcttccacagtgaactttcagtgaagaagttcatgtctctctacattatctgttttactcagcattcagagatatgtggtgcctccacaggggccatatccaggctttctgatgaccctatagggagcaatggcaatttaatgaggaggggaaaagatcagcttaacctagcttctacttcatccgggttctcatggttagttgagagtgctgatccgtgaccaccattgagtcattgatctcccgctcttcctagtcaatctgtcattcagagatttgcttgatcccttgtgccagatgcatgtatttaacaagctaacatgcactaagcatctgctatgtgtcaggtactattagacgcatcatactacaatgactaagacacagtccttgtcctcaaagaaatagtagccctgggagtaaaaatgatataggggaggctgggcacggtagttcacgcctgtaatcctagcactttgggaggctgaggcaggcagattgcttgagcccaggagtttgagaccagcctgggcaacatagtgaaaccccgtctcctttaaaaataatcaaaatatttttaaaaagtgatttgaaggagtaacatcctgttcatgttcagaggcattcagcctatgagcccaaggagttacgctcatttctctctatgtacatcttttagtcctaatatgcgtttcttcatttcttttatttttgttaccattatactctttacacaaggtccttcaccagagacctgttatcagtgtcagagacccagccctggtggccttgtgcagcagatcagaataactcaaggagctcccacatttgctctcctgactttctagaggcacacgatatccacatatgttaatgtattggttttatcataggtttctccttgcatttctttcatgtaaaagtgttaagagttcagtctgatctgaaagcaaaagtttaagttctcagcataactattcttacaatcttgtgcctttgcaaatatgttaaaatgttctcagccccctccagtcctgaactccccatttttttatggttaacgcgctgtcaccactacccagcagactacaaagcagcagcaagtgcaatgcagagaacgcgatgtagatcttgttcaaagcagctgacatgttgtcatctcaggaagggcagaatggcaaggaggagtgattgatggaaacttgatggagcaaccttcacttaattatttttgcatagattcctgaattgtggcttctttgctggaaaaaataataatgatcctgtaatgcagactgctttagaggctggaatgtgtcatcgtatgtgaggattaccacttgctcttttagaaccccaagcatctatctctacctagaaattttttatcgtgaagactaatagccttaagggtgaaggagaggacagagaccctaacccagagtaagataggaatgattaggaatgattgttggtgataatcagatgaacacactgtagccctgtatcaggagagaaaatgtgtttgagattagcacgttatcagaaaaatgtttgcacttatcttattctttgaataagttgcaagctatttctcttctttcacaaaggcaaagtagtaagccaaacctgtaatcagaaaaatattgatatgttagatagagaaagttatttttgtgtgtttgtttcagttgttgaatcaactggtatgtatcgagtacctactgcatgtagggggattgtagagaactttcagcgtcaagttagagattttaaactttatcctagaagtaaaacgagaaattaaggcactgagttagaaaggagctagaccatgatttctcccatatctcttgtgcaaatggcactagccaagccagaagcccctatgctgttcctccatgtgcccctgcccagccattcagcagccttggtgctgagtctgcctgggacatctcccctgtccgcctcctcttctccatgcttactgcccctgcagcaggccaaacctgatgacagctcagtggcattgcagcaagttcctcccgactgtttgccttgcctgtagaacctggtcccttctcatccatcttctactctatgaccagagtgacatttttaatcaaaaaatgttcctgcctaacccttctgagattctccataccttcaagagatatcttggggagagaagggcactcgttacctccttcctcccctcctggcatgccatacttgtgcttccctgaatgtggcatgtccccttatgtgactctgcatgagctccctcctctgtctagacaatgttccctctcacatcacatgcagtcacacattcctgtgtactcttcaaaactcaaccctgccatcagctccaaggagcccaccctaacttttccctcctggtctcactgagccactctgtgcttcccacccatgaaactcatatgtaagatttttagtgtctgttctcttgaccatctctgcacactggatacagatgtattagtctcttctcacattgctatgagaactacctgagactggataatgtgtaaagaaaagaggtttaattggctcatgtttccacaggctgtacaggaaacatggctggggaggcctcaggaaacttacaatcatggcagaaggagaaggggaagccagcacgtcctacgtggctggagcaggaggaagggaaaggggaggtgctacacacttttaaacaaccagatctcatgagaactcactatcatgagaacagagagggagaaatctaagcccgtgatccagtcatctcccaccaggcccttcctccaaacactggggattacaatttgacatgagatttgggtggggacacaaatgccaaccatatcaatggagctccttgagaacaggaactgtgtcttttagatcttctgttttatatgtctgatgcatagtaggcagttggtgatcactcatttggtgaatgaagtgttaggctgaactgaagtgggaatgaatatgaagagataccacacacctgcattccttgctatctgtgccatttgttccatctcatatctcatggtcacaccagtctgagcaaggtcagatactctttttagagaaccttctgtggccttattccatgttcagttgtttaatcacgattacctttatttttgtattggtccatgtcctgagtattttttaaagcattgactgttgtggatccatggagaagtcagagaaaacagatgaagctctctgataggaaaaaggattgaataatcttgccatccaaactgtggtatcaaaatatgactatatatgttgcaatcaggtgcatgcgtttcttggctttcctggatgtgcaaaatagaattcaagacagggtacagagagaacacattctacataccccacataaccttggcatgactgtttggaccttgctggtaagaagtggcattggctagtcttttgttcacaggctggcaaggttgctcctgattttctctttacacggataattcctttactgaccaaatctcatgagagcaaagtgaagtatcctgtagctggcactacattcatgaccttttctatgacaggttaatcatttctttgtgtgttcactcactgacctttacttcattggccaaaggagtgccccatgtcaaagtaatgtcctcgttcctccattccatcatccctttggggcagaaaagatgctgtcttacccgtttttgtccccagactagctgggtgcctggtgtgtagatgttaaatgaataaattgtttaggcaaagccgttagtagcatgatctaatgaccacaaacagaaaagtgtgtgtggtggggaagggcaacttatattttaagaattgtgttttaataagtggtgaattatttcagtataaatccagtattatcattaataatagataaatatattgagcatttaccataagcaccatattctatcgcctctcccattacgtgaaagactaagttttatagtttgaaaagaaggaaaataggaaatatataactacatttaatattatagcataaagggctcaagtggaatgatgctggtatgacagagtattcccaacagtcctcccagttctttttacattaatataaaatgttccatgaattaaagaaaaatatagcaagtcataaacatttacaattctctttcctcaccatctaaggaggacaagttctgtgcttatttagcttgctattccttgtgaggtcagaaaggtcaatgattaaacttagattaggccaaattcctccttaagagaagatatggtgcggggtagggagtggggaacataagaacagccattatagggacctgtaagagaggagggcgagatgggaggaagagcaatcgtcctgggaaaagggaacttgggacagagaggagtaacaaggctttcagggagtctttctgagcatggtgccatgctccctactccccacttccaccctccccactccccccctcccattcacctctgccatccaggccttcccaggaacacttggccaagacttgcaagtttatttattttttttttagctcatcagctgtcattagtgatagtgtcttttatgtgcagcccaagacaatttttctccttccagtgtggcccagggaagccaaaagattggacacccctgctctagatgtgagtcttggatgaccacccttcactctacctaggctacagtaacagacgttgaaagtcagcatcttcattgttatggaggaatggaaatgggataaactattttaaaacaattttggatttaaaaaaatagtttaaatattcctgttctctcaccccacccacccctaacttctttgcattattaattttcttagctaatcttatttctaaaaaagcaaaaccttccaagggaattctttttcttttctttagggagagagtctcactcttgtcacccaggctggagagcactggcacgatcatagctcactgcatcctcaaacttctgggcccaagtgatgcttccacctcagcctcccaagttgctgggactataagtgcacaccaccgtacctgggtatttttttttttttttgagatggaatctcgctctgttgcccaggctggagtgcagtagtgtgatcccagctcactgcaagctccgcctcccaggttcacaccattctcctgcctggctatttttttaagcttcttgtatagatggggtcttgctatgttgcccaggctggtcttaaactcctggcctcaagggatcctcctgccttggcctcccaaagtgctgagattagagccataagccaccaggcctggcccaaatgaattattaatttgttttgggtagaattactaatagccaattactagttagtggaacttcaatttgggatgtttttatctatttgaataaactttcattctgtataactccatgtctaaatctataaatgtagacatacatcagtatagaaacgtcagtggctcttagattgggtactttaataataactctccatgactgaccactggggacttctcaaggagcaggagaagtatctaccaaacgtagatacctgagaaatagtggagtctgctgtaatgttcactgtggataacctgactggcagagttgtcccttctggaagagaggcagctcaggtcactgtgtaaggcacctgtcttaacttgcaatgggaattttgcagtcaggtgaggggcacaatatatgtgaagaggaagtgaatgttgttgatagcatcacatcataattaaattccagccactggatgatgaagtcattccttcacacacaaacggcattatatgcctgtaatatttttccagggctgccattacaaagtgccagaaactgggtgacttaacagacattgagtgtctcacagctggggggcctggaagtcagagatcaaggtgtgggcagggccatgctccctgtgaagatgctcgggaaggatctgttccaggtcactccctagcttctggtggctccttagcatgtggctctgtcactccagtcctcacagagcactctgcctgtgtgcctgagtccacatttccccctttttttttcatgatggagtcttgctctgtcacccaggctggggtgcagtggtgcgatctcacttactgcaacctctgcctcccaggttcaagagattctcctccctcattctcccgagtagctggaattataggcgcccgccaccacgccaggctaatttttgtaatagtagagacagggtttcaccatgttggctagactggtctcgaactcctgacctcatgatccgcctgcctcgacctcccaaagtgctgggattacaggcgtgagccaccgcgcccagcccacatttccccttttcacaaggacaccagttctgtcagattaggaacccctctcctccaggatgacctcatcttaactaattatatctgcaacaaccctatttccaagtaagttcacattcagaggtattaggggtcaggatgtcaatatataaatttggagggacagaattcagcccataacaatgcctgccagtggtagttttttgggggtcagggtgagtctagtatctgcattttcaacagcatgcctttttggggagatgagtgtcaagcattcactgatttgaggtaacggggccctcttgagtctgtgatgtaatctcacactcccctaagagctatttatggcctacaagcctgtgcacatttgaatgcgcgtgtgcagaaaagacaatgagccagacaggcttctacacccacttaagagcactcacatggatcagtcacccaccctgaatgccacgttagttttgacatctgaaatgtgtctggcattttcaggcagagaaggcttttaaaaaaaaaaaaaagtcacatggatgccagttccttactatctccctaaaagagcctaaacacagaaatccagacacaggaactcacaagaatattagataataaatagccaagcttctgaagaggcctggaaccagagaatgatatttaagggttattaagcttaattttttgcactgtggtctgcctggcatatagtagacactcactgaaagtttgtgaacagatgactaggagagtctctgttccgtgggtatgaatcttaaagatgcatgtattcagccccttctcctggcttctgttctaagcagagggaatctgatgccttgtttctgcgcatctgtgatctgggcagattacagatgtcacaagccagtgatgtacacctggattgcatcctgaccaaaatcagggaagtacccgctggcatgttgaggacctcctttgaagaaaatcctgtggctaaaccaattcattgcccttgggagagaaacattctatagcctgctgggtggatgtgtacagtccatgtggacccacctaagtttcctattttgttccttctttcttgttttcctttccttcctcttttcttactttttaagccacttattgagtttatcctttcaaaactcatcttgaggatatgttcaaaaatgacccatctagagcttcctgtacacttctttgcagagtgagttgctgctgacttatttctccttccagcgtcttgctgatgcctctgtagagtcatttattacctgcgtaagagtgacctctacacgtgcctggttcccaacaagacatggagtctcaactgaattttactcatctctgtttccctaatacctagtgcagtacctggttagcacttcctggatgttcagtgtatggttattgaatgaatgaatgaataagctgttactttctgcttgcatagcactgttctagagtgtcatggaggacacaaaggaatagaattgatagtaggtcattcttcagttgcgttgcatcacaagggtaaaacgtgtacttattcaaaataagtggcataataataacttcttaaaatttttattttatttttccgtaagttattgggatacaggtggtatttggttacataagttctttagtggcgatttgtgagattttggtgcacccatcacctgagcagtatacactgcaccatatttgcagtcttttatccctctccccactcccactcttccccctaagtgcccaaagtccgctgtatcattcttatgcctttgcatcctcatagcttagctctcacatatcagtgagaacatatgatgtttggttttccattcttgagttacttcacttagaataatagtctccaatctcatccaggtcactgcaaatgctgttaattcattcctttttatggctgagtagtattccatcatatatatgtaccacagttcctttatccactcaattgatgggcatttgggttggttccatgattttgcaattgtgaattgtgctgctataaacatgcgtgtgcaagtatctttttcgaataatgacttattttcctctgggtagatacccagtagtgggcttgctgaatcggcatcataataacttaataagtcaagaggaggtctgggcactgtgctcatgcctatactcccagcattttgggaagctgaggtgggaggactgcttgaacccaggagtttgagaccagcctgggaaatatagtgagactttgtctttacaaaaaagttaaaaaattagccaggggtggtggtgtgcacctgtagtcccagctactcaggaggctgaggtgggaggatatttcagccagggcagtcaaggctgcggtgagccgtgattgcaccactgcactccagcctcggtgacagagtgagaccctgtctctaaataaataaataaataaataaataaataaataaataaagtcaagagaggggcccagtggtgtaatggaagagcactgttcatagaatctgtagatttgttttctagtcctggctccacaagttacatattctgtgctcctgggaacttcccttaacctacatgagcctgagtttactgatctaaaaagtgggcctaacgcctatctgaaagaattactggggatattaagggtataatgtatattataaagtgcttggtaagtcatagcatggtatctaaatctaaggtatgttgcttttatgacacaaggcagtatctgagttaggacagaccaggggagtggtacaatcagttaatgttctgagttgctgggtaggagttagcaagtaaggcacgtgcaagaattagaacttggccagagctttgaagaataaggccacctggcatagacaaagggaagcagtgtggcctgagtacctgcacacaggttgtggtgggccaggaggatatgaacgagccccatggctgccatagagggctggtggtgcccgagatggccctccttgccatgaagtaggcagaaggcgcttagagctctagtttcccaaatggagctcaattgcttgtcatattacatacacgtgctgttatgtgtgatgatgctctgttctaaccctgaaagacctggtggagccttagcaaatcactggccattctcccaaacactgcgtgtgcttatgctatgccgccatagttttacaagcatttttcagcgtttatgcaaatgctgcccttctgtctttggtaactgctttgctcatctttcaggattcagcttacatcttgtcttctctgtgccacattcctgtcagcagccacctcacaccacccgctcctgtgcacacaggcgtacagagatagtcttgttcctctctgctcttagagcaccattcagctacccccagtggagcactaatcccagtgagctgtgatggtttcttggtgtctgtctccccgcgagaccatgggctcttggtgaacagcggctgtagcctgttcagctctgaccctccggaccctcatataacctgtatgacccatgaaggtgcacagcaatgggaaggatgagggaagaagaaggatcttttcaaactctgtacattcttcacacagaaaagcaggctcatatcagctgacttgttctcccaggcagagaacaagagtgtgccacattcactccagttgaatggtttcaaacttttcttcctttgaggtggatgtatttttggcttttggcagtgtcttagtccatttggactgctaagcaaaataccgtaaacttataaacaacagaaatacatttctcacagtgctggtggctgggaagtccaagatcaaggtgccagcagcttcaggatttggtgaggtttgatttttttggttcatagatgacaccttcttggtgtgtcctcacatggtggaaggagcaaggtcgctctctggggtcccttatagatgggcactaatcccatatatgagggatactgaaagtaaattgatggaagtgctcgtgtgaatgaatgaatgaatgaaaccattttgaagctagattgctaggttcctgcaggttatatctttgtatactccttacctttcaagaatgtctgcagctctctgcatacaataacttccttgagtatatataactacagtatgacaaggcttttaaattgaacaattctaaagactgtttttttgagtccaaaaagtagaatttggtatcaacattaggtttaaaagaagtgatttcagagtttgtcaactattcaagtgtcagaaaaaaataatgtaaatgatgtgcttaagacatttatttttgtattctcgattctcctgaaataaagggaaattgtcttgaaaagctgtagattttaaatgaaaaggaaagcgggaaggtgacataatttgcctctgcctttgcagaaattcaagtgtatatggcctctctccaatccaccattttcccacctccacaggccccatgtcagctgtttccttcatatcattgcaatgctttgagggtgattgttggtttaagctacagtcccttcaaatttgtgaaagactaaacagattgataacaactccacctagattaaatgaaattctgtgggtagacaggctagtcaaaatacaatccccacacaccccaagtgagcattgcttctcctttcagatatgctgtgggtacaaagaaaggatttagtccaaagtgccttggggttttgttcagtccagagtgtaatttttttctctcttttgcctatagccatttctgtaacattactgaaagggcttttttcctaatgaagcatgaaaattgatcgtatcttgccaggagagttcttcctaagtcttaagatattaaagatttcatgagaaccgcatgaagaatatcttcttgaatcatttacatttttcccttttgtaggcttatgtaaccatgcagaaaatctaataataagtgtgctattagtgtaccatgtgccatcccgcaggcagctgtgccatggggcaccagtgcccagggcttgtggatagcattaacctgtacaactttctaaagtaaagcccagtgggaaatctgtaggtaattgaacagatagtccatttttatcagacttccccctgccccttccctgttctgtcttttctcttttcttgtgccagaaggaaacaccttggccataggcctttcattcacaatggagtatattttccaaagcaaatagcttggactatttcaattcccagagcaatctaggtgggcacacagagctaaatttgggtttgaaagaactcttaaattagtatcataggaaggcaatgagcaggaaaaaaaaaaataaagatacaagcattgtggtctgatggaaattatccagcactcacttacaaatgacaagtgggtaccacccagcctttctcatgttccaaaatttaataaagggttccatctaggtcccccagaaactactgtgattatcagggtgagagaagggggaatgatgaatttttgtaatgccccaatctttgtaaccaggcatagaaggacattcgctgggctcaggatgggtgttagcatgtagtggataaaggaattgcagagttgttgacagctgtttcctcagagacacttgtcctgatgatatttgctttggattctaagtaacagagctgtagttcttaaagtttaaattgaaaaaaaggagttttctgtcaagtggcttagtcatggaaatcagtgaagttaagcttgggcaataatatatccttttcaaatccaggtgccttcctgatcatgccagagcttttgtgactcctttctccttggtgttcttcttttgatgcggcgatagggtctgaacacgtccaggctgtctttgctgggagagggcagaatgcctcggctttcttcagccttgcctttcttcattgtcttcaccctgcagcacttctgcaaagctgctggggtaggtgggtgagtgggcgtcttttctttgctagcccaagctgagttctgaagggaagttagcagggctcagctgctgccgcaaagtcagtcagaccaattctcatttgcatgcctacagaattagacatattcaggggctcgggttaatgccataccctcctcttgtccttggaaaactgtaagaatgcgtgcaggtaactctgcagcaattctgtgttgctcagatgtatttctcttctttcagaattcctccttctatagcattcccctaatatttatgtgctggggctttcttctttcatcccaggccccagcttcgctctatatcagacagaggtgggagctgctgatcaagggggcacacttgccatccaaacctcacgatgctcacaggtgtcctttcaaccctgctaacccagatgatacatcaccatttatacctttggaggcattttctctttaattgatgctcacttagacctaagattgttcattaaagtccagaggtgctcattaaaatgaacattggatagtgtggtagatgcaggttatcattatgaatccaagaaagggctctgtggaacttgttatatacggcatttataggttgttaaattaaaggattagtgttgtgctaaaccattttcaggttaatcagttgtgggaaaccagatctaatgttaaagcaggcttaaactatggtttttatagtagggaagtttttaagctactgttatttctaataaaccctctagcttgctaatcgagcatacttttcaatttttgcacttaactgaatatggtcttgttccctaatttttttatgtgtgggctttatttcttcaagctggattgtaagttcctttttagcagggtctatgtcttttttttttttttttttgctcatatcctaaaagcttctggtataattcgaggtatatagcagatgctaaggattttattgagtgattactacatttttagagtgtcattacaatgtattatcacctggtttatgccgtggtgctttatgtaacatgtgcctatttacagaacattgatataacatgttggtctgcaaccaggttgttatcagcaataggaaaagcattacagagttcatatggaagtagaggagaaacaggtctaatttgggtgtgatgccctgtattagtctgttttcatgctgctaataaagacatacccaagcctaggtaatttataaagaaaaagaggtttaatggactcacagttccacgtggctggggaggcttcacaatcatggtggaaggcaaaaggcatgtcttacatggcagcaggcaagagaaaatgagaggcaatcaaaaggggaaacctcttataaaacaatcagatctcgtgagacttattcactaccacgagaacagtatgggggaaactgcccccattattcagttgtctcccagcaggtccctcctacaatatgtgggaattgtgggagctacgattcaggatgacacttgggtggggacacagccaaactatatcatgccctaacctgatcagatatggcttccagactggcccctggagtggcctgaataccttcaccaagacacgtgtgtgggacagatcaaaagtttccatctgccatttgtctttcacttggtaactgctaatgattgcttgttaaccatacacattaatatgcccgtgaagcagatagaaaataaaataagtaaaaaattgtataagtggaaaaactaagacccaaacaagaaattatggatcatttctaaatggtggccaggacgtttatacggagaaaccataccattgaaccataatcaatgtaagaatacaactgatggtttcagactttcaggaatagaatgagtctcaggcagacatgttctcaggcaacatggcctgggacatccccagaaacctcctccatggagttaacaggacacctacatggccctatgtgtccctccacttgggcctcttgttcaacctcgtatcacatgtccccttcctaccacataaacttctgtctctacattctctactctaccacaggttcatttatttgtttgtttgtttgtttgtttgtttgtttgtttatttatttatttatttattttgatacagtgtctcactttgctgtccagctggagtgcagtgtgcaatcacagctccctatagcctctgtctcccaggctcaagtgatcctcctgcctcagcctccctagtagcaaggactatagacatgtgccaccacgcccagctaatttttaccttttttttgtagagatgagttctcactgggttgcccaggctggtctcaaactcctgggctcaagtgatccttctgcctcagactcccaaagagcttggattacagacatgagccactgtgcccagcccacagtcatgttttaaagtgtctgagctataaatactactataaaggtgtcaactggttgtatatgtgggcccttggcatttcagaaatgacagttattgccaaccattaccaaatggaatccattttatccaaatgggcatggttggggctgagcatgggatggagtaatgcagtcttattgcatttcagtgttagagggctttcactcggtttgcagtttctccacagctcacccaccaattctacctgtgtacttcttttctgttccctctcaacttcttttccattctctccttcctcttgtttctgtccatatctctggcttcttttaatttcccttttcccttctttcttattggtctggccctgggtctggtgagaccaagggcacagaaggatactggctccatgccaacctttcctccaaggcacaatctccttcttggcatttactgagatgttcaacttcctgtgtttctaatattccttcctgttttataaaagaaaaatagattggatttgcaaagtgccttaatttgttgattttctaaaaagcaattttaaaaatgtgtatcaacaatatcacatacatgtaactgatttattgactctggcttgccctgggtttaatcacacataaagaaattttacaataacacatgatccagtagagaaagaagtcaaagaaatatgtaaagtcctgtgacctctgtagacatttgggattaaaccaaattaaaacacctgtatgggctgggcatggtggctcatgcctgtaattccagcactttgggaggctaaggcaggaggatcacttgagcccaggattttgagaccagcctaggtaccatagcaagacccaatctctactgaaaaaaataaaaataaaaataaaaataaaaataaaaataaataaccaggcatagtggcatgcctgtagtcccagctactcaggaagctgagatgggaggatcacttgagccagcagtttgagactgcagtgagctatgattgcaccactgcactctagatgcaacagagcaagaccctgtctcggctcaaaaaaaagaaaacacttgtatcaattcaggtcaaatattggtttcttttttttaagagcagattaacatcttgcatatcttttgctatcacatttcttcttatctgaccagctgaaatggaactagtgttaaatacaaataataaaacctgtaaagatcctaagtttttgcatggtacaataaatcctcactcattcacatgcttggagaaagtccagtctgattcaattaatgaaaagcaaaaaaaaaaaaaaattgtaactacataatttttatctcatgtattagctcctatttagttcacataagtgttcaaataggtactcatttttaattaacaaaatatttgtgtgtagtgagtatttttaaaccaattaaaacagttccttcttgtaagtaaattaagtgctattcttagacgatggtatgcatcattcatttgctttgcaaaccattctttcacaccattctagttggtgtgaaagcaaattgagcccatctctactggaatttattgcattctcttaatttctgacactctatgctcccaatagtagggactccatcttagccaccacgacatcccaggcatggctcctagaataatttcagctctttaagactcaattaatatttgctcactgattaatatttagctccattaatttatgtgtccaaattccttaccatttgccaagtgcttttggattttacagttagttacaaactgtagtttaaggtttttctggctttacttcattcttcctttaactagctttaaaaaactagtttataattctagttacaatacaatgttaagtgaaagaactgattcaaaattatatattcagaattattctaactttgtaaacatgcatagatatatgtgagctttaaaaaagaaaattatatatatatgccaaaatacaatcaaaatgtaaatagtggatatatcatgttggagatattaggagcagttttatattttttaagttttctgtgtttccacatatgatcacactttatttttatatcagaaaaaagctatcttagttgtgcattgtacattagaaatattagttttgaagataacctaaacacaagtttttatttcttctgtcacagttgcctcttttcttaaaatcgtgtttgccagtttctttcacgacactgcaaacaattttagtagcttcagttctttgataaatctgtagcttttagatctttgattactattagcaaagaaaagatagacccaaatgaaaaacagttgcatttttgaaatatgtccggcgggggttgatgtggaaagaacaattcctctcaactccagggtcaaagcagcagccctgccaggctctgtcggggtcgcctggagaacatcacttaactttctacatcagttcctgcttctggacattataacattcatgatatccacctcatgcaggattcctgggaggagcagatcagatcataatgtgtgtgaaggggctttgaacgacagtcaccacattattaccaccataagcattatttccatttcaaaaatggtagaggagggaagatgcagatgttctctttatgttggctcggcaccaggcacgtccaggttgtgctgctttaccctccagcatgaagagttagaaggtaaatatcgatattgcttttcataactaatagcttcatagttcatgtcaggtgatttcttggcttccgttagcatttcagagaccattatacacagcagccatcctctgcagagctggagaaaactcatttttcaaggcaaatagtcccaagtcagggttcagtcctggtggaatgaaataaagaaggagagtttatctttaaggtaagctagcatttaagtagatgttggatattatcagagatgcttatgaggggcagagagcattgaagacttataccctttgcacatctttaaatgcctgtaagtgcttaccaggagccaagagcgaacgggtggctgcgtgcaaatgctagaggttaacccctgtccatgggcatttaccgcatgagtaaaaatttattgcagagttcaggactgtgattctgctgctcatttctgtagcgtatttctttatctgaaaggatgcccattgtcctttctagctttttgggccataaccgtgagggaaggcccaaaggaagaacctctgttggagatcaggtttattcatccatgtgggtggaggtacgaaggagggaagaacctctgttggatatcgggtttctttgtctgtgtgggttggagactagtagaataggggaaaccacatactgcccattcctccaggatcattttccatttggatatttagaaagcaacaagagaggagttttagaagacaaggtagatgatttcaagttactttaacatagaggaagaaagtttccttctatttttaatggctagtgcatgatttgtgggagtgaagattgggagggggcacggacgaacaccaggaagaggcggttaatttattggtccccattaattgaatttaataagtgagttttgtcagtttagcaatatccattagtttcagagagtgtttcagtattattctgtaaaagcatccagggatatattttacagctacagcatagattatcttgcacacatattgaagtaaagatacctttcaacattccagatactgacttttcacccaaatttgaaaatctccatttagcactttctaaaataccagtgaaaattaatatagttttgtagatttatgtactaagatgcagattaagacatgtggaatctaatgaacatagcaggaaaagaaaattttctcaagtctgttcattactattcctcatcacattttttattatttaatagcttattccttgaatatgtgtgacttgggattagatgtgccagttggaagacctcagaggttcagaaattcacagacatgtgaaatataaaaccgtattcatttagcagatactgataggcatataaaatagaaccttcatcatctatctttagaaaaagaagattaaacagaagtgtaattaatttgccaactctgcttcccgattgagacatttatcaaagttgatctttaatcattagtttcctaatctgtaaaatgaagtctattatgacctctaaggtctatttgtaacagttaggattaggttcagttccatatcaccaaaaaaaaaaaaaaaaaaaaaaaagaagaagaagtcaagccaaagaaatagacatttatttttctctcacataaaagtggttttgagaggtaagcagtccagggtgattatggtcactgcacaggctcagaaacattgtcacctttctattctgccatgctgtagtatatttcttttcttttctttctttttttttttgagacagattcttgctctgtctcccaggctggagtgcagtggcatgatttcagctcactgcaacctcttcctcttgggttcgagcaattgtcctgcctcaggctcccgagtaactgggactacaggtgcgcaccaacatgtctggctaatttttatgtattttttagtagagacagggtttcacatgttggccaagctggtctcgaactcctgacctcaagtgatgcacccgcctcagcctatgtctcacatacaagatggctgcatagctctagcctttaacattaccattccagaaagcagaaaggaggaagagacgaaggacctaccccctttccaaagacacttgccagaggaaccataccacatttttgtttacttcatgtcaacaagaatttagtctaggcatacctagctgcaaggctaggcataccttcttgcaagtctaggcataccttcttgcaaggcaagaagaagatcaggtcattcagttgggcagcaatgtgtctacctcaaaaccaaggtttctacttctaaggaaaagaaggaaagtgggatattggggtaagcaacaattatccacaggttttgagctcaaaaagccgtgatcgcatgtttctgggaaaatttgacctatacaatcgagtctgaatgtgtgctgggtgtgtacaaatcagacaacttcaactgtgagccttcattagctctcccctttatctagacttaggattgtatttccaggcataggtcagaatctttacactgattgtgtgtgtgtctgtatgtgtgtgtgtgtgtgtgtgtgtgagagagagagagagagagagagagagagaaacagaatcttggctgcaagatgtgctgaatataaacacaataacttagcaatttataactgcccctttcccatctctgccccctccccagtatcagcatacgcagtgttacccccacactatcaatatgtcaatgattaatagcaactggcaaatgtgtgctttccatgagacttgtatgcaaggttactcgggttcacagaggctgctaataacagcagcactattgaattatgctatgtgtctgtgtctgttaagacaggtcggaggacaggggaggaaacttcccccagggtaattgagagacaaagtcactaaaagctacagatctccagtttgggctctatgcatgagattgttcttaaaagtcaaagaaatataaaaggaaattgcacatttgtaatttttttaagttccccatttcatagctcattaaaaccaggactttaatattctgggtcagaacccccattggatatttttgtgaacatgtaacatgtgggttgattagaggtttgggcctgtttttttctttttctttttttttttttttcagacagagtctcactctgtcacccaggctggagtgtagtggtgtagtctcggctcactgcaacctccacctcccgggttcaagtgattctcctgtctcagcctcccgagtagctgggattacaggtgcccgccatcatgcccggctaatttttgtatttttaatagagaaggggtttcaatatgttggctagtctggtctccaacacctgacctcaagtgatccacctgcctcggcctcccaaagtgctgggattacaggcatgagccaccgtgcccagcctggcctattttatttcatgcatatatagtttaagtgtctctgagattcttgatcaactaacaaaatccaagaggcccttttgttatattctaaattcattcctgcttctgattgttgcaaaggggtcagcggatagggtgccagagccagaagttagctaggtggcaggttctgaattaatgtggtattctgggtaatataatgtcatttcctagggaactgccagcatctagctgacctccaagaggacaagtggtcaggaaggtggagatagtattagaactgttattattgttgttgtttttaacaagcagacctgtcatgaaacttgccatagaggtccccttttccatatatcaccaaagcctcataggtaagaaaaggtaaacatccaagattgtttctttaaagattgctgttgggcagaccaagatttagccacaaaaataaacataatctctgatgctgagaagagatcagaatgagttgaaacacaggggaaaaaagaagtaagcagaaaaaaattttacaatagtagatatggggattagatagatagacggctatatagatatataggactctgaatagacccattacaggcaggcatgtaagtggaaatgattaatatatagatgtagacacaggtaattctatataaatgtggaagagcagcaggaagtttctacagctgggaaggaaaaggtaattttttaaaaatgaggtcattacaggttgtttgggtccaggcagattcccattgtcctccctaaacactgcttgtaaacagttttgggactgaatgcaccctttgactgtagtctatgctttacattgactagaactgacaaacagatgaaaagtaaaataatgtttctagagattttctatttggttatgtcatttttttccatggacacatctggctaaagccaaggggtgttaagcccccaaatgtcatttgaatgttcttacagtatgaagaagaggaagaagaaacactttgaaaaccaataattcggccaggcgcagtggctcaatgcctgtaatcccagcactttgggaggccaatgtgggtggatcacctgaggtcaggagttcgagaccagcctggccaacatggtgaaaccccatctctactaaaaatacaaaaagttaggcaggcgtggtgatgcgtgcctgcagtcccagctactcaggaggctgaggcagaagaatcacttgaacttgggaggcagaggttgcagtaagccaaggttgcaccactgcactccagcctgggcaacagagtgagactttgtctcaataagaaaaaaaagaaaaccggtaattctgttttggaactccttgctctgctatggcacatgtatacatatgtaacaaacgtgcacattgtgcatatgtaccctagaacttaaagtgtaataaaatatatatatatatgaaaaaagaaaaagaaaacaacagtgctgattgaggtgtcacacttttgctggttgtctctcctgggtatacctctagcttatcaccgccattctgggaagacaggagcaactgccttttagctgtagtcaccactcatttccctgttagccccttgtggactggaagctccttgaaggagacaaggcaccaagtcacattttacttcatatcccaccaccatgatgtgcctggcacgtaaatgttgaataatctgaacgagtggatccctgaacagtttaataaaatggggtttaaggagactgtgacattcatgaatagcatcacatccaggcttatttctatggctttctattgggctcaatgcctgggtccctggcacatgagaaacaagtatccttgagcagtaggggaaccataccttattcttaccacctcaaaatatctagaactggctgggtgcggtggctcatgcctgtaatcccagcacattgggaggctgaggcgggcagatcacgaggtcaggagatcgagaccatcctggctaacacagtgaaaccctatctctactaaaaatacaaaaaattagccaggcgtggtggcgggtgcctgtagtcccagatactcgggaggctgaggcaggagaatggtgtgaacgtggaggcggagcttgcagtgagctgagatcgcgccactgcactccagcctggcgacagaacgagcctccatctccaaaaaaaaaaaatctagaacctcagcatgaagccatttttaaaatggtgccctatacttagtcaaattcaggcaattcagtttggggaattattttctgtaaatgaggtgctctgaatcagagttctgactccagctttactggctgcctaagtgccatggtttagtgtaatgaaaatacagtggggggtccttaaggcatcattcagggtctacctttaagcgactccagctcttgaacttaatgaactggacactttcaagttctgaacatggtaaataaaagccagcacctgctgccaaaataccttgtctcataatcaaaatcatttctagagccagcggaacatggattccctgagaaattcccactgactcagcaattttaggttgggattttattttagagtcacttaacgaaaagatttcacctagtggcatggccccaatatttatcaggtaactctggccccatctcagcagactgactgattcaatcatcttaccctttactggggatgaaacgaaatgcttactaactcactcctgaccccacctgccactccaagtcattccagcaaacaaatccgtaatagattgctgagagggggaagataggtgaaattggagaatacactaaaaatcaactagttttaaacggtacgggtgggagccatgccccctctgtactggtccactttataaatcccagagggaactcattctatgcttgaaggaaaactttgccttgttctttggttagattgtgctgaacagatcaattcatgtcaaagagcatcaacttttcttatttatgccatggcttccataccacatcacactttatttactcttagtggaaccttgaatcaatgatcaattttgttttgtccttcagtggagtatcagacaccaggacaacctggtcagcaaatattctgaagtcctcagcagttattactagacaggatattagcatatggcacatcatggaattaatttatgtaacacatacttagcatgcacctatcaaatatgtatcaggcacagtgccacggccttaggatggagaagaaaaaacatagttcttgctctcagagagcttagatctagaagttgatagatgctgttttccaagtttctccacttgtatttctgaaactgtgaacagccaactgacatgtagtaagcaatcatttttccagaaaaagtctgttggggtgaaataacatgataagggatctgagaaaagtaggcagggtagggatggcaatggggaagattccgttataaaggaacagcatacatatagattatatcgctgtatatttgtgtctgtgaagcacctcatttaattagatggtatcatggcaactagaagagtgcttacttaaatgagcggctccatgcaaagccctagcagactgaaagtgctttgtaggtattagctgttattattcctactgctcatcactaatatgtagtaggcactccataaaggtttgcgacatgagtgggtgggagatttagtgctgaaatgtaaacctatacataaactgaatatcacatctatatgaatagagaaccttttacagtacaagcaagagcaagatgttcacattatattctgcaaagaatgatctgaacacttaaacttacaggctccgaaagtgtctctctgcccaacatccctatccatttaaatagaaatggcagtagcagcttcctggtgctgctggtgggaagagccgtggtaaggtgtctcctttctttcactccggagcgggggtgatgacaggagagggaccgggcgggagcgaagtgatgatggtgataatgggggtaactgctgagagcgggagggtgggggccaggaacaggaggagtgtgagcgtgagaagacagtgctcagaagccgacacccaggtgacttctctggaatctccctgctctgaaatgggtaacgtggctcctttctctgaagctccaacacttaaaggagcttcttgttttaagcttcttgtgttaagctccagatttttacaagcatctcttcagagcctggtctccaaagccatccgtccagtcagatcaagagctacttgccctgtttctccatagtcacgaactggttaatgtgaggggaaggcaagaatggtctccatcgtcacgggtttctgccttggtttgaagcaagctccagcagttacatgaacaccagttacggaatgtctacagttatgacaagacacagcagggctgacccggctcacccagcaagggaacaaaggccatccacacgtcagacccagcaattcaggtgaaggaacacacagaacctcctagttcgctggatgaggagtcccccaatttcaccagataatcacacaacatgttttcatatggccacatgcccacagcctcaagaaggtgaagcattttcagagaatgattcctgacactacagaaacattgaccatttagaatcagaagaccctcagtcaaggctggcctcacaggaaaatcaaatgtaatgattcccataatgagttcaagccagacaactgaattatgcatctgacattaaaacaactgggggattgtaggaggaggagaagtttgggaagagagaggacagtgtaatcttctgggagtaaaatttattactgaacattaaaaaaagatctgcaagttaagttgagagtcattttgtttatactcgaaatgctacaatgtcctttgatttgtttatgcaagttttaggggacaagttacgtttttttagcatataatctacatttattcccaaaacactgctcctgagacaatccatcagatatttcctcaaggctgtggaaaaggggataaaaggcatatttttaaaggtgggcgtgtatgtgcaaaacatgtttgttttaaagagatctgaatgctgtagaaataattagccatgtgcgtgaacgaaaataatgaataccaaatggtacaatgtcctgcttgaatcctgtttcagaaacagaatgtgaaggaaacattacgttctctcatccctctcttttctctttcacccttgttacccctgaattttgtaataatcactattacccttttggctatgaatttaatgtctctatatatagagccacacccctaacacagattcttcttgcctctcagagacagttaaatgtctttgggtattgcactacttattctccataggggctcagacatattcactattgagcattttcattagctaaaataaattaaatgtatgtcgtaaatgtgcagcaacactgaagaagctgcgagctacatcttgtccttgggagtcatttacttagaataagtaaagactttctcacttgctagtttcaggcgtcttaccttgtgttattccttacaaatggacagggctgttctagaacccacttcctgaatacagggaaagaccccagtggtgtattgggataatggagacagacaggtctgaatgtgaggtgtggacgtgggcttgtgtgtgtgttttctccactggatttcttcaaacctaaagttgctggatcacatttctaacaacaatttgcctgaccttataggatctcctttctcactgaatatgttacgattagaggaactaagattggctaaaggacttttggaatgagccctggacttaaaaacccgttgaagagggagcaaacaagaggaacagtgttttccaagaggcttacttctcttaaattgaaatatagtcatgttccctggctctgagggcactttctcagagcccatatgtttattcaagcatttgcttcgtgatgtgggaggctcagccagtgtaatcccaggcatgagatgttcaaatgctgaatatgttattcaagcacattatttcccattgacatatgtaaatttaaaaataaaataataatgcaaatttacatattgaatcttgggaatggaaaacacatttccgatgtcactgggtatatctgttcccctactttaaaataggactatagagctgttctctttgaagtcatctctgaccatacagtttaatccagtgggcattaattcagattctgggttagtgtcttgtagaagctctccggtgcttctaatattcagcagatattgagaacccatggtctaatccaatggccattcttagtctttctgtttctctgctgcatttaatataattgatgtcttaattttcttctgtcttttttatttttattttttacgtccataggttttgggggaacaggtggtgtttggttacatgaataagttcttcggtggtgatttctgagattttcggtgcagccatcacccgagcactatacactgtacccattttgtagtcatttatccctcacccccctcccaccctttctcccaagtccccaaagtccactgtatcattgtgaggcctttgcatcctcatggcttggctcccacttatgcgtgagaacatactgttataggatctctggggtgtcaatttttctgatgggaaacttctgtggccgcaacgccttttaagcccaagtttttgtcctgcgtccagaaagaatgaggtacacagacatgtgaagggtgaaaaagaagagttttatttagtgttagaacaactcggaggagtggggagctcctctctataagcagatcgtcccattgagtgttcagctctcagcagagaggaggccctggaaagggtggctcctctctgcaggcaagtcattctgcaggtctctgaagcactcctcttagcagagagggtagctcctctctgccagcaggtcatctctgcagctggttgtcccatcgtctccagctatcagcagagagggtactcctctctgcaactggtcatccagtcccattctctctctgccccctttgtccctggccatcctcctgcctgctgtggctaagcccagggcttttatggacctcagaggggaggaagtatgtgccaattggtccatgggtggccatgggtggacggaagaggcaccacgagtccccactctggtcggcaggactggcagcccggcccccagccttcaggccctccctcgcctgaaggtggggcctaattggggactcccctcttttctgccccggaccctgtcttcctcctgctgccattcatggccccggggcttggccccaacccagctctgagatctgagtgggtgcctggaacggagagaggccaggcagtgggcgcagacacatctgagcatgcagagatggggagggtccttcctggggcgcccaagggtgcaggctgcagagacgcccaggtcctgtgcctgggagggttggccacagctgcacccgggagctcccgccctgacaactcggaaggggcagggctcccgcttgttcctggctcctgcctgcttcctggaatgggaggcccaggtctgcagccgtgggtgcggcagctgcagctgcacctgggaaggcagatcctgcctgttccaggctcccccaagagcacagggagactcggatctacagctgcagtttgggtggctgtggccccaagagggcggggctcctgcttgctctgtggagcaggaggcctgggtctgcagctgcagttcaggtggctgcagtggcacgcggagctcccatcccaactcggaatgaacagggctgccaccagctccatggagtatgcagcaccagccgcgcagccagcttgatggcagcagccactgccatcattacggtgttcagttttccattcctgagttacttcacttagaataatggtatccagttccaaacaggttgctgtgaatgctattattttgttcctttttatggctgagtagtattctgtgatatatacatacaataatttatccactcattgattgatgggcatttgggctggttccatatttctgcaattgcgaattgtgctgctgtaaacatgcatgtgcaagtatctttttcataagacgtctcctctgggtagatacccagtagtgggattgttggatcaaatggtagttctactttaagttctttaaggaatctccacactgttttccatagtggttgtattagtctacattcccaccagcaatgtaaaagtgttcccgtttcaccacatccccatcaatatctatcattttttttattatggccatttttgcatcttcgcccttcttgactacttttcctctctctaaccaaaattatggtaggtgtttgctcttcttgccttttgattgcctttcttggatatttctcccagtgtcagcttccctcccgggtactggtgctgcttctgtcaccccgttcccttacctactcttggtcctttcaggagagttcctgtatgtttatcttagagccacgtaaagctaaatgggtcttactatctttattaacgagctttattatctgcccctcctctagcttagcactctgtccattctgtgtatcttattgcagttgtacctttcctattcccacctgagagctcccactcctttggttcaacccagcttccatcaatcattcctcgagccttgccaattttttgtctctcttccatgtttattgtcgctacctgagtctagaccctctgggaactgagctgattggattgcagtcttctgcacggggagccatggtgtagagtggaaagtgtaatggatgtggagttagaaagatcaaattctggactcggttaagcatttaattaaaatgtcttggccaggcatggtggctcacacctgtaatcccagcactttgggaggccgatgtgggtggatcatttgaggtcaggagtttgagaccagcctgaccaacatggtgaaatctcgcctctaccaaaaatacaaaaattagccgggcatggtggcgggcacctgtagtcccagctactcaggaggctgaggcagaagaaccgcttgaacccgggaggcagaggttgcagtgagccggggtcacgccactgcactccagcctgggtgacagagtgagactgcgtctcaaaaagcaaaaaaaaataaaataaaataaataaaataaaataaaataaaataaaaaataataaaataaaaataaaaatgtctcaaacccataggaccttagtagtgcatatttgtctctaggcctgtttcgccacctataaaataagctgcattttataaatggaataactataaatgaatataaatcgatgtggaatttgcataaattccatatagatttgggtttcttggccttatgctgaaaccagcatttgagactgttggtgaaaagaatataaagaggtggtgtggtgtacatattactgtccgtattatggtctgattgtcaccacagtcctccatattagctttttatatgacccctgctttcccaatctagatctccagaatttttttggtgttttttgaatataatcaaaagtttgttttgctcaagattcatcttcctaaaaatgtttgacaaatgcctaatttgaaaattagtttgctgtcttcaagcttctcttaggaaagaaacgtggtccaaaagaagtttgtctagtatgcagggatttttaaaaactggataacccagggtggtctgcataagttatatgcttttcccccaaagaatttcaaacggctttcctggtatcatttgtccttatgtttctttagttccaggacagttcatactgttcttggcagcttacaaaatgagaaactgaggtattgtaattcagtctacttcccttccaaggaaaattgaaaaacactgtggggaaaatactaacaattatgtgagcctcaactttagattctgaaaaatttattcatggaaagcaaaaattcattactattcccataacattgccaacagcaaagagattatattcagaattaaatacagccctgttccatttcttctttgctttgaaactcagtgtgagacagcagtggaaccttttctgacttaaggccaaattaggtcaaaaacctttgctttgaaccttctgagtcatagaataagcagggaggaggaagaaaatccgtgacctgtgccacgattttttactgaggttttgtgcaaagagtgccgtgggcaggaaatgtaggaagaagagaggacatcacttcttcagtgtttccctgtatgtccagagataggaaattcagacatttgctttatttgctaaacttcacagatgtgagcaagaggaatattagaggcaatgtgtctaaattacttacttcgatgtaatgacttcagagctctcaggaggagaatggtcgcggggaaggaacgagcccaaccaatggcatgcccagagtcagcccttcatctgcagttttaagaagtggtggttggagcaagacgtgtttgcagttacaggaataagcaggagagggcagctcaagttgcccatcaaaagggtgggtgaggggctgggcgtggtgcctcacgcctgtaatcccagcactttgggaggccaaggcgggtggatcacctgaggtcaggaattcaagaccagccttgccaatacggtgaaaccccgtctctactaaaaatagaaaaaaattagccgggcgtggtggcgcatgcctataatcccagctactcaggaggctgaggcaggagaattgtttgaacctgggaggcagaggttgcagtgagccgagatcgtgccacttcacaccggcctgggcgacagagcgagactccgtctcaaaaaagaaaaaaaaaaaagggtgggtgagtattcctgcaggaaggggaagattgagcagagaaaaatgtcatccctttcttatccatggggcttctcctcccccaccaagctcatccatcagggtcgacactgctcttgtttgtgtcttcgcttagaagagcctgctagaagagtggcagatgagtcacctgtcactaaaagtaggtgttcttagtgctggggaaaatggaaggtggcagcaaattcctgctgcagttttccgtaaaattggattaccactactggttttaggtgcccctggttttaggtgctctgtatgtaagtttgtgcaaaagtacagcggcatctgtgggcatccaagctgggttctgctctcagcaaactgaagcaagcccaggccagtccaagggaagatggctgtggaccttccttctgttttatgcagcctagtttgaggcagttcaactgccccagagttaaacagttcaccatacataatagaggacttcgtaattaaaataaatacctctccaccaagagaggagaaaaagaaagatgtgcacagtgtgatgcagaaatgcaaggtgccctaaagtcaaatatgttacaggacacagtgtgcagctgtcagggcctctggccagtctccagctatgctggaggtattttctgtgctctgaccataggctacaagaccacatggctgctgctccactctgtagagtttcttgcatatcagaaaatctgagacctgacatttgtgatgaatatttcttgtacccatcacaaatcagaagaacaacccagagaggatgtcaggcacctgttggtctttcctcttgatctacttgttgcctccaagcaactaaggttctttttagagctctcacccctcaaagtgtagataattatattatcctctaaatatctaaaaactttgtttaaaaggactcgattttgttttctgggaaaagcttggtttaatacaaacaaattccatgtgtaacccagctttataaaatagaagggtccgagtgcggtggctgtaatccccacactttgggaggctgaggcaggtagatcaggaggtcaggagattgagaccatcctggctaacacagtgaaatcccgtctctactaaaaatacaaaaaattagccaggcatggtggcgcacacctgtagtcccagctactagagaggctgaggcaggagaatcgcttgaacccaggaggcagaggttgcagtgagccgagattgcaccactgcactccagcctgggcgacagagcgagactccatctcaaaaaaaaaaataagtgaaataagatagaaggaagggggtctggctttattgtggagggcactgttttagggaggtacatacatgaatatgttcctccgtcagggaactgagggtccactgcactgattctcaaccatggctgcacattgaaatcactgatacccactccgaccctataggttctgagttcagtggcctggagtgtggtgtgaccggcaagacttttcaaaatctttccaggtgattctcctgtgctgccaaggttaagaagcacaggtctagtgtagtagttccccaacctagctgccaatcagaatcaccaaaagagatttttaaaatacagattcctaggtcccagcccagacctacacaatcttgggaaactacagaggatgtgtatttttacagcatcacatgtatttctgattatcgactcaggggaccctcactgtaatgtcctcatgcacgattgtgatcttaaagcataatgcctgtagcagtttttatttatttattctcgtagacgaagctgtttttcactgcttcaagtttaatggccaagtgtgtttgtaattgtggttttttgttttttgctttttttgagacaaggtcttgctctgtcgtccaggctggagtgcagtggtgcaatctcagctcattgcaacctccgcctcccaggttcaagtgattctcatgcctcagcctcctgagtagcagggattacaggcacaagccaccatgcctggctaatttttgtagttttagtagagacgggggttttggcatgttggccaggctggtctcgaactcctgaccccaagatccgcccacctcagcctcccaaagtgctgggactacaggtgtgagccaccatgccgggcctcctgtaattgcttgttaagagaatcagacacctttctgaagccactaaccaaccagcagcattccccattctatgagcgcttttcctttctgctttcttggcacatttctgtcatagacctcgttctcagccttgttgagacacctcctttagtttagtgtggagtattttcctagaacaccgcagccagacgtcccccgttatccgcaggttgatttctgaggccaactgcagactgaaagtatgaaatggaaaattccagaaataaacagttcctaagttttaagttgcgtgctgttctcagtagcatgataaaatctcacgccttaccccatcctaacgcagacgtgaatcgtccctttctccagcttgtccgctgcgcagcgctccccgccggtgagtcacctagcggccatcttggtgcttagatccactgtggtgggatggaagtgcttgtgttcaagtcacctttattttacttaatgatggtcccaaagcacttagtgatgctggcatactgttacaatcgttctattttattattagctattatcattaatctcatactgtgcctaatgtataaatcaaactttatcgtaggtatgtatatataggaaaaaaacatagcgtacatagggtttggtactatccagtgggtttcaggaacccactgggggtcttggaacctattcctcatggataaggcggggactattgtactgaaatctgacaataactctgccatgatgcttcttttgagccacaaagggagccctcgatgtgccttgctgtggtcatttcctttaaattcccttgctgtgatcatttccttccatccagcccagcctgagatgtggagactaccagacagagcctcgtgtgatgctctgtcggcttgagtgtgaggaagcttgtaaatccatgcgttttgttaaaacattatcttctacagtgtcattgagggaagtttcaaatcagctgtgaaagaaaacaaaacccacccatctaaggcattactcatgcctggctgttcctggcttgcattagactccctggctggtcccttcaggctctccgttgagagctttctgtgaagttctttgtatattttcccaaatatgtttattatgggttcattttatcttctacgttggaaacgttatagattgagactcagtcactgccttattgctgcttttcatcatcccacccaccatcccttgggttaaccagagcaaaatagaagcaaactatattattcgcgaaactatagcagggaaaaagatccaagtttctggaacgtgtcctgatgaaaaaataagagtgcatcagatgtggagataaaatgtctcaatgttgaagggatgcatttatctacttaacactcagatgtttttctgatggaagcctctgcttatttatattttagcaaaggccaaactaacctgttctaagaaataatctcatactgaaagagagacctcacttcccatttcccaatccaaagtaaatgctgtgaaagaccaggaatgtagtaccgtcagcacacatctgggactgtttgtagcctacgttctgaaatcaggggatgctgacaggctcaagctgcgatactgaaaggaggcctggtttcccttctgttggaattacattacaaggagaaatattgatccagcatactcaagaatgggctgggtgtggtagctcatgcctgttatcccaacactttgggaggctgagacaggcagatctcttgagcccaagagttcaagacaagcctggacaacatggtgaaaccccgtctctacaaaaactacaaaaattagctgggcgtggtggcatgcgcctgtagtcccagcaactcaagaggcagaggtgggtggatggcttgagcctgggaggtcgaagctacagtgagccaagattgggccactgcactccagcctgtatgacagagtgagaccttgtttcaaaaaaaaaaaaaaaccctgaaattaaaaaaacattcactgggggaaaaattggtttcttagtagaagaataccagcaaaactcaaaatgaaaatggaaatgctctgctgccaatcaggaaaagactgaaaatcttggcagaattctgctggaatcctctgcccatttccttcatgttctcataattataaaagaaaaagaaatgaacattgataaagttcctgctgaataagagaagttttttctacctcacatttgttgaatgcatctcatttagtcatcaccctaaccctgtagggtacgtgttattatctccattttctttattttttgagacagggtcttgttctgtctcccaggttggagtgcagtgccgcgatctcagctcaatgcagctttgatctcccaggctaggctcaagcaatcctcccacctcagcctcccaagttgctgggactgcaagcatgcaccaccacacctgcctaaatttttttattattttgtagagacaggcctcactttgttacccaggctggtctcgaattcctggcctcacatagtcctcctgcctcggcctcctgaagtgctgggattacaggtgtgagccaccacacccagccaattcccattttaaaatgaggaaaccaaggcttgggttcggtgatttgctgtgactgaaaatccttccctccccacaaatagggacaccactatcagatatcacatagatcatttcccaggagccaagggcaaagggcagacccgtctttggccaaagccaaattctttcctacacagtaaatatgggaaaaagagagacttcaagcttcaccccaagagttgagacattttgaagaaagactgacacaattaggggagtcgctggatataggagtgaagtgcgagagaggtatcaaatatcaggctctggcctatgcttggagaaatggtgcaaaaccgttagcagaaatatggaaccggagtgcatgctgatttgagaggggtggtaagcatccaagtggaaattcctcacagactcttgagctgagactgaagttcaggaagaagaacacacctggattttttttcttatgctaggcattatagttgcttttatttcatctcaacaatcttttgaaaacgtattatcatcattcacatattccagatgaggaaactgaggcttacagaggttaactgcatcttccacgtccacagtgctagtatagaaaatgagctttgttgtaaacaggagactgccttactttttttgcatttccgcttgtccattaaatattttattgcctgtttagattacagtcattggtgcctacagcagcattatttatctttcattgggaattagggccttaaattaaatcgttagtcatattttatgtttttataatgttgtagagattctagttagggcatggtattctaaaaaggaaaagcattgatttaatttataatgaataattgtatctaaacagtgtactatgtgttctgcgttcaaataagccagaaagcttctatttataccaaaggaataaacagcaaacaacagacatacttaaattgaaaacatgagcacatttgaattttatttttgaatgtagatgtaattgaccatttgttctgcaaacaaggctttggtccagtttagggggaaaaaaaaatcagtgcactagtgtggagtattttctaaaagaagacaattttagagacttagtaaactttctgaaccggtaagacttgaaatgcctcatgaagggaagtgaggcagggaaacttttaatgagagattattccattcaccatctttgctggagctgactggtgtctatgatgcaggaagtaacctgagaaagaattctagggaggaaaatgtgttttttttttttctttctttcttttttgagacacagtctcgctctgtcaccaggctggagtgcagtggcatgatctcagctcactgcaacctctgcctcccgggttcaagtgattcttctgcctcagcctcccgagtagctggaactacaggcacgtgccaccatgcccagctaatttttgtatttttagtagaaacaagatgtcaccatgttggccaggatggtctcgatctcttcatctcgtgatccaccagcctcagcctcccaaagtgctgggattacaggcgtgagccaccatgcccagcctgaaaatgtgatttttttatgcagatgaaaataggaccacagtgaaggaggtagagaagagggcctttcttagaaaataatcggaacaaccacagccagtaattgtaggtcttgagtacgccaggccctcatctaaattcttcttatgtgtgaactcacagcaagcctgtggggtaggaactagtattattcccactttggagatgagcaaactgaggcacagagaaatgaattagttaggcctggttagtacttagatcagagaaattaattaacttgcatcagatatacacagctgaggagtaaggccaccaggattccaaatcaggtggcctagatcccaggcctgtgctgtttgctgcagcagtcataggaggtagtttgaactggaaagcagttcatcatgagaggtagcattttttgaggcactactgcctgcttgcatgctaggcactgaattgtcccatgcaattctcataacaacttcatgaaataaggcgtattactatcttcatttttttttttctaaggcagagtttcactcctgtcgcccaggctagagtgcaatggtacaatcttggttcgctgcaacctccacctcgcgggttcaagtgattcttctgcctcagcctccctggaattacaggcactcaccaccaagcccggctaattttttttgtatttttagtagagacggggctttgccacattgaccaggctggtctcgaactctggatctcacatgatctgccccccctcggcctctgaaagtgctgggattatatgtgtgagccaccgtgcctcgccatactatcttcattttcttaaagaggaaatcaaagcttagaaagttgaatgggcccggtgctgtggctcatatctgtaattctaacactatggaaagccaaaatgggaggatcgcttaagcccaggagtttgagaccagcctgcacagcgtgatgaaaccctatctgaataaaaaagtttaaaatgtagctagatgtggcggcacaagtctgtaatcccagctactaaggaagctgaggatcacttgagcacagggaggtcgaggctacagtaaactatggttgtgctactgtgtccagaattaggtgcgttcttggtctcactgacttcaagaattaagccgtggacccttgcggtgagtgttacagttcttaaagcggcatgtctggagttgttcattcctccctgtgggttcatggtctcactggcttcaggaatgaagctgcagacctttccggtgagtgttatagctcatacaggcagtatagatccaaagagtgaacagcagcagcaagatttattgcaaagacaaaaagaacaaagcttccacagtgtggaaagggatcggagaaggttaccactgctggctcgggcagcctgcttttattctcttatctggccctacccatgttctgctgattggtccattttacagagagcccagtggtctgttttgacagggtactgattggtgcatttacaatccctgagctagacacaaaggttctccagggccccactagattagctaaataaagagtgtcgacacaaaggttctccaagtccccaccagagtagctagatacagagtgtggattggtgcattcacaaaccctgagctagacacagggtgctgattggtgtgtttacaaaccttgagctagatacagagtgccgattggtgtatttacaatcccttagctagacataaaggttctccaagtccccaccagagtagctagttacagagtgtggattggtgcattcacaaaccctgagctagacacagggtgctgattggtgtgtttacaaaccttgagctagatatagagtgctgattggtgtatttaaaatcccttagctagacataaaggttctccaaggccccaccagactcaggagcccagctggcttcacctagtggatcttcacagaggcagtaggtggagctgcctgccagtgccgtgcgcccgcactcctcagtccttgggtggtcgatgggactgggcgctgtggagcagggggcggcgctcgtcggggaggctctggctgcacaggagcccacggaggggcagggggaggttcaggcatggcgggctgcaggtcccgagccctgcccgccagaaggcagctaaggcctggcgagaaattgagcacagcggctgctggcccaactgctaagcccctcactgccctagggccggcggggtccgccgctgctccgagtgcggggcccacggagcccacagccacctggaacgcgcgctggcccacaagcaacgcgcgcagcccgggttcccacccacgcctctccttccacacctccgcgcaagctgagggagccggctctggccttggccagcccagaaagaggtcccacagtgcagcggcggggtgaagggctcctcaagagccgccaaagtgggagcccaggcagaggaggcgcagagagcaagtgagggctgtgagggctgccagtatgctgtcacctctcactacactccagcctgggtgacagagtgagacccggcgacaaaaaagagggagagaaaattgaaagactttcctaaagtcacgagttatcaaatgccagttagcccggtctaacatgacactgaatcaactatgtgcttcctgctcaggagtcagaacgatattatcaagtgttaatgcttctaaatgcaaagagggagcaaggtgtttcttctctttagtctgtgaccagcagctgctcactataacctctcttccactgcatgtccaaggattactgcatagaggaggattcccatcttcccagcccctaaatttaaaaataaattaaataggctgagcgtggtggctcagggctgtaatcccaagcggtggctcactcccactttgggaggccgagatgggcggatcacctgaggtcaggagtttgagaccagcctggccaacatgatataaccctgtctgaaaaaagtacaaaaactagccaggcatggtggcaggcgcctgtaatcccagctactcaggaggctgaggcatgagaatcgcttgaacccaggaggcggaggttgcagtgagctgggatcacgtgactgcgctccagctctggctactgtctcaaaataaataaataaataaataattaaaagaatatagaaccgccctcacacttcctgccggatgcagtcaatttgacagtgtgcctcattcagagggtgttgcctacatccagggagtgtcaatttttttttattgaatgaatacctgattaagttaatgacgctgagctgggggaggaggagcagtttggcagcccaatgctgaagggcttctggcagctcattcagtgtccttaatgttccattggctttgtgctgggccgcatgtgagccccaggagaggctgctgtaattactcagcttttttattgaaaacagctgcaggtagcgagtcatcccattgtccatcttgctagtgactggaaacaactcggggccatcttgggctccactacactgcagcctcattctgaagtcagtggaggtagaaagtaggcttcccacttgctgggcttttcaaaatgagccattcatcttttgagggtcagaagtcagccacccattcaccgagtgtgagtcatacccctaattttaaaacaaacatttattgcagagagaattcttatcttggccgatgtgtacagctgatctccttgtccttcctacgattgatttaggctggtttcaacaaaattgttgtctttgtaaatacacacctcttccagtaaatccagagactaccgaggtgtttccttgagattgagcctaagacaatctttaattagttttggataattggatatgaatgtttagaggccttcccatatagcaagtgtctttaacatctcacacaatatattatacttgtacttcctgacccgagaagtaacaggagttaataatctcacgtgagaaagtatgtttgaaatggaatctcaaggggcagattctttgcagataccacaacattattttatgtccctccgtaatgagttcagttttttatcatcacatccaaaatctagaaaatgatccagaaatcctttgccttttaataaccagcttgtaaggaagacaaactgcaagagatggacacaagataagaacagtaaccaaccaaggacggacagcaccctagaaacccaaggggttgtgaacttcagtctctaagcagcatcggagtttacggtctaatgacgaaaacacgtgaaaacaaggattgcagcagccggaagtggctttgctgagagtttaggaatgattgcctaaggaagtagcagttaggggacccactgtattagtcagggttctctagacagacaggactaataggatagatgtatatatgaaggggagtttattaaggaatattgactcacatgatcaaaaggtcaagtcctacaataggccacctgcaagctgaggagcaaggaagccagtggttgaccagtctgagtcccaagacctcaaaagtagggaagccgacagtgcagccttcagcctgtggccaaaggcccaagagccctggccaaccattagtgtaggtccaagagtccaaaagctgaagaacttcaagtcgggtgttcgagggcaggaagcatccagcacgagaaaaagatgaaggccagaagactcagccagtctagtccttctacgttcttctgcctgctttcattctagcctcactggcagctgattagattgtgcccacccagattgagggtgggtcttcctctccaagcccatgacccaaatgtttatctcctttggcaacaccctcacagacacaaccaagaataatactttgcatccttcaatccaatcaagttgacactcagtattaaccatcatgcccaccatggtgaaggcatgcgggggtggctggtgttagactaattggagccttggaggatagtcgaggaaacggttcctgaacggtgtgtggatgagaatgttggagcagggtgctaaggaggcacagaggagaggcagagggtatggggttggagtggggagagccttaaggaggtgacatggaaggagagacctgaaagatgggtgaggccagtgcttctggaagtgtggttcctggaccagcagcatcagcagcatctgggaactccgggtgaatgtgatgcgcacgctcgagtataagaaccactgcattagaaaacaggtgacagtgccttgcggaggagcggtggctggtgtggaaagtactctaacagagcagagggaacacatacccagaggcctgcagcaggcatatttgaggcttgatcaggacacagccacccacacccactggttacaaattatctgtggttgctttcagcctgcagaggtagagctgagtaatggccacagaggtgtatggcccgcaaagccacacgatttactaggtggccgcgcatcgtcaaggttttccagtccctgattcagagggtggaactgacataacctgatgacagaatcaggggagaagaggcatacagggatatcggccagctttcagtcttcagtgagcaatgacatgatagagcagtgacactaagatactgctgcctcactttttacagctcacagtcccctttgcggatgtgagaaagggcatacagctttaagggcttaaaggatgccctgacgtccagtcctggaatacaggctaatgccagcaggtatctcagagatccttgtagctccaagcagatgagggagcggggcgctgtgtggtttcaaaacagaaatgcagtttgttcacaaacttttaagatcatgacatatttatttatttatttatttgagacagagtctcgctctgtcacccaggctggagtgcagtggtgcgatctcagctcactgcaagcctgcctcccaggttcacgccattctcctgtctcagcctctcgagtagctgggactacacgtgcccaccaccacgcccggctaattttttctattttttagtagagacagggtttcaccgtgttagccaggatggtcttgatctcctgaccttgtgatctgcgcgcctcagcctcccaaagtgctgggattacaggcgtgagccaacgcgcccagccatgacatacttatttttaaaaatttttgactggtgacaaaatatgcataatatgaaatttaccatcttaatcatttttacgtgcacggttaagtggcacattcttgttcaaccatcaccaccatctgtctccagaatgtttccatcataccaaactgaaattctggaaccgttaaacaactcccattgccccgtcctcccagctcctgctaacgcctgttctacgctctctccaaatttgactattctagattcctcatagaaggggaatcatatgatattgttcttttgtgtctggcttctttcacttagcataatgtttgaagatttatcaatgtcatagcatgtaacagaatgtcattcctttgtaaggagagggggatgaataatagctcgtcataaggatataccacatttttaaagtttattcatctgttgatgatcattgggttgttgacaccttttggctcgtgtgcacaatgctgctatgaacacgggtgtggaatatctgagtccctgctttcagtgctttgtggtagatatccagacgtggaattgctgagtcatgtggtaattctgtatttcacattttgaggaactgccaaaatgttttccatgcagctgcatcattttacgttcccaccaacgatgcacataggttctcgtttccccatctccaccaacacttgctattttccatttttgttttgtttttttttttaaaaaaaagaatataatgtccatcttaatgagtgtgaagtggtgtctcattgtggacatagcatataattttaagtatgattaaaggaggttagaacacgacttttgtgttggcaaagtggggaaaaggattggctgctgtaattaaaatcactgagacaggccgggctcagtggctcacgcctgtaatcccagcacgttgggaggccaaggtaggtggatcgctcaggtcaggagtttgagaccagcctggccaacatggtaaaaccccgtctctaccaaaaataaaaataaaaataacatagccaggtgtggtggcaggcacctgtaatcccaactacttgggaggctgaggcaggagaatcacttgaacctgggaggtgcagtgagccgagactgcacccattgcacaccagcctgggtgacagagcgagactccgtctcaaaaaaaaaaaaaaaaaaaaaatcactgagacatactgccaaggacagatggagttagggggcttaaagatcctctataccagccgggtgcggtggctcacgcctataatcccagtactttgggaggccgaggcaggcagatcaagaggtcaggagatcaagaccatcctggctaacacggtgaaaccccatctctactaaaaatacaaaaaaattagccaggcgtggtggtgggtgcctgtagtcccagccactcgggaggctgaggcaggagaatggtgtgaacccgggaggtggagcttgcagtgagccgagatcacgccactgcattccagcctgggggacagagcgagactctgtctcaaaaaaaaaaaaaaaaaaaaaatcctctataccagaggttctcacctctggctgcaaattagaatcccctggtgcatttcctaaaatgccagtggtggtcccaacatctagggattcttattcagttggtctggggtagatctggacattatgtttttaaaagctccctgggtgagtctgatgtgccgtcagcattgatttcttattctgcaggtgagagagtatggccctagtactaaggctgcaagggttctggtctctcagccagagctgctgccactgatacaccattattcagcatgaccacaaacacagtgaaaccagtagtgtcccaggtacatgtgcatcctcctttgtattgtggaggaaatatgtccccaaaatctgcagagccaagtgcgggagccaactcctccatttggtctgttgggatgttcagtattctatggtagatttctagtaagtcaatttcactcagtgggctgaggatattaagacaccggaagttagctgatgtgttcccccattgctccaacactttgaactctgtaccccaaaaattgatccactcagtgcttcttacatgtatgtgccattggggagatttccacagggaggctttctctgagcctttggccctggtgacattacactgagtaatatatatccctgttcctttctgtaccacccatctgcctgttccctggccacagtttggggtataccaatttagattaacctaattattgtttcacaaggcattcttatcactgaacgctgatggatgttacttcaacgttgttatattttattacttggcctatttaagtgtataaccatcactagctataagaaggtgaccaactacaacgttagagagagcagtgcctgcaccacgaattgcaagttcagggggtttcccagaccaccctccgttttgataattcagtaaaaggactcacagaactcactgaaagctgttctactcatacttattacagggaaaggatacaagttaaacttagccagggtaagaggcatataggagaggtctagaggggtccagacatggggcttctgttgccctctgcccatgaagtgatgaacagcattacctcctcccagccatgatgtgaagaatcaccaaccagggaagctcacgcgaacctcagcatctagagtttttattggagctcaattgctactgtcctcatgactgacctctagtccctaggccctcctggagatcaggcaaatatctttcattattagttcctctgaggttggaacgtatacctcatggcccaaagcccccatcataaatcacattgttactccatccagtggccaataaacatacttctgtgaggcaggacattccagaggccgagagatcacctccccacaggtgggggcaaaggccagacctgagtttgggtgaggttaaattcttcatggtcaggcgcggtggctcatacctgtaatcccagcactttgggaggccgaggtgggcagaccgcgaagtcaagagatcgagaccatcctggccaacatggtgaaaccctgtctctactaaaaatacaaaaattagctgggcatggtggcatgcgcctgtagtcccagcttcttggaaggctgaggcaggagaatcgcttgaacccaggaggcagaggttgcagtgagccgagatcacgccactgcactacagcatggtgacagagtgagactccgtctcaaaaaagaaaaaaaattcttcactacacactaatgacccactacacaacccaagaactagatcccaagttttcatattaggattttttgtgtgttgtttctgcccttttttagccatgtaatcttaggcaagtgacttacactctgagcttcaatgtccttgtctttgaaatggggtgatcatatgctagttgttatttatatgtaaagcattgctgtagcctgcacaaattaagcatcgtgacttgtcctgcctgctgtgccttagagagcctgggtcccgggaggtcttggggtctttgcagttgagagcattgaattgtgcagtgtctcagtgactgaaaccaccatagaaggtaagccagtgtgtgacacctggaggaacagctggttagtttatgaattatctggaggcattggctttgctttcattcagccacaccaaggacagtgaatagttttaagactctcccagagtacctcagttcccacgagacctttttcctgacttgatggagagttttatgttctctgttgtagactggggctgtctaatgtcctggaaacccagccccctggtggctggcaggatccagcctaggcctcctggagcagttgctggcgctttgcatcgtgttgtgtggtgaagctcgtgagtgtgtgtgcgggtagacagctggcagccttccctgcgggatgtggaaggaggattctgcatttccccaccatgcgtcttgggaattactcatccaaaaagtattgtggaaaagcaggcagagtgaaacacggaggcattgcacttaacccttccctggaaatgccatccttgagtttagcgtctgagctttctgtttattctgcttgtgtgctgaattgccttccttcttgttggtgtgcataggggtctgcacattgggcacttataaatattatcccacctatcaagtgaagaaaaaaatgaactctcaaacacccatcacttcctctttttctatcacagatgtgaggaaaaaacagatgtttgaaagaattgatagtttgaaggtgttgtattgattacatcatggccaggagagatgagcaacagataagtgtgggtgatcactgagaattcatgaggaaatgtttattgaattataactacgatggcgaccatgtactgagtgtgtgttatactaggcactgtgcatgttaattcttccccattttaaaggcagagattacaactttacacattgttgaaatgaaatttttgcctcattaaacttgggcacatgtataatcgcaagtaaaattaaaattattattttgagatggagtctcgctctgtcgcccaggctggagtgcagtggtgtgatctcggctcactgcaacctccgcctcctgggttcaagcgattctcctgccttagcctccctcgtagctgggactacaggcgcctgccaccacgcctggctcattttttgtatttttagtagagacaggatttcactgtgttatccaggatggtctcaatctcctgacctcgcaatccgcccgcctcagcctcctaaagtgctgggtttgcaggcatgagccaccacgcccggccaaaattatatttttaaaaatggataacataggtggtttggggtaaagccaaggtttgaacctgttctctaccttacggcgtagcccactctaactacaattctgtgtgtccttagtagtaatagcagtggaatattattgatctattatcatcattgttagtaataataatattaatatttatcttgatattctaaataggacagtggatgtgaatgcttcatgcatcgggtagtgagatctatcacagtggtggtaagaaacattcaagtgagagtcaaagtgacaggttctcatcctcctgaccccagttcttactgtgttaccttggccaatacttttcatcttcttgcatcagtccttgaaataagataatgaagagggctcacttcctctcactttgaaacaagttagtctggactgggatgagaaccactaactccaggcagcgtggaaagcatctgtgtaactgttcccagccttcaaccagagtggtggataaacagaaacgtgggtgcccccgggtagctaacctggaatgcactacgctttaaagcaaaaaagtatttgcttctgtattgaatcaggaaaggtcttgacagaaaggcatttccagcttttcttaaaaactccaactcaacctctgtcagacaattcatttgggaccagcttggatccagatggttatttttccatcttgagcctttccaggaattccggcatgggcaggccgccagagacactggctacacagccactgcagcgcgttttccatgtgagccggcttctagggatggcccagccaagctgtggccccgcccctcctccttcctcatccaggctgatcctccagctctcacggacatgtgccatgagccacgcagggggaccccagccacatggccgatgtcctgatgtttccaggggtggcagagctcactaactgcacccccagaactgtcatctgctcactacgaatagcaatggcagaagccaggaatctaagaattgatgaagcctggccctccattatgtggacaggtagtagcaaatcactcagccccacttagggataagggagacagcaacttaaccacgtgccaagcagacaagttcagcagaatggcagccagtgcagctgtgtgtcttgaggaattctttccagcctccccttcaaggcccttaatcaaagaacaactccccactggacgcagagctacccaagccagcgaccacccgaatgagactattattttgggtggatttaaattttttaatcattgcttcaagtatagtcgtatccattgcccaaaaagtctatagatgcatggggtcaaaaaacactactattcgtggtgctgataatataagtagtggggctgcttttctcctgcctttgcttgacccactgcagtcccagctggcagtggtagtggcagattcccctgacccaaccacccccaggaaggtcttgcctcaaagaaaaggaaaatgtggtgtgtgctgctggctgccacggactcaggggagcctgtgccaggttgcaggcttgaacttgcttcttgtgacactagagggagagagcttgtttcaaaagcatgttagtgctctcagttcctcacgtccgacctgtgccagaggctccttctgcagtctcaccactcctatggcctggatcacaattgggtgggtggtcttgaacttggctgctgagcctgaggtcccctgcttgcttgcctgggaaatacaaacatcctgacctctcttccttggtcactgatcagtctcttccttactgaacgtctcaccagctgcagttcttgattagtcaacatggtgcagaggtcccctagacatcttttcccctacttatccctgtgcattctgtcccttttctacatgaaaaataaataggcatatttgctatgaggctgccatcgccatagccaggaggtgagtgtaacccgcatcatggttgggtagactaagaaagtgatttccagtgctagttctacctctgactgtatggccttgggaaaacctcagtgtccttatctggaaaatggagataataatacaaacctcacaaatttgttatgaagagtaaatgagatatttaagtaaggttcttggcatgtataataagtaatcaataaatggaagatatttggattggtttcttagggctgccataataaattaccaaaacatatcgtggcttaaaacaacagaaaagtattctctaacactcctggaggcttgaagtctaaaattaaggtgctggtggagccatgttcccttcataggctctaggggataatctttccttgcttcttgctgcttctagtagcttcgggtgatccttggcttgggactgcgtcattccagtctctctgcctctgcctccacagggcctttgcctctgtacatctcacatctttctctgcctttctcttataaggacatttgtctttgaattgagggcccacctggatcatccagcatgatctcatttccaaatccataattacatctgcaaagaccctttttccaaataaagccattcccaggttctgagtgggcataacttttagggatctaccattcaacccactgtccttccttattcatgataaaaattaagatacataaaattatttattttttatgtccttaggccctcgtgtggactccttctagcttggattacgagctttcatttcttgctttttctcttctcactcactacacttccgtgaagagcaagatcccatgtcccaggggtgcagagccgagaagggaaacccgagcgcgttggggcgaggctctcagacagcatcttctacaaagttgtgccaggtcccagctcgcctctctggtggtttctggcctggatgtctctagacagggccttcagtccccttcaggagcctcctcattttgggccaagaggcctgccccatgaagctccacgcttagatagacatggaagagaaggtcaatagtcagtttccactgaggacacagcaagaagaaattgtgacagtagactgggatgacaagccagccaccttgacacagagtggaatcacagtctcagaatgttcctaatggcaaaaaaatgtagagtaagtagttcgaacacccaaccagggcagggacccctaccccatatccctgagtttctatcctgacccttggggtgacccagagatccctgactcatgaggcagcccagtccatttttaaccattctcattgcttcctaatgctgcagctttttctgttcttccccagggcactcattcccagttgtctcagctgttactcatctgcttgcctccagacctcttgcgcaactgatcactccccctagacatgccccatccttcccacgtgcctttgcagcaggatttcaactgtggctttacccgtgccatctatggttgcagtatttattcccttattctgaacattgttttctttctcttttcttgagacagggtcttgctttatcacctaggctggagtgcagtggagcaatcatggctcactgcagcctcaacctcctgggctcaagcaatcctcctgccttagcctcctgggtagctaggaccacagatgcaaaccaccatgcctagctaattttttttattttttgtagagacaggatctcgatatgttgtccaggctggccttgagctcctgggctcccaaagtgctgggattacaggtgtgagccactgaacccagcctgaacattatattttttttaatgaaggttataattactatactttttaagaaccctaccaaatggttgttcatattgagtgtatagtcaaacaaaaactttctgggctctttcattgaaaccattattaaaccagatctcttcaaccctgctagtaggctaattgagctgttgaaaccaagggcaggcatttacatttattctcattgatcttaattttcctggtttggtaccatcacttccggcttcttaagatatatttgaatcttattcgcaacatatatcccttctagccttctgttacttcgaaatatgataaccaaaacactgtattagtattgaatagaacagaactaaaaatagagttctggcataccatttgcttcacactgacattgaacaattgaggtccccgtcatacatactagaaacggaatgagtgtttgatgaatgaatgtgtgatccactttgggggcatgcctgttcagtcaaccataaaggcatctaattatagctatcatccaatccacctttctccattctagatactccaagcatgtcgggtttggacctgtttttaatgcttggccaaaatgaagtgctttctgccagtgcaccacacaggccttccagtttagtgatgtaataaagctggaaggagattggtgagtcagcactttgagaatccttgacatgcccaagtaacctctgtcctcacacccaggtattctgccctcttcagtgtttgcatacgtagtttttccagtcctggcacaagctcatcagcctgctcttcctcttctttaaagctgaaaccgtgccctgtttgtccatagatatacaggccaggcagccatgggttcattcaaactgagaagcacaggattgggggtgtaggaaaagcaacccattttcttgccctaggtttaagatgtatttttaggagtttatatatcaaattctaagagcatcttccattctgagcagttggctgctatttactggacttgcagtcagtgggcatatattccccacatccctagcacagaagcatctcattttcctatcacttcccaagcagtctgaatccatggtaatagcaaaaaatttctcgaaatgaaattatagcaaagaaagaagtgtggagcttcctttgttaaatttcatttttcttcctgggaatgattgagttgtgtataaaatttatgataatagcctttttaaagtatatttctctgcagttgtgtaaagaaccagaagaaaagcagcatttgttatttgcagccgtattaggtttagatgaccccagaggaagcagtggagcatcacctaaatattagatgtttatctccgaggctccatcaactctgtgtttacgtacaacacctagtttggtttcccagtgcctgctccattaggaagaggctagagatgtttaatttgcttaagagtttagcagtagaaaatttaatcggatagctgctagggtttctcaaaccttactgtgcatagaatcatctggatatcttgttaaaatgcaggactgggtggggcctgagagtctgcatttccagcaaacttgcagaggatgctgatgtcacgggtcggaggaccacacttcgactagcaaagccttataccactgggctaaatttagaaattatgatagagagatagttaatgtagctctaaagcggcttaagatgaatgtattcagaacagtgattatcaggcaaaccatgggtagcaaactctaaatacatttgtcttgattcatctattaactctccctccaatttcccttttccaataggaatgtttaaacagtgcgatctgcatatgtggctctctggtaatttggcattgatataattgtgcatggccccatgtttggaagaaatctttttgttgtggcaggtgcttccagagataaactcctcgggggtcccctgggagggcaattcaggacacagaggccagttgtctgcaactagagactctaagagcagaaatcccactctccttttttcttttttcttctttcgtttctttttctctcttccttattttccaaatctacttttccaccttcataagttacttctttgttgtttagtcccatgatcacccgatagaccaggaatgtggtgccatcctggggcgccctctggtggttcattgaaaatacagcaagacccaatctctacccgtgggtttccccttatcagtactgaaagcttacggggcccagagaagggacacatacctcagcgttagagagccctgtctgctccgtgctgcactggtaaatagccctaaatgtaggaggaggatgggtggaaacttttatcggtttggccccagctcgctgcaactgctgtcttaatcattgtgtccttgatttctcattggcaatctctggaaaagatgctgtttatcaatggataagttttcagaagaataaatttggatttgtgtgttaaggccaatatgtcttagcaatcatttcgcagaagaccagtccagtgagtcttcagggctgactaagccgatgtctctcaaataaacagtataattaaacctgagcactactgagaaccaagtcagcattctttttcaaatttacgaaagctggcttcctaaagaagtaccttcagaggagttttctagttttgtgtattgtgcattcaattgtacaggcaatgttacatttgcattgctaatagacccttcctgaatgtgtttgacattttacttggctttgaaaggacttttatgccgctgctttttcttccctagtgctgccttgggctaattaacctattcccttactggctgggcctactatatgcaaatgttctcattttgcattctgacacatcactcttgcataaatatccctcatgaaaccctgtggggttttattggatcagtgctgcaggagggccagcagggggcgcatggactggttctctctgagtaggtctcacgcatgagttttccttgctcgttggtatggaaatgtgggagcgtttggcattccctttcttaagagtgagtcttgaaatttaaagataaaagttcattattagaacttctttttacaagggaaggctgtacagaacacagttatttgtcacttacaaaaaccctaggtgggcagggcgcagtggctcacgcctgtaatcccagcactttgggaggtagaggctggtggatcatttgaggtcaggagttcgagaccagcctggccaacatggtgaaactccgcctctactaaaaatacaaaaattagccaggcatggcggcagccgcctataatcccagctactcaggaggctgaggcaggagaatcgcttgaacccgggaggcggaggttgcagtgagccgagattggcacattgccctccagcctgggcgacagagtgagactccatctcaaaaaaaaaacacctgggttgcgagagtaaataagtgacattactccttcaacacttcatttcttcagcataagtgttttagggtttttttaaccttatttttcatttccgtcccagtctttaagcgcctctcttgtcatatgagaaattctattcttactgaaatgtcctttgatatcgagacaccaaatttctaaacctgcaccttcctagatatctgatcaaaatcattaaggattgagaactttctgttgtatcatttgtcatttcattatgatgttcattgatgatgttggagcaaaaccaataagggccattaaatcattgccccttccaagctggctgcagtggctcatgcctgtaatcccagcaccgggaggccaagtgggtggatcactgaggcctgttcaagaccagcctggccaacatggcaaaaccccacctctacaaaaagtacaaaaattagccgggtgtggtggcgtgcacctgtagtcccagctacctgggaggctgaggtgggaggatcacttgagcccaggaggcacaggttgcagcaagccgagatcacgccactgcacttcagtctgagcaacgaagcaagaccttttcaaaaaaaaaaaaaaaaaaaggaaggaaggaaggaaaaaaatcattgccccctctaaaaaatagttacaaagtagggggcagagtagagaaagggggttatgtttcagtagggatttcagtgttgctccaacatggacaaggattgaatgctgaaggccgctactttattgtgtttgttttaaaatcggatcattggctacacacagtggctcatgcctggaatcctagcactttgggaggccaaggaaggaggatttcttgaggccaggatttcaagaccagcctggttaacatagcaagaccccatctctccaaagaaagaaagaaagaaagaaagaaaatcagatcattgaaaagagggtctggatgtgagataccaaaacccaagggtgtggaattcccaaagcccaatcccacagctctcagaatcacagcatgttgcactgtgcatacctacagctgctacctgtggaagcaatcacatccgctgcttgctagcctgggtcatgtcagttccactgatatttggcctcttgtctgttgggcattggtttgcccacacagcagcagtaactcagacttcagtggttagtaagagactgagatacttgaccataagaactggctccagggtcaccatttgtatgtccaggtttgaacacactgatctgatttgtctgaaagagctgtcgtctctagtgttaatggcgagttgttactttccaatgagaaaggggacggtgtgaaggggaacttcaatgacaacttgaaaaggaagagagagatggacaaaccaagcatgtaacccactgagaaaacattcagtgcactagccctatttttgtatggtatttgggttttttaaccataatcaaattcggtttttaacagtctcactccgtcatcatatgagtggctgtactgggaattcttttgaaacttgcagagaacaggattatttctggcggcctctgctgagttggcgtgtgtgtgtgtgtttgtgtgtgtgtgtattagggagaggaaatcgtaggtccagtgtggacccagagctaaggggaatcttggagagtagtggctctggcagatgaggattcagaaatcgagtgcaaggactgttctggactttcactgctaacctgctttttctcagtgcctggctctgagggcagggtccagctggtgtcatgctctccaagggcttcattttatgttccagccaggcaaaggagaggtgagaaatggaaccaacatttctgaaaaggaaatttaagaactgcatcatctgcccttgaagaagaaaaggagaaaaaaaaacaggagagagggtattgagaacatcttaggggagttgttaactccattaaaaaatatatgtgttacagtgttcacttgcccagtgtcttcataatcttcctttataatgtgcagctgccacggctagtgtttttgtttttgttgttgttgttttgtttcgtttttggagacagagtgtcgctctgttgcccaggctggagtacaatggtgcaatctcggctcactgcaacctctgcctcctgggttcaagcaattctcctgcctcagcctctcaagtagctgggactacagccgtgtgccagctaatgttacaccaggctaaatttgttttttattttttatttttggtagagacggggtttcaccatgttagccaggatggtcttaatctcctgacctcgtgatctgcctgcctcggcctcccaaagtgttggctagtgttttctctgcttcagtgcttggggtatgattgggttatgggagttcacaccgagtccagggcctagtcttaatcttgccaaagatgttctttccccggtgctcatgttctgatgtcctttccctccttccctttctcctccctttccttttccctttgtcactgccctcttccctttcccagcatccagagctgctgttggcggattgtacccacggggagatgattcctcatgaagagcctggatcccctacagaaatcaaatgtgactttccgtttatcagactaaaatcagagccatccagacagtgaaacagtcaccgtggaggggggacggcgaaaaatgaaatccaaccaagagcggagcaacgaatgcctgcctcccaagaagcgcgagatccccgccaccagccggtcctccgaggagaaggcccctaccctgcccagcgacaaccaccgggtggagggcacagcatggctcccgggcaaccctggtggccggggccacgggggcgggaggcatgggccggcagggacctcggtggagcttggtttacaacagggaataggtttacacaaagcattgtccacagggctggactactccccgcccagcgctcccaggtctgtccccgtggccaccacgctgcctgccgcgtacgccaccccgcagccagggaccccggtgtcccccgtgcagtacgctcacctgccgcacaccttccagttcattgggtcctcccaatacagtggaacctatgccagcttcatcccatcacagctgatccccccaaccgccaaccccgtcaccagtgcagtggcctcggccgcaggggccaccactccatcccagcgctcccagctggaggcctattccactctgctggccaacatgggcagtctgagccagacgccgggacacaaggctgagcagcagcagcagcagcagcagcagcagcagcagcagcatcagcatcagcagcagcagcagcagcagcagcagcagcagcagcagcagcacctcagcagggctccggggctcatcaccccggggtcccccccaccagcccagcagaaccagtacgtccacatttccagttctccgcagaacaccggccgcaccgcctctcctccggccatccccgtccacctccacccccaccagacgatgatcccacacacgctcaccctggggcccccctcccaggtcgtcatgcaatacgccgactccggcagccactttgtccctcgggaggccaccaagaaagctgagagcagccggctgcagcaggccatccaggccaaggaggtcctgaacggtgagatggagaagagccggcggtacggggccccgtcctcagccgacctgggcctgggcaaggcaggcggcaagtcggttcctcacccgtacgagtccaggcacgtggtggtccacccgagcccctcagactacagcagtcgtgatccttcgggggtccgggcctctgtgatggtcctgcccaacagcaacacgcccgcagctgacctggaggtgcaacaggccactcatcgtgaagcctccccttctaccctcaacgacaaaagtggcctgcatttagggaagcctggccaccggtcctacgcgctctcaccccacacggtcattcagaccacacacagtgcttcagagccactcccggtgggactgccagccacggccttctacgcagggactcaaccccctgtcatcggctacctgagcggccagcagcaagcaatcacctacgccggcagcctgccccagcacctggtgatccccggcacacagcccctgctcatcccggtcggcagcactgacatggaagcgtcgggggcagccccggccatagtcacgtcatccccccagtttgctgcagtgcctcacacgttcgtcaccaccgcccttcccaagagcgagaacttcaaccctgaggccctggtcacccaggccgcctacccagccatggtgcaggcccagatccacctgcctgtggtgcagtccgtggcctccccggcggcggctccccctacgctgcctccctacttcatgaaaggctccatcatccagttggccaacggggagctaaagaaggtggaagacttaaaaacagaagatttcatccagagtgcagagataagcaacgacctgaagatcgactccagcaccgtagagaggattgaagacagccatagcccgggcgtggccgtgatacagttcgccgtcggggagcaccgagcccaggtaacgttagccagggtggcacagggatgggacaccacaccgtgatgccatcatcatctcctggcaagacgaattgcttctatgaggcaggattaagggttctcgggtacacctagaccttagactcggcctttcccaactgcgttctctagaaaaaataagccccatttccccgtgatctctgctgtgtgtaatgaattaacctccatgcatggagagtggggctagttatggagtccttgagacaatccagaaactcaccactctagttattttttgaattctgtgattaagatgaggaaccctgattaggaaacgctgctggacttcaggtccttctagtggtcattcggcactttttcttaccaggaaaagacagaggatgccgttggagtgaggggattagatgctaaagcaatcatatcccattgcaacatccatgttttaaaatatgtcttattagctgggtacagtggtatatgccttcggtcccagctactccagagactgaggcaggaggatcacttgagcccaggagttcgaggctgtagtgagctatggctgaacctgtgactatcactgcactcaagcctgggcaacatagcaaggcccggtctccaacatatatataatgtcttattatttaggtatgataaggccaacagatagatcagcagacaactctctttgacgagataatttttatactctctgatcccaagaggaaagggcactctacaccaagaggtgtagaacaccgtaaagtggggggcacctggggaagccccaggtgggtcaggaggtggagggagtgaggggaaatgtggcaaacaacagcctttattgtggtttcatgggaggcagggtaaacgggtttaggattggttagagtggataattccagtgtgctctggggtgtaggggctgtccttagttgtctggctgctggtgctggggtgatcaatacaggtggaagggctgggcacagtggctcacacctgtaatcccagcactttgggaggctgaggcgggtggatcaccagaggtcaggagttcgagaccggcctggccaacatggtgaaaccctgtctctactaaaaatacaaaaattagccgggcatggtggtgtgtgcctgtaatcccagctactccagaggctgaggtaggagaattgcatgaacccgggaggtggggattgcagtgagccgagatcaggccactgcactccagccttggacacacagcaagactctgtctcagacaaaaaaaaaaaaacagatggaaggcagccctaagtgtgatggaccaatataggaggctgctggggagtgggctctggactggttagtttgcatatgaaagtcaggctcctaggaattagctctggactggttggtttgcatataaaagtcaggcctctaggaattagctaatcctaggagagactatacctctgggatccacaagacactaaaatatcaaagcatcagaaaataaaagcgtggttaatacaatctgagaagtcagggctgtcccaggtgacctgctgggcttggggtaaagtcagctgtagccaagatgagtcactggaagtatggttaacgctcttaatttccacaggctccttcaatctacccttttccaggttcttagatcgattacatgcatttattccacagcccatttctttcactgcccaagttgctgggagtccagcaggttcagcctgcagctgagagctttcctggctatcgagcgtactttctacaagtgtttccatctaggatttgaaaacattcaaatgggacagagcctccttccagcttgagttgaaaatagtcatgaaatagctgctatttgggacattcagataaaataaaacaagaaaaaaaagataaactaattaatggtttgaattgttttgggcatttttttttttcatttttgagacagtgtttcttgtctcctaggctggaatgcagtggtgcaatcatagctcactgtggccttgacctcctaggctccagcgatcctcccaccccaacctccctagtagctaggaccacaggtgcataccaccatgcccagctaatttaaaaataaaaaacattttagtagagatggggtcttgctgtgttgcctaggctggtctcaaactcctgggctccaagcagtccttccacctcggcctcccaaagccctgagattacagacacgagtccctatgtctggcttttttgagcatttcttaaatgcccaagtgaggaaaggaccaaatcagttttccagaaccactcgtgaatgactggatatgggggcttgcacaaagccggggccctgcattgccgagagcttttagccctgaatacttttctttgtattatgagatgtcactgtaggtttacagtctttggaagggcccaagaaagatttccccaaagatcttatttaaaaaaaaaagaaaatcaggatttttaaaataaatggcataataatacagctcactacccctctgtagtggctgttcacttcctgcatgaattaggggtgggtactaggagaaagaaaatgaactaccttgagcaaagttgactcttcacagaccccaggtgacacatggaaaataaacatgagtgaagagtcattgcttttcatggtacttagaatccttaacacatttttgtgaacagaggcaggtgtgaaaagaggttttgtttagaaatgcgactggttccttgccggccagcatcaacttcagcttgagaatgaaggcagccacttcagctgtgggccacacttcccaggcctggcagcctctgcagaaaccagactcttctattttttttttttttttttttttttttttttggagacagagtcttgctctgtcacccaggctggagtgcagagtgcagtggggtgatcttggctcactgcaacatctgcctcttggttcaagtgattcttctgcctcagcctcccaagtagccgagactacaggcacacgccatcaccccctgctaatttttgtatttttagtagagacagggtttcaccatgttggccaggctggtctcgaactcctgacctcaggtgattcacccgcctcagcctcctaaagctgggattgtaggcgtgagccactgcgcccagccccttacagccctcttctgttcttggggaggaagatctaggtgtgtttttccctactccaaactttgcaaaattaatgattaaatgaaagagaaattggcttccctgtgaagtcagagccctgttctcatgttttttcccatagtgagatcactaaatctctctactgacagccagggtgcagacgagcaggtagaagtgttgtcagggcctgttggcaggtctgtgaggttggcccccgcgtggctatgctgcatgccgggaagggcttcctcaaagaaaggcaagtgtgctgagacctgctgaaaaggcagctagggcttcacgctgtagaaacaaaagtgcaaggcctgacgcaaccaatgatttgtcactttaccgaggagcctatcagaaatcggctgacatcatcacagctaaaatactccaccagctgtgtttgccacaagtgacaggttcagagtcagtggagactcagacagagagcatgagagggggagatgggagggagagagagaactcatatctggacttaattgaggttccaaaggctacatccttctcccctctgcagtgccttcctgaggggttttctcccctagcctgaagaatcttcctggtcttctcaactggttaggcactgctgacactgcacccacagagaaattcagaaatgtgcaaattgttgagcttaataagcaaaatcacaaatttgattggggaagttgtggaagaagagatggttttctccaaaacagatggcattgtgactctaggcagaaatcctgcatgaacagactcttgaggatgcctgaactcataagacccccccaacatcacacccccagggaaagcagtgtgatatagtatggtggtgacagacccaggggtgcggatttgggtctctggcaggacaagttacttcacctctctgagctgcagcactctcctctctaaaccaggcaaatgagttttgtttttctgtgggtttttgtgttcgtttgtttgcttgttttgagacagggtcttgccctgtcacccaggctgaagtgcagtgatgggatcattggctcactgcagcctcaacctcctggactcaattgatcctcccacctcagcctccccagtagctgggactatgggtgtgtaccactacacccagctaattttctgtgtttttttgtagagacagggttttgctatcttgcccgtgctggtctggaactcctgggctcaagcgatccacccacctcggtctcccaaaatgctgggattataggcgtgagccacggcgcccggccacgtatgattcttcataggagataatctcttgagagggttccgttttttaatgcttcacttttatactttccagaacagcacagcccttgtaaaaatttattagcgtcggttaacaaaaaaccaagaagagcattaagatgaacatgtactgacctcatgctaagcggcacacagacctcatgggaactaaagccatggcatataaaactgaggggtgtttagtttggggatgatttttaaggggctgaattcctcattaagactgtggaaagatgcccccagcattgtcccagctgacgctccagacgaggcaatgtaggagaaaaatgcttttccgtgtttgtcactatccctgtggcattgccctgcccagtacagcttttctccactcgagcaaagcgtctatgcatcccccaggcccccacctaggtgctgtgggaggaaaggggaatgccaggtgttgtccattgttactgcgtgcaccaaaggaagcctccttcctcttcagtggagggtgatagcacgttccccaccctggaagagagttgctgctttgccatgccttgattctggttgagagtcccaaaggatgacagaatcacttcccttgggcctcactgccaaatataatccacttaatatcctccaagtttgaggccataagtctgtggcgcatccagatgcgacccccgaggcgatagcatcaacgtgggagccaatgcaactcaaaagaaggatggggcttcgcacctcctccttgggtaggaagtaggttagctgcttggaaaatgcaggaactggcactgaagagatctgagtctgaacatatccctcacccgtcagtagcactgggaccttgtgcaatgttagttttcccttccctgcttcaacttagatggctcgggccctgagaaagtgattcacagctgaaaaataaatcaaaggcctcgtgttctaaaaagagtttatggaaggagaggcagctgatgaaagtctagaaagaaggctgaacttttccaatgagcacaataagccatttttaccctgcctgtaatcctcggggtggaatcccgcgagtggccgaggcgagcacccttcccgccgttcctgtttctaaggctaaatgatgtcatgccagcctgcgtgagcatatcaatctgtatttctgagtatgaactggatttgaggggtgcattggtgctccagccctccagatcagtaagacaaccaatgcagaaacaagggctcccaggctcctcttctgcaagaggctgttagtgacgtgcccgctgggacagccctgcccaggatggccccagctggggagcctttggcttccatctggcggcgttctatattatcccatccttctgtctcacccttcctaggttcagcttctctgaagagtacacagcatttgctcagtggagttgtaaaatgtattggtaaagtgctctgggttgacacgttcctttgcttctttcctaaatgccaggctctgtgttattagggccgtctgtcgcttcccagcgcctcccgaggtgactgcttccctgactcggtggctgcttaatattcagtgccatttcctcctcccgactgtcctggcgtgggtgtgagtgtgcctgtgtgtgtgctcgtacagcagttgttatcatgatgtacttactggctgtctaccgatggctttcctttcattctactattttttggttgacttctgtgagctgtgagtcatcggtggtaacattatgcattgaatggattagctggtacctaaaaatagccgaggccctcatgcaggcggcacatgagcctgtagagtcagtccctttgcagccaaggcagacccacttgccaacattgaacatgccgagcttggtggcgatgaatcctaatgtatcaaaaaatagatagttggtgactgccctgtgtgcagagcccagccctggatttgtgccgcagttgttggtaatacacacttcctgtctgttctggtgctggaaaggctccaacagagaaactatgtcaaaccacatttttgtttgtgggtctttgtacctctctaaaaaaaaaaaaaaaggagaaaaatgctctcctttaaactgtatgtgctatatgtgcccccaactgggtcatcttatatgttttgattctctcagactgttgttgtttatagcatttagaaaaaaattaaagactattgtttaaagcagttttaggtgtacagcaagtagagagaggtctcacacacctaacagttttccctgttattaaaatcttgcattggtgtgatagattggttacaactgatgagccagtaccgataccttatttttaactaaagtccatagtttatactacagttcactctgtgttgtacatgctgtttttgatgaatttatgatgtcatgtatccagcattacattattatacagaacagctgtaccaccctaaaaatcccttatgcatcaactatttgtcccccacaccccacctgaaactcctggcacccactgatcattttactctctccatagttttgcctgttccagaatgccatgcagttggaatcatccggtatgtcgccttttcacattggcgtctctcacttagcgatatgcatttcaggttcttccatgtcttcttgttgctctgatagctcatttctttttagcactgaatattatgttgttctttaaggcacattttttttttttgagatagggtcttgctctgttgcccaggctggagtgcagtgacaccataatagctcactgcagctttgacctcctaggctcaagcaatcctcccacttcagcctccctaggaacagggaccacaagtacacaccaccacgcccagctaatttttctatttttttgtagagacggggtcttgccatgttgcccaggctgctcttgaactcctgagctcatgtgatcctcccgcctcaggcccccaaagtgctgggattacagggatgagccacccttccctgcctaaggcacacattttaaggccccagaaaaggaaggcaagtgagctagaacctgtgtgcctaagggcttccgtgtcacagctgctgtggtcactcactgggcagtgtccttcctggccatccctgagcctccccacagggccttcccacaagggagctctgtgagccacgctaccatgtgtaagaaaaacccagcttttaatgtgggatttgtgttaggaggcgtcccggtgctagggtgtgggtttactgaacaaccctgaaacacttccaccaaggactgagtcaggctttgcgtgaacatgattcagtgttttaaatagaacactcacagagattcttacactcagccaaagcgttttgactgtttttattaatgatttttaaacattgcagtaaatgggtctctcgcttacccccttcatctttgagacggggttttctgatttttttcatgctgagaacgtaaccatgcagacttagccttccaggaaagcagaccggcctttctctacaggtaaaacaagactgagaatttcacttgcagacaaagttaagaatgcccaatttaataatttcgccaaaaaacaagacatacttactgaaacctagcttatgagagaattcattgctcccagcaacaggcgaaatttgtatgtctgggatagtgtcatgaaaaaatgttttgtaaaacagatgcccttcgcaatttgtgaaaacagggactcttgtgaaggaaatgggagacatatttaaacaacagacgttttgttttctttctatcttgtttttggtgatatgtacatatgtgtgtatatagacatagcaccaatctaagattgaaatatacaatcaaacagcataaatatgcgtgtatgtgcatagtgtttagatatagtagttattgactaagtggtgaaaggaattttattgaattttcatacagaggagctaaaatttttcttaaaagccagtcattagtcagattaggaaggtgacatttaaaaaataattatgagcccagaagtgagtcggtgttgtctccctgtctaggttcgtccatccaaaatgggagttggaggtgacagttctagaggagtcgatttagggggatggatggaggaaggggtaggcagatctcttataaccacactgatgagcacatgggcttgctggcagcagtgggaggagggagggaaagagtggaggagggtgggaggcggtccacccccaaaagcaagaggtgctggcgacagggcatccagagatgaaagacagagggccctcaagcttacaaaagtataaaggccatccctgggcgcggtggctcacacctgtaatcccagcactttgggaggccgaggtgggtggatcatctgaggtcaagagttcaagaccagcctgactaacatggtgaaaacccgtctctactaaatacaaaaaaattagcctggtgtggtggcaggcgcctataatcccagctacttgggaggctgaggcaggagaattgcttgaacctgggaggcagaggttaccgtgaatcaagatggcaccactacactctagccttggcgacagagtgagactctgtctcaaaaaaaaagaaagaaagaaagaaagaaaagttataaaggctattctacttactgcttagggtgtttgaaacaggatatatttactggatgaaaaaatgggctatattgagctgtctggcgttatgtaacgtgctttggttatctgtggtactgctcccatgagtttattttcattgggatttaatcagaaaccattctggaaaatgtgtggaaccccagcaagatcataaaatgacttaatgattactaacacagctgcaagaacgagagtggagagaaaataactgaagtgtgattcaataaaatcatgacgacctcagcatctgacaaggtgaggtggctatggctccgctgagaaagctgcctgttaggcggtaaagccacaccctggagaaagcactgctcctctccctgggggaggtcacagcccactttagttctggctggttaaaaaaaaaaaaaaaaaaaaaaaaaaagacaggcagtctctctattgccccctgttgtccacttgtaccattgcaatgtttttccatacagaaggcaaacagaactattctttcagttttttttttgttttgtttttgttttttttaagacggagtcttgcactgtcacctgggctggggtgcaatggcgtgatcttggctcactgcaacctccgcctcccaggttcaagcaattctcctgcttcagccttcagagtagctgagattacaggcacctgctcccacgcctggctaatttttttgtatttttagtagagacagggtttcaccatgttggtcaggctggtcttgaactcctgacctcatgatcagcccgcctctgcctcccaaagtggtgggattacaggtgtgagccaccatgcccggcctcttctttcagattttaactgagcacctattacttgctaggaagtcttttagactctggagatagaacactgagtttggggaaagaggcaaaacagacaaatatacaagtaaataaaaaagaatgcataagaagataaccagtcccttttggcaccagggactggtttcatggaagaagattttttggcaggatgggaagagggagggggatggttttgggatgaaactgttccacctcagatcatcaggcattagttagattctcataaggagtgcacaacctggattccttgcatgcgcagtttacaatagggttcacgctcctatgagaatctaatgcttgcgactgatctgacaggaggcggagctcagtctggaatggttgctcacctccagctgtgcagcccagtacctaacaggccatggactgctactggtctgttgcctgggggttggggatccctggtataaagaggagaaggggccaggctaggtggctcatgcttgtaatctcagcactttgggaggctgaggcaagagggcacttgaggccaggagttttgaaaccagccaggccaacatagcaaggctccatctctacataatgatcatcattatcttcaccaacaaaacattagctggacatggtggtgcatgcatgtggtcccaactactcaggcggctgaggcaggaagatatcttgagcccacgaggtcaaggctgcagtgagccatgatcatgctactgtactccagcctgggcaacagaacaagaccctatctcaaaataaaaaaaggaagctatggaaactagagggttgttattttaaatagaactgtcaggggagttctctctgaaaaggacagtgggtggcaacagtacgtgaggcaaaaaagattccaaatgaatggagagagtagcaggtgcccagacggaaggcgcaagaggggttaaagaaccagcaaggagaccactgttgctacagtgtagggagtaaggggcacatgcagaccacatcaggcttgcatgtggtgaccgagcgagtgagatgcagcttggccaggacaaaggtggtggaggtagtaaaaaaatagtatcattctaggtgtatttggaaaaggaacccatacagtttgcttataattgggatgtttgtgatgtaagagaaagagcggaagaaagtatgattccaaggtgcttgattgaacagccggaagaatgggataccatttatggagatggggaagaacatgggatggccaccgggcaggggcacatcgggaggtctggtgtgttttaggtcactttaagtttgagttgcccattcgacatctgagtggacgtcatcggatagtgtggtcactggtgtccaaatgtacccgttttgcgtgtatgttctgtctcctggtgggaggcaagaaactaggtcttaaccaatagatactcttctaaggttcctaacacttagcaggtgctcggtgtatacttgttgaacttttattaaaactggaaagcctgaaatgtatcattaggaaccctcaataatattttgaggccgggcacggtggctcacacctgtaatcccagcactttaggaggccaaggcaggcagatcacttgaggtcaggagttcaagaccagcctggccaacatggtaaaaccccgtctctactaaacatacaaaaattagccaggtgtggtggcttatgcctcccagctactcgggaggctgaggcaggagaatcgcttgaacccaggaggtggagtttgcagtgagccgagatagtgccactacattccagcctgggcaacagagcaagactccatctcaaaaaaaaaaataataataataacaatattttgaagctatcagcatcatagagaatacccatatgggttttaaattcaaggaattcacagacttattgttccagttgaagatgacatcatcctacaaaatcacaccgtctctgtttcacatccaaaccagtccccgctggcattgacagcatgttttgagatggagaaggctcctctccaagggaatttcaagcaacagatttgatgatatatattctcactgagaaacccctcagtgagatttcttcattaacggttaatgatcagttaacctttaagaatgtttatatccttatgacaaacctaattataaaataaagatagatttgctatgaatgcttgagtgtacctatttgagatgtgtgcaacaagattttaactttcaccaaagaagggaaaaaaaccttattttacttctcatacattcagaccccaagggggaaaaagtacattgtctaggtagttcacactaattagtgaggagaaaactagcattgggctggcaagctatccgatctgtgcctacaatgatcagattatctgaataatcttccgctcccacctcagctttcatggacccagctgatatctggtcgtggcatcttttcgcagggtgacacagctcctttggtaggaagcaaaggcagaatttaggcaaaaagaaacaaagagaagcctttgaagtgattaaagaagaatctcccaagcctatctaggttaacataaatttcattaacaggccaggtgggcgcggtgactcacttctgtaatcctagcattttgggaggctgtggcgggcagatcgcctgagatcaggagttcaagactagcttggccaacatggtgaatgaaaccccgtgtctactaaaaatataaaaaattagccaggggtggtggtgggcacctgtaatccctgctacttgggaggctgaggcaggagaatcgctcgaatccaggaggcagagattgcagtgagctgagatggtgccactgcactccaacctgggtgacagagcgagactctgtctcaaaaaaaaaaaaaaaattccattaacgtcatcttgttttagtacgcatctcaaatattctctctctccatcacttttctctcgtgaatttttcggcaggctgttctagctatggttcacaccacagcatttaattctaaggcctgtctttggagatttggagtttggtttggtttggtttggtttttagagacagagtcttgctctggcacacaggctggagtggtgcagtagctcgagtgaccctcgcacctctgtaactgaacttaggtttggctgctcaccactcaaaagccaaatacgagagatgaggttggtgagaggaaaagcaggtttattgggaaagccagagaaattgagaagatgatgagctagccttctaaagtaccatctccaggccaggcatggtagctcacatctgtaatcccagcactttgggatgccaaggcaggcggatcacctaaggtcaggagtttgagaccagcctgacccacaatggccaaacaccatctctactaaaaaatacaaaaattagccaggtgtggtggcacatgcctgtagtcccagctactcaggaggctgagacaggagaatagcttgaacctaggaagcagaggttgcagtgagccgagattgtaccactgcactccagcctgggcaacagagaatccatctcaagaaataataattttgtaaaaattaagtaaaatctccaattttttaggctggttggagggtttttatgggaggggggtatggggggagacgaaggggttagtatcgaggagactgaggaccatagacatttgggcaccagtgagggttcaagaaggttgagaacttctttgtccttggtcaggtcataatgctccttcagtctttagtatttttaatagagggtttcaccatattggccagactggtctctaactcctgacctcaggtgatccgcccgcctcggcctcccaaagtgctgggattacaggcgtgagccaccgtgcccagccactcctatcagtctttaacaatatatagttagttgtttatatacttcccctttaatcccagagttagtttctaaaagtacatgattgttgtttgtgtatattatctcggtgccataaaattatcctagcctacgtgcaggaaagggtaaaaccctttaaacaaaaatggagttagttatgttcgttcttttgctatttcacaattgtacctcagcctcccaaagtgctgggattacaagagtggtgtctttggagttttgagatgcggaaataatgaaaggctttcaaaatgtccaataacattatgaagtctttagagggaaacacgtgtatctgtatcctgacttttgcactaatcaattatagtacctgttataaagggcttgtagacatttcttaatgagtctacagatacttggtaacgtggaaatcctcagataagtttacctatgagaacacagtagatgttattttcagaaaattaaatattgcctgccctgtgaagtgtgtataatgtggctcacacaccaagggcctctccatgggtaggtgtccggccatctgccagcaaggagacagggagttatccgggaacacgcagaaccagaaaagaggctgacatgtttggaactaaggcttctggtcttctgaatgtcacattacctctgcctggtgttgggcaagaataagcaaaccgcaactctggtagagagtcttacgagacagatgttaacacctgagagttttatttttatgacttggatttgcagcaaaacaatctccacttgatgtgggattggtttccttctgttcagtttatgttgttaatgactctaagaggtttgcaagaggatctatggagccagttccagattggtcctcctacttagaatacagtgggtatccccatctgatacagtcacttgtaagtatatttgtctatgtatatatgcacatatatgtttctgtgtgtgatgtaaatgtagttttgaaaccaaatagtgtcacacacttgtacagggtaactagaattgtatgagtggctataaggcaaacactgcatcacaattatctgtaccatggaacaagcccatgagctcatgcctttggatcctacttatttcagtcaatattcaccactgttggggggtagcaggaatgcttagttcatctcttttggtggcattgtaatgtctttgctcacaagggtagaggtcaggaggcacagaaaaaagaaaatgggtttgggggccaatgactgggataaaatcctaaacccattagctaatagctatgacattaggcaagtgacttaatctctctgtgactattcgtaaaatttacaaaattggaagagcaatactattccatactaatactattatgaacattaaacaaaatactttttgtaaagtttgtacctgagagcttgacagagagtaggcactcaaaaacttttagcttgcttcacattataaaaatagcccagaacaatgaaactttcccccagtaatacacacaggagaaggggttcatgcttacaagctgccatatgaatgtactcaagttgtctcttctaaaaatatgccttgtatggatccagtaaagtctgtcattctagaaatgtatcagaactagatcaatcagagttaacaaaggaaacaaagaagatgaagtagaaaagcaacaatctgtggaaatctactacttttaaagtttttttggtacttcaattatgcatgtgtgtttttgtgtgtctgaatgtgtataaaatccaatggaggcctgacacggtggctcacgcctgtaatcccagcactttgggagactgaggcgggtggatcatgaggtcaggatatcgagaccatcctggccaacatggtgaagcccccactctactaaaaatacaaaaagtagctgggcgtggtggtggtggtgcatacctgtagtcccagctacttgggagtctgaggcaggagactcgcttgaacccgggaggcggagattgcagtgagccgagatcgcgccactgcactccagcctgggcgacagagcaagactccctctcacaaaaagaaaaaaagaatccaacaatattttaaatattgttacatatagccaatattcattcagattcaccatgtatctaccattttcattcctcttcattcctccctgtacaaacttcaatctagatttgttttttctctacctaaagaataccttttagtattttctataatgcagatctgttgatggtgaattcttttaattactgtttgtctgaacatgtctctattttgccttcattctggaaggatctttttgctccatatagaattcgccattgacaattctttttctttagcactgtaaagatattccattgtctccattgtctactggcttccattatttttgttgagatgtaaactgtgagttccattgttgcttatttggagataatatgtattttgttctagaggctttttttttttaatggagtttctctattgtcgcccagtctagagtgtgatggaatgatcttggctcactgcaacgatcttggctcactgcaacgatcttggctcactgcaacctccgcctcccgggttcaagtgattctcctgcctcagccccccgagtagctgggattacaggttcctgccaccatgcccagctaatttttgcatttttagtagagatggggtttcaccatgttggccagactggtctcaaactcctgacctcaggtaatccacccacctcggcctcccaaagtgctgggattacaggcaggagccaccacacccagcctgttctagaggcttttaacgatattttttcctgtttagtttacaagatgtctttgatttatagcagtttaattctcatctgcctcagtgaggatttctttttgtttatttttcctgtttggggctaggccttcttgaaactgtcttattatccttcttcagtttgggaaaattcttagccattacctcctcaagtattaacttctgccctattatctccctctcttcctcctcctaggattcaaattatgtgtctgttagcccctctcaatgtatcctatgtgtctcttaccctctcctccatattgaccatctttttgtctctatgttcactctgtggagtctcttctaaagctctaattagagaatccagttcctgaattctttcttaatccatgtctattcaactggaaagctcattgcattcttgatttcagtggtgtatattttaattctacaattctcatagaccttttttaattaattaattattattattattattatttattttttttttttttagagacagagtctcactctgttgtccaggctggagtgcagtcttgtgatcatagctcactgcaacctctaactcctgggctcaagatcctcctgcctcagcctcctgagtagttgggactacaggcacgcatcaccacactaggctatttttttttaaatttctgtagaaacggggtctcattttgttgcccagactggtctgaaactcctggcctcaagtgatcctccctgtctcagcctcccaaagtactgagattacaggcatgagccaccatgcctggcttcatggatcttttaaaaacagattctagtttcctatcaaaattctcaagctgtctttaatcttcttaattattgtaagcatagtctttgtaaagtctatatgtatgactctatatgagaagccctggtgcatccttttttaagatctgatattttgctagtgcttatacaagctatctggtctcctcatgaccaccaccccccttttttaaattgaatgcttttatttgcaaaattgtgaaagtaattcaagaccttaatccagttttagggactcagatgagtcaatctgagcttcagaccttgaaaggcctgttggcttgtggttcactgtctcctctaagggacagtgctttggggtcacaactcaaaagaatggggctcaccagagaacaccctcccttggtgtatcctgaactccattacctgttccctatgctcttaacactatcaaaagcccacttggtttcccaactgctccactttggaatgttcaagtgccttcaggagaaaacaggcccccaacaccagcttcacctctctgggccatcatcttttcctgatccaacccaggaagtgtgtgtgtgtgtgtgtgtgtgtgtgtgtgtgtgtgtgtgtgtgtgacggagtttcactctgtcgcccaggctggagtgaagtggcatgatctcggttcactgcagcctccgcctcccgggttcaagcgattctcttgcctcagcctcctgagtagctgggattataggcgcctgccaccacacctggctaatttttgtatttttagtagggacagggtttcaccatgctggccaggctggtctcagagtaaagtggcacgatcttggctcactgcaaccttcgtcccccggactcaaacgattctcctgcctcagcctcctgagtagctgggattataggggcccaccaccacacctggctaagttttgtatttttagtagagatggggttttgccatggtagccaggctggtctcaaactcctgacctcaggtgatccacgcgccttggcctcccaaagtgctgggattacaggcatgagccaccgcgcctggcctttttactatcttatttgctgtccagtactataagaaaaaaagtttaaacattttgtccagagtttttaaatttatttgtttgcttatatttttgttcagagtttttagttgtcctcagaaggagggttggtccaaattacctagtctactacatctagaaaggacattggaaattgactttttttttttttttttgagacggagtctcactctgtggcccaggctggatcgcccagtggcacgatctcggctcgctgcaacatctgcctcctgggttcaagtgattctagtgtttcagcctcccaagtagctgggattacaggtgcccgccaccacgcatggctaattttttttttttatttttagtggagacggggtttccccatgttggccaggctggtcttgaactcctgacctcaaatgatccacccaccttggtgtcccaaagtgctgggattacaggcatgagccactgtgcccagccaccaagcatccttttaggggctggggactcagtgataaacacactgtgcctgcttcttggaactcacagtctcactctgatccatgtttagtcctgtcctgtatgataatagcagttgtccattgagctcataaaatctaagaccgcgctgggcttgtgagccacctgcagagcctagcttggtgctgaaagctaagtgggtgctctgtcattactggggttcgattgactggttctaacagagaccagctatagagctaacacttgatggaatattttgaatattgatgaccttttcactggcttctgcctatggcaagtagaggtacaacccaaagagaagagcctcatttatagtgtgtggctgggggagagggaggtttgcaaactgagtcattttcccccattcagcctgtgtgtgtctgtgtgagttcatacctgtgtgtgtgcataaaatcaaacaagaataaaatgttttcatttgttcccttccttcttcctctctctgtctctccctgtttccacaggtcagcgttgaagttttggtagagtatcctttttttgtgtttggacagggctggtcatcctgctgtccggagagaaccagccagctctttgatttgccgtgttccaaactctcagttggggatgtctgcatctcgcttaccctcaagaacctgaagaacggctctgttaaaaagggccagcccgtggatcccgccagcgtcctgctgaagcactcaaaggccgacggcctggcgggcagcagacacaggtatgccgagcaggaaaacggaatcaaccaggggagtgcccagatgctctctgagaatggcgaactgaagtttccagagaaaatgggattgcctgcagcgcccttcctcaccaaaatagaacccagcaagcccgcggcaacgaggaagaggaggtggtcggcgccagagagccgcaaactggagaagtcagaagacgaaccacctttgactcttcctaagccttctctaattcctcaggaggttaagatttgcattgaaggccggtctaatgtaggcaagtagaggcagcgtgggggaaaggaaacgtggctctcccttatcatttgtatccagattactgtactgtaggctaaaataacacagtatttacatgttatcttcttaattttaggtttctgttctaaccttgtcattagagttacagcaggtgtgtcgcaggagactggtgcatatgctttttccacgagtgtctgtcagtgagcgggcgggaggaagggcacagcaggagcggtcagggctccaggcatccccggggaagaaaggaacggggcttcacagtgcctgccttctctagcggcacagaagcagccgggggcgctgactcccgctagtgtcaggagaaaagtcccgtgggaagggtcctgcaggggtgcagggttgcacgcatgtgggggtgcacaggcgctgtggcggcgagtgagggtctctttttctctgcctccctctgcctcactctcttgctatcggcatgggccgggggggttcagagcagtgtcctcctggggttcccacgtgcaaaatcaacatcaggaacccagcttcagggcatcgcggagacgcgtcagatggcagatttggaaagttaaccatttaaaagaacatttttctctccaacatattttacaataaaagcaacttttaattgtatagatatatatttccccctatggggcctgactgcactgatatatattttttttaaagagcaactgccacatgcgggatttcatttctgctttttactagtgcagcgatgtcaccagggtgttgtggtggacagggaagcccctgctgtcatggccccacatggggtaaggggggttgggggtgggggagagggagagagcgaacacccacgctggtttctgtgcagtgttaggaaaaccaatcaggttattgcattgacttcactcccaagaggtagatgcaaactgcccttcagtgagagcaacagaagctcttcacgttgagtttgcgaaatctttttgtctttgaactctagtactgtttatagttcatgactatggacaactcgggtgccactttttttttttttcagattccagtgtgacatgaggaattagattttgaagatgagcatatattactatctttaagcatttaaaaatactgttcacactttattaccaagcatcttggtctctcattcaacaagtactgtatctcactttaaactctttggggaaaaaacaaaaacaaaaaaaactaagttgctttctttttttcaacactgtaactacatttcagctctgcagaattgctgaagagcaagatattgaaagtttcaatgtggtttaaagggatgaatgtgaattatgaactagtatgtgacaataaatgaccaccaagtactacctgacgggaggcacttttcactttgatgtctgagaatcagttcaaggcatatgcagagttggcagagaaactgagagaaaagggatggagaagagaatactcatttttgtccagtgtttttctttttaagatgaacttttaaagaaccttgcgatttgcacatattgagtttataacttgtgtgatattcctgcagtttttatccaataacattgtgggaaaggtttgggggactgaacgagcataaataaatgtagcaaaatttctttctaacctgcctaaactctaggccattttataaggttatgttcctttgaaaattcattttggtctttttaccacatctgtcacaaaaagccaggtcttagcgggctcttagaaactctgagaattttcttcagattcattgagagagttttccataaagacatttatatatgtgagcaagattttttttaaacaattactttattattgttgttattaatgttattttcagaatggcttttttttttctattcaaaatcaaatcgagatttaatgtttggtacaaacccagaaagggtatttcatagtttttaaacctttcattcccagagatccgaaatatcatttgtgggttttgaatgcatctttaaagtgctttaaaaaaaagttttataagtagggagaaatttttaaatattcttacttggatggctgcaactaaactgaacaaatacctgacttttcttttaccccattgaaaatagtactttcttcgtttcacaaattaaaaaaaaaatctggtatcaacccacattttggctgtctagtattcatttacatttagggttcaccaggactaatgatttttataaaccgttttctggggtgtaccaaaaacatttgaataggtttagaatagctagaatagttccttgactttcctcgaatttcattaccctctcagcatgcttgcagagagctgggtgggctcattcttgcagtcatactgcttatttagtgctgtattttttaaacgtttctgttcagagaacttgcttaatcttccatatattctgctcagggcacttgcaattattaggttttgtttttctttttgttttttagcctttgatggtaagaggaatacgggctgccacatagactttgttctcattaatatcactatttacaactcatgtggactcagaaaaacacacaccaccttttggcttacttcgagtattgaattgactggatccactaaaccaacactaagatgggaaaacacacatggtttggagcaataggaacatcatcataatttttgtggttctatttcaggtataggaattataaaataattggttctttctaaacacttgtcccatttcattctcttgcttttttagcatgtgcaatactttctgtgccaatagagtctgaccagtgtgctatatagttaaagctcattcccttttggctttttccttgtttggttgatcttccccattctggccagagcagggctggagggaaggagccaggagggagagagcctcccacctttcccctgctgcggatgctgagtgctggggcggggagccttcaggagccccgtgcgtctgccgccacgttgcagaaagagccagccaaggagacccgggggaggaaccgcagtgtcccctgtcaccacacggaatagtgaatgtggagtgtggagaggaaggaggcagattcatttctaagacgcactctggagccatgtagcctggagtcaacccattttccacggtcttttctgcaagtgggcaggcccctcctcggggtctgtgtccttgagacttggagccctgcctctgagcctggacgggaagtgtggcctgttgtgtgtgtgcgttctgagcgtgttggccagtggctgtggaggggaccacctgccacccacggtcaccactcccttgtggcagctttctcttcaaataggaagaacgcacagagggcaggagcctcctgtttgcagacgttggcgggccccgaggctcccagagcagcctctgtcaccgcttctgtgtagcaaacattaacgatgacaggggtagaaattcttcggtgccgttcagcttacaaggatcagccatgtgcctctgtactatgtccactttgcaatatttaccgacagccgtcttttgttctttctttcctgttttccatttttaaactagtaacagcaggccttttgcgtttacaatggaacacaatcaccaagaaattagtcagggcgaaaagaaaaaaataatactattaataagaaaccaacaaacaagaacctctctttctagggatttctaaatatataaaatgactgttccttagaatgtttaacttaagaattatttcagtttgtctgggccacactggggcagaggggggagggagggatacagagatggatgccacttacctcagatcttttaaagtggaaatccaaattgaattttcatttggactttcaggataattttctatgttggtcaacttttcgttttccctaactcacccagtttagtttgggatgatttgatttctgttgttgttgatcccatttctaacttggaattgtgagcctctatgttttctgttaggtgagtgtgttgggttttttccccccaccaggaagtggcagcatccctccttctcccctaaagggactctgcggaacctttcacacctctttctcagggacggggcaggtgtgtgtgtggtacactgacgtgtccagaagcagcactttgactgctctggagtagggttgtacaatttcaaggaatgtttggatttcctgcatcttgtggattactccttagataccgcatagattgcaatataatgctgcatgttcaagatgaacagtagctcctagtaatcataaaatccactctttgcacagtttgatctttactgaaatatgttgccaaaatttatttttgttgttgtagctctggattttgttttgttttgttttttaaggaaacgattgacaataccctttaacatctgtgactactaaggaaacctatttctttcatagagagaaaaatctccaatgcttttgaagacactaataccgtgctatttcagatatgggtgaggaagcagagctctcggtaccgaaggccgggcttcttgagctgtgttggttgtcatggctactgtttcatgaaccacaagcagctcaacagactggtctgttgccttctgaaaccctttgcacttcaatttgcaccaggtgaaaacagggccagcagactccatggcccaattcggtttcttcggtggtgatgtgaaaggagagaattacactttttttttttttaagtggcgtggaggcctttgcttccacatttgtttttaacccagaatttctgaaatagagaatttaagaacacatcaagtaataaatatacagagaatatacttttttataaagcacatgcatctgctattgtgttgggttggtttcctctcttttccacggacagtgttgtgtttctggcatagggaaactccaaacaacttgcacacctctactccggagctgagatttcttttacatagatgacctcgcttcaaatacgttaccttactgatgataggatcttttcttgtagcactataccttgtgggaatttttttttaaatgtacacctgatttgagaagctgaagaaaacaaaattttgaagcactcactttgaggagtacaggtaatgttttaaaaaattgcacaaaagaaaaatgaatgtcgaaatgattcattcagtgtttgaaagatatggctctgttgaaacaatgagtttcatactttgtttgtaaaaaaaaaaaagcagagaagggttgaaagttacatgtttttttgtatatagaaatttgtcatgtctaaatgatcagatttgtatggttatggcctggaagaattactacgtaaaaggctcttaaactatacctatgcttattgttatttttgttacatatagccctcgtctgagggaggggaactcggtattctgcgatttgagaatactgttcattcctatgctgaaagtacttctctgagctcccttcttagtctaaactcttaagccattgcaacttctttttcttcagagatgatgtttgacattttcagcacttcctgttcctataaacccaaagaatataatcttgaacacgaagtgtttgtaacaagggatccaggctaccaatcaaacaggactcattatggggacaaaaaaaaaaattatttcaccttctttccccccacacctcatttaaatggggggagtaaaaacatgatttcaatgtaaatgcctcattttattttagttttattttgatttttatttaatataaagaggccagaataaatacggagcatcttctcagaatagtattcctgtccaaaaatcaagccggacagtggaaactggacagctgtggggatattaagcacccccacttacaattcttaaattcagaatctcgtcccctcccttctcgttgaaggcaactgttctggtagctaactttctcctgtgtaatggcgggagggaacaccggcttcagtttttcatgtccccatgacttgcatacaaatggttcaactgtattaaaattaagtgcatttggccaataggtagtatctatacaataacaacaatctctaagaatttccataacttttcttatctgaaaggactcaagtcttccactgcagatacattggaggcttcacccacgttttctttccctttagtttgtttgctgtctggatggccaatgagcctgtctccttttctgtggccaatctgaaggccttcgttggaagtgttgtttacagtaatccttaccaagataacatactgtcctccagaataccaagtattaggtgacactagctcaagctgttgtcttcagagcagttaccaagaagctcggtgcacaggttttctctggttcttacaggaaccacctactctttcagttttctggcccaggagtggggtaaatcctttagttagtgcatttgaacttgatacctgtgcattcagttctgtgaatactgccctttttggcggggtttcctcatctccccagcctgaactgctcaactctaaacccaaattagtgtcagccgaaaggaggtttcaagatagtcctgtcagtatttgtggtgaccttcagattagacagtcttcatttccagccagtggagtcctggctccagagccatctctgagactcgtactactggatgttttaatatcagatcattacccaccatatgcctcccacaggccaagggaaaacagacaccagaacttgggttgagggcactaccagactgacatggccagtacagaggagaactagggaaggaatgatgttttgcaccttattgaaaagaaaattttaagtgcatacataatagttaagagcttttattgtgacaggagaacttttttccatatgcgtgcatactctctgtaattccagtgtaaaatattgtacttgcactagcttttttaaacaaatattaaaaaatggaagaattcatattctattttctaatcgtggtgtgtctatttgtaggatacactcgagtctgtttattgaattttatggtccctttctttgatggtgcttgcaggttttctaggtagaaattatttcattattataataaaacaatgtttgattcaaaatttgaacaaaattgttttaaataaattgtctgtataccagtacaagtttattgtttcagtatactcgtactaataaaataacagtgccaattgcagatgtgtgtctttgccttctgttgggtcctcaaggaagaggccaggaaaagagtgctaattcctcctccttattgacccccgctcacgagttctccctgggtaggtcggaggtagggaggtgtgacatgaggcattgccttcgctgctaatgttttggggggaagagtacgtgtgagatgaggttctaagataaaaggcacacagccacacctgatgtcttggtttcttcagttcatgtttatgcctcctagctgaacactgctgttcacaagaggtatacttgtctttaaacatgtggtagcttcatgcgctcgtgtggcataatctatacactccttacagatttgctctaaactggttagtggtctgtaagtggaaaatttatttttacttcctgtaattcaagctcattagaaattcagcgagcagaccgggcacagtggctcacgcccataatcccaacagttggggaggccgaggcacaaggcctgcttgagcccaggagttcgagaccagcctagtcaacatagtaagacctcatctctacaaaaaatgaaattagccgggtgtggtggcacatacctatggtcccagctacttaggggactgaggtgggaggatcgcctggggccaggaggtcgaggctgcagtgagccataatcataccgctgcactccagcctgggcgacagagcaaaactctgcctcaaaaacaaaaaaaaaacccaactcctcgagcaggtctctcagcatgtggaggaactccccgtttacctcaagagtaccacattacagctttgcactgggcccagtcttggaaagatatggcttagcagttgtgccagaaaaagtaattcctcaagaacccatagcttccaggtggaatcccctgcacccacctcaacccacctcaacccacctcaagaccttccagcctcaaggttacacagaggtgggagaacgcttggggttaaattcattttcacttagccaaggaggaactatcttcttgggaaggtgttttggactctcctctgattatttagttgaggtcctgacacattatataataaatatgtgaaaggacacacagcaaaccagagctgtgtaggtgcaactcaggctacaagggctgccccaggtcctgtggagtagcccgggcaaatgtgcctgtgtgctgtgggcaaactcggcaaagcagtctgcatctctgccttccctttttgtttgtgtgagatactgattgttctgacaagtttggggtccagtggctgtgttacttacctcagctggtgaaatcaattagggggaaccataccttcaggtgctgcagcggggcaggacttgaaaccatcaaaagcactgccagagccctcagatggaacggccagagtggcccaaggcaaatggcgtcgagttcactggctgtcctcctcctcccccagctctggcacaggaagcccagtgggtcagcagcaaagctgcatgcttcatctccaggtcctgtgggacacccggtccaagggacactctggtgtgggctcccccagccccactcctatcagaggcagagatgaacctgctaaggcaaacggtgacggagccttacaagttctctttatgggccaggcgcggtggctcacacctgtaatcccagcactttgggaggctgaggtgggtggatcacccgagcccaggagtttgagaccagcctgggtaacatggcaaaaacccatctctactaaaaacataaacattagccagacgtggcgggcacctgtaatcccggctactctgaaggctgaggcacgagaatcacttgaacctgggaggcggaggttgcagtgagccgagattgtgccactgcactctgcctgggtgacagagcaagacttggtctcaggaaaaaaaaaaaaaaaaaagacattctctttctgaaggctctgcttcaaaatggtcctaacgagtttttgattttgtaactactcagttacaagcagctggaagaccacagagagcaaggcggggagcctgcagccaagccccatgtcttgctccacgttaaatcgcctcttggccctcccgtctccaaagtgcagcccttgtgtttctacaggtgcaagagttattcttaatgggccgggcacagtggctcacacctgtaatcctagcactttggggaggttgacgcaggtggatggcttgagccctggagtttgagaccagtctgggcaacatggtgagaccctgtctctataaaaaatacaaaaattagctgggcgtggtagcaggtgtctgtagtcccagctacttgggagactgaggtcagaggatcacctgagcccgggaggtcaaggctgtggtgagctgtgatcctgccactgcactccagcctgggcaacagagaccctgtctcaaattaaaaaaaaaaaaaaaaaaaaaaaaaaaaaactcttaatggatttagtaggggaaagtattacaatggagacaatgctgctggctggatctctaaacataatcttaaaggaccaacagtgggcctgtattatcccagagtgtgacagctctggttggacccttctcatgccatcggtcactgtggacaatcaggccattcattcaccctggcacagcagcaccctgtggatcttctctactccagggtcattgcttgcctttccaaagaaaactgacttgtgtatctgctcttcagccttattaaaaagcaaagtaaaacaacctgatctgcatacgctttccaggcctggaactcaatacttcaaagtttagcggccggtcatcacttcttctgcgttcactgtttaaacaagcatcctggtggactgctgcaggtcagctgcagaggccaattctccaagacaatgtcattgttcccaacccgttaactgacccttatacagtagtgccatgtggtccttccgagaaaggattcactggcacactgagggaatggctctaactcatgtctcaaaccaatgccttttaggatgccactgatcaaagctttggctctttttcagtgtgactccacctgctaatttcttgggagacaaccttcccataaaacatcctgtggaatttcaaattaagacaagttgggactgagaagggggaaaaaaaagatggaggaaaacaaaacgaaatgagaagccaggacagggacagcttcctagaggcaacagcaaactggtagcgacagatgacttgtccctgaaaagcacatgtaatgaaactcggggaaaacacattggctcaactttgtgagtatcagctgggaaaacaattcatgttcatctgtccagttaattgcttttgttcttttgcagcaaccaaaagctagaggtgagggatgccagttactttgactccggcctgtccacccttggcccccgcactgtcctcctctccttgcccctcctaaggtgacttgtctgctaatcgccgggagaggcttgccatcagcctgtctaggaaggtagcaaaacaaatcccaaaccattcaacttgactcctggaaatacaaactccagcaactccattaagtcttaagataatagcattatattaaagtgaaaccatcttcttttaaaaaagaaagaaaaacaaagaaagggagagagaaagagaaaaagagaaaggtgcaagtgttggtttgaacaatgaggttatgagttctgggcagcagggctctgatgttggcccaatcggtgccttgcgtctgggccccgagaaggcaggcgggagagccccgaagcctccaggcagcaggagacagaagagaggacacagcattccaccattcaggagcagccagaagctctgacggaacagacttggggggagatgggaaaagcaggtttggacgcttccactcgagccagacgctgctttgtccccagggttagctgaacacggtgttgtgctgctgggtcacccggatgaatgttgccctcctgctgagctccttgagtttggcggcccccacgtaggtgcacgtggacctcagtcccccgagaatatccaggatagtgttttccacatctcctttgtaaggaacttccacagtcttaccctcagaggctctggaagacgatagaagttttctttttatctagtttcccgccccaccttaagagcccaattagaattactcccagctccagcactttctgtagcccccaaggcactcagaaaaccagaccccaccctctgaccccatccccacatttctaccaagtgccaagatgatcaccagcatctcagatgaacacattcctcccgcccaaagggcacgggctcattgctggctgccctgcatgttgcggagaggaaagtcctggtgagcagcgcttgaaggagtcagggacccataacaccctgcttggtgccattctctccagcaacgtgctcccctctgctgctaacagaaaccacctttacctttctattctacctcaacatgcacaccaacttcccaacaaccaggagcccaaaatgcccccagaatggccctggccgattcccccctggaaacagcctcctgtcctcctacgtcaacaacaggaaaagtccagagcttcacctcccgcctgtctggtctaagatcagaaatcaagtgtcttcaagggggacgaccaggacgaggaggacataaaatggatagcgcaggtcctaccagcttacgtggaaatcaccagcaaggtgatttcattgaagtggctctgttttgatagcctgcctgtctttctgctttgctgggtacactggccacccccagttcgactccctgttctcttacaggtcactacacctatcaccctgcacatgtgtgggtccaagcaaggtggaatcagaggagaaccaagacctgtcttagcaccagaggcttccaggctttggatagcaacgttcacattttcagaggagtatttagaaactcaagtctggcctatggcatgaacactaagcaacatttc

SEQ ID NO: 5305 - DNA, 20 bp, Artificial Sequence
  Description of Artificial Sequence: Synthetic oligonucleotide
  Target: ATXN1; (-) strand; PAM type: NAAAAC; PAM sequence: GAAAAC
tgtagcccccaaggcactca

SEQ ID NO: 5306 - DNA, 20 bp, Artificial Sequence
  Description of Artificial Sequence: Synthetic oligonucleotide
  Target: ATXN1; (-) strand; PAM type: NAAAAC; PAM sequence: AAAAAC
tcttcttttaaaaaagaaag

SEQ ID NO: 5307 - DNA, 20 bp, Artificial Sequence
  Description of Artificial Sequence: Synthetic oligonucleotide
  Target: ATXN1; (-) strand; PAM type: NAAAAC; PAM sequence: CAAAAC
cagcctgtctaggaaggtag

SEQ ID NO: 5308 - DNA, 20 bp, Artificial Sequence
  Description of Artificial Sequence: Synthetic oligonucleotide
  Target: ATXN1; (-) strand; PAM type: NAAAAC; PAM sequence: GAAAAC
actttgtgagtatcagctgg

SEQ ID NO: 5309 - DNA, 20 bp, Artificial Sequence
  Description of Artificial Sequence: Synthetic oligonucleotide
  Target: ATXN1; (-) strand; PAM type: NAAAAC; PAM sequence: GAAAAC
cacatgtaatgaaactcggg

SEQ ID NO: 5310 - DNA, 20 bp, Artificial Sequence
  Description of Artificial Sequence: Synthetic oligonucleotide
  Target: ATXN1; (-) strand; PAM type: NAAAAC; PAM sequence: CAAAAC
aaaaaaaagatggaggaaaa

SEQ ID NO: 5311 - DNA, 20 bp, Artificial Sequence
  Description of Artificial Sequence: Synthetic oligonucleotide
  Target: ATXN1; (-) strand; PAM type: NAAAAC; PAM sequence: GAAAAC
gggggaaaaaaaagatggag

SEQ ID NO: 5312 - DNA, 20 bp, Artificial Sequence
  Description of Artificial Sequence: Synthetic oligonucleotide
  Target: ATXN1; (-) strand; PAM type: NAAAAC; PAM sequence: TAAAAC
cttgggagacaaccttccca

SEQ ID NO: 5313 - DNA, 20 bp, Artificial Sequence
  Description of Artificial Sequence: Synthetic oligonucleotide
  Target: ATXN1; (-) strand; PAM type: NAAAAC; PAM sequence: TAAAAC
agccttattaaaaagcaaag

SEQ ID NO: 5314 - DNA, 20 bp, Artificial Sequence
  Description of Artificial Sequence: Synthetic oligonucleotide
  Target: ATXN1; (-) strand; PAM type: NAAAAC; PAM sequence: GAAAAC
tcattgcttgcctttccaaa

SEQ ID NO: 5315 - DNA, 20 bp, Artificial Sequence
  Description of Artificial Sequence: Synthetic oligonucleotide
  Target: ATXN1; (-) strand; PAM type: NAAAAC; PAM sequence: AAAAAC
aaaaaaaaaaaaaaaaaaaa

SEQ ID NO: 5316 - DNA, 20 bp, Artificial Sequence
  Description of Artificial Sequence: Synthetic oligonucleotide
  Target: ATXN1; (-) strand; PAM type: NAAAAC; PAM sequence: AAAAAC
ggcaaaaacccatctctact

SEQ ID NO: 5317 - DNA, 20 bp, Artificial Sequence
  Description of Artificial Sequence: Synthetic oligonucleotide
  Target: ATXN1; (-) strand; PAM type: NAAAAC; PAM sequence: AAAAAC
accagcctgggtaacatggc

SEQ ID NO: 5318 - DNA, 20 bp, Artificial Sequence
  Description of Artificial Sequence: Synthetic oligonucleotide
  Target: ATXN1; (-) strand; PAM type: NAAAAC; PAM sequence: AAAAAC
ctctgcctcaaaaacaaaaa

SEQ ID NO: 5319 - DNA, 20 bp, Artificial Sequence
  Description of Artificial Sequence: Synthetic oligonucleotide
  Target: ATXN1; (-) strand; PAM type: NAAAAC; PAM sequence: AAAAAC
acagagcaaaactctgcctc

SEQ ID NO: 5320 - DNA, 20 bp, Artificial Sequence
  Description of Artificial Sequence: Synthetic oligonucleotide
  Target: ATXN1; (-) strand; PAM type: NAAAAC; PAM sequence: CAAAAC
ctccagcctgggcgacagag

SEQ ID NO: 5321 - DNA, 20 bp, Artificial Sequence
  Description of Artificial Sequence: Synthetic oligonucleotide
  Target: ATXN1; (-) strand; PAM type: NAAAAC; PAM sequence: TAAAAC
aaattatttcattattataa

SEQ ID NO: 5322 - DNA, 20 bp, Artificial Sequence
  Description of Artificial Sequence: Synthetic oligonucleotide
  Target: ATXN1; (-) strand; PAM type: NAAAAC; PAM sequence: GAAAAC
atgcctcccacaggccaagg

SEQ ID NO: 5323 - DNA, 20 bp, Artificial Sequence
  Description of Artificial Sequence: Synthetic oligonucleotide
  Target: ATXN1; (-) strand; PAM type: NAAAAC; PAM sequence: AAAAAC
ctcatttaaatggggggagt

SEQ ID NO: 5324 - DNA, 20 bp, Artificial Sequence
  Description of Artificial Sequence: Synthetic oligonucleotide
  Target: ATXN1; (-) strand; PAM type: NAAAAC; PAM sequence: GAAAAC
acctgatttgagaagctgaa

SEQ ID NO: 5325 - DNA, 20 bp, Artificial Sequence
  Description of Artificial Sequence: Synthetic oligonucleotide
  Target: ATXN1; (-) strand; PAM type: NAAAAC; PAM sequence: GAAAAC
cacttcaatttgcaccaggt

SEQ ID NO: 5326 - DNA, 20 bp, Artificial Sequence
  Description of Artificial Sequence: Synthetic oligonucleotide
  Target: ATXN1; (-) strand; PAM type: NAAAAC; PAM sequence: GAAAAC
ctaaaccaacactaagatgg

SEQ ID NO: 5327 - DNA, 20 bp, Artificial Sequence
  Description of Artificial Sequence: Synthetic oligonucleotide
  Target: ATXN1; (-) strand; PAM type: NAAAAC; PAM sequence: AAAAAC
tacaactcatgtggactcag

SEQ ID NO: 5328 - DNA, 20 bp, Artificial Sequence
  Description of Artificial Sequence: Synthetic oligonucleotide
  Target: ATXN1; (-) strand; PAM type: NAAAAC; PAM sequence: AAAAAC
accgttttctggggtgtacc

SEQ ID NO: 5329 - DNA, 20 bp, Artificial Sequence
  Description of Artificial Sequence: Synthetic oligonucleotide
  Target: ATXN1; (-) strand; PAM type: NAAAAC; PAM sequence: AAAAAC
ggggaaaaaacaaaaacaaa

SEQ ID NO: 5330 - DNA, 20 bp, Artificial Sequence
  Description of Artificial Sequence: Synthetic oligonucleotide
  Target: ATXN1; (-) strand; PAM type: NAAAAC; PAM sequence: AAAAAC
aaactctttggggaaaaaac

SEQ ID NO: 5331 - DNA, 20 bp, Artificial Sequence
  Description of Artificial Sequence: Synthetic oligonucleotide
  Target: ATXN1; (-) strand; PAM type: NAAAAC; PAM sequence: AAAAAC
cactttaaactctttgggga

SEQ ID NO: 5332 - DNA, 20 bp, Artificial Sequence
  Description of Artificial Sequence: Synthetic oligonucleotide
  Target: ATXN1; (-) strand; PAM type: NAAAAC; PAM sequence: GAAAAC
tggtttctgtgcagtgttag

SEQ ID NO: 5333 - DNA, 20 bp, Artificial Sequence
  Description of Artificial Sequence: Synthetic oligonucleotide
  Target: ATXN1; (-) strand; PAM type: NAAAAC; PAM sequence: GAAAAC
gacacaggtatgccgagcag

SEQ ID NO: 5334 - DNA, 20 bp, Artificial Sequence
  Description of Artificial Sequence: Synthetic oligonucleotide
  Target: ATXN1; (-) strand; PAM type: NAAAAC; PAM sequence: GAAAAC
atgttcaagtgccttcagga

SEQ ID NO: 5335 - DNA, 20 bp, Artificial Sequence
  Description of Artificial Sequence: Synthetic oligonucleotide
  Target: ATXN1; (-) strand; PAM type: NAAAAC; PAM sequence: AAAAAC
cctggcttcatggatctttt

SEQ ID NO: 5336 - DNA, 20 bp, Artificial Sequence
  Description of Artificial Sequence: Synthetic oligonucleotide
  Target: ATXN1; (-) strand; PAM type: NAAAAC; PAM sequence: AAAAAC
ttgacagagagtaggcactc

SEQ ID NO: 5337 - DNA, 20 bp, Artificial Sequence
  Description of Artificial Sequence: Synthetic oligonucleotide
  Target: ATXN1; (-) strand; PAM type: NAAAAC; PAM sequence: CAAAAC
tttatgacttggatttgcag

SEQ ID NO: 5338 - DNA, 20 bp, Artificial Sequence
  Description of Artificial Sequence: Synthetic oligonucleotide
  Target: ATXN1; (-) strand; PAM type: NAAAAC; PAM sequence: TAAAAC
agcctacgtgcaggaaaggg

SEQ ID NO: 5339 - DNA, 20 bp, Artificial Sequence
  Description of Artificial Sequence: Synthetic oligonucleotide
  Target: ATXN1; (-) strand; PAM type: NAAAAC; PAM sequence: GAAAAC
ttcacactaattagtgagga

SEQ ID NO: 5340 - DNA, 20 bp, Artificial Sequence
  Description of Artificial Sequence: Synthetic oligonucleotide
  Target: ATXN1; (-) strand; PAM type: NAAAAC; PAM sequence: AAAAAC
actttcaccaaagaagggaa

SEQ ID NO: 5341 - DNA, 20 bp, Artificial Sequence
  Description of Artificial Sequence: Synthetic oligonucleotide
  Target: ATXN1; (-) strand; PAM type: NAAAAC; PAM sequence: TAAAAC
gaccagcctggccaacatgg

SEQ ID NO: 5342 - DNA, 20 bp, Artificial Sequence
  Description of Artificial Sequence: Synthetic oligonucleotide
  Target: ATXN1; (-) strand; PAM type: NAAAAC; PAM sequence: TAAAAC
tatacttgttgaacttttat

SEQ ID NO: 5343 - DNA, 20 bp, Artificial Sequence
  Description of Artificial Sequence: Synthetic oligonucleotide
  Target: ATXN1; (-) strand; PAM type: NAAAAC; PAM sequence: CAAAAC
atcatcattatcttcaccaa

SEQ ID NO: 5344 - DNA, 20 bp, Artificial Sequence
  Description of Artificial Sequence: Synthetic oligonucleotide
  Target: ATXN1; (-) strand; PAM type: NAAAAC; PAM sequence: CAAAAC
actgagtttggggaaagagg

SEQ ID NO: 5345 - DNA, 20 bp, Artificial Sequence
  Description of Artificial Sequence: Synthetic oligonucleotide
  Target: ATXN1; (-) strand; PAM type: NAAAAC; PAM sequence: GAAAAC
accagcctgactaacatggt

SEQ ID NO: 5346 - DNA, 20 bp, Artificial Sequence
  Description of Artificial Sequence: Synthetic oligonucleotide
  Target: ATXN1; (-) strand; PAM type: NAAAAC; PAM sequence: GAAAAC
agatgcccttcgcaatttgt

SEQ ID NO: 5347 - DNA, 20 bp, Artificial Sequence
  Description of Artificial Sequence: Synthetic oligonucleotide
  Target: ATXN1; (-) strand; PAM type: NAAAAC; PAM sequence: TAAAAC
tgtcatgaaaaaatgttttg

SEQ ID NO: 5348 - DNA, 20 bp, Artificial Sequence
  Description of Artificial Sequence: Synthetic oligonucleotide
  Target: ATXN1; (-) strand; PAM type: NAAAAC; PAM sequence: AAAAAC
ccaatttaataatttcgcca

SEQ ID NO: 5349 - DNA, 20 bp, Artificial Sequence
  Description of Artificial Sequence: Synthetic oligonucleotide
  Target: ATXN1; (-) strand; PAM type: NAAAAC; PAM sequence: TAAAAC
gaccggcctttctctacagg

SEQ ID NO: 5350 - DNA, 20 bp, Artificial Sequence
  Description of Artificial Sequence: Synthetic oligonucleotide
  Target: ATXN1; (-) strand; PAM type: NAAAAC; PAM sequence: AAAAAC
gccacgctaccatgtgtaag

SEQ ID NO: 5351 - DNA, 20 bp, Artificial Sequence
  Description of Artificial Sequence: Synthetic oligonucleotide
  Target: ATXN1; (-) strand; PAM type: NAAAAC; PAM sequence: TAAAAC
ggaactaaagccatggcata

SEQ ID NO: 5352 - DNA, 20 bp, Artificial Sequence
  Description of Artificial Sequence: Synthetic oligonucleotide
  Target: ATXN1; (-) strand; PAM type: NAAAAC; PAM sequence: AAAAAC
tttattagcgtcggttaaca

SEQ ID NO: 5353 - DNA, 20 bp, Artificial Sequence
  Description of Artificial Sequence: Synthetic oligonucleotide
  Target: ATXN1; (-) strand; PAM type: NAAAAC; PAM sequence: CAAAAC
gaagaagagatggttttctc

SEQ ID NO: 5354 - DNA, 20 bp, Artificial Sequence
  Description of Artificial Sequence: Synthetic oligonucleotide
  Target: ATXN1; (-) strand; PAM type: NAAAAC; PAM sequence: AAAAAC
gcccagctaatttaaaaata

SEQ ID NO: 5355 - DNA, 20 bp, Artificial Sequence
  Description of Artificial Sequence: Synthetic oligonucleotide
  Target: ATXN1; (-) strand; PAM type: NAAAAC; PAM sequence: TAAAAC
tttgggacattcagataaaa

SEQ ID NO: 5356 - DNA, 20 bp, Artificial Sequence
  Description of Artificial Sequence: Synthetic oligonucleotide
  Target: ATXN1; (-) strand; PAM type: NAAAAC; PAM sequence: GAAAAC
agtgtttccatctaggattt

SEQ ID NO: 5357 - DNA, 20 bp, Artificial Sequence
  Description of Artificial Sequence: Synthetic oligonucleotide
  Target: ATXN1; (-) strand; PAM type: NAAAAC; PAM sequence: AAAAAC
tctgtctcagacaaaaaaaa

SEQ ID NO: 5358 - DNA, 20 bp, Artificial Sequence
  Description of Artificial Sequence: Synthetic oligonucleotide
  Target: ATXN1; (-) strand; PAM type: NAAAAC; PAM sequence: AAAAAC
ctaaagaaggtggaagactt

SEQ ID NO: 5359 - DNA, 20 bp, Artificial Sequence
  Description of Artificial Sequence: Synthetic oligonucleotide
  Target: ATXN1; (-) strand; PAM type: NAAAAC; PAM sequence: AAAAAC
tgaagaagaaaaggagaaaa

SEQ ID NO: 5360 - DNA, 20 bp, Artificial Sequence
  Description of Artificial Sequence: Synthetic oligonucleotide
  Target: ATXN1; (-) strand; PAM type: NAAAAC; PAM sequence: GAAAAC
ccaagcatgtaacccactga

SEQ ID NO: 5361 - DNA, 20 bp, Artificial Sequence
  Description of Artificial Sequence: Synthetic oligonucleotide
  Target: ATXN1; (-) strand; PAM type: NAAAAC; PAM sequence: CAAAAC
agggtctggatgtgagatac

SEQ ID NO: 5362 - DNA, 20 bp, Artificial Sequence
  Description of Artificial Sequence: Synthetic oligonucleotide
  Target: ATXN1; (-) strand; PAM type: NAAAAC; PAM sequence: CAAAAC
gaccagcctggccaacatgg

SEQ ID NO: 5363 - DNA, 20 bp, Artificial Sequence
  Description of Artificial Sequence: Synthetic oligonucleotide
  Target: ATXN1; (-) strand; PAM type: NAAAAC; PAM sequence: CAAAAC
gttcattgatgatgttggag

SEQ ID NO: 5364 - DNA, 20 bp, Artificial Sequence
  Description of Artificial Sequence: Synthetic oligonucleotide
  Target: ATXN1; (-) strand; PAM type: NAAAAC; PAM sequence: AAAAAC
gtgagactccatctcaaaaa

SEQ ID NO: 5365 - DNA, 20 bp, Artificial Sequence
  Description of Artificial Sequence: Synthetic oligonucleotide
  Target: ATXN1; (-) strand; PAM type: NAAAAC; PAM sequence: AAAAAC
cacagttatttgtcacttac

SEQ ID NO: 5366 - DNA, 20 bp, Artificial Sequence
  Description of Artificial Sequence: Synthetic oligonucleotide
  Target: ATXN1; (-) strand; PAM type: NAAAAC; PAM sequence: CAAAAC
ttacttcgaaatatgataac

SEQ ID NO: 5367 - DNA, 20 bp, Artificial Sequence
  Description of Artificial Sequence: Synthetic oligonucleotide
  Target: ATXN1; (-) strand; PAM type: NAAAAC; PAM sequence: AAAAAC
tattgagtgtatagtcaaac

SEQ ID NO: 5368 - DNA, 20 bp, Artificial Sequence
  Description of Artificial Sequence: Synthetic oligonucleotide
  Target: ATXN1; (-) strand; PAM type: NAAAAC; PAM sequence: TAAAAC
taccaaaacatatcgtggct

SEQ ID NO: 5369 - DNA, 20 bp, Artificial Sequence
  Description of Artificial Sequence: Synthetic oligonucleotide
  Target: ATXN1; (-) strand; PAM type: NAAAAC; PAM sequence: CAAAAC
gggctgccataataaattac

SEQ ID NO: 5370 - DNA, 20 bp, Artificial Sequence
  Description of Artificial Sequence: Synthetic oligonucleotide
  Target: ATXN1; (-) strand; PAM type: NAAAAC; PAM sequence: GAAAAC
ctctgactgtatggccttgg

SEQ ID NO: 5371 - DNA, 20 bp, Artificial Sequence
  Description of Artificial Sequence: Synthetic oligonucleotide
  Target: ATXN1; (-) strand; PAM type: NAAAAC; PAM sequence: AAAAAC
tctatagatgcatggggtca

SEQ ID NO: 5372 - DNA, 20 bp, Artificial Sequence
  Description of Artificial Sequence: Synthetic oligonucleotide
  Target: ATXN1; (-) strand; PAM type: NAAAAC; PAM sequence: AAAAAC
aggcatttccagcttttctt

SEQ ID NO: 5373 - DNA, 20 bp, Artificial Sequence
  Description of Artificial Sequence: Synthetic oligonucleotide
  Target: ATXN1; (-) strand; PAM type: NAAAAC; PAM sequence: AAAAAC
ttctatcacagatgtgagga

SEQ ID NO: 5374 - DNA, 20 bp, Artificial Sequence
  Description of Artificial Sequence: Synthetic oligonucleotide
  Target: ATXN1; (-) strand; PAM type: NAAAAC; PAM sequence: TAAAAC
gaccagcctggccaacatgg

SEQ ID NO: 5375 - DNA, 20 bp, Artificial Sequence
  Description of Artificial Sequence: Synthetic oligonucleotide
  Target: ATXN1; (-) strand; PAM type: NAAAAC; PAM sequence: CAAAAC
agcggggcgctgtgtggttt

SEQ ID NO: 5376 - DNA, 20 bp, Artificial Sequence
  Description of Artificial Sequence: Synthetic oligonucleotide
  Target: ATXN1; (-) strand; PAM type: NAAAAC; PAM sequence: GAAAAC
gtataagaaccactgcatta

SEQ ID NO: 5377 - DNA, 20 bp, Artificial Sequence
  Description of Artificial Sequence: Synthetic oligonucleotide
  Target: ATXN1; (-) strand; PAM type: NAAAAC; PAM sequence: GAAAAC
gtctaatgacgaaaacacgt

SEQ ID NO: 5378 - DNA, 20 bp, Artificial Sequence
  Description of Artificial Sequence: Synthetic oligonucleotide
  Target: ATXN1; (-) strand; PAM type: NAAAAC; PAM sequence: GAAAAC
ggagtttacggtctaatgac

SEQ ID NO: 5379 - DNA, 20 bp, Artificial Sequence
  Description of Artificial Sequence: Synthetic oligonucleotide
  Target: ATXN1; (-) strand; PAM type: NAAAAC; PAM sequence: TAAAAC
gtgagtcatacccctaattt

SEQ ID NO: 5380 - DNA, 20 bp, Artificial Sequence
  Description of Artificial Sequence: Synthetic oligonucleotide
  Target: ATXN1; (-) strand; PAM type: NAAAAC; PAM sequence: GAAAAC
aattactcagcttttttatt

SEQ ID NO: 5381 - DNA, 20 bp, Artificial Sequence
  Description of Artificial Sequence: Synthetic oligonucleotide
  Target: ATXN1; (-) strand; PAM type: NAAAAC; PAM sequence: AAAAAC
accctgtctgaaaaaagtac

SEQ ID NO: 5382 - DNA, 20 bp, Artificial Sequence
  Description of Artificial Sequence: Synthetic oligonucleotide
  Target: ATXN1; (-) strand; PAM type: NAAAAC; PAM sequence: GAAAAC
acaacagacatacttaaatt

SEQ ID NO: 5383 - DNA, 20 bp, Artificial Sequence
  Description of Artificial Sequence: Synthetic oligonucleotide
  Target: ATXN1; (-) strand; PAM type: NAAAAC; PAM sequence: GAAAAC
tttcatctcaacaatctttt

SEQ ID NO: 5384 - DNA, 20 bp, Artificial Sequence
  Description of Artificial Sequence: Synthetic oligonucleotide
  Target: ATXN1; (-) strand; PAM type: NAAAAC; PAM sequence: CAAAAC
ctatgcttggagaaatggtg

SEQ ID NO: 5385 - DNA, 20 bp, Artificial Sequence
  Description of Artificial Sequence: Synthetic oligonucleotide
  Target: ATXN1; (-) strand; PAM type: NAAAAC; PAM sequence: CAAAAC
tcttagtagaagaataccag

SEQ ID NO: 5386 - DNA, 20 bp, Artificial Sequence
  Description of Artificial Sequence: Synthetic oligonucleotide
  Target: ATXN1; (-) strand; PAM type: NAAAAC; PAM sequence: AAAAAC
aaaaaaaaccctgaaattaa

SEQ ID NO: 5387 - DNA, 20 bp, Artificial Sequence
  Description of Artificial Sequence: Synthetic oligonucleotide
  Target: ATXN1; (-) strand; PAM type: NAAAAC; PAM sequence: AAAAAC
accttgtttcaaaaaaaaaa

SEQ ID NO: 5388 - DNA, 20 bp, Artificial Sequence
  Description of Artificial Sequence: Synthetic oligonucleotide
  Target: ATXN1; (-) strand; PAM type: NAAAAC; PAM sequence: AAAAAC
tggtgaaaccccgtctctac

SEQ ID NO: 5389 - DNA, 20 bp, Artificial Sequence
  Description of Artificial Sequence: Synthetic oligonucleotide
  Target: ATXN1; (-) strand; PAM type: NAAAAC; PAM sequence: CAAAAC
aaatcagctgtgaaagaaaa

SEQ ID NO: 5390 - DNA, 20 bp, Artificial Sequence
  Description of Artificial Sequence: Synthetic oligonucleotide
  Target: ATXN1; (-) strand; PAM type: NAAAAC; PAM sequence: GAAAAC
gtttcaaatcagctgtgaaa

SEQ ID NO: 5391 - DNA, 20 bp, Artificial Sequence
  Description of Artificial Sequence: Synthetic oligonucleotide
  Target: ATXN1; (-) strand; PAM type: NAAAAC; PAM sequence: TAAAAC
tgtaaatccatgcgttttgt

SEQ ID NO: 5392 - DNA, 20 bp, Artificial Sequence
  Description of Artificial Sequence: Synthetic oligonucleotide
  Target: ATXN1; (-) strand; PAM type: NAAAAC; PAM sequence: AAAAAC
taggtatgtatatataggaa

SEQ ID NO: 5393 - DNA, 20 bp, Artificial Sequence
  Description of Artificial Sequence: Synthetic oligonucleotide
  Target: ATXN1; (-) strand; PAM type: NAAAAC; PAM sequence: AAAAAC
atattatcctctaaatatct

SEQ ID NO: 5394 - DNA, 20 bp, Artificial Sequence
  Description of Artificial Sequence: Synthetic oligonucleotide
  Target: ATXN1; (-) strand; PAM type: NAAAAC; PAM sequence: AAAAAC
acttaaggccaaattaggtc

SEQ ID NO: 5395 - DNA, 20 bp, Artificial Sequence
  Description of Artificial Sequence: Synthetic oligonucleotide
  Target: ATXN1; (-) strand; PAM type: NAAAAC; PAM sequence: AAAAAC
ttcccttccaaggaaaattg

SEQ ID NO: 5396 - DNA, 20 bp, Artificial Sequence
  Description of Artificial Sequence: Synthetic oligonucleotide
  Target: ATXN1; (-) strand; PAM type: NAAAAC; PAM sequence: AAAAAC
tctagtatgcagggattttt

SEQ ID NO: 5397 - DNA, 20 bp, Artificial Sequence
  Description of Artificial Sequence: Synthetic oligonucleotide
  Target: ATXN1; (-) strand; PAM type: NAAAAC; PAM sequence: GAAAAC
catattgaatcttgggaatg

SEQ ID NO: 5398 - DNA, 20 bp, Artificial Sequence
  Description of Artificial Sequence: Synthetic oligonucleotide
  Target: ATXN1; (-) strand; PAM type: NAAAAC; PAM sequence: AAAAAC
ttggaatgagccctggactt

SEQ ID NO: 5399 - DNA, 20 bp, Artificial Sequence
  Description of Artificial Sequence: Synthetic oligonucleotide
  Target: ATXN1; (-) strand; PAM type: NAAAAC; PAM sequence: CAAAAC
taaaggtgggcgtgtatgtg

SEQ ID NO: 5400 - DNA, 20 bp, Artificial Sequence
  Description of Artificial Sequence: Synthetic oligonucleotide
  Target: ATXN1; (-) strand; PAM type: NAAAAC; PAM sequence: CAAAAC
atataatctacatttattcc

SEQ ID NO: 5401 - DNA, 20 bp, Artificial Sequence
  Description of Artificial Sequence: Synthetic oligonucleotide
  Target: ATXN1; (-) strand; PAM type: NAAAAC; PAM sequence: TAAAAC
ctgaattatgcatctgacat

SEQ ID NO: 5402 - DNA, 20 bp, Artificial Sequence
  Description of Artificial Sequence: Synthetic oligonucleotide
  Target: ATXN1; (-) strand; PAM type: NAAAAC; PAM sequence: AAAAAC
cggccttaggatggagaaga

SEQ ID NO: 5403 - DNA, 20 bp, Artificial Sequence
  Description of Artificial Sequence: Synthetic oligonucleotide
  Target: ATXN1; (-) strand; PAM type: NAAAAC; PAM sequence: GAAAAC
aactcattctatgcttgaag

SEQ ID NO: 5404 - DNA, 20 bp, Artificial Sequence
  Description of Artificial Sequence: Synthetic oligonucleotide
  Target: ATXN1; (-) strand; PAM type: NAAAAC; PAM sequence: GAAAAC
tatatatgaaaaaagaaaaa

SEQ ID NO: 5405 - DNA, 20 bp, Artificial Sequence
  Description of Artificial Sequence: Synthetic oligonucleotide
  Target: ATXN1; (-) strand; PAM type: NAAAAC; PAM sequence: GAAAAC
tgtctcaataagaaaaaaaa

SEQ ID NO: 5406 - DNA, 20 bp, Artificial Sequence
  Description of Artificial Sequence: Synthetic oligonucleotide
  Target: ATXN1; (-) strand; PAM type: NAAAAC; PAM sequence: GAAAAC
agaggaagaagaaacacttt

SEQ ID NO: 5407 - DNA, 20 bp, Artificial Sequence
  Description of Artificial Sequence: Synthetic oligonucleotide
  Target: ATXN1; (-) strand; PAM type: NAAAAC; PAM sequence: TAAAAC
ttccccatttcatagctcat

SEQ ID NO: 5408 - DNA, 20 bp, Artificial Sequence
  Description of Artificial Sequence: Synthetic oligonucleotide
  Target: ATXN1; (-) strand; PAM type: NAAAAC; PAM sequence: CAAAAC
gggcagcaatgtgtctacct

SEQ ID NO: 5409 - DNA, 20 bp, Artificial Sequence
  Description of Artificial Sequence: Synthetic oligonucleotide
  Target: ATXN1; (-) strand; PAM type: NAAAAC; PAM sequence: TAAAAC
attcacagacatgtgaaata

SEQ ID NO: 5410 - DNA, 20 bp, Artificial Sequence
  Description of Artificial Sequence: Synthetic oligonucleotide
  Target: ATXN1; (-) strand; PAM type: NAAAAC; PAM sequence: GAAAAC
ccatcctctgcagagctgga

SEQ ID NO: 5411 - DNA, 20 bp, Artificial Sequence
  Description of Artificial Sequence: Synthetic oligonucleotide
  Target: ATXN1; (-) strand; PAM type: NAAAAC; PAM sequence: AAAAAC
agaaaagatagacccaaatg

SEQ ID NO: 5412 - DNA, 20 bp, Artificial Sequence
  Description of Artificial Sequence: Synthetic oligonucleotide
  Target: ATXN1; (-) strand; PAM type: NAAAAC; PAM sequence: AAAAAC
tcttcctttaactagcttta

SEQ ID NO: 5413 - DNA, 20 bp, Artificial Sequence
  Description of Artificial Sequence: Synthetic oligonucleotide
  Target: ATXN1; (-) strand; PAM type: NAAAAC; PAM sequence: TAAAAC
gtgagtatttttaaaccaat

SEQ ID NO: 5414 - DNA, 20 bp, Artificial Sequence
  Description of Artificial Sequence: Synthetic oligonucleotide
  Target: ATXN1; (-) strand; PAM type: NAAAAC; PAM sequence: TAAAAC
ctagtgttaaatacaaataa

SEQ ID NO: 5415 - DNA, 20 bp, Artificial Sequence
  Description of Artificial Sequence: Synthetic oligonucleotide
  Target: ATXN1; (-) strand; PAM type: NAAAAC; PAM sequence: GAAAAC
ctgtctcggctcaaaaaaaa

SEQ ID NO: 5416 - DNA, 20 bp, Artificial Sequence
  Description of Artificial Sequence: Synthetic oligonucleotide
  Target: ATXN1; (-) strand; PAM type: NAAAAC; PAM sequence: TAAAAC
catttgggattaaaccaaat

SEQ ID NO: 5417 - DNA, 20 bp, Artificial Sequence
  Description of Artificial Sequence: Synthetic oligonucleotide
  Target: ATXN1; (-) strand; PAM type: NAAAAC; PAM sequence: AAAAAC
gtaaaaaattgtataagtgg

SEQ ID NO: 5418 - DNA, 20 bp, Artificial Sequence
  Description of Artificial Sequence: Synthetic oligonucleotide
  Target: ATXN1; (-) strand; PAM type: NAAAAC; PAM sequence: TAAAAC
tcaaaaggggaaacctctta

SEQ ID NO: 5419 - DNA, 20 bp, Artificial Sequence
  Description of Artificial Sequence: Synthetic oligonucleotide
  Target: ATXN1; (-) strand; PAM type: NAAAAC; PAM sequence: GAAAAC
ataccctcctcttgtccttg

SEQ ID NO: 5420 - DNA, 20 bp, Artificial Sequence
  Description of Artificial Sequence: Synthetic oligonucleotide
  Target: ATXN1; (-) strand; PAM type: NAAAAC; PAM sequence: TAAAAC
gttgcgttgcatcacaaggg

SEQ ID NO: 5421 - DNA, 20 bp, Artificial Sequence
  Description of Artificial Sequence: Synthetic oligonucleotide
  Target: ATXN1; (-) strand; PAM type: NAAAAC; PAM sequence: CAAAAC
acttattgagtttatccttt

SEQ ID NO: 5422 - DNA, 20 bp, Artificial Sequence
  Description of Artificial Sequence: Synthetic oligonucleotide
  Target: ATXN1; (-) strand; PAM type: NAAAAC; PAM sequence: CAAAAC
taatcttatttctaaaaaag

SEQ ID NO: 5423 - DNA, 20 bp, Artificial Sequence
  Description of Artificial Sequence: Synthetic oligonucleotide
  Target: ATXN1; (-) strand; PAM type: NAAAAC; PAM sequence: TAAAAC
ggaaatgggataaactattt

SEQ ID NO: 5424 - DNA, 20 bp, Artificial Sequence
  Description of Artificial Sequence: Synthetic oligonucleotide
  Target: ATXN1; (-) strand; PAM type: NAAAAC; PAM sequence: GAAAAC
ggatccatggagaagtcaga

SEQ ID NO: 5425 - DNA, 20 bp, Artificial Sequence
  Description of Artificial Sequence: Synthetic oligonucleotide
  Target: ATXN1; (-) strand; PAM type: NAAAAC; PAM sequence: CAAAAC
acacattcctgtgtactctt

SEQ ID NO: 5426 - DNA, 20 bp, Artificial Sequence
  Description of Artificial Sequence: Synthetic oligonucleotide
  Target: ATXN1; (-) strand; PAM type: NAAAAC; PAM sequence: TAAAAC
tttaaactttatcctagaag

SEQ ID NO: 5427 - DNA, 20 bp, Artificial Sequence
  Description of Artificial Sequence: Synthetic oligonucleotide
  Target: ATXN1; (-) strand; PAM type: NAAAAC; PAM sequence: GAAAAC
tttgggttattggccatcat

SEQ ID NO: 5428 - DNA, 20 bp, Artificial Sequence
  Description of Artificial Sequence: Synthetic oligonucleotide
  Target: ATXN1; (-) strand; PAM type: NAAAAC; PAM sequence: TAAAAC
gagcagaggcatgagaatgt

SEQ ID NO: 5429 - DNA, 20 bp, Artificial Sequence
  Description of Artificial Sequence: Synthetic oligonucleotide
  Target: ATXN1; (-) strand; PAM type: NAAAAC; PAM sequence: TAAAAC
tgccagaagttcttgggaag

SEQ ID NO: 5430 - DNA, 20 bp, Artificial Sequence
  Description of Artificial Sequence: Synthetic oligonucleotide
  Target: ATXN1; (-) strand; PAM type: NAAAAC; PAM sequence: AAAAAC
tactgaaaacatggcaatga

SEQ ID NO: 5431 - DNA, 20 bp, Artificial Sequence
  Description of Artificial Sequence: Synthetic oligonucleotide
  Target: ATXN1; (-) strand; PAM type: NAAAAC; PAM sequence: GAAAAC
gtgataggacaacagatact

SEQ ID NO: 5432 - DNA, 20 bp, Artificial Sequence
  Description of Artificial Sequence: Synthetic oligonucleotide
  Target: ATXN1; (-) strand; PAM type: NAAAAC; PAM sequence: GAAAAC
ggaggtagaaaatccaaact

SEQ ID NO: 5433 - DNA, 20 bp, Artificial Sequence
  Description of Artificial Sequence: Synthetic oligonucleotide
  Target: ATXN1; (-) strand; PAM type: NAAAAC; PAM sequence: AAAAAC
aactgatatcctctgaagaa

SEQ ID NO: 5434 - DNA, 20 bp, Artificial Sequence
  Description of Artificial Sequence: Synthetic oligonucleotide
  Target: ATXN1; (-) strand; PAM type: NAAAAC; PAM sequence: AAAAAC
tgccttcagagttacagttt

SEQ ID NO: 5435 - DNA, 20 bp, Artificial Sequence
  Description of Artificial Sequence: Synthetic oligonucleotide
  Target: ATXN1; (-) strand; PAM type: NAAAAC; PAM sequence: GAAAAC
ccagagccagcattcttcct

SEQ ID NO: 5436 - DNA, 20 bp, Artificial Sequence
  Description of Artificial Sequence: Synthetic oligonucleotide
  Target: ATXN1; (-) strand; PAM type: NAAAAC; PAM sequence: CAAAAC
ctccaacctgggctatagag

SEQ ID NO: 5437 - DNA, 20 bp, Artificial Sequence
  Description of Artificial Sequence: Synthetic oligonucleotide
  Target: ATXN1; (-) strand; PAM type: NAAAAC; PAM sequence: CAAAAC
gaccggcctgggcaaaaaag

SEQ ID NO: 5438 - DNA, 20 bp, Artificial Sequence
  Description of Artificial Sequence: Synthetic oligonucleotide
  Target: ATXN1; (-) strand; PAM type: NAAAAC; PAM sequence: TAAAAC
ttgtgtttccgaacaggact

SEQ ID NO: 5439 - DNA, 20 bp, Artificial Sequence
  Description of Artificial Sequence: Synthetic oligonucleotide
  Target: ATXN1; (-) strand; PAM type: NAAAAC; PAM sequence: TAAAAC
tatttggaccaagcataggt

SEQ ID NO: 5440 - DNA, 20 bp, Artificial Sequence
  Description of Artificial Sequence: Synthetic oligonucleotide
  Target: ATXN1; (-) strand; PAM type: NAAAAC; PAM sequence: CAAAAC
taaaggcagacctttataac

SEQ ID NO: 5441 - DNA, 20 bp, Artificial Sequence
  Description of Artificial Sequence: Synthetic oligonucleotide
  Target: ATXN1; (-) strand; PAM type: NAAAAC; PAM sequence: GAAAAC
atgaaattaaattttaaaat

SEQ ID NO: 5442 - DNA, 20 bp, Artificial Sequence
  Description of Artificial Sequence: Synthetic oligonucleotide
  Target: ATXN1; (-) strand; PAM type: NAAAAC; PAM sequence: GAAAAC
gtccttaagagaagactgca

SEQ ID NO: 5443 - DNA, 20 bp, Artificial Sequence
  Description of Artificial Sequence: Synthetic oligonucleotide
  Target: ATXN1; (-) strand; PAM type: NAAAAC; PAM sequence: AAAAAC
ttttttttaagttttctgtt

SEQ ID NO: 5444 - DNA, 20 bp, Artificial Sequence
  Description of Artificial Sequence: Synthetic oligonucleotide
  Target: ATXN1; (-) strand; PAM type: NAAAAC; PAM sequence: AAAAAC
ttataaactttttaattttt

SEQ ID NO: 5445 - DNA, 20 bp, Artificial Sequence
  Description of Artificial Sequence: Synthetic oligonucleotide
  Target: ATXN1; (-) strand; PAM type: NAAAAC; PAM sequence: CAAAAC
aaaaacaaaaaaacaaaaaa

SEQ ID NO: 5446 - DNA, 20 bp, Artificial Sequence
  Description of Artificial Sequence: Synthetic oligonucleotide
  Target: ATXN1; (-) strand; PAM type: NAAAAC; PAM sequence: AAAAAC
aaacaaaaaacaaaaaaaca

SEQ ID NO: 5447 - DNA, 20 bp, Artificial Sequence
  Description of Artificial Sequence: Synthetic oligonucleotide
  Target: ATXN1; (-) strand; PAM type: NAAAAC; PAM sequence: AAAAAC
ctcaaaaaaacaaaaaacaa

SEQ ID NO: 5448 - DNA, 20 bp, Artificial Sequence
  Description of Artificial Sequence: Synthetic oligonucleotide
  Target: ATXN1; (-) strand; PAM type: NAAAAC; PAM sequence: AAAAAC
gacttcatctcaaaaaaaca

SEQ ID NO: 5449 - DNA, 20 bp, Artificial Sequence
  Description of Artificial Sequence: Synthetic oligonucleotide
  Target: ATXN1; (-) strand; PAM type: NAAAAC; PAM sequence: AAAAAC
agaacgagacttcatctcaa

SEQ ID NO: 5450 - DNA, 20 bp, Artificial Sequence
  Description of Artificial Sequence: Synthetic oligonucleotide
  Target: ATXN1; (-) strand; PAM type: NAAAAC; PAM sequence: TAAAAC
aataacttagacacaaagta

SEQ ID NO: 5451 - DNA, 20 bp, Artificial Sequence
  Description of Artificial Sequence: Synthetic oligonucleotide
  Target: ATXN1; (-) strand; PAM type: NAAAAC; PAM sequence: CAAAAC
gacacacacatacacactca

SEQ ID NO: 5452 - DNA, 20 bp, Artificial Sequence
  Description of Artificial Sequence: Synthetic oligonucleotide
  Target: ATXN1; (-) strand; PAM type: NAAAAC; PAM sequence: AAAAAC
tataactcctggaggaggcg

SEQ ID NO: 5453 - DNA, 20 bp, Artificial Sequence
  Description of Artificial Sequence: Synthetic oligonucleotide
  Target: ATXN1; (-) strand; PAM type: NAAAAC; PAM sequence: GAAAAC
aactttttctgaaagccaaa

SEQ ID NO: 5454 - DNA, 20 bp, Artificial Sequence
  Description of Artificial Sequence: Synthetic oligonucleotide
  Target: ATXN1; (-) strand; PAM type: NAAAAC; PAM sequence: GAAAAC
agttctgcttaatgtgttga

SEQ ID NO: 5455 - DNA, 20 bp, Artificial Sequence
  Description of Artificial Sequence: Synthetic oligonucleotide
  Target: ATXN1; (-) strand; PAM type: NAAAAC; PAM sequence: GAAAAC
caggtacctagaactggctt

SEQ ID NO: 5456 - DNA, 20 bp, Artificial Sequence
  Description of Artificial Sequence: Synthetic oligonucleotide
  Target: ATXN1; (-) strand; PAM type: NAAAAC; PAM sequence: CAAAAC
atcctcctgcctcagcttcc

SEQ ID NO: 5457 - DNA, 20 bp, Artificial Sequence
  Description of Artificial Sequence: Synthetic oligonucleotide
  Target: ATXN1; (-) strand; PAM type: NAAAAC; PAM sequence: AAAAAC
aaaaaaaaaaaaaaaaaaaa

SEQ ID NO: 5458 - DNA, 20 bp, Artificial Sequence
  Description of Artificial Sequence: Synthetic oligonucleotide
  Target: ATXN1; (-) strand; PAM type: NAAAAC; PAM sequence: GAAAAC
gcacattgtccctgttttgt

SEQ ID NO: 5459 - DNA, 20 bp, Artificial Sequence
  Description of Artificial Sequence: Synthetic oligonucleotide
  Target: ATXN1; (-) strand; PAM type: NAAAAC; PAM sequence: AAAAAC
aagttttaaaaacgaattag

SEQ ID NO: 5460 - DNA, 20 bp, Artificial Sequence
  Description of Artificial Sequence: Synthetic oligonucleotide
  Target: ATXN1; (-) strand; PAM type: NAAAAC; PAM sequence: AAAAAC
ccagttgtctcgtaagtttt

SEQ ID NO: 5461 - DNA, 20 bp, Artificial Sequence
  Description of Artificial Sequence: Synthetic oligonucleotide
  Target: ATXN1; (-) strand; PAM type: NAAAAC; PAM sequence: TAAAAC
gatttgaattcagactgggt

SEQ ID NO: 5462 - DNA, 20 bp, Artificial Sequence
  Description of Artificial Sequence: Synthetic oligonucleotide
  Target: ATXN1; (-) strand; PAM type: NAAAAC; PAM sequence: GAAAAC
tgaataacttcctcttctta

SEQ ID NO: 5463 - DNA, 20 bp, Artificial Sequence
  Description of Artificial Sequence: Synthetic oligonucleotide
  Target: ATXN1; (-) strand; PAM type: NAAAAC; PAM sequence: CAAAAC
tttagtggaaaatgtgaaaa

SEQ ID NO: 5464 - DNA, 20 bp, Artificial Sequence
  Description of Artificial Sequence: Synthetic oligonucleotide
  Target: ATXN1; (-) strand; PAM type: NAAAAC; PAM sequence: GAAAAC
caccttttagtggaaaatgt

SEQ ID NO: 5465 - DNA, 20 bp, Artificial Sequence
  Description of Artificial Sequence: Synthetic oligonucleotide
  Target: ATXN1; (-) strand; PAM type: NAAAAC; PAM sequence: GAAAAC
atttcacaggaaatgaccca

SEQ ID NO: 5466 - DNA, 20 bp, Artificial Sequence
  Description of Artificial Sequence: Synthetic oligonucleotide
  Target: ATXN1; (-) strand; PAM type: NAAAAC; PAM sequence: TAAAAC
aattattggttggctgtgag

SEQ ID NO: 5467 - DNA, 20 bp, Artificial Sequence
  Description of Artificial Sequence: Synthetic oligonucleotide
  Target: ATXN1; (-) strand; PAM type: NAAAAC; PAM sequence: AAAAAC
gtgaaatgctgagaaaggta

SEQ ID NO: 5468 - DNA, 20 bp, Artificial Sequence
  Description of Artificial Sequence: Synthetic oligonucleotide
  Target: ATXN1; (-) strand; PAM type: NAAAAC; PAM sequence: TAAAAC
agcaaaccagatgttgtgag

SEQ ID NO: 5469 - DNA, 20 bp, Artificial Sequence
  Description of Artificial Sequence: Synthetic oligonucleotide
  Target: ATXN1; (-) strand; PAM type: NAAAAC; PAM sequence: CAAAAC
aaagttctcttctgagacca

SEQ ID NO: 5470 - DNA, 20 bp, Artificial Sequence
  Description of Artificial Sequence: Synthetic oligonucleotide
  Target: ATXN1; (-) strand; PAM type: NAAAAC; PAM sequence: TAAAAC
atccttactttccttatcat

SEQ ID NO: 5471 - DNA, 20 bp, Artificial Sequence
  Description of Artificial Sequence: Synthetic oligonucleotide
  Target: ATXN1; (-) strand; PAM type: NAAAAC; PAM sequence: AAAAAC
tgacagagacctcaactcta

SEQ ID NO: 5472 - DNA, 20 bp, Artificial Sequence
  Description of Artificial Sequence: Synthetic oligonucleotide
  Target: ATXN1; (-) strand; PAM type: NAAAAC; PAM sequence: CAAAAC
ctgatgtataaatatcgggg

SEQ ID NO: 5473 - DNA, 20 bp, Artificial Sequence
  Description of Artificial Sequence: Synthetic oligonucleotide
  Target: ATXN1; (-) strand; PAM type: NAAAAC; PAM sequence: TAAAAC
gaacataaagaagattctag

SEQ ID NO: 5474 - DNA, 20 bp, Artificial Sequence
  Description of Artificial Sequence: Synthetic oligonucleotide
  Target: ATXN1; (-) strand; PAM type: NAAAAC; PAM sequence: AAAAAC
ttttaaccttcaagaaggta

SEQ ID NO: 5475 - DNA, 20 bp, Artificial Sequence
  Description of Artificial Sequence: Synthetic oligonucleotide
  Target: ATXN1; (-) strand; PAM type: NAAAAC; PAM sequence: TAAAAC
tgcgagagagagagctgagt

SEQ ID NO: 5476 - DNA, 20 bp, Artificial Sequence
  Description of Artificial Sequence: Synthetic oligonucleotide
  Target: ATXN1; (-) strand; PAM type: NAAAAC; PAM sequence: AAAAAC
aagttctggactgaatccct

SEQ ID NO: 5477 - DNA, 20 bp, Artificial Sequence
  Description of Artificial Sequence: Synthetic oligonucleotide
  Target: ATXN1; (-) strand; PAM type: NAAAAC; PAM sequence: GAAAAC
acctcatcaccctaacacta

SEQ ID NO: 5478 - DNA, 20 bp, Artificial Sequence
  Description of Artificial Sequence: Synthetic oligonucleotide
  Target: ATXN1; (-) strand; PAM type: NAAAAC; PAM sequence: AAAAAC
ttgtaccttaaaaaaaaaac

SEQ ID NO: 5479 - DNA, 20 bp, Artificial Sequence
  Description of Artificial Sequence: Synthetic oligonucleotide
  Target: ATXN1; (-) strand; PAM type: NAAAAC; PAM sequence: AAAAAC
ctatatttgtaccttaaaaa

SEQ ID NO: 5480 - DNA, 20 bp, Artificial Sequence
  Description of Artificial Sequence: Synthetic oligonucleotide
  Target: ATXN1; (-) strand; PAM type: NAAAAC; PAM sequence: CAAAAC
aacaatcaatgttccatttt

SEQ ID NO: 5481 - DNA, 20 bp, Artificial Sequence
  Description of Artificial Sequence: Synthetic oligonucleotide
  Target: ATXN1; (-) strand; PAM type: NAAAAC; PAM sequence: AAAAAC
aaccaaaaacaaacaaacaa

SEQ ID NO: 5482 - DNA, 20 bp, Artificial Sequence
  Description of Artificial Sequence: Synthetic oligonucleotide
  Target: ATXN1; (-) strand; PAM type: NAAAAC; PAM sequence: AAAAAC
gaccctgtctcaaaaaaacc

SEQ ID NO: 5483 - DNA, 20 bp, Artificial Sequence
  Description of Artificial Sequence: Synthetic oligonucleotide
  Target: ATXN1; (-) strand; PAM type: NAAAAC; PAM sequence: AAAAAC
agagtgagaccctgtctcaa

SEQ ID NO: 5484 - DNA, 20 bp, Artificial Sequence
  Description of Artificial Sequence: Synthetic oligonucleotide
  Target: ATXN1; (-) strand; PAM type: NAAAAC; PAM sequence: AAAAAC
ctcattctgaagggagggaa

SEQ ID NO: 5485 - DNA, 20 bp, Artificial Sequence
  Description of Artificial Sequence: Synthetic oligonucleotide
  Target: ATXN1; (-) strand; PAM type: NAAAAC; PAM sequence: CAAAAC
aatatcttaggggaagttga

SEQ ID NO: 5486 - DNA, 20 bp, Artificial Sequence
  Description of Artificial Sequence: Synthetic oligonucleotide
  Target: ATXN1; (-) strand; PAM type: NAAAAC; PAM sequence: CAAAAC
ctccagcctcggcaacagag

SEQ ID NO: 5487 - DNA, 20 bp, Artificial Sequence
  Description of Artificial Sequence: Synthetic oligonucleotide
  Target: ATXN1; (-) strand; PAM type: NAAAAC; PAM sequence: GAAAAC
aactagggtagtggcaggta

SEQ ID NO: 5488 - DNA, 20 bp, Artificial Sequence
  Description of Artificial Sequence: Synthetic oligonucleotide
  Target: ATXN1; (-) strand; PAM type: NAAAAC; PAM sequence: AAAAAC
aagtatcgcttaatgtggcc

SEQ ID NO: 5489 - DNA, 20 bp, Artificial Sequence
  Description of Artificial Sequence: Synthetic oligonucleotide
  Target: ATXN1; (-) strand; PAM type: NAAAAC; PAM sequence: TAAAAC
cacattgtgcacatgtaacc

SEQ ID NO: 5490 - DNA, 20 bp, Artificial Sequence
  Description of Artificial Sequence: Synthetic oligonucleotide
  Target: ATXN1; (-) strand; PAM type: NAAAAC; PAM sequence: GAAAAC
caagaacccatctcaaagaa

SEQ ID NO: 5491 - DNA, 20 bp, Artificial Sequence
  Description of Artificial Sequence: Synthetic oligonucleotide
  Target: ATXN1; (-) strand; PAM type: NAAAAC; PAM sequence: GAAAAC
actccatggttgtatcacaa

SEQ ID NO: 5492 - DNA, 20 bp, Artificial Sequence
  Description of Artificial Sequence: Synthetic oligonucleotide
  Target: ATXN1; (-) strand; PAM type: NAAAAC; PAM sequence: AAAAAC
agaatgaggacccacacttt

SEQ ID NO: 5493 - DNA, 20 bp, Artificial Sequence
  Description of Artificial Sequence: Synthetic oligonucleotide
  Target: ATXN1; (-) strand; PAM type: NAAAAC; PAM sequence: AAAAAC
tagctaagctattgttaaat

SEQ ID NO: 5494 - DNA, 20 bp, Artificial Sequence
  Description of Artificial Sequence: Synthetic oligonucleotide
  Target: ATXN1; (-) strand; PAM type: NAAAAC; PAM sequence: CAAAAC
cagatggggaaaatcaacta

SEQ ID NO: 5495 - DNA, 20 bp, Artificial Sequence
  Description of Artificial Sequence: Synthetic oligonucleotide
  Target: ATXN1; (-) strand; PAM type: NAAAAC; PAM sequence: TAAAAC
cactctattagataaaagcc

SEQ ID NO: 5496 - DNA, 20 bp, Artificial Sequence
  Description of Artificial Sequence: Synthetic oligonucleotide
  Target: ATXN1; (-) strand; PAM type: NAAAAC; PAM sequence: AAAAAC
gcacagaggcaaataaaaaa

SEQ ID NO: 5497 - DNA, 20 bp, Artificial Sequence
  Description of Artificial Sequence: Synthetic oligonucleotide
  Target: ATXN1; (-) strand; PAM type: NAAAAC; PAM sequence: AAAAAC
acctatatctttctgctggc

SEQ ID NO: 5498 - DNA, 20 bp, Artificial Sequence
  Description of Artificial Sequence: Synthetic oligonucleotide
  Target: ATXN1; (-) strand; PAM type: NAAAAC; PAM sequence: GAAAAC
accacattggcccaggttgg

SEQ ID NO: 5499 - DNA, 20 bp, Artificial Sequence
  Description of Artificial Sequence: Synthetic oligonucleotide
  Target: ATXN1; (-) strand; PAM type: NAAAAC; PAM sequence: AAAAAC
gggaacaaagtgaaatcatg

SEQ ID NO: 5500 - DNA, 20 bp, Artificial Sequence
  Description of Artificial Sequence: Synthetic oligonucleotide
  Target: ATXN1; (-) strand; PAM type: NAAAAC; PAM sequence: TAAAAC
tcatctgtgaagagagcccc

SEQ ID NO: 5501 - DNA, 20 bp, Artificial Sequence
  Description of Artificial Sequence: Synthetic oligonucleotide
  Target: ATXN1; (-) strand; PAM type: NAAAAC; PAM sequence: AAAAAC
tctgaagataaatgatgcat

SEQ ID NO: 5502 - DNA, 20 bp, Artificial Sequence
  Description of Artificial Sequence: Synthetic oligonucleotide
  Target: ATXN1; (-) strand; PAM type: NAAAAC; PAM sequence: AAAAAC
gggagggaaacaagaaagga

SEQ ID NO: 5503 - DNA, 20 bp, Artificial Sequence
  Description of Artificial Sequence: Synthetic oligonucleotide
  Target: ATXN1; (-) strand; PAM type: NAAAAC; PAM sequence: GAAAAC
gaggcagttgaggtcacttt

SEQ ID NO: 5504 - DNA, 20 bp, Artificial Sequence
  Description of Artificial Sequence: Synthetic oligonucleotide
  Target: ATXN1; (-) strand; PAM type: NAAAAC; PAM sequence: GAAAAC
cctgggagttgtatctgcct

SEQ ID NO: 5505 - DNA, 20 bp, Artificial Sequence
  Description of Artificial Sequence: Synthetic oligonucleotide
  Target: ATXN1; (-) strand; PAM type: NAAAAC; PAM sequence: CAAAAC
tccagcctgggtgacaagag

SEQ ID NO: 5506 - DNA, 20 bp, Artificial Sequence
  Description of Artificial Sequence: Synthetic oligonucleotide
  Target: ATXN1; (-) strand; PAM type: NAAAAC; PAM sequence: AAAAAC
ggtgaaaccccgtcgcaact

SEQ ID NO: 5507 - DNA, 20 bp, Artificial Sequence
  Description of Artificial Sequence: Synthetic oligonucleotide
  Target: ATXN1; (-) strand; PAM type: NAAAAC; PAM sequence: AAAAAC
ttgccattactttcaatggc

SEQ ID NO: 5508 - DNA, 20 bp, Artificial Sequence
  Description of Artificial Sequence: Synthetic oligonucleotide
  Target: ATXN1; (-) strand; PAM type: NAAAAC; PAM sequence: AAAAAC
ctttctcaaaaaaaaaaaaa

SEQ ID NO: 5509 - DNA, 20 bp, Artificial Sequence
  Description of Artificial Sequence: Synthetic oligonucleotide
  Target: ATXN1; (-) strand; PAM type: NAAAAC; PAM sequence: CAAAAC
gaccagcctggccaacatgg

SEQ ID NO: 5510 - DNA, 20 bp, Artificial Sequence
  Description of Artificial Sequence: Synthetic oligonucleotide
  Target: ATXN1; (-) strand; PAM type: NAAAAC; PAM sequence: GAAAAC
agaatgcttctatgataaga

SEQ ID NO: 5511 - DNA, 20 bp, Artificial Sequence
  Description of Artificial Sequence: Synthetic oligonucleotide
  Target: ATXN1; (-) strand; PAM type: NAAAAC; PAM sequence: TAAAAC
ttatgtggatcgaatgggcc

SEQ ID NO: 5512 - DNA, 20 bp, Artificial Sequence
  Description of Artificial Sequence: Synthetic oligonucleotide
  Target: ATXN1; (-) strand; PAM type: NAAAAC; PAM sequence: AAAAAC
aaaggcaaagcccttgtttc

SEQ ID NO: 5513 - DNA, 20 bp, Artificial Sequence
  Description of Artificial Sequence: Synthetic oligonucleotide
  Target: ATXN1; (-) strand; PAM type: NAAAAC; PAM sequence: AAAAAC
catcgccatagacattatgt

SEQ ID NO: 5514 - DNA, 20 bp, Artificial Sequence
  Description of Artificial Sequence: Synthetic oligonucleotide
  Target: ATXN1; (-) strand; PAM type: NAAAAC; PAM sequence: GAAAAC
gcacagaccctccttcccaa

SEQ ID NO: 5515 - DNA, 20 bp, Artificial Sequence
  Description of Artificial Sequence: Synthetic oligonucleotide
  Target: ATXN1; (-) strand; PAM type: NAAAAC; PAM sequence: AAAAAC
cccacacccatttcccccaa

SEQ ID NO: 5516 - DNA, 20 bp, Artificial Sequence
  Description of Artificial Sequence: Synthetic oligonucleotide
  Target: ATXN1; (-) strand; PAM type: NAAAAC; PAM sequence: AAAAAC
cagttgtatttctctattct

SEQ ID NO: 5517 - DNA, 20 bp, Artificial Sequence
  Description of Artificial Sequence: Synthetic oligonucleotide
  Target: ATXN1; (-) strand; PAM type: NAAAAC; PAM sequence: TAAAAC
tctgcactcgagtttaaaaa

SEQ ID NO: 5518 - DNA, 20 bp, Artificial Sequence
  Description of Artificial Sequence: Synthetic oligonucleotide
  Target: ATXN1; (-) strand; PAM type: NAAAAC; PAM sequence: CAAAAC
taccctcacatgtttaccac

SEQ ID NO: 5519 - DNA, 20 bp, Artificial Sequence
  Description of Artificial Sequence: Synthetic oligonucleotide
  Target: ATXN1; (-) strand; PAM type: NAAAAC; PAM sequence: GAAAAC
agaggttctacaaaaccaat

SEQ ID NO: 5520 - DNA, 20 bp, Artificial Sequence
  Description of Artificial Sequence: Synthetic oligonucleotide
  Target: ATXN1; (-) strand; PAM type: NAAAAC; PAM sequence: CAAAAC
catttagtatagaggttcta

SEQ ID NO: 5521 - DNA, 20 bp, Artificial Sequence
  Description of Artificial Sequence: Synthetic oligonucleotide
  Target: ATXN1; (-) strand; PAM type: NAAAAC; PAM sequence: TAAAAC
tcagaaaatatcaagagttt

SEQ ID NO: 5522 - DNA, 20 bp, Artificial Sequence
  Description of Artificial Sequence: Synthetic oligonucleotide
  Target: ATXN1; (-) strand; PAM type: NAAAAC; PAM sequence: CAAAAC
cacaaaggaaaataataata

SEQ ID NO: 5523 - DNA, 20 bp, Artificial Sequence
  Description of Artificial Sequence: Synthetic oligonucleotide
  Target: ATXN1; (-) strand; PAM type: NAAAAC; PAM sequence: TAAAAC
gcttgtagccccaacggcat

SEQ ID NO: 5524 - DNA, 20 bp, Artificial Sequence
  Description of Artificial Sequence: Synthetic oligonucleotide
  Target: ATXN1; (-) strand; PAM type: NAAAAC; PAM sequence: TAAAAC
ctgtcacagttaaaggaatt

SEQ ID NO: 5525 - DNA, 20 bp, Artificial Sequence
  Description of Artificial Sequence: Synthetic oligonucleotide
  Target: ATXN1; (-) strand; PAM type: NAAAAC; PAM sequence: AAAAAC
agtatttgatttgttgagtg

SEQ ID NO: 5526 - DNA, 20 bp, Artificial Sequence
  Description of Artificial Sequence: Synthetic oligonucleotide
  Target: ATXN1; (-) strand; PAM type: NAAAAC; PAM sequence: TAAAAC
cactatcaccattctagtcc

SEQ ID NO: 5527 - DNA, 20 bp, Artificial Sequence
  Description of Artificial Sequence: Synthetic oligonucleotide
  Target: ATXN1; (-) strand; PAM type: NAAAAC; PAM sequence: CAAAAC
gaccctgtacctcctctgat

SEQ ID NO: 5528 - DNA, 20 bp, Artificial Sequence
  Description of Artificial Sequence: Synthetic oligonucleotide
  Target: ATXN1; (-) strand; PAM type: NAAAAC; PAM sequence: CAAAAC
ttgatgccttcaaaccatct

SEQ ID NO: 5529 - DNA, 20 bp, Artificial Sequence
  Description of Artificial Sequence: Synthetic oligonucleotide
  Target: ATXN1; (-) strand; PAM type: NAAAAC; PAM sequence: TAAAAC
taggacttctcatttctaat

SEQ ID NO: 5530 - DNA, 20 bp, Artificial Sequence
  Description of Artificial Sequence: Synthetic oligonucleotide
  Target: ATXN1; (-) strand; PAM type: NAAAAC; PAM sequence: AAAAAC
tggtagctctgaggctgaaa

SEQ ID NO: 5531 - DNA, 20 bp, Artificial Sequence
  Description of Artificial Sequence: Synthetic oligonucleotide
  Target: ATXN1; (-) strand; PAM type: NAAAAC; PAM sequence: CAAAAC
ctacaaagtgctttgaaaaa

SEQ ID NO: 5532 - DNA, 20 bp, Artificial Sequence
  Description of Artificial Sequence: Synthetic oligonucleotide
  Target: ATXN1; (-) strand; PAM type: NAAAAC; PAM sequence: AAAAAC
gaaaactacaaagtgctttg

SEQ ID NO: 5533 - DNA, 20 bp, Artificial Sequence
  Description of Artificial Sequence: Synthetic oligonucleotide
  Target: ATXN1; (-) strand; PAM type: NAAAAC; PAM sequence: GAAAAC
taaatactttttagggacaa

SEQ ID NO: 5534 - DNA, 20 bp, Artificial Sequence
  Description of Artificial Sequence: Synthetic oligonucleotide
  Target: ATXN1; (-) strand; PAM type: NAAAAC; PAM sequence: CAAAAC
agcttgggagcccgttgtgc

SEQ ID NO: 5535 - DNA, 20 bp, Artificial Sequence
  Description of Artificial Sequence: Synthetic oligonucleotide
  Target: ATXN1; (-) strand; PAM type: NAAAAC; PAM sequence: CAAAAC
ttttcctgaaacaaaaccca

SEQ ID NO: 5536 - DNA, 20 bp, Artificial Sequence
  Description of Artificial Sequence: Synthetic oligonucleotide
  Target: ATXN1; (-) strand; PAM type: NAAAAC; PAM sequence: CAAAAC
atatttaaattttcctgaaa

SEQ ID NO: 5537 - DNA, 20 bp, Artificial Sequence
  Description of Artificial Sequence: Synthetic oligonucleotide
  Target: ATXN1; (-) strand; PAM type: NAAAAC; PAM sequence: AAAAAC
ttaaagtataataataatat

SEQ ID NO: 5538 - DNA, 20 bp, Artificial Sequence
  Description of Artificial Sequence: Synthetic oligonucleotide
  Target: ATXN1; (-) strand; PAM type: NAAAAC; PAM sequence: TAAAAC
cacattgtgcacatgtaccc

SEQ ID NO: 5539 - DNA, 20 bp, Artificial Sequence
  Description of Artificial Sequence: Synthetic oligonucleotide
  Target: ATXN1; (-) strand; PAM type: NAAAAC; PAM sequence: AAAAAC
agtaaactatcacaaggaca

SEQ ID NO: 5540 - DNA, 20 bp, Artificial Sequence
  Description of Artificial Sequence: Synthetic oligonucleotide
  Target: ATXN1; (-) strand; PAM type: NAAAAC; PAM sequence: CAAAAC
gccatcagagaaatgcaaat

SEQ ID NO: 5541 - DNA, 20 bp, Artificial Sequence
  Description of Artificial Sequence: Synthetic oligonucleotide
  Target: ATXN1; (-) strand; PAM type: NAAAAC; PAM sequence: AAAAAC
taaagttcctttaatagaaa

SEQ ID NO: 5542 - DNA, 20 bp, Artificial Sequence
  Description of Artificial Sequence: Synthetic oligonucleotide
  Target: ATXN1; (-) strand; PAM type: NAAAAC; PAM sequence: CAAAAC
atcacttgacgccagaagtt

SEQ ID NO: 5543 - DNA, 20 bp, Artificial Sequence
  Description of Artificial Sequence: Synthetic oligonucleotide
  Target: ATXN1; (-) strand; PAM type: NAAAAC; PAM sequence: TAAAAC
tgagaaattcaatttaaaaa

SEQ ID NO: 5544 - DNA, 20 bp, Artificial Sequence
  Description of Artificial Sequence: Synthetic oligonucleotide
  Target: ATXN1; (-) strand; PAM type: NAAAAC; PAM sequence: AAAAAC
ttgcacagggtggtataaac

SEQ ID NO: 5545 - DNA, 20 bp, Artificial Sequence
  Description of Artificial Sequence: Synthetic oligonucleotide
  Target: ATXN1; (-) strand; PAM type: NAAAAC; PAM sequence: GAAAAC
tactaacaaaatggagttaa

SEQ ID NO: 5546 - DNA, 20 bp, Artificial Sequence
  Description of Artificial Sequence: Synthetic oligonucleotide
  Target: ATXN1; (-) strand; PAM type: NAAAAC; PAM sequence: AAAAAC
gatgctcattgatgtactta

SEQ ID NO: 5547 - DNA, 20 bp, Artificial Sequence
  Description of Artificial Sequence: Synthetic oligonucleotide
  Target: ATXN1; (-) strand; PAM type: NAAAAC; PAM sequence: GAAAAC
taaatcttccattagaggga

SEQ ID NO: 5548 - DNA, 20 bp, Artificial Sequence
  Description of Artificial Sequence: Synthetic oligonucleotide
  Target: ATXN1; (-) strand; PAM type: NAAAAC; PAM sequence: TAAAAC
ccacttaaaacgtgttcact

SEQ ID NO: 5549 - DNA, 20 bp, Artificial Sequence
  Description of Artificial Sequence: Synthetic oligonucleotide
  Target: ATXN1; (-) strand; PAM type: NAAAAC; PAM sequence: TAAAAC
ttcctttaaacttatccact

SEQ ID NO: 5550 - DNA, 20 bp, Artificial Sequence
  Description of Artificial Sequence: Synthetic oligonucleotide
  Target: ATXN1; (-) strand; PAM type: NAAAAC; PAM sequence: GAAAAC
atgttgttgtgcagtattga

SEQ ID NO: 5551 - DNA, 20 bp, Artificial Sequence
  Description of Artificial Sequence: Synthetic oligonucleotide
  Target: ATXN1; (-) strand; PAM type: NAAAAC; PAM sequence: GAAAAC
caatacaccctgaactcgga

SEQ ID NO: 5552 - DNA, 20 bp, Artificial Sequence
  Description of Artificial Sequence: Synthetic oligonucleotide
  Target: ATXN1; (-) strand; PAM type: NAAAAC; PAM sequence: TAAAAC
cacaaacctacctgctatta

SEQ ID NO: 5553 - DNA, 20 bp, Artificial Sequence
  Description of Artificial Sequence: Synthetic oligonucleotide
  Target: ATXN1; (-) strand; PAM type: NAAAAC; PAM sequence: AAAAAC
ttacacaagtgaaacacacc

SEQ ID NO: 5554 - DNA, 20 bp, Artificial Sequence
  Description of Artificial Sequence: Synthetic oligonucleotide
  Target: ATXN1; (-) strand; PAM type: NAAAAC; PAM sequence: GAAAAC
ctggcacaatatggagtggg

SEQ ID NO: 5555 - DNA, 20 bp, Artificial Sequence
  Description of Artificial Sequence: Synthetic oligonucleotide
  Target: ATXN1; (-) strand; PAM type: NAAAAC; PAM sequence: AAAAAC
tcaggtcttttgtccatttt

SEQ ID NO: 5556 - DNA, 20 bp, Artificial Sequence
  Description of Artificial Sequence: Synthetic oligonucleotide
  Target: ATXN1; (-) strand; PAM type: NAAAAC; PAM sequence: GAAAAC
gcccttaccaatgcattctt

SEQ ID NO: 5557 - DNA, 20 bp, Artificial Sequence
  Description of Artificial Sequence: Synthetic oligonucleotide
  Target: ATXN1; (-) strand; PAM type: NAAAAC; PAM sequence: AAAAAC
gcccttaccaatggattctc

SEQ ID NO: 5558 - DNA, 20 bp, Artificial Sequence
  Description of Artificial Sequence: Synthetic oligonucleotide
  Target: ATXN1; (-) strand; PAM type: NAAAAC; PAM sequence: AAAAAC
ggtgtttcccatctgaaaga

SEQ ID NO: 5559 - DNA, 20 bp, Artificial Sequence
  Description of Artificial Sequence: Synthetic oligonucleotide
  Target: ATXN1; (-) strand; PAM type: NAAAAC; PAM sequence: GAAAAC
tatacctaccaggatcatct

SEQ ID NO: 5560 - DNA, 20 bp, Artificial Sequence
  Description of Artificial Sequence: Synthetic oligonucleotide
  Target: ATXN1; (-) strand; PAM type: NAAAAC; PAM sequence: GAAAAC
cgttaaccaccccaagggga

SEQ ID NO: 5561 - DNA, 20 bp, Artificial Sequence
  Description of Artificial Sequence: Synthetic oligonucleotide
  Target: ATXN1; (-) strand; PAM type: NAAAAC; PAM sequence: CAAAAC
agggagtatgtttgccatta

SEQ ID NO: 5562 - DNA, 20 bp, Artificial Sequence
  Description of Artificial Sequence: Synthetic oligonucleotide
  Target: ATXN1; (-) strand; PAM type: NAAAAC; PAM sequence: AAAAAC
ctctattttcccattggaga

SEQ ID NO: 5563 - DNA, 20 bp, Artificial Sequence
  Description of Artificial Sequence: Synthetic oligonucleotide
  Target: ATXN1; (-) strand; PAM type: NAAAAC; PAM sequence: AAAAAC
tatccctgagtggttagtgt

SEQ ID NO: 5564 - DNA, 20 bp, Artificial Sequence
  Description of Artificial Sequence: Synthetic oligonucleotide
  Target: ATXN1; (-) strand; PAM type: NAAAAC; PAM sequence: AAAAAC
acaaatttgacaaagaggtt

SEQ ID NO: 5565 - DNA, 20 bp, Artificial Sequence
  Description of Artificial Sequence: Synthetic oligonucleotide
  Target: ATXN1; (-) strand; PAM type: NAAAAC; PAM sequence: CAAAAC
tatttgttcctcccaatccc

SEQ ID NO: 5566 - DNA, 20 bp, Artificial Sequence
  Description of Artificial Sequence: Synthetic oligonucleotide
  Target: ATXN1; (-) strand; PAM type: NAAAAC; PAM sequence: AAAAAC
atcctcctagttcttggcca

SEQ ID NO: 5567 - DNA, 20 bp, Artificial Sequence
  Description of Artificial Sequence: Synthetic oligonucleotide
  Target: ATXN1; (-) strand; PAM type: NAAAAC; PAM sequence: GAAAAC
agaacattaatcctttcatt

SEQ ID NO: 5568 - DNA, 20 bp, Artificial Sequence
  Description of Artificial Sequence: Synthetic oligonucleotide
  Target: ATXN1; (-) strand; PAM type: NAAAAC; PAM sequence: GAAAAC
gaaagcgcctccagagtcaa

SEQ ID NO: 5569 - DNA, 20 bp, Artificial Sequence
  Description of Artificial Sequence: Synthetic oligonucleotide
  Target: ATXN1; (-) strand; PAM type: NAAAAC; PAM sequence: TAAAAC
ttatttttagctacaatttt

SEQ ID NO: 5570 - DNA, 20 bp, Artificial Sequence
  Description of Artificial Sequence: Synthetic oligonucleotide
  Target: ATXN1; (-) strand; PAM type: NAAAAC; PAM sequence: TAAAAC
tgacaaataaaaccaaacag

SEQ ID NO: 5571 - DNA, 20 bp, Artificial Sequence
  Description of Artificial Sequence: Synthetic oligonucleotide
  Target: ATXN1; (-) strand; PAM type: NAAAAC; PAM sequence: TAAAAC
aaagcagtagttttgacaaa

SEQ ID NO: 5572 - DNA, 20 bp, Artificial Sequence
  Description of Artificial Sequence: Synthetic oligonucleotide
  Target: ATXN1; (-) strand; PAM type: NAAAAC; PAM sequence: GAAAAC
tatgcccatagaaaagaatg

SEQ ID NO: 5573 - DNA, 20 bp, Artificial Sequence
  Description of Artificial Sequence: Synthetic oligonucleotide
  Target: ATXN1; (-) strand; PAM type: NAAAAC; PAM sequence: AAAAAC
ataaaaataaaaataataat

SEQ ID NO: 5574 - DNA, 20 bp, Artificial Sequence
  Description of Artificial Sequence: Synthetic oligonucleotide
  Target: ATXN1; (-) strand; PAM type: NAAAAC; PAM sequence: AAAAAC
cccgtctctactaaaaatac

SEQ ID NO: 5575 - DNA, 20 bp, Artificial Sequence
  Description of Artificial Sequence: Synthetic oligonucleotide
  Target: ATXN1; (-) strand; PAM type: NAAAAC; PAM sequence: GAAAAC
atgtatattctcaagcatct

SEQ ID NO: 5576 - DNA, 20 bp, Artificial Sequence
  Description of Artificial Sequence: Synthetic oligonucleotide
  Target: ATXN1; (-) strand; PAM type: NAAAAC; PAM sequence: TAAAAC
cccacggtgtaagtgcattt

SEQ ID NO: 5577 - DNA, 20 bp, Artificial Sequence
  Description of Artificial Sequence: Synthetic oligonucleotide
  Target: ATXN1; (-) strand; PAM type: NAAAAC; PAM sequence: CAAAAC
gcagtggtgtgatctcggct

SEQ ID NO: 5578 - DNA, 20 bp, Artificial Sequence
  Description of Artificial Sequence: Synthetic oligonucleotide
  Target: ATXN1; (-) strand; PAM type: NAAAAC; PAM sequence: CAAAAC
tcacacctctttttttctgg

SEQ ID NO: 5579 - DNA, 20 bp, Artificial Sequence
  Description of Artificial Sequence: Synthetic oligonucleotide
  Target: ATXN1; (-) strand; PAM type: NAAAAC; PAM sequence: AAAAAC
accttggttggcctgtggag

SEQ ID NO: 5580 - DNA, 20 bp, Artificial Sequence
  Description of Artificial Sequence: Synthetic oligonucleotide
  Target: ATXN1; (-) strand; PAM type: NAAAAC; PAM sequence: GAAAAC
tgagaaagcaaagcttgtat

SEQ ID NO: 5581 - DNA, 20 bp, Artificial Sequence
  Description of Artificial Sequence: Synthetic oligonucleotide
  Target: ATXN1; (-) strand; PAM type: NAAAAC; PAM sequence: TAAAAC
attgtcacttatcttaatat

SEQ ID NO: 5582 - DNA, 20 bp, Artificial Sequence
  Description of Artificial Sequence: Synthetic oligonucleotide
  Target: ATXN1; (-) strand; PAM type: NAAAAC; PAM sequence: TAAAAC
atcaaagtcaacactgtgat

SEQ ID NO: 5583 - DNA, 20 bp, Artificial Sequence
  Description of Artificial Sequence: Synthetic oligonucleotide
  Target: ATXN1; (-) strand; PAM type: NAAAAC; PAM sequence: GAAAAC
tactcatgtgaaatggaaat

SEQ ID NO: 5584 - DNA, 20 bp, Artificial Sequence
  Description of Artificial Sequence: Synthetic oligonucleotide
  Target: ATXN1; (-) strand; PAM type: NAAAAC; PAM sequence: AAAAAC
caaagacaggagagggtttg

SEQ ID NO: 5585 - DNA, 20 bp, Artificial Sequence
  Description of Artificial Sequence: Synthetic oligonucleotide
  Target: ATXN1; (-) strand; PAM type: NAAAAC; PAM sequence: AAAAAC
ggaagacaagaaggaaaact

SEQ ID NO: 5586 - DNA, 20 bp, Artificial Sequence
  Description of Artificial Sequence: Synthetic oligonucleotide
  Target: ATXN1; (-) strand; PAM type: NAAAAC; PAM sequence: GAAAAC
gaacagaggaagacaagaag

SEQ ID NO: 5587 - DNA, 20 bp, Artificial Sequence
  Description of Artificial Sequence: Synthetic oligonucleotide
  Target: ATXN1; (-) strand; PAM type: NAAAAC; PAM sequence: AAAAAC
tggttaggtggtagaagcct

SEQ ID NO: 5588 - DNA, 20 bp, Artificial Sequence
  Description of Artificial Sequence: Synthetic oligonucleotide
  Target: ATXN1; (-) strand; PAM type: NAAAAC; PAM sequence: GAAAAC
tgaggagtagatgttaacca

SEQ ID NO: 5589 - DNA, 20 bp, Artificial Sequence
  Description of Artificial Sequence: Synthetic oligonucleotide
  Target: ATXN1; (-) strand; PAM type: NAAAAC; PAM sequence: GAAAAC
gtcactggggaaagaaatga

SEQ ID NO: 5590 - DNA, 20 bp, Artificial Sequence
  Description of Artificial Sequence: Synthetic oligonucleotide
  Target: ATXN1; (-) strand; PAM type: NAAAAC; PAM sequence: AAAAAC
gtgtctaggtggtgataggt

SEQ ID NO: 5591 - DNA, 20 bp, Artificial Sequence
  Description of Artificial Sequence: Synthetic oligonucleotide
  Target: ATXN1; (-) strand; PAM type: NAAAAC; PAM sequence: TAAAAC
tgagtagaactctgaaaaag

SEQ ID NO: 5592 - DNA, 20 bp, Artificial Sequence
  Description of Artificial Sequence: Synthetic oligonucleotide
  Target: ATXN1; (-) strand; PAM type: NAAAAC; PAM sequence: AAAAAC
gaaataatttttggaaaaag

SEQ ID NO: 5593 - DNA, 20 bp, Artificial Sequence
  Description of Artificial Sequence: Synthetic oligonucleotide
  Target: ATXN1; (-) strand; PAM type: NAAAAC; PAM sequence: GAAAAC
tctgggcaggcctccaggag

SEQ ID NO: 5594 - DNA, 20 bp, Artificial Sequence
  Description of Artificial Sequence: Synthetic oligonucleotide
  Target: ATXN1; (-) strand; PAM type: NAAAAC; PAM sequence: CAAAAC
atctactggctcacataatt

SEQ ID NO: 5595 - DNA, 20 bp, Artificial Sequence
  Description of Artificial Sequence: Synthetic oligonucleotide
  Target: ATXN1; (-) strand; PAM type: NAAAAC; PAM sequence: TAAAAC
gctacccgttataagcattg

SEQ ID NO: 5596 - DNA, 20 bp, Artificial Sequence
  Description of Artificial Sequence: Synthetic oligonucleotide
  Target: ATXN1; (-) strand; PAM type: NAAAAC; PAM sequence: CAAAAC
ctatcataatcttttatttc

SEQ ID NO: 5597 - DNA, 20 bp, Artificial Sequence
  Description of Artificial Sequence: Synthetic oligonucleotide
  Target: ATXN1; (-) strand; PAM type: NAAAAC; PAM sequence: CAAAAC
tttgtacagaaaaacccaaa

SEQ ID NO: 5598 - DNA, 20 bp, Artificial Sequence
  Description of Artificial Sequence: Synthetic oligonucleotide
  Target: ATXN1; (-) strand; PAM type: NAAAAC; PAM sequence: AAAAAC
tccaactgaactttgtacag

SEQ ID NO: 5599 - DNA, 20 bp, Artificial Sequence
  Description of Artificial Sequence: Synthetic oligonucleotide
  Target: ATXN1; (-) strand; PAM type: NAAAAC; PAM sequence: AAAAAC
tgtttggtttgaacactgac

SEQ ID NO: 5600 - DNA, 20 bp, Artificial Sequence
  Description of Artificial Sequence: Synthetic oligonucleotide
  Target: ATXN1; (-) strand; PAM type: NAAAAC; PAM sequence: TAAAAC
atttttgaacttgagttttc

SEQ ID NO: 5601 - DNA, 20 bp, Artificial Sequence
  Description of Artificial Sequence: Synthetic oligonucleotide
  Target: ATXN1; (-) strand; PAM type: NAAAAC; PAM sequence: TAAAAC
acctcatttacaactgtttt

SEQ ID NO: 5602 - DNA, 20 bp, Artificial Sequence
  Description of Artificial Sequence: Synthetic oligonucleotide
  Target: ATXN1; (-) strand; PAM type: NAAAAC; PAM sequence: CAAAAC
catgctaagtactttctttt

SEQ ID NO: 5603 - DNA, 20 bp, Artificial Sequence
  Description of Artificial Sequence: Synthetic oligonucleotide
  Target: ATXN1; (-) strand; PAM type: NAAAAC; PAM sequence: TAAAAC
taggaaacaagtgtcttatg

SEQ ID NO: 5604 - DNA, 20 bp, Artificial Sequence
  Description of Artificial Sequence: Synthetic oligonucleotide
  Target: ATXN1; (-) strand; PAM type: NAAAAC; PAM sequence: AAAAAC
attttacttatttttttaaa

SEQ ID NO: 5605 - DNA, 20 bp, Artificial Sequence
  Description of Artificial Sequence: Synthetic oligonucleotide
  Target: ATXN1; (-) strand; PAM type: NAAAAC; PAM sequence: TAAAAC
gggcaagtcgcgagccccca

SEQ ID NO: 5606 - DNA, 20 bp, Artificial Sequence
  Description of Artificial Sequence: Synthetic oligonucleotide
  Target: ATXN1; (-) strand; PAM type: NAAAAC; PAM sequence: GAAAAC
ccagcttcttaactcagcca

SEQ ID NO: 5607 - DNA, 20 bp, Artificial Sequence
  Description of Artificial Sequence: Synthetic oligonucleotide
  Target: ATXN1; (-) strand; PAM type: NAAAAC; PAM sequence: CAAAAC
cttgttgctggactgtgtca

SEQ ID NO: 5608 - DNA, 20 bp, Artificial Sequence
  Description of Artificial Sequence: Synthetic oligonucleotide
  Target: ATXN1; (-) strand; PAM type: NAAAAC; PAM sequence: AAAAAC
catgctcatgatttgaaagg

SEQ ID NO: 5609 - DNA, 20 bp, Artificial Sequence
  Description of Artificial Sequence: Synthetic oligonucleotide
  Target: ATXN1; (-) strand; PAM type: NAAAAC; PAM sequence: TAAAAC
ttcaaattttatgcatctcc

SEQ ID NO: 5610 - DNA, 20 bp, Artificial Sequence
  Description of Artificial Sequence: Synthetic oligonucleotide
  Target: ATXN1; (-) strand; PAM type: NAAAAC; PAM sequence: GAAAAC
tgtgggatgatagggaagaa

SEQ ID NO: 5611 - DNA, 20 bp, Artificial Sequence
  Description of Artificial Sequence: Synthetic oligonucleotide
  Target: ATXN1; (-) strand; PAM type: NAAAAC; PAM sequence: AAAAAC
tagaaagaacagagagagca

SEQ ID NO: 5612 - DNA, 20 bp, Artificial Sequence
  Description of Artificial Sequence: Synthetic oligonucleotide
  Target: ATXN1; (-) strand; PAM type: NAAAAC; PAM sequence: AAAAAC
acaaccaaaaaaaaaaaaaa

SEQ ID NO: 5613 - DNA, 20 bp, Artificial Sequence
  Description of Artificial Sequence: Synthetic oligonucleotide
  Target: ATXN1; (-) strand; PAM type: NAAAAC; PAM sequence: CAAAAC
taggcattcacatgcaaaaa

SEQ ID NO: 5614 - DNA, 20 bp, Artificial Sequence
  Description of Artificial Sequence: Synthetic oligonucleotide
  Target: ATXN1; (-) strand; PAM type: NAAAAC; PAM sequence: AAAAAC
aaccataggcattcacatgc

SEQ ID NO: 5615 - DNA, 20 bp, Artificial Sequence
  Description of Artificial Sequence: Synthetic oligonucleotide
  Target: ATXN1; (-) strand; PAM type: NAAAAC; PAM sequence: TAAAAC
aacataaggaaaatgaattt

SEQ ID NO: 5616 - DNA, 20 bp, Artificial Sequence
  Description of Artificial Sequence: Synthetic oligonucleotide
  Target: ATXN1; (-) strand; PAM type: NAAAAC; PAM sequence: AAAAAC
catgaaatataattttttta

SEQ ID NO: 5617 - DNA, 20 bp, Artificial Sequence
  Description of Artificial Sequence: Synthetic oligonucleotide
  Target: ATXN1; (-) strand; PAM type: NAAAAC; PAM sequence: TAAAAC
ccttttcaagcaggcatgaa

SEQ ID NO: 5618 - DNA, 20 bp, Artificial Sequence
  Description of Artificial Sequence: Synthetic oligonucleotide
  Target: ATXN1; (-) strand; PAM type: NAAAAC; PAM sequence: TAAAAC
tctgttggcttttaatttag

SEQ ID NO: 5619 - DNA, 20 bp, Artificial Sequence
  Description of Artificial Sequence: Synthetic oligonucleotide
  Target: ATXN1; (-) strand; PAM type: NAAAAC; PAM sequence: CAAAAC
acttttgagagcttattcga

SEQ ID NO: 5620 - DNA, 20 bp, Artificial Sequence
  Description of Artificial Sequence: Synthetic oligonucleotide
  Target: ATXN1; (-) strand; PAM type: NAAAAC; PAM sequence: AAAAAC
gccactgacttacacacttt

SEQ ID NO: 5621 - DNA, 20 bp, Artificial Sequence
  Description of Artificial Sequence: Synthetic oligonucleotide
  Target: ATXN1; (-) strand; PAM type: NAAAAC; PAM sequence: GAAAAC
ttacaatatgaatgagcctt

SEQ ID NO: 5622 - DNA, 20 bp, Artificial Sequence
  Description of Artificial Sequence: Synthetic oligonucleotide
  Target: ATXN1; (-) strand; PAM type: NAAAAC; PAM sequence: CAAAAC
acaatagagtattattgaac

SEQ ID NO: 5623 - DNA, 20 bp, Artificial Sequence
  Description of Artificial Sequence: Synthetic oligonucleotide
  Target: ATXN1; (-) strand; PAM type: NAAAAC; PAM sequence: AAAAAC
ttgcaaacaggtattcaaac

SEQ ID NO: 5624 - DNA, 20 bp, Artificial Sequence
  Description of Artificial Sequence: Synthetic oligonucleotide
  Target: ATXN1; (-) strand; PAM type: NAAAAC; PAM sequence: GAAAAC
agtatggtgcaatcactata

SEQ ID NO: 5625 - DNA, 20 bp, Artificial Sequence
  Description of Artificial Sequence: Synthetic oligonucleotide
  Target: ATXN1; (-) strand; PAM type: NAAAAC; PAM sequence: CAAAAC
gtgtttaggggaatgcaaat

SEQ ID NO: 5626 - DNA, 20 bp, Artificial Sequence
  Description of Artificial Sequence: Synthetic oligonucleotide
  Target: ATXN1; (-) strand; PAM type: NAAAAC; PAM sequence: GAAAAC
aaactataaaacttttaaat

SEQ ID NO: 5627 - DNA, 20 bp, Artificial Sequence
  Description of Artificial Sequence: Synthetic oligonucleotide
  Target: ATXN1; (-) strand; PAM type: NAAAAC; PAM sequence: TAAAAC
aaatgtaggaactgaaacta

SEQ ID NO: 5628 - DNA, 20 bp, Artificial Sequence
  Description of Artificial Sequence: Synthetic oligonucleotide
  Target: ATXN1; (-) strand; PAM type: NAAAAC; PAM sequence: AAAAAC
ctttaaaatgtgggatgagg

SEQ ID NO: 5629 - DNA, 20 bp, Artificial Sequence
  Description of Artificial Sequence: Synthetic oligonucleotide
  Target: ATXN1; (-) strand; PAM type: NAAAAC; PAM sequence: GAAAAC
tctggtgggtcatcattcat

SEQ ID NO: 5630 - DNA, 20 bp, Artificial Sequence
  Description of Artificial Sequence: Synthetic oligonucleotide
  Target: ATXN1; (-) strand; PAM type: NAAAAC; PAM sequence: GAAAAC
gaaagaattactacatctct

SEQ ID NO: 5631 - DNA, 20 bp, Artificial Sequence
  Description of Artificial Sequence: Synthetic oligonucleotide
  Target: ATXN1; (-) strand; PAM type: NAAAAC; PAM sequence: TAAAAC
tacctaatgcatgaggggct

SEQ ID NO: 5632 - DNA, 20 bp, Artificial Sequence
  Description of Artificial Sequence: Synthetic oligonucleotide
  Target: ATXN1; (-) strand; PAM type: NAAAAC; PAM sequence: GAAAAC
agcaaactaacacaggaaca

SEQ ID NO: 5633 - DNA, 20 bp, Artificial Sequence
  Description of Artificial Sequence: Synthetic oligonucleotide
  Target: ATXN1; (-) strand; PAM type: NAAAAC; PAM sequence: GAAAAC
gaggtacaactcccacttgt

SEQ ID NO: 5634 - DNA, 20 bp, Artificial Sequence
  Description of Artificial Sequence: Synthetic oligonucleotide
  Target: ATXN1; (-) strand; PAM type: NAAAAC; PAM sequence: GAAAAC
tatttttagcctattacaaa

SEQ ID NO: 5635 - DNA, 20 bp, Artificial Sequence
  Description of Artificial Sequence: Synthetic oligonucleotide
  Target: ATXN1; (-) strand; PAM type: NAAAAC; PAM sequence: AAAAAC
aggcagagttctggctttta

SEQ ID NO: 5636 - DNA, 20 bp, Artificial Sequence
  Description of Artificial Sequence: Synthetic oligonucleotide
  Target: ATXN1; (-) strand; PAM type: NAAAAC; PAM sequence: TAAAAC
tgaggagtaggaggaaccga

SEQ ID NO: 5637 - DNA, 20 bp, Artificial Sequence
  Description of Artificial Sequence: Synthetic oligonucleotide
  Target: ATXN1; (-) strand; PAM type: NAAAAC; PAM sequence: AAAAAC
tatgaaaaacatttaaaatt

SEQ ID NO: 5638 - DNA, 20 bp, Artificial Sequence
  Description of Artificial Sequence: Synthetic oligonucleotide
  Target: ATXN1; (-) strand; PAM type: NAAAAC; PAM sequence: AAAAAC
ggcaatgtgatcattatatg

SEQ ID NO: 5639 - DNA, 20 bp, Artificial Sequence
  Description of Artificial Sequence: Synthetic oligonucleotide
  Target: ATXN1; (-) strand; PAM type: NAAAAC; PAM sequence: CAAAAC
agattttctgagttccctgc

SEQ ID NO: 5640 - DNA, 20 bp, Artificial Sequence
  Description of Artificial Sequence: Synthetic oligonucleotide
  Target: ATXN1; (-) strand; PAM type: NAAAAC; PAM sequence: TAAAAC
agacatcagctttgcttatg

SEQ ID NO: 5641 - DNA, 20 bp, Artificial Sequence
  Description of Artificial Sequence: Synthetic oligonucleotide
  Target: ATXN1; (-) strand; PAM type: NAAAAC; PAM sequence: TAAAAC
tagggagtgaggagaaaaat

SEQ ID NO: 5642 - DNA, 20 bp, Artificial Sequence
  Description of Artificial Sequence: Synthetic oligonucleotide
  Target: ATXN1; (-) strand; PAM type: NAAAAC; PAM sequence: AAAAAC
ttccattaaaaaacaaaagg

SEQ ID NO: 5643 - DNA, 20 bp, Artificial Sequence
  Description of Artificial Sequence: Synthetic oligonucleotide
  Target: ATXN1; (-) strand; PAM type: NAAAAC; PAM sequence: AAAAAC
aaatttgttttcttccatta

SEQ ID NO: 5644 - DNA, 20 bp, Artificial Sequence
  Description of Artificial Sequence: Synthetic oligonucleotide
  Target: ATXN1; (-) strand; PAM type: NAAAAC; PAM sequence: CAAAAC
tctcagctgtttgtgtcttg

SEQ ID NO: 5645 - DNA, 20 bp, Artificial Sequence
  Description of Artificial Sequence: Synthetic oligonucleotide
  Target: ATXN1; (-) strand; PAM type: NAAAAC; PAM sequence: AAAAAC
gacattaaaaggatggcaag

SEQ ID NO: 5646 - DNA, 20 bp, Artificial Sequence
  Description of Artificial Sequence: Synthetic oligonucleotide
  Target: ATXN1; (-) strand; PAM type: NAAAAC; PAM sequence: AAAAAC
gataaactgtatataaaagt

SEQ ID NO: 5647 - DNA, 20 bp, Artificial Sequence
  Description of Artificial Sequence: Synthetic oligonucleotide
  Target: ATXN1; (-) strand; PAM type: NAAAAC; PAM sequence: TAAAAC
ggatgtgacagaaaactctt

SEQ ID NO: 5648 - DNA, 20 bp, Artificial Sequence
  Description of Artificial Sequence: Synthetic oligonucleotide
  Target: ATXN1; (-) strand; PAM type: NAAAAC; PAM sequence: GAAAAC
taagtctactggatgtgaca

SEQ ID NO: 5649 - DNA, 20 bp, Artificial Sequence
  Description of Artificial Sequence: Synthetic oligonucleotide
  Target: ATXN1; (-) strand; PAM type: NAAAAC; PAM sequence: TAAAAC
cccttaaatgtctattgtgt

SEQ ID NO: 5650 - DNA, 20 bp, Artificial Sequence
  Description of Artificial Sequence: Synthetic oligonucleotide
  Target: ATXN1; (-) strand; PAM type: NAAAAC; PAM sequence: GAAAAC
gaggaagaagaactgtgtat

SEQ ID NO: 5651 - DNA, 20 bp, Artificial Sequence
  Description of Artificial Sequence: Synthetic oligonucleotide
  Target: ATXN1; (-) strand; PAM type: NAAAAC; PAM sequence: CAAAAC
cataataaattccatagctc

SEQ ID NO: 5652 - DNA, 20 bp, Artificial Sequence
  Description of Artificial Sequence: Synthetic oligonucleotide
  Target: ATXN1; (-) strand; PAM type: NAAAAC; PAM sequence: TAAAAC
tttgaatgtgggcgagaaag

SEQ ID NO: 5653 - DNA, 20 bp, Artificial Sequence
  Description of Artificial Sequence: Synthetic oligonucleotide
  Target: ATXN1; (-) strand; PAM type: NAAAAC; PAM sequence: CAAAAC
atcaaatcttaaatcagcag

SEQ ID NO: 5654 - DNA, 20 bp, Artificial Sequence
  Description of Artificial Sequence: Synthetic oligonucleotide
  Target: ATXN1; (-) strand; PAM type: NAAAAC; PAM sequence: GAAAAC
ggggccacgcatatgctgag

SEQ ID NO: 5655 - DNA, 20 bp, Artificial Sequence
  Description of Artificial Sequence: Synthetic oligonucleotide
  Target: ATXN1; (-) strand; PAM type: NAAAAC; PAM sequence: TAAAAC
actgcatgtatcccagtatt

SEQ ID NO: 5656 - DNA, 20 bp, Artificial Sequence
  Description of Artificial Sequence: Synthetic oligonucleotide
  Target: ATXN1; (-) strand; PAM type: NAAAAC; PAM sequence: GAAAAC
gcaacgtgactgtgctgcca

SEQ ID NO: 5657 - DNA, 20 bp, Artificial Sequence
  Description of Artificial Sequence: Synthetic oligonucleotide
  Target: ATXN1; (-) strand; PAM type: NAAAAC; PAM sequence: TAAAAC
ccacatgcatatataccttg

SEQ ID NO: 5658 - DNA, 20 bp, Artificial Sequence
  Description of Artificial Sequence: Synthetic oligonucleotide
  Target: ATXN1; (-) strand; PAM type: NAAAAC; PAM sequence: AAAAAC
ttttattttaccaaatgaga

SEQ ID NO: 5659 - DNA, 20 bp, Artificial Sequence
  Description of Artificial Sequence: Synthetic oligonucleotide
  Target: ATXN1; (-) strand; PAM type: NAAAAC; PAM sequence: CAAAAC
gaactaagtgcacttatttc

SEQ ID NO: 5660 - DNA, 20 bp, Artificial Sequence
  Description of Artificial Sequence: Synthetic oligonucleotide
  Target: ATXN1; (-) strand; PAM type: NAAAAC; PAM sequence: TAAAAC
aagaccctatctcaaaaaaa

SEQ ID NO: 5661 - DNA, 20 bp, Artificial Sequence
  Description of Artificial Sequence: Synthetic oligonucleotide
  Target: ATXN1; (-) strand; PAM type: NAAAAC; PAM sequence: AAAAAC
tccatctccgcaaataaaga

SEQ ID NO: 5662 - DNA, 20 bp, Artificial Sequence
  Description of Artificial Sequence: Synthetic oligonucleotide
  Target: ATXN1; (-) strand; PAM type: NAAAAC; PAM sequence: CAAAAC
ttcacagcctggcaatgtag

SEQ ID NO: 5663 - DNA, 20 bp, Artificial Sequence
  Description of Artificial Sequence: Synthetic oligonucleotide
  Target: ATXN1; (-) strand; PAM type: NAAAAC; PAM sequence: TAAAAC
tggattataaagtgttgctt

SEQ ID NO: 5664 - DNA, 20 bp, Artificial Sequence
  Description of Artificial Sequence: Synthetic oligonucleotide
  Target: ATXN1; (-) strand; PAM type: NAAAAC; PAM sequence: AAAAAC
tgtgtaccaagcgccacact

SEQ ID NO: 5665 - DNA, 20 bp, Artificial Sequence
  Description of Artificial Sequence: Synthetic oligonucleotide
  Target: ATXN1; (-) strand; PAM type: NAAAAC; PAM sequence: CAAAAC
tatgctacacccactcaaac

SEQ ID NO: 5666 - DNA, 20 bp, Artificial Sequence
  Description of Artificial Sequence: Synthetic oligonucleotide
  Target: ATXN1; (-) strand; PAM type: NAAAAC; PAM sequence: AAAAAC
acgagagagttgggcaaagc

SEQ ID NO: 5667 - DNA, 20 bp, Artificial Sequence
  Description of Artificial Sequence: Synthetic oligonucleotide
  Target: ATXN1; (-) strand; PAM type: NAAAAC; PAM sequence: TAAAAC
catctgtacaatgaggccaa

SEQ ID NO: 5668 - DNA, 20 bp, Artificial Sequence
  Description of Artificial Sequence: Synthetic oligonucleotide
  Target: ATXN1; (-) strand; PAM type: NAAAAC; PAM sequence: AAAAAC
acaaaaaaaaaaaaaaaaca

SEQ ID NO: 5669 - DNA, 20 bp, Artificial Sequence
  Description of Artificial Sequence: Synthetic oligonucleotide
  Target: ATXN1; (-) strand; PAM type: NAAAAC; PAM sequence: AAAAAC
tatcttcacaaaaaaaaaaa

SEQ ID NO: 5670 - DNA, 20 bp, Artificial Sequence
  Description of Artificial Sequence: Synthetic oligonucleotide
  Target: ATXN1; (-) strand; PAM type: NAAAAC; PAM sequence: GAAAAC
tgattttaattactttcctt

SEQ ID NO: 5671 - DNA, 20 bp, Artificial Sequence
  Description of Artificial Sequence: Synthetic oligonucleotide
  Target: ATXN1; (-) strand; PAM type: NAAAAC; PAM sequence: GAAAAC
atgggcattgatacagtatt

SEQ ID NO: 5672 - DNA, 20 bp, Artificial Sequence
  Description of Artificial Sequence: Synthetic oligonucleotide
  Target: ATXN1; (-) strand; PAM type: NAAAAC; PAM sequence: TAAAAC
agtgtagatgttctcttaag

SEQ ID NO: 5673 - DNA, 20 bp, Artificial Sequence
  Description of Artificial Sequence: Synthetic oligonucleotide
  Target: ATXN1; (-) strand; PAM type: NAAAAC; PAM sequence: TAAAAC
cacagacacccaggaaatca

SEQ ID NO: 5674 - DNA, 20 bp, Artificial Sequence
  Description of Artificial Sequence: Synthetic oligonucleotide
  Target: ATXN1; (-) strand; PAM type: NAAAAC; PAM sequence: GAAAAC
gactgcaagctattcacttt

SEQ ID NO: 5675 - DNA, 20 bp, Artificial Sequence
  Description of Artificial Sequence: Synthetic oligonucleotide
  Target: ATXN1; (-) strand; PAM type: NAAAAC; PAM sequence: GAAAAC
tatgtagagacttaccactg

SEQ ID NO: 5676 - DNA, 20 bp, Artificial Sequence
  Description of Artificial Sequence: Synthetic oligonucleotide
  Target: ATXN1; (-) strand; PAM type: NAAAAC; PAM sequence: CAAAAC
acgttttcatcttcccaaag

SEQ ID NO: 5677 - DNA, 20 bp, Artificial Sequence
  Description of Artificial Sequence: Synthetic oligonucleotide
  Target: ATXN1; (-) strand; PAM type: NAAAAC; PAM sequence: TAAAAC
aaattgggtctctgaggttg

SEQ ID NO: 5678 - DNA, 20 bp, Artificial Sequence
  Description of Artificial Sequence: Synthetic oligonucleotide
  Target: ATXN1; (-) strand; PAM type: NAAAAC; PAM sequence: AAAAAC
ttcttaccaagaatatagga

SEQ ID NO: 5679 - DNA, 20 bp, Artificial Sequence
  Description of Artificial Sequence: Synthetic oligonucleotide
  Target: ATXN1; (-) strand; PAM type: NAAAAC; PAM sequence: TAAAAC
gcattttactgcatattggt

SEQ ID NO: 5680 - DNA, 20 bp, Artificial Sequence
  Description of Artificial Sequence: Synthetic oligonucleotide
  Target: ATXN1; (-) strand; PAM type: NAAAAC; PAM sequence: GAAAAC
agagatgtgtgcccctgatt

SEQ ID NO: 5681 - DNA, 20 bp, Artificial Sequence
  Description of Artificial Sequence: Synthetic oligonucleotide
  Target: ATXN1; (-) strand; PAM type: NAAAAC; PAM sequence: CAAAAC
tggtgctttgaattctctaa

SEQ ID NO: 5682 - DNA, 20 bp, Artificial Sequence
  Description of Artificial Sequence: Synthetic oligonucleotide
  Target: ATXN1; (-) strand; PAM type: NAAAAC; PAM sequence: AAAAAC
agccaaccatgcctggccag

SEQ ID NO: 5683 - DNA, 20 bp, Artificial Sequence
  Description of Artificial Sequence: Synthetic oligonucleotide
  Target: ATXN1; (-) strand; PAM type: NAAAAC; PAM sequence: AAAAAC
taattaactcctatttcaag

SEQ ID NO: 5684 - DNA, 20 bp, Artificial Sequence
  Description of Artificial Sequence: Synthetic oligonucleotide
  Target: ATXN1; (-) strand; PAM type: NAAAAC; PAM sequence: GAAAAC
gttatgtaaattttatatct

SEQ ID NO: 5685 - DNA, 20 bp, Artificial Sequence
  Description of Artificial Sequence: Synthetic oligonucleotide
  Target: ATXN1; (-) strand; PAM type: NAAAAC; PAM sequence: AAAAAC
ctaaaacttaaagtataatt

SEQ ID NO: 5686 - DNA, 20 bp, Artificial Sequence
  Description of Artificial Sequence: Synthetic oligonucleotide
  Target: ATXN1; (-) strand; PAM type: NAAAAC; PAM sequence: TAAAAC
catgttgtgcacatgtaccc

SEQ ID NO: 5687 - DNA, 20 bp, Artificial Sequence
  Description of Artificial Sequence: Synthetic oligonucleotide
  Target: ATXN1; (-) strand; PAM type: NAAAAC; PAM sequence: AAAAAC
ctatctcaatcgcaaggaca

SEQ ID NO: 5688 - DNA, 20 bp, Artificial Sequence
  Description of Artificial Sequence: Synthetic oligonucleotide
  Target: ATXN1; (-) strand; PAM type: NAAAAC; PAM sequence: AAAAAC
tgaaaccctgtctctactga

SEQ ID NO: 5689 - DNA, 20 bp, Artificial Sequence
  Description of Artificial Sequence: Synthetic oligonucleotide
  Target: ATXN1; (-) strand; PAM type: NAAAAC; PAM sequence: TAAAAC
gccctgtgattaagagtttc

SEQ ID NO: 5690 - DNA, 20 bp, Artificial Sequence
  Description of Artificial Sequence: Synthetic oligonucleotide
  Target: ATXN1; (-) strand; PAM type: NAAAAC; PAM sequence: AAAAAC
atgataaaatctgcatgcaa

SEQ ID NO: 5691 - DNA, 20 bp, Artificial Sequence
  Description of Artificial Sequence: Synthetic oligonucleotide
  Target: ATXN1; (-) strand; PAM type: NAAAAC; PAM sequence: TAAAAC
tgcaaatattttgtaaactg

SEQ ID NO: 5692 - DNA, 20 bp, Artificial Sequence
  Description of Artificial Sequence: Synthetic oligonucleotide
  Target: ATXN1; (-) strand; PAM type: NAAAAC; PAM sequence: CAAAAC
aaacctcattttccttattt

SEQ ID NO: 5693 - DNA, 20 bp, Artificial Sequence
  Description of Artificial Sequence: Synthetic oligonucleotide
  Target: ATXN1; (-) strand; PAM type: NAAAAC; PAM sequence: AAAAAC
ttctgccctggctggtgatg

SEQ ID NO: 5694 - DNA, 20 bp, Artificial Sequence
  Description of Artificial Sequence: Synthetic oligonucleotide
  Target: ATXN1; (-) strand; PAM type: NAAAAC; PAM sequence: AAAAAC
ctagagagagccccagtgtg

SEQ ID NO: 5695 - DNA, 20 bp, Artificial Sequence
  Description of Artificial Sequence: Synthetic oligonucleotide
  Target: ATXN1; (-) strand; PAM type: NAAAAC; PAM sequence: AAAAAC
atgggtgtatatgtatagga

SEQ ID NO: 5696 - DNA, 20 bp, Artificial Sequence
  Description of Artificial Sequence: Synthetic oligonucleotide
  Target: ATXN1; (-) strand; PAM type: NAAAAC; PAM sequence: AAAAAC
cccacagtcaagcgtggtac

SEQ ID NO: 5697 - DNA, 20 bp, Artificial Sequence
  Description of Artificial Sequence: Synthetic oligonucleotide
  Target: ATXN1; (-) strand; PAM type: NAAAAC; PAM sequence: GAAAAC
agcatcaagtagtaatgctt

SEQ ID NO: 5698 - DNA, 20 bp, Artificial Sequence
  Description of Artificial Sequence: Synthetic oligonucleotide
  Target: ATXN1; (-) strand; PAM type: NAAAAC; PAM sequence: GAAAAC
ataacacgccaacgcgcctg

SEQ ID NO: 5699 - DNA, 20 bp, Artificial Sequence
  Description of Artificial Sequence: Synthetic oligonucleotide
  Target: ATXN1; (-) strand; PAM type: NAAAAC; PAM sequence: GAAAAC
cctttccattttgtcctttc

SEQ ID NO: 5700 - DNA, 20 bp, Artificial Sequence
  Description of Artificial Sequence: Synthetic oligonucleotide
  Target: ATXN1; (-) strand; PAM type: NAAAAC; PAM sequence: AAAAAC
atgtttggaattttccatga

SEQ ID NO: 5701 - DNA, 20 bp, Artificial Sequence
  Description of Artificial Sequence: Synthetic oligonucleotide
  Target: ATXN1; (-) strand; PAM type: NAAAAC; PAM sequence: AAAAAC
ttatggctcagggtccagtt

SEQ ID NO: 5702 - DNA, 20 bp, Artificial Sequence
  Description of Artificial Sequence: Synthetic oligonucleotide
  Target: ATXN1; (-) strand; PAM type: NAAAAC; PAM sequence: CAAAAC
gtatatttccgtctgttagg

SEQ ID NO: 5703 - DNA, 20 bp, Artificial Sequence
  Description of Artificial Sequence: Synthetic oligonucleotide
  Target: ATXN1; (-) strand; PAM type: NAAAAC; PAM sequence: TAAAAC
gggaagccttggtatccatg

SEQ ID NO: 5704 - DNA, 20 bp, Artificial Sequence
  Description of Artificial Sequence: Synthetic oligonucleotide
  Target: ATXN1; (-) strand; PAM type: NAAAAC; PAM sequence: TAAAAC
ttatgcatgaaaggcacttt

SEQ ID NO: 5705 - DNA, 20 bp, Artificial Sequence
  Description of Artificial Sequence: Synthetic oligonucleotide
  Target: ATXN1; (-) strand; PAM type: NAAAAC; PAM sequence: AAAAAC
atattgcttatagtcaagaa

SEQ ID NO: 5706 - DNA, 20 bp, Artificial Sequence
  Description of Artificial Sequence: Synthetic oligonucleotide
  Target: ATXN1; (-) strand; PAM type: NAAAAC; PAM sequence: TAAAAC
ggaaaaataagacctgaagt

SEQ ID NO: 5707 - DNA, 20 bp, Artificial Sequence
  Description of Artificial Sequence: Synthetic oligonucleotide
  Target: ATXN1; (-) strand; PAM type: NAAAAC; PAM sequence: AAAAAC
gacgtgcagcaggcattcag

SEQ ID NO: 5708 - DNA, 20 bp, Artificial Sequence
  Description of Artificial Sequence: Synthetic oligonucleotide
  Target: ATXN1; (-) strand; PAM type: NAAAAC; PAM sequence: GAAAAC
gtagcatctttgagtggcaa

SEQ ID NO: 5709 - DNA, 20 bp, Artificial Sequence
  Description of Artificial Sequence: Synthetic oligonucleotide
  Target: ATXN1; (-) strand; PAM type: NAAAAC; PAM sequence: CAAAAC
ctgataaattacaccttatt

SEQ ID NO: 5710 - DNA, 20 bp, Artificial Sequence
  Description of Artificial Sequence: Synthetic oligonucleotide
  Target: ATXN1; (-) strand; PAM type: NAAAAC; PAM sequence: GAAAAC
tctgattgtctttaagcaga

SEQ ID NO: 5711 - DNA, 20 bp, Artificial Sequence
  Description of Artificial Sequence: Synthetic oligonucleotide
  Target: ATXN1; (-) strand; PAM type: NAAAAC; PAM sequence: GAAAAC
acgcatagtagatttttagg

SEQ ID NO: 5712 - DNA, 20 bp, Artificial Sequence
  Description of Artificial Sequence: Synthetic oligonucleotide
  Target: ATXN1; (-) strand; PAM type: NAAAAC; PAM sequence: CAAAAC
tttgacagccggtctcatgt

SEQ ID NO: 5713 - DNA, 20 bp, Artificial Sequence
  Description of Artificial Sequence: Synthetic oligonucleotide
  Target: ATXN1; (-) strand; PAM type: NAAAAC; PAM sequence: CAAAAC
gcattagcagaactggaaaa

SEQ ID NO: 5714 - DNA, 20 bp, Artificial Sequence
  Description of Artificial Sequence: Synthetic oligonucleotide
  Target: ATXN1; (-) strand; PAM type: NAAAAC; PAM sequence: GAAAAC
cccttgcattagcagaactg

SEQ ID NO: 5715 - DNA, 20 bp, Artificial Sequence
  Description of Artificial Sequence: Synthetic oligonucleotide
  Target: ATXN1; (-) strand; PAM type: NAAAAC; PAM sequence: CAAAAC
attattaccaaaaaatgaca

SEQ ID NO: 5716 - DNA, 20 bp, Artificial Sequence
  Description of Artificial Sequence: Synthetic oligonucleotide
  Target: ATXN1; (-) strand; PAM type: NAAAAC; PAM sequence: GAAAAC
tagggcttttataatgagta

SEQ ID NO: 5717 - DNA, 20 bp, Artificial Sequence
  Description of Artificial Sequence: Synthetic oligonucleotide
  Target: ATXN1; (-) strand; PAM type: NAAAAC; PAM sequence: GAAAAC
cattttcattactccaaaaa

SEQ ID NO: 5718 - DNA, 20 bp, Artificial Sequence
  Description of Artificial Sequence: Synthetic oligonucleotide
  Target: ATXN1; (-) strand; PAM type: NAAAAC; PAM sequence: CAAAAC
tagaattatacaatcatcat

SEQ ID NO: 5719 - DNA, 20 bp, Artificial Sequence
  Description of Artificial Sequence: Synthetic oligonucleotide
  Target: ATXN1; (-) strand; PAM type: NAAAAC; PAM sequence: TAAAAC
gagatatgattcatatatcg

SEQ ID NO: 5720 - DNA, 20 bp, Artificial Sequence
  Description of Artificial Sequence: Synthetic oligonucleotide
  Target: ATXN1; (-) strand; PAM type: NAAAAC; PAM sequence: GAAAAC
tctttgccaatctgagaggt

SEQ ID NO: 5721 - DNA, 20 bp, Artificial Sequence
  Description of Artificial Sequence: Synthetic oligonucleotide
  Target: ATXN1; (-) strand; PAM type: NAAAAC; PAM sequence: GAAAAC
tcacctaacagtgtgtcctg

SEQ ID NO: 5722 - DNA, 20 bp, Artificial Sequence
  Description of Artificial Sequence: Synthetic oligonucleotide
  Target: ATXN1; (-) strand; PAM type: NAAAAC; PAM sequence: TAAAAC
aagcaaaaatataggttttt

SEQ ID NO: 5723 - DNA, 20 bp, Artificial Sequence
  Description of Artificial Sequence: Synthetic oligonucleotide
  Target: ATXN1; (-) strand; PAM type: NAAAAC; PAM sequence: AAAAAC
cagtcaattttgagggttta

SEQ ID NO: 5724 - DNA, 20 bp, Artificial Sequence
  Description of Artificial Sequence: Synthetic oligonucleotide
  Target: ATXN1; (-) strand; PAM type: NAAAAC; PAM sequence: AAAAAC
tgtgcttgacaggcaaggtg

SEQ ID NO: 5725 - DNA, 20 bp, Artificial Sequence
  Description of Artificial Sequence: Synthetic oligonucleotide
  Target: ATXN1; (-) strand; PAM type: NAAAAC; PAM sequence: CAAAAC
tatttaccaatgaagaaaag

SEQ ID NO: 5726 - DNA, 20 bp, Artificial Sequence
  Description of Artificial Sequence: Synthetic oligonucleotide
  Target: ATXN1; (-) strand; PAM type: NAAAAC; PAM sequence: GAAAAC
gcatcagcctatttgtttct

SEQ ID NO: 5727 - DNA, 20 bp, Artificial Sequence
  Description of Artificial Sequence: Synthetic oligonucleotide
  Target: ATXN1; (-) strand; PAM type: NAAAAC; PAM sequence: GAAAAC
ctttaacctcaacatgtttt

SEQ ID NO: 5728 - DNA, 20 bp, Artificial Sequence
  Description of Artificial Sequence: Synthetic oligonucleotide
  Target: ATXN1; (-) strand; PAM type: NAAAAC; PAM sequence: AAAAAC
agtggtgtggcctgtctttt

SEQ ID NO: 5729 - DNA, 20 bp, Artificial Sequence
  Description of Artificial Sequence: Synthetic oligonucleotide
  Target: ATXN1; (-) strand; PAM type: NAAAAC; PAM sequence: CAAAAC
ttcattatcttcatcttaac

SEQ ID NO: 5730 - DNA, 20 bp, Artificial Sequence
  Description of Artificial Sequence: Synthetic oligonucleotide
  Target: ATXN1; (-) strand; PAM type: NAAAAC; PAM sequence: CAAAAC
ccaaacttttccagtctctt

SEQ ID NO: 5731 - DNA, 20 bp, Artificial Sequence
  Description of Artificial Sequence: Synthetic oligonucleotide
  Target: ATXN1; (-) strand; PAM type: NAAAAC; PAM sequence: AAAAAC
ttatggtgtggagaagcaga

SEQ ID NO: 5732 - DNA, 20 bp, Artificial Sequence
  Description of Artificial Sequence: Synthetic oligonucleotide
  Target: ATXN1; (-) strand; PAM type: NAAAAC; PAM sequence: AAAAAC
tttaacctcaacgttccttt

SEQ ID NO: 5733 - DNA, 20 bp, Artificial Sequence
  Description of Artificial Sequence: Synthetic oligonucleotide
  Target: ATXN1; (-) strand; PAM type: NAAAAC; PAM sequence: TAAAAC
ttgaccatagtaacctgtta

SEQ ID NO: 5734 - DNA, 20 bp, Artificial Sequence
  Description of Artificial Sequence: Synthetic oligonucleotide
  Target: ATXN1; (-) strand; PAM type: NAAAAC; PAM sequence: AAAAAC
tatttcttatatctggatgc

SEQ ID NO: 5735 - DNA, 20 bp, Artificial Sequence
  Description of Artificial Sequence: Synthetic oligonucleotide
  Target: ATXN1; (-) strand; PAM type: NAAAAC; PAM sequence: AAAAAC
ttttttagcctcacccaagc

SEQ ID NO: 5736 - DNA, 20 bp, Artificial Sequence
  Description of Artificial Sequence: Synthetic oligonucleotide
  Target: ATXN1; (-) strand; PAM type: NAAAAC; PAM sequence: AAAAAC
gccgtctctttgaccctaca

SEQ ID NO: 5737 - DNA, 20 bp, Artificial Sequence
  Description of Artificial Sequence: Synthetic oligonucleotide
  Target: ATXN1; (-) strand; PAM type: NAAAAC; PAM sequence: CAAAAC
tgatggtttttctctactgt

SEQ ID NO: 5738 - DNA, 20 bp, Artificial Sequence
  Description of Artificial Sequence: Synthetic oligonucleotide
  Target: ATXN1; (-) strand; PAM type: NAAAAC; PAM sequence: TAAAAC
aatggtctttcccttctgtt

SEQ ID NO: 5739 - DNA, 20 bp, Artificial Sequence
  Description of Artificial Sequence: Synthetic oligonucleotide
  Target: ATXN1; (-) strand; PAM type: NAAAAC; PAM sequence: CAAAAC
tagctctttttgccttcctg

SEQ ID NO: 5740 - DNA, 20 bp, Artificial Sequence
  Description of Artificial Sequence: Synthetic oligonucleotide
  Target: ATXN1; (-) strand; PAM type: NAAAAC; PAM sequence: AAAAAC
gcagacagatgccagaaaaa

SEQ ID NO: 5741 - DNA, 20 bp, Artificial Sequence
  Description of Artificial Sequence: Synthetic oligonucleotide
  Target: ATXN1; (-) strand; PAM type: NAAAAC; PAM sequence: CAAAAC
ctcaagattagatctgctgt

SEQ ID NO: 5742 - DNA, 20 bp, Artificial Sequence
  Description of Artificial Sequence: Synthetic oligonucleotide
  Target: ATXN1; (-) strand; PAM type: NAAAAC; PAM sequence: AAAAAC
gaaggaaggagaaaacctat

SEQ ID NO: 5743 - DNA, 20 bp, Artificial Sequence
  Description of Artificial Sequence: Synthetic oligonucleotide
  Target: ATXN1; (-) strand; PAM type: NAAAAC; PAM sequence: GAAAAC
taaccacagtgaaggaagga

SEQ ID NO: 5744 - DNA, 20 bp, Artificial Sequence
  Description of Artificial Sequence: Synthetic oligonucleotide
  Target: ATXN1; (-) strand; PAM type: NAAAAC; PAM sequence: AAAAAC
tgaaacctggaaatgatagg

SEQ ID NO: 5745 - DNA, 20 bp, Artificial Sequence
  Description of Artificial Sequence: Synthetic oligonucleotide
  Target: ATXN1; (-) strand; PAM type: NAAAAC; PAM sequence: TAAAAC
ctatctctacaaaaaaaatt

SEQ ID NO: 5746 - DNA, 20 bp, Artificial Sequence
  Description of Artificial Sequence: Synthetic oligonucleotide
  Target: ATXN1; (-) strand; PAM type: NAAAAC; PAM sequence: TAAAAC
ggaaccggccatggcatatc

SEQ ID NO: 5747 - DNA, 20 bp, Artificial Sequence
  Description of Artificial Sequence: Synthetic oligonucleotide
  Target: ATXN1; (-) strand; PAM type: NAAAAC; PAM sequence: GAAAAC
ttttatctctatgacaagct

SEQ ID NO: 5748 - DNA, 20 bp, Artificial Sequence
  Description of Artificial Sequence: Synthetic oligonucleotide
  Target: ATXN1; (-) strand; PAM type: NAAAAC; PAM sequence: AAAAAC
atactgaactttatagaaga

SEQ ID NO: 5749 - DNA, 20 bp, Artificial Sequence
  Description of Artificial Sequence: Synthetic oligonucleotide
  Target: ATXN1; (-) strand; PAM type: NAAAAC; PAM sequence: CAAAAC
atgctgtgttcccaaggtac

SEQ ID NO: 5750 - DNA, 20 bp, Artificial Sequence
  Description of Artificial Sequence: Synthetic oligonucleotide
  Target: ATXN1; (-) strand; PAM type: NAAAAC; PAM sequence: AAAAAC
tactgttggaccatactcat

SEQ ID NO: 5751 - DNA, 20 bp, Artificial Sequence
  Description of Artificial Sequence: Synthetic oligonucleotide
  Target: ATXN1; (-) strand; PAM type: NAAAAC; PAM sequence: CAAAAC
gactccatcaaaaaacaaaa

SEQ ID NO: 5752 - DNA, 20 bp, Artificial Sequence
  Description of Artificial Sequence: Synthetic oligonucleotide
  Target: ATXN1; (-) strand; PAM type: NAAAAC; PAM sequence: CAAAAC
agtgagactccatcaaaaaa

SEQ ID NO: 5753 - DNA, 20 bp, Artificial Sequence
  Description of Artificial Sequence: Synthetic oligonucleotide
  Target: ATXN1; (-) strand; PAM type: NAAAAC; PAM sequence: AAAAAC
gacagagtgagactccatca

SEQ ID NO: 5754 - DNA, 20 bp, Artificial Sequence
  Description of Artificial Sequence: Synthetic oligonucleotide
  Target: ATXN1; (-) strand; PAM type: NAAAAC; PAM sequence: AAAAAC
aaatctaaaattatcttcaa

SEQ ID NO: 5755 - DNA, 20 bp, Artificial Sequence
  Description of Artificial Sequence: Synthetic oligonucleotide
  Target: ATXN1; (-) strand; PAM type: NAAAAC; PAM sequence: AAAAAC
aaaaaaagcctgtttggtgc

SEQ ID NO: 5756 - DNA, 20 bp, Artificial Sequence
  Description of Artificial Sequence: Synthetic oligonucleotide
  Target: ATXN1; (-) strand; PAM type: NAAAAC; PAM sequence: GAAAAC
aacgaggaaggaagcagtat

SEQ ID NO: 5757 - DNA, 20 bp, Artificial Sequence
  Description of Artificial Sequence: Synthetic oligonucleotide
  Target: ATXN1; (-) strand; PAM type: NAAAAC; PAM sequence: AAAAAC
attattccctgtgaaggaat

SEQ ID NO: 5758 - DNA, 20 bp, Artificial Sequence
  Description of Artificial Sequence: Synthetic oligonucleotide
  Target: ATXN1; (-) strand; PAM type: NAAAAC; PAM sequence: GAAAAC
tgaactgactgaccagaaag

SEQ ID NO: 5759 - DNA, 20 bp, Artificial Sequence
  Description of Artificial Sequence: Synthetic oligonucleotide
  Target: ATXN1; (-) strand; PAM type: NAAAAC; PAM sequence: TAAAAC
agattccaaaataatcccat

SEQ ID NO: 5760 - DNA, 20 bp, Artificial Sequence
  Description of Artificial Sequence: Synthetic oligonucleotide
  Target: ATXN1; (-) strand; PAM type: NAAAAC; PAM sequence: AAAAAC
acaataaaacaaaccaaaac

SEQ ID NO: 5761 - DNA, 20 bp, Artificial Sequence
  Description of Artificial Sequence: Synthetic oligonucleotide
  Target: ATXN1; (-) strand; PAM type: NAAAAC; PAM sequence: CAAAAC
ggatagacaataaaacaaac

SEQ ID NO: 5762 - DNA, 20 bp, Artificial Sequence
  Description of Artificial Sequence: Synthetic oligonucleotide
  Target: ATXN1; (-) strand; PAM type: NAAAAC; PAM sequence: TAAAAC
tccttctccaggatagacaa

SEQ ID NO: 5763 - DNA, 20 bp, Artificial Sequence
  Description of Artificial Sequence: Synthetic oligonucleotide
  Target: ATXN1; (-) strand; PAM type: NAAAAC; PAM sequence: CAAAAC
aacaaataaacatagccaaa

SEQ ID NO: 5764 - DNA, 20 bp, Artificial Sequence
  Description of Artificial Sequence: Synthetic oligonucleotide
  Target: ATXN1; (-) strand; PAM type: NAAAAC; PAM sequence: CAAAAC
catactactcaaagtgcggg

SEQ ID NO: 5765 - DNA, 20 bp, Artificial Sequence
  Description of Artificial Sequence: Synthetic oligonucleotide
  Target: ATXN1; (-) strand; PAM type: NAAAAC; PAM sequence: TAAAAC
ccatcatctgtgtttactct

SEQ ID NO: 5766 - DNA, 20 bp, Artificial Sequence
  Description of Artificial Sequence: Synthetic oligonucleotide
  Target: ATXN1; (-) strand; PAM type: NAAAAC; PAM sequence: TAAAAC
tcctactgatattaagtatt

SEQ ID NO: 5767 - DNA, 20 bp, Artificial Sequence
  Description of Artificial Sequence: Synthetic oligonucleotide
  Target: ATXN1; (-) strand; PAM type: NAAAAC; PAM sequence: AAAAAC
tcctacagaaacacaaaaag

SEQ ID NO: 5768 - DNA, 20 bp, Artificial Sequence
  Description of Artificial Sequence: Synthetic oligonucleotide
  Target: ATXN1; (-) strand; PAM type: NAAAAC; PAM sequence: GAAAAC
gggcattgaagataatggag

SEQ ID NO: 5769 - DNA, 20 bp, Artificial Sequence
  Description of Artificial Sequence: Synthetic oligonucleotide
  Target: ATXN1; (-) strand; PAM type: NAAAAC; PAM sequence: CAAAAC
tatgaggatgaataagaaaa

SEQ ID NO: 5770 - DNA, 20 bp, Artificial Sequence
  Description of Artificial Sequence: Synthetic oligonucleotide
  Target: ATXN1; (-) strand; PAM type: NAAAAC; PAM sequence: GAAAAC
gtgactatgaggatgaataa

SEQ ID NO: 5771 - DNA, 20 bp, Artificial Sequence
  Description of Artificial Sequence: Synthetic oligonucleotide
  Target: ATXN1; (-) strand; PAM type: NAAAAC; PAM sequence: TAAAAC
tatgaaatgtttaaaatcgt

SEQ ID NO: 5772 - DNA, 20 bp, Artificial Sequence
  Description of Artificial Sequence: Synthetic oligonucleotide
  Target: ATXN1; (-) strand; PAM type: NAAAAC; PAM sequence: GAAAAC
tttccaatgctgagaatttt

SEQ ID NO: 5773 - DNA, 20 bp, Artificial Sequence
  Description of Artificial Sequence: Synthetic oligonucleotide
  Target: ATXN1; (-) strand; PAM type: NAAAAC; PAM sequence: AAAAAC
agtttttgacattctgattt

SEQ ID NO: 5774 - DNA, 20 bp, Artificial Sequence
  Description of Artificial Sequence: Synthetic oligonucleotide
  Target: ATXN1; (-) strand; PAM type: NAAAAC; PAM sequence: CAAAAC
aatcaaagtacagtcaaatc

SEQ ID NO: 5775 - DNA, 20 bp, Artificial Sequence
  Description of Artificial Sequence: Synthetic oligonucleotide
  Target: ATXN1; (-) strand; PAM type: NAAAAC; PAM sequence: GAAAAC
ctattctgcttagatttcca

SEQ ID NO: 5776 - DNA, 20 bp, Artificial Sequence
  Description of Artificial Sequence: Synthetic oligonucleotide
  Target: ATXN1; (-) strand; PAM type: NAAAAC; PAM sequence: GAAAAC
gagtttattgattcgtgggg

SEQ ID NO: 5777 - DNA, 20 bp, Artificial Sequence
  Description of Artificial Sequence: Synthetic oligonucleotide
  Target: ATXN1; (-) strand; PAM type: NAAAAC; PAM sequence: GAAAAC
atgtcatactctgtgtgctg

SEQ ID NO: 5778 - DNA, 20 bp, Artificial Sequence
  Description of Artificial Sequence: Synthetic oligonucleotide
  Target: ATXN1; (-) strand; PAM type: NAAAAC; PAM sequence: TAAAAC
atatgaaagatactggcaaa

SEQ ID NO: 5779 - DNA, 20 bp, Artificial Sequence
  Description of Artificial Sequence: Synthetic oligonucleotide
  Target: ATXN1; (-) strand; PAM type: NAAAAC; PAM sequence: TAAAAC
tttcagtaggacttaatata

SEQ ID NO: 5780 - DNA, 20 bp, Artificial Sequence
  Description of Artificial Sequence: Synthetic oligonucleotide
  Target: ATXN1; (-) strand; PAM type: NAAAAC; PAM sequence: GAAAAC
atgctgatgcatctggaagt

SEQ ID NO: 5781 - DNA, 20 bp, Artificial Sequence
  Description of Artificial Sequence: Synthetic oligonucleotide
  Target: ATXN1; (-) strand; PAM type: NAAAAC; PAM sequence: GAAAAC
aaaggcttgatcacctcttg

SEQ ID NO: 5782 - DNA, 20 bp, Artificial Sequence
  Description of Artificial Sequence: Synthetic oligonucleotide
  Target: ATXN1; (-) strand; PAM type: NAAAAC; PAM sequence: AAAAAC
tagaaacaatattgtgtgaa

SEQ ID NO: 5783 - DNA, 20 bp, Artificial Sequence
  Description of Artificial Sequence: Synthetic oligonucleotide
  Target: ATXN1; (-) strand; PAM type: NAAAAC; PAM sequence: AAAAAC
gcattgtttctaatagaaaa

SEQ ID NO: 5784 - DNA, 20 bp, Artificial Sequence
  Description of Artificial Sequence: Synthetic oligonucleotide
  Target: ATXN1; (-) strand; PAM type: NAAAAC; PAM sequence: TAAAAC
aaaataaggccctacttaat

SEQ ID NO: 5785 - DNA, 20 bp, Artificial Sequence
  Description of Artificial Sequence: Synthetic oligonucleotide
  Target: ATXN1; (-) strand; PAM type: NAAAAC; PAM sequence: TAAAAC
tgggttccagctcactagct

SEQ ID NO: 5786 - DNA, 20 bp, Artificial Sequence
  Description of Artificial Sequence: Synthetic oligonucleotide
  Target: ATXN1; (-) strand; PAM type: NAAAAC; PAM sequence: AAAAAC
attcagtctctgaaaaataa

SEQ ID NO: 5787 - DNA, 20 bp, Artificial Sequence
  Description of Artificial Sequence: Synthetic oligonucleotide
  Target: ATXN1; (-) strand; PAM type: NAAAAC; PAM sequence: TAAAAC
gtgcactcctggtctcctaa

SEQ ID NO: 5788 - DNA, 20 bp, Artificial Sequence
  Description of Artificial Sequence: Synthetic oligonucleotide
  Target: ATXN1; (-) strand; PAM type: NAAAAC; PAM sequence: GAAAAC
tatactgaaatttcaaaaga

SEQ ID NO: 5789 - DNA, 20 bp, Artificial Sequence
  Description of Artificial Sequence: Synthetic oligonucleotide
  Target: ATXN1; (-) strand; PAM type: NAAAAC; PAM sequence: GAAAAC
tgctgtgtagaaagagaggg

SEQ ID NO: 5790 - DNA, 20 bp, Artificial Sequence
  Description of Artificial Sequence: Synthetic oligonucleotide
  Target: ATXN1; (-) strand; PAM type: NAAAAC; PAM sequence: GAAAAC
ggtactgatgcataggaaaa

SEQ ID NO: 5791 - DNA, 20 bp, Artificial Sequence
  Description of Artificial Sequence: Synthetic oligonucleotide
  Target: ATXN1; (-) strand; PAM type: NAAAAC; PAM sequence: AAAAAC
ttcatcttaattattaaata

SEQ ID NO: 5792 - DNA, 20 bp, Artificial Sequence
  Description of Artificial Sequence: Synthetic oligonucleotide
  Target: ATXN1; (-) strand; PAM type: NAAAAC; PAM sequence: TAAAAC
atgggtagtgactttgattt

SEQ ID NO: 5793 - DNA, 20 bp, Artificial Sequence
  Description of Artificial Sequence: Synthetic oligonucleotide
  Target: ATXN1; (-) strand; PAM type: NAAAAC; PAM sequence: GAAAAC
agtcccttggcatggattct

SEQ ID NO: 5794 - DNA, 20 bp, Artificial Sequence
  Description of Artificial Sequence: Synthetic oligonucleotide
  Target: ATXN1; (-) strand; PAM type: NAAAAC; PAM sequence: AAAAAC
ttttttttggtgggcggagc

SEQ ID NO: 5795 - DNA, 20 bp, Artificial Sequence
  Description of Artificial Sequence: Synthetic oligonucleotide
  Target: ATXN1; (-) strand; PAM type: NAAAAC; PAM sequence: TAAAAC
gcctggtcacctgctcgtct

SEQ ID NO: 5796 - DNA, 20 bp, Artificial Sequence
  Description of Artificial Sequence: Synthetic oligonucleotide
  Target: ATXN1; (-) strand; PAM type: NAAAAC; PAM sequence: GAAAAC
ataattcacatatataacat

SEQ ID NO: 5797 - DNA, 20 bp, Artificial Sequence
  Description of Artificial Sequence: Synthetic oligonucleotide
  Target: ATXN1; (-) strand; PAM type: NAAAAC; PAM sequence: CAAAAC
caaacaaacgaacaaacaaa

SEQ ID NO: 5798 - DNA, 20 bp, Artificial Sequence
  Description of Artificial Sequence: Synthetic oligonucleotide
  Target: ATXN1; (-) strand; PAM type: NAAAAC; PAM sequence: AAAAAC
aaaaaaaaacccacaaacaa

SEQ ID NO: 5799 - DNA, 20 bp, Artificial Sequence
  Description of Artificial Sequence: Synthetic oligonucleotide
  Target: ATXN1; (-) strand; PAM type: NAAAAC; PAM sequence: AAAAAC
caaaaaataaaaataaaaaa

SEQ ID NO: 5800 - DNA, 20 bp, Artificial Sequence
  Description of Artificial Sequence: Synthetic oligonucleotide
  Target: ATXN1; (-) strand; PAM type: NAAAAC; PAM sequence: AAAAAC
taagagcaaaagtccgtctc

SEQ ID NO: 5801 - DNA, 20 bp, Artificial Sequence
  Description of Artificial Sequence: Synthetic oligonucleotide
  Target: ATXN1; (-) strand; PAM type: NAAAAC; PAM sequence: CAAAAC
ccccatctctactaaaaata

SEQ ID NO: 5802 - DNA, 20 bp, Artificial Sequence
  Description of Artificial Sequence: Synthetic oligonucleotide
  Target: ATXN1; (-) strand; PAM type: NAAAAC; PAM sequence: TAAAAC
ctggagatctgtttatagca

SEQ ID NO: 5803 - DNA, 20 bp, Artificial Sequence
  Description of Artificial Sequence: Synthetic oligonucleotide
  Target: ATXN1; (-) strand; PAM type: NAAAAC; PAM sequence: CAAAAC
agacagagaggggaaattta

SEQ ID NO: 5804 - DNA, 20 bp, Artificial Sequence
  Description of Artificial Sequence: Synthetic oligonucleotide
  Target: ATXN1; (-) strand; PAM type: NAAAAC; PAM sequence: CAAAAC
tctgagattcttttgctttt

SEQ ID NO: 5805 - DNA, 20 bp, Artificial Sequence
  Description of Artificial Sequence: Synthetic oligonucleotide
  Target: ATXN1; (-) strand; PAM type: NAAAAC; PAM sequence: TAAAAC
tgattttgtattaacagttg

SEQ ID NO: 5806 - DNA, 20 bp, Artificial Sequence
  Description of Artificial Sequence: Synthetic oligonucleotide
  Target: ATXN1; (-) strand; PAM type: NAAAAC; PAM sequence: TAAAAC
tcttatttttgtatatattt

SEQ ID NO: 5807 - DNA, 20 bp, Artificial Sequence
  Description of Artificial Sequence: Synthetic oligonucleotide
  Target: ATXN1; (-) strand; PAM type: NAAAAC; PAM sequence: TAAAAC
tattacatattttaaaaatt

SEQ ID NO: 5808 - DNA, 20 bp, Artificial Sequence
  Description of Artificial Sequence: Synthetic oligonucleotide
  Target: ATXN1; (-) strand; PAM type: NAAAAC; PAM sequence: AAAAAC
caaaaagactgacttgtcaa

SEQ ID NO: 5809 - DNA, 20 bp, Artificial Sequence
  Description of Artificial Sequence: Synthetic oligonucleotide
  Target: ATXN1; (-) strand; PAM type: NAAAAC; PAM sequence: GAAAAC
ttcccacagaatatttaaga

SEQ ID NO: 5810 - DNA, 20 bp, Artificial Sequence
  Description of Artificial Sequence: Synthetic oligonucleotide
  Target: ATXN1; (-) strand; PAM type: NAAAAC; PAM sequence: AAAAAC
caaaaagactgacttgtcaa

SEQ ID NO: 5811 - DNA, 20 bp, Artificial Sequence
  Description of Artificial Sequence: Synthetic oligonucleotide
  Target: ATXN1; (-) strand; PAM type: NAAAAC; PAM sequence: GAAAAC
ttcccacagaatatttaaga

SEQ ID NO: 5812 - DNA, 20 bp, Artificial Sequence
  Description of Artificial Sequence: Synthetic oligonucleotide
  Target: ATXN1; (-) strand; PAM type: NAAAAC; PAM sequence: GAAAAC
tgattatcattgcgttttag

SEQ ID NO: 5813 - DNA, 20 bp, Artificial Sequence
  Description of Artificial Sequence: Synthetic oligonucleotide
  Target: ATXN1; (-) strand; PAM type: NAAAAC; PAM sequence: CAAAAC
ataaataaaaccatggaaag

SEQ ID NO: 5814 - DNA, 20 bp, Artificial Sequence
  Description of Artificial Sequence: Synthetic oligonucleotide
  Target: ATXN1; (-) strand; PAM type: NAAAAC; PAM sequence: TAAAAC
acagcaaattgaccaataaa

SEQ ID NO: 5815 - DNA, 20 bp, Artificial Sequence
  Description of Artificial Sequence: Synthetic oligonucleotide
  Target: ATXN1; (-) strand; PAM type: NAAAAC; PAM sequence: TAAAAC
agactaatttagtcagattt

SEQ ID NO: 5816 - DNA, 20 bp, Artificial Sequence
  Description of Artificial Sequence: Synthetic oligonucleotide
  Target: ATXN1; (-) strand; PAM type: NAAAAC; PAM sequence: AAAAAC
catctttattaagtactaat

SEQ ID NO: 5817 - DNA, 20 bp, Artificial Sequence
  Description of Artificial Sequence: Synthetic oligonucleotide
  Target: ATXN1; (-) strand; PAM type: NAAAAC; PAM sequence: AAAAAC
taaaaaaaaaagaaacaaac

SEQ ID NO: 5818 - DNA, 20 bp, Artificial Sequence
  Description of Artificial Sequence: Synthetic oligonucleotide
  Target: ATXN1; (-) strand; PAM type: NAAAAC; PAM sequence: AAAAAC
ggatgtatatattcatttag

SEQ ID NO: 5819 - DNA, 20 bp, Artificial Sequence
  Description of Artificial Sequence: Synthetic oligonucleotide
  Target: ATXN1; (-) strand; PAM type: NAAAAC; PAM sequence: TAAAAC
agcccactttggagttgaaa

SEQ ID NO: 5820 - DNA, 20 bp, Artificial Sequence
  Description of Artificial Sequence: Synthetic oligonucleotide
  Target: ATXN1; (-) strand; PAM type: NAAAAC; PAM sequence: TAAAAC
acttgtgtatttccagtgtt

SEQ ID NO: 5821 - DNA, 20 bp, Artificial Sequence
  Description of Artificial Sequence: Synthetic oligonucleotide
  Target: ATXN1; (-) strand; PAM type: NAAAAC; PAM sequence: AAAAAC
atacacactactggcaggct

SEQ ID NO: 5822 - DNA, 20 bp, Artificial Sequence
  Description of Artificial Sequence: Synthetic oligonucleotide
  Target: ATXN1; (-) strand; PAM type: NAAAAC; PAM sequence: TAAAAC
aacaatgaaagtgaatgatc

SEQ ID NO: 5823 - DNA, 20 bp, Artificial Sequence
  Description of Artificial Sequence: Synthetic oligonucleotide
  Target: ATXN1; (-) strand; PAM type: NAAAAC; PAM sequence: AAAAAC
ttaggtattatccagttaac

SEQ ID NO: 5824 - DNA, 20 bp, Artificial Sequence
  Description of Artificial Sequence: Synthetic oligonucleotide
  Target: ATXN1; (-) strand; PAM type: NAAAAC; PAM sequence: TAAAAC
atatgtttttgaagagacag

SEQ ID NO: 5825 - DNA, 20 bp, Artificial Sequence
  Description of Artificial Sequence: Synthetic oligonucleotide
  Target: ATXN1; (-) strand; PAM type: NAAAAC; PAM sequence: CAAAAC
aacccgacctaatactgaaa

SEQ ID NO: 5826 - DNA, 20 bp, Artificial Sequence
  Description of Artificial Sequence: Synthetic oligonucleotide
  Target: ATXN1; (-) strand; PAM type: NAAAAC; PAM sequence: AAAAAC
ctccgaaccttaggctgttc

SEQ ID NO: 5827 - DNA, 20 bp, Artificial Sequence
  Description of Artificial Sequence: Synthetic oligonucleotide
  Target: ATXN1; (-) strand; PAM type: NAAAAC; PAM sequence: GAAAAC
gcgttgtactaggcactggg

SEQ ID NO: 5828 - DNA, 20 bp, Artificial Sequence
  Description of Artificial Sequence: Synthetic oligonucleotide
  Target: ATXN1; (-) strand; PAM type: NAAAAC; PAM sequence: AAAAAC
acagaggaagaccctgactc

SEQ ID NO: 5829 - DNA, 20 bp, Artificial Sequence
  Description of Artificial Sequence: Synthetic oligonucleotide
  Target: ATXN1; (-) strand; PAM type: NAAAAC; PAM sequence: AAAAAC
tgaaaccccgtctctactaa

SEQ ID NO: 5830 - DNA, 20 bp, Artificial Sequence
  Description of Artificial Sequence: Synthetic oligonucleotide
  Target: ATXN1; (-) strand; PAM type: NAAAAC; PAM sequence: AAAAAC
gtggctcagtgtagccaggg

SEQ ID NO: 5831 - DNA, 20 bp, Artificial Sequence
  Description of Artificial Sequence: Synthetic oligonucleotide
  Target: ATXN1; (-) strand; PAM type: NAAAAC; PAM sequence: CAAAAC
caaacaaataaaccaaaaat

SEQ ID NO: 5832 - DNA, 20 bp, Artificial Sequence
  Description of Artificial Sequence: Synthetic oligonucleotide
  Target: ATXN1; (-) strand; PAM type: NAAAAC; PAM sequence: CAAAAC
tgggccttggggaaacaaaa

SEQ ID NO: 5833 - DNA, 20 bp, Artificial Sequence
  Description of Artificial Sequence: Synthetic oligonucleotide
  Target: ATXN1; (-) strand; PAM type: NAAAAC; PAM sequence: CAAAAC
acggctgggccttggggaaa

SEQ ID NO: 5834 - DNA, 20 bp, Artificial Sequence
  Description of Artificial Sequence: Synthetic oligonucleotide
  Target: ATXN1; (-) strand; PAM type: NAAAAC; PAM sequence: AAAAAC
ggaggaggaagaggagcaga

SEQ ID NO: 5835 - DNA, 20 bp, Artificial Sequence
  Description of Artificial Sequence: Synthetic oligonucleotide
  Target: ATXN1; (-) strand; PAM type: NAAAAC; PAM sequence: AAAAAC
agcaaactatcacaggaaca

SEQ ID NO: 5836 - DNA, 20 bp, Artificial Sequence
  Description of Artificial Sequence: Synthetic oligonucleotide
  Target: ATXN1; (-) strand; PAM type: NAAAAC; PAM sequence: AAAAAC
ccatctctactaaaaaatac

SEQ ID NO: 5837 - DNA, 20 bp, Artificial Sequence
  Description of Artificial Sequence: Synthetic oligonucleotide
  Target: ATXN1; (-) strand; PAM type: NAAAAC; PAM sequence: AAAAAC
gacatgatttatatgacagg

SEQ ID NO: 5838 - DNA, 20 bp, Artificial Sequence
  Description of Artificial Sequence: Synthetic oligonucleotide
  Target: ATXN1; (-) strand; PAM type: NAAAAC; PAM sequence: AAAAAC
atccttcttatcatgattat

SEQ ID NO: 5839 - DNA, 20 bp, Artificial Sequence
  Description of Artificial Sequence: Synthetic oligonucleotide
  Target: ATXN1; (-) strand; PAM type: NAAAAC; PAM sequence: TAAAAC
agcctctgttttctcagctt

SEQ ID NO: 5840 - DNA, 20 bp, Artificial Sequence
  Description of Artificial Sequence: Synthetic oligonucleotide
  Target: ATXN1; (-) strand; PAM type: NAAAAC; PAM sequence: TAAAAC
tcctatagaagtgtgggtca

SEQ ID NO: 5841 - DNA, 20 bp, Artificial Sequence
  Description of Artificial Sequence: Synthetic oligonucleotide
  Target: ATXN1; (-) strand; PAM type: NAAAAC; PAM sequence: CAAAAC
taaagtggtgggatctgaaa

SEQ ID NO: 5842 - DNA, 20 bp, Artificial Sequence
  Description of Artificial Sequence: Synthetic oligonucleotide
  Target: ATXN1; (-) strand; PAM type: NAAAAC; PAM sequence: AAAAAC
gcaaattgaaaaattcttca

SEQ ID NO: 5843 - DNA, 20 bp, Artificial Sequence
  Description of Artificial Sequence: Synthetic oligonucleotide
  Target: ATXN1; (-) strand; PAM type: NAAAAC; PAM sequence: CAAAAC
ttgcctgtgtgaattcaaat

SEQ ID NO: 5844 - DNA, 20 bp, Artificial Sequence
  Description of Artificial Sequence: Synthetic oligonucleotide
  Target: ATXN1; (-) strand; PAM type: NAAAAC; PAM sequence: TAAAAC
aaactggaaaagaaaactga

SEQ ID NO: 5845 - DNA, 20 bp, Artificial Sequence
  Description of Artificial Sequence: Synthetic oligonucleotide
  Target: ATXN1; (-) strand; PAM type: NAAAAC; PAM sequence: GAAAAC
tcccttccaaaactggaaaa

SEQ ID NO: 5846 - DNA, 20 bp, Artificial Sequence
  Description of Artificial Sequence: Synthetic oligonucleotide
  Target: ATXN1; (-) strand; PAM type: NAAAAC; PAM sequence: CAAAAC
gtttcaagggctttcccttc

SEQ ID NO: 5847 - DNA, 20 bp, Artificial Sequence
  Description of Artificial Sequence: Synthetic oligonucleotide
  Target: ATXN1; (-) strand; PAM type: NAAAAC; PAM sequence: AAAAAC
ggaattgtgggtgcttgggg

SEQ ID NO: 5848 - DNA, 20 bp, Artificial Sequence
  Description of Artificial Sequence: Synthetic oligonucleotide
  Target: ATXN1; (-) strand; PAM type: NAAAAC; PAM sequence: GAAAAC
tattatcctcctacagatga

SEQ ID NO: 5849 - DNA, 20 bp, Artificial Sequence
  Description of Artificial Sequence: Synthetic oligonucleotide
  Target: ATXN1; (-) strand; PAM type: NAAAAC; PAM sequence: AAAAAC
acaaaacagtgactatacta

SEQ ID NO: 5850 - DNA, 20 bp, Artificial Sequence
  Description of Artificial Sequence: Synthetic oligonucleotide
  Target: ATXN1; (-) strand; PAM type: NAAAAC; PAM sequence: CAAAAC
agattgtgatgttggtttta

SEQ ID NO: 5851 - DNA, 20 bp, Artificial Sequence
  Description of Artificial Sequence: Synthetic oligonucleotide
  Target: ATXN1; (-) strand; PAM type: NAAAAC; PAM sequence: CAAAAC
gctacaacatagatgaacct

SEQ ID NO: 5852 - DNA, 20 bp, Artificial Sequence
  Description of Artificial Sequence: Synthetic oligonucleotide
  Target: ATXN1; (-) strand; PAM type: NAAAAC; PAM sequence: AAAAAC
aatggaatattgatcaggaa

SEQ ID NO: 5853 - DNA, 20 bp, Artificial Sequence
  Description of Artificial Sequence: Synthetic oligonucleotide
  Target: ATXN1; (-) strand; PAM type: NAAAAC; PAM sequence: CAAAAC
gcaattgtaaacaaaagtga

SEQ ID NO: 5854 - DNA, 20 bp, Artificial Sequence
  Description of Artificial Sequence: Synthetic oligonucleotide
  Target: ATXN1; (-) strand; PAM type: NAAAAC; PAM sequence: CAAAAC
ttgagcttgttttcctgcaa

SEQ ID NO: 5855 - DNA, 20 bp, Artificial Sequence
  Description of Artificial Sequence: Synthetic oligonucleotide
  Target: ATXN1; (-) strand; PAM type: NAAAAC; PAM sequence: GAAAAC
tctggggaaaccggaacctt

SEQ ID NO: 5856 - DNA, 20 bp, Artificial Sequence
  Description of Artificial Sequence: Synthetic oligonucleotide
  Target: ATXN1; (-) strand; PAM type: NAAAAC; PAM sequence: GAAAAC
gtcacaggaccatgggaaag

SEQ ID NO: 5857 - DNA, 20 bp, Artificial Sequence
  Description of Artificial Sequence: Synthetic oligonucleotide
  Target: ATXN1; (-) strand; PAM type: NAAAAC; PAM sequence: TAAAAC
gtgcatatgtatgcattaat

SEQ ID NO: 5858 - DNA, 20 bp, Artificial Sequence
  Description of Artificial Sequence: Synthetic oligonucleotide
  Target: ATXN1; (-) strand; PAM type: NAAAAC; PAM sequence: CAAAAC
ggtgtgtggttcatggtgaa

SEQ ID NO: 5859 - DNA, 20 bp, Artificial Sequence
  Description of Artificial Sequence: Synthetic oligonucleotide
  Target: ATXN1; (-) strand; PAM type: NAAAAC; PAM sequence: GAAAAC
ggtgttgtgttagcaggcgt

SEQ ID NO: 5860 - DNA, 20 bp, Artificial Sequence
  Description of Artificial Sequence: Synthetic oligonucleotide
  Target: ATXN1; (-) strand; PAM type: NAAAAC; PAM sequence: AAAAAC
ttttaaaatgctttattgct

SEQ ID NO: 5861 - DNA, 20 bp, Artificial Sequence
  Description of Artificial Sequence: Synthetic oligonucleotide
  Target: ATXN1; (-) strand; PAM type: NAAAAC; PAM sequence: CAAAAC
tgttttcaaagcttccttaa

SEQ ID NO: 5862 - DNA, 20 bp, Artificial Sequence
  Description of Artificial Sequence: Synthetic oligonucleotide
  Target: ATXN1; (-) strand; PAM type: NAAAAC; PAM sequence: AAAAAC
acaaacaaacaaacaaacaa

SEQ ID NO: 5863 - DNA, 20 bp, Artificial Sequence
  Description of Artificial Sequence: Synthetic oligonucleotide
  Target: ATXN1; (-) strand; PAM type: NAAAAC; PAM sequence: CAAAAC
agacttcttctcaaaaaaaa

SEQ ID NO: 5864 - DNA, 20 bp, Artificial Sequence
  Description of Artificial Sequence: Synthetic oligonucleotide
  Target: ATXN1; (-) strand; PAM type: NAAAAC; PAM sequence: AAAAAC
gagcgagacttcttctcaaa

SEQ ID NO: 5865 - DNA, 20 bp, Artificial Sequence
  Description of Artificial Sequence: Synthetic oligonucleotide
  Target: ATXN1; (-) strand; PAM type: NAAAAC; PAM sequence: TAAAAC
aatccatgaaataagaaaaa

SEQ ID NO: 5866 - DNA, 20 bp, Artificial Sequence
  Description of Artificial Sequence: Synthetic oligonucleotide
  Target: ATXN1; (-) strand; PAM type: NAAAAC; PAM sequence: AAAAAC
catcctaagtacctagtgac

SEQ ID NO: 5867 - DNA, 20 bp, Artificial Sequence
  Description of Artificial Sequence: Synthetic oligonucleotide
  Target: ATXN1; (-) strand; PAM type: NAAAAC; PAM sequence: AAAAAC
cctgatctttgcattcattt

SEQ ID NO: 5868 - DNA, 20 bp, Artificial Sequence
  Description of Artificial Sequence: Synthetic oligonucleotide
  Target: ATXN1; (-) strand; PAM type: NAAAAC; PAM sequence: AAAAAC
gctatttaatattacatgtc

SEQ ID NO: 5869 - DNA, 20 bp, Artificial Sequence
  Description of Artificial Sequence: Synthetic oligonucleotide
  Target: ATXN1; (-) strand; PAM type: NAAAAC; PAM sequence: AAAAAC
gccatatttatgaagttact

SEQ ID NO: 5870 - DNA, 20 bp, Artificial Sequence
  Description of Artificial Sequence: Synthetic oligonucleotide
  Target: ATXN1; (-) strand; PAM type: NAAAAC; PAM sequence: CAAAAC
gtctcaaggaaaaaaaaaaa

SEQ ID NO: 5871 - DNA, 20 bp, Artificial Sequence
  Description of Artificial Sequence: Synthetic oligonucleotide
  Target: ATXN1; (-) strand; PAM type: NAAAAC; PAM sequence: AAAAAC
agctcgtctcaaggaaaaaa

SEQ ID NO: 5872 - DNA, 20 bp, Artificial Sequence
  Description of Artificial Sequence: Synthetic oligonucleotide
  Target: ATXN1; (-) strand; PAM type: NAAAAC; PAM sequence: GAAAAC
ccacaaaggctagaagtaaa

SEQ ID NO: 5873 - DNA, 20 bp, Artificial Sequence
  Description of Artificial Sequence: Synthetic oligonucleotide
  Target: ATXN1; (-) strand; PAM type: NAAAAC; PAM sequence: GAAAAC
aaaaaggaaaacgacggaca

SEQ ID NO: 5874 - DNA, 20 bp, Artificial Sequence
  Description of Artificial Sequence: Synthetic oligonucleotide
  Target: ATXN1; (-) strand; PAM type: NAAAAC; PAM sequence: GAAAAC
ggatttatagacagaaaaag

SEQ ID NO: 5875 - DNA, 20 bp, Artificial Sequence
  Description of Artificial Sequence: Synthetic oligonucleotide
  Target: ATXN1; (-) strand; PAM type: NAAAAC; PAM sequence: AAAAAC
ataatctaatgtgttaaaag

SEQ ID NO: 5876 - DNA, 20 bp, Artificial Sequence
  Description of Artificial Sequence: Synthetic oligonucleotide
  Target: ATXN1; (-) strand; PAM type: NAAAAC; PAM sequence: CAAAAC
tttcttctaacaggcatcat

SEQ ID NO: 5877 - DNA, 20 bp, Artificial Sequence
  Description of Artificial Sequence: Synthetic oligonucleotide
  Target: ATXN1; (-) strand; PAM type: NAAAAC; PAM sequence: TAAAAC
tggttttgtatagctgtgag

SEQ ID NO: 5878 - DNA, 20 bp, Artificial Sequence
  Description of Artificial Sequence: Synthetic oligonucleotide
  Target: ATXN1; (-) strand; PAM type: NAAAAC; PAM sequence: GAAAAC
caagtaaccatccatggtag

SEQ ID NO: 5879 - DNA, 20 bp, Artificial Sequence
  Description of Artificial Sequence: Synthetic oligonucleotide
  Target: ATXN1; (-) strand; PAM type: NAAAAC; PAM sequence: TAAAAC
tctaaactataaataaatga

SEQ ID NO: 5880 - DNA, 20 bp, Artificial Sequence
  Description of Artificial Sequence: Synthetic oligonucleotide
  Target: ATXN1; (-) strand; PAM type: NAAAAC; PAM sequence: GAAAAC
ccagatactccattttagct

SEQ ID NO: 5881 - DNA, 20 bp, Artificial Sequence
  Description of Artificial Sequence: Synthetic oligonucleotide
  Target: ATXN1; (-) strand; PAM type: NAAAAC; PAM sequence: AAAAAC
ttagaaaaaagaacaaaagc

SEQ ID NO: 5882 - DNA, 20 bp, Artificial Sequence
  Description of Artificial Sequence: Synthetic oligonucleotide
  Target: ATXN1; (-) strand; PAM type: NAAAAC; PAM sequence: AAAAAC
ctctcaaatggccattgtca

SEQ ID NO: 5883 - DNA, 20 bp, Artificial Sequence
  Description of Artificial Sequence: Synthetic oligonucleotide
  Target: ATXN1; (-) strand; PAM type: NAAAAC; PAM sequence: TAAAAC
tgagtgggagctgagttaca

SEQ ID NO: 5884 - DNA, 20 bp, Artificial Sequence
  Description of Artificial Sequence: Synthetic oligonucleotide
  Target: ATXN1; (-) strand; PAM type: NAAAAC; PAM sequence: TAAAAC
tactggtaaatttttcaaac

SEQ ID NO: 5885 - DNA, 20 bp, Artificial Sequence
  Description of Artificial Sequence: Synthetic oligonucleotide
  Target: ATXN1; (-) strand; PAM type: NAAAAC; PAM sequence: CAAAAC
ttattttcttatggcaaaaa

SEQ ID NO: 5886 - DNA, 20 bp, Artificial Sequence
  Description of Artificial Sequence: Synthetic oligonucleotide
  Target: ATXN1; (-) strand; PAM type: NAAAAC; PAM sequence: AAAAAC
tgaatttattttcttatggc

SEQ ID NO: 5887 - DNA, 20 bp, Artificial Sequence
  Description of Artificial Sequence: Synthetic oligonucleotide
  Target: ATXN1; (-) strand; PAM type: NAAAAC; PAM sequence: GAAAAC
ccaaaatgtctatcaaattg

SEQ ID NO: 5888 - DNA, 20 bp, Artificial Sequence
  Description of Artificial Sequence: Synthetic oligonucleotide
  Target: ATXN1; (-) strand; PAM type: NAAAAC; PAM sequence: AAAAAC
tgaaacattcaaatacatgt

SEQ ID NO: 5889 - DNA, 20 bp, Artificial Sequence
  Description of Artificial Sequence: Synthetic oligonucleotide
  Target: ATXN1; (-) strand; PAM type: NAAAAC; PAM sequence: CAAAAC
aaaaaaaaaaaaaaaaaaac

SEQ ID NO: 5890 - DNA, 20 bp, Artificial Sequence
  Description of Artificial Sequence: Synthetic oligonucleotide
  Target: ATXN1; (-) strand; PAM type: NAAAAC; PAM sequence: AAAAAC
caaaaaaaaaaaaaaaaaaa

SEQ ID NO: 5891 - DNA, 20 bp, Artificial Sequence
  Description of Artificial Sequence: Synthetic oligonucleotide
  Target: ATXN1; (-) strand; PAM type: NAAAAC; PAM sequence: CAAAAC
ctccagcctgggtgaaagag

SEQ ID NO: 5892 - DNA, 20 bp, Artificial Sequence
  Description of Artificial Sequence: Synthetic oligonucleotide
  Target: ATXN1; (-) strand; PAM type: NAAAAC; PAM sequence: TAAAAC
tactccaaatcttagtggct

SEQ ID NO: 5893 - DNA, 20 bp, Artificial Sequence
  Description of Artificial Sequence: Synthetic oligonucleotide
  Target: ATXN1; (-) strand; PAM type: NAAAAC; PAM sequence: CAAAAC
tccagcctgggcaacaagag

SEQ ID NO: 5894 - DNA, 20 bp, Artificial Sequence
  Description of Artificial Sequence: Synthetic oligonucleotide
  Target: ATXN1; (-) strand; PAM type: NAAAAC; PAM sequence: GAAAAC
taccactgagtagtttcagg

SEQ ID NO: 5895 - DNA, 20 bp, Artificial Sequence
  Description of Artificial Sequence: Synthetic oligonucleotide
  Target: ATXN1; (-) strand; PAM type: NAAAAC; PAM sequence: CAAAAC
tacagcctgggcaacaagag

SEQ ID NO: 5896 - DNA, 20 bp, Artificial Sequence
  Description of Artificial Sequence: Synthetic oligonucleotide
  Target: ATXN1; (-) strand; PAM type: NAAAAC; PAM sequence: AAAAAC
aataaataaataaaaaatta

SEQ ID NO: 5897 - DNA, 20 bp, Artificial Sequence
  Description of Artificial Sequence: Synthetic oligonucleotide
  Target: ATXN1; (-) strand; PAM type: NAAAAC; PAM sequence: AAAAAC
atattccatcagtatggatc

SEQ ID NO: 5898 - DNA, 20 bp, Artificial Sequence
  Description of Artificial Sequence: Synthetic oligonucleotide
  Target: ATXN1; (-) strand; PAM type: NAAAAC; PAM sequence: TAAAAC
gatgcatcacatgcctttaa

SEQ ID NO: 5899 - DNA, 20 bp, Artificial Sequence
  Description of Artificial Sequence: Synthetic oligonucleotide
  Target: ATXN1; (-) strand; PAM type: NAAAAC; PAM sequence: AAAAAC
aatctgattgactttcttaa

SEQ ID NO: 5900 - DNA, 20 bp, Artificial Sequence
  Description of Artificial Sequence: Synthetic oligonucleotide
  Target: ATXN1; (-) strand; PAM type: NAAAAC; PAM sequence: AAAAAC
ccaaatttatcccaaccttt

SEQ ID NO: 5901 - DNA, 20 bp, Artificial Sequence
  Description of Artificial Sequence: Synthetic oligonucleotide
  Target: ATXN1; (-) strand; PAM type: NAAAAC; PAM sequence: GAAAAC
caaccaaacaacatatcaca

SEQ ID NO: 5902 - DNA, 20 bp, Artificial Sequence
  Description of Artificial Sequence: Synthetic oligonucleotide
  Target: ATXN1; (-) strand; PAM type: NAAAAC; PAM sequence: TAAAAC
cgatcatgtacccataaaaa

SEQ ID NO: 5903 - DNA, 20 bp, Artificial Sequence
  Description of Artificial Sequence: Synthetic oligonucleotide
  Target: ATXN1; (-) strand; PAM type: NAAAAC; PAM sequence: AAAAAC
aataagaaaacaaaaacaaa

SEQ ID NO: 5904 - DNA, 20 bp, Artificial Sequence
  Description of Artificial Sequence: Synthetic oligonucleotide
  Target: ATXN1; (-) strand; PAM type: NAAAAC; PAM sequence: AAAAAC
aaacaaaaaaataagaaaac

SEQ ID NO: 5905 - DNA, 20 bp, Artificial Sequence
  Description of Artificial Sequence: Synthetic oligonucleotide
  Target: ATXN1; (-) strand; PAM type: NAAAAC; PAM sequence: GAAAAC
taataaaaacaaaaaaataa

SEQ ID NO: 5906 - DNA, 20 bp, Artificial Sequence
  Description of Artificial Sequence: Synthetic oligonucleotide
  Target: ATXN1; (-) strand; PAM type: NAAAAC; PAM sequence: AAAAAC
taccctaaaactttagtaat

SEQ ID NO: 5907 - DNA, 20 bp, Artificial Sequence
  Description of Artificial Sequence: Synthetic oligonucleotide
  Target: ATXN1; (-) strand; PAM type: NAAAAC; PAM sequence: TAAAAC
cacattgtgcacatgtaccc

SEQ ID NO: 5908 - DNA, 20 bp, Artificial Sequence
  Description of Artificial Sequence: Synthetic oligonucleotide
  Target: ATXN1; (-) strand; PAM type: NAAAAC; PAM sequence: AAAAAC
ttaaaaataaaatcaacgtt

SEQ ID NO: 5909 - DNA, 20 bp, Artificial Sequence
  Description of Artificial Sequence: Synthetic oligonucleotide
  Target: ATXN1; (-) strand; PAM type: NAAAAC; PAM sequence: GAAAAC
cagtttgtggcattcctact

SEQ ID NO: 5910 - DNA, 20 bp, Artificial Sequence
  Description of Artificial Sequence: Synthetic oligonucleotide
  Target: ATXN1; (-) strand; PAM type: NAAAAC; PAM sequence: AAAAAC
gttaggtttcagaggaaggc

SEQ ID NO: 5911 - DNA, 20 bp, Artificial Sequence
  Description of Artificial Sequence: Synthetic oligonucleotide
  Target: ATXN1; (-) strand; PAM type: NAAAAC; PAM sequence: GAAAAC
tgattaatagcagtgattca

SEQ ID NO: 5912 - DNA, 20 bp, Artificial Sequence
  Description of Artificial Sequence: Synthetic oligonucleotide
  Target: ATXN1; (-) strand; PAM type: NAAAAC; PAM sequence: TAAAAC
tacctaatgcatttggggct

SEQ ID NO: 5913 - DNA, 20 bp, Artificial Sequence
  Description of Artificial Sequence: Synthetic oligonucleotide
  Target: ATXN1; (-) strand; PAM type: NAAAAC; PAM sequence: AAAAAC
aaaatatagatgagccaagt

SEQ ID NO: 5914 - DNA, 20 bp, Artificial Sequence
  Description of Artificial Sequence: Synthetic oligonucleotide
  Target: ATXN1; (-) strand; PAM type: NAAAAC; PAM sequence: AAAAAC
aaaagtcaaattgagttcta

SEQ ID NO: 5915 - DNA, 20 bp, Artificial Sequence
  Description of Artificial Sequence: Synthetic oligonucleotide
  Target: ATXN1; (-) strand; PAM type: NAAAAC; PAM sequence: TAAAAC
ttttcacttgtttagaaatg

SEQ ID NO: 5916 - DNA, 20 bp, Artificial Sequence
  Description of Artificial Sequence: Synthetic oligonucleotide
  Target: ATXN1; (-) strand; PAM type: NAAAAC; PAM sequence: TAAAAC
agaaactcaaatacctattt

SEQ ID NO: 5917 - DNA, 20 bp, Artificial Sequence
  Description of Artificial Sequence: Synthetic oligonucleotide
  Target: ATXN1; (-) strand; PAM type: NAAAAC; PAM sequence: GAAAAC
ttttaatgcagtatgacaca

SEQ ID NO: 5918 - DNA, 20 bp, Artificial Sequence
  Description of Artificial Sequence: Synthetic oligonucleotide
  Target: ATXN1; (-) strand; PAM type: NAAAAC; PAM sequence: GAAAAC
tttttgatcgtcccaaatgg

SEQ ID NO: 5919 - DNA, 20 bp, Artificial Sequence
  Description of Artificial Sequence: Synthetic oligonucleotide
  Target: ATXN1; (-) strand; PAM type: NAAAAC; PAM sequence: TAAAAC
tgtaagaatatatatatata

SEQ ID NO: 5920 - DNA, 20 bp, Artificial Sequence
  Description of Artificial Sequence: Synthetic oligonucleotide
  Target: ATXN1; (-) strand; PAM type: NAAAAC; PAM sequence: AAAAAC
gtttaagtcatgttcttggc

SEQ ID NO: 5921 - DNA, 20 bp, Artificial Sequence
  Description of Artificial Sequence: Synthetic oligonucleotide
  Target: ATXN1; (-) strand; PAM type: NAAAAC; PAM sequence: CAAAAC
gagcagaattcagaactaca

SEQ ID NO: 5922 - DNA, 20 bp, Artificial Sequence
  Description of Artificial Sequence: Synthetic oligonucleotide
  Target: ATXN1; (-) strand; PAM type: NAAAAC; PAM sequence: AAAAAC
ccatctccacctctccctga

SEQ ID NO: 5923 - DNA, 20 bp, Artificial Sequence
  Description of Artificial Sequence: Synthetic oligonucleotide
  Target: ATXN1; (-) strand; PAM type: NAAAAC; PAM sequence: TAAAAC
tattaaatctggcagggtct

SEQ ID NO: 5924 - DNA, 20 bp, Artificial Sequence
  Description of Artificial Sequence: Synthetic oligonucleotide
  Target: ATXN1; (-) strand; PAM type: NAAAAC; PAM sequence: CAAAAC
tgaatgaagcaagatacagg

SEQ ID NO: 5925 - DNA, 20 bp, Artificial Sequence
  Description of Artificial Sequence: Synthetic oligonucleotide
  Target: ATXN1; (-) strand; PAM type: NAAAAC; PAM sequence: AAAAAC
tattgctagaattttgtgct

SEQ ID NO: 5926 - DNA, 20 bp, Artificial Sequence
  Description of Artificial Sequence: Synthetic oligonucleotide
  Target: ATXN1; (-) strand; PAM type: NAAAAC; PAM sequence: AAAAAC
ttgaacttaaccgcccacat

SEQ ID NO: 5927 - DNA, 20 bp, Artificial Sequence
  Description of Artificial Sequence: Synthetic oligonucleotide
  Target: ATXN1; (-) strand; PAM type: NAAAAC; PAM sequence: GAAAAC
gaatgaagtaatacttgctg

SEQ ID NO: 5928 - DNA, 20 bp, Artificial Sequence
  Description of Artificial Sequence: Synthetic oligonucleotide
  Target: ATXN1; (-) strand; PAM type: NAAAAC; PAM sequence: AAAAAC
taaaagacttcaagacagtg

SEQ ID NO: 5929 - DNA, 20 bp, Artificial Sequence
  Description of Artificial Sequence: Synthetic oligonucleotide
  Target: ATXN1; (-) strand; PAM type: NAAAAC; PAM sequence: AAAAAC
caattctgctcccaccagaa

SEQ ID NO: 5930 - DNA, 20 bp, Artificial Sequence
  Description of Artificial Sequence: Synthetic oligonucleotide
  Target: ATXN1; (-) strand; PAM type: NAAAAC; PAM sequence: AAAAAC
ctgccttgtatataacagtg

SEQ ID NO: 5931 - DNA, 20 bp, Artificial Sequence
  Description of Artificial Sequence: Synthetic oligonucleotide
  Target: ATXN1; (-) strand; PAM type: NAAAAC; PAM sequence: GAAAAC
tgtaagtctatgtggcttca

SEQ ID NO: 5932 - DNA, 20 bp, Artificial Sequence
  Description of Artificial Sequence: Synthetic oligonucleotide
  Target: ATXN1; (-) strand; PAM type: NAAAAC; PAM sequence: TAAAAC
gatcccttgcacatgtactt

SEQ ID NO: 5933 - DNA, 20 bp, Artificial Sequence
  Description of Artificial Sequence: Synthetic oligonucleotide
  Target: ATXN1; (-) strand; PAM type: NAAAAC; PAM sequence: TAAAAC
tcttgccatgtaaaatacta

SEQ ID NO: 5934 - DNA, 20 bp, Artificial Sequence
  Description of Artificial Sequence: Synthetic oligonucleotide
  Target: ATXN1; (-) strand; PAM type: NAAAAC; PAM sequence: GAAAAC
gcagagcaatttgccaggaa

SEQ ID NO: 5935 - DNA, 20 bp, Artificial Sequence
  Description of Artificial Sequence: Synthetic oligonucleotide
  Target: ATXN1; (-) strand; PAM type: NAAAAC; PAM sequence: GAAAAC
cccataaagaatccaataaa

SEQ ID NO: 5936 - DNA, 20 bp, Artificial Sequence
  Description of Artificial Sequence: Synthetic oligonucleotide
  Target: ATXN1; (-) strand; PAM type: NAAAAC; PAM sequence: GAAAAC
caagtttcaataagtcccta

SEQ ID NO: 5937 - DNA, 20 bp, Artificial Sequence
  Description of Artificial Sequence: Synthetic oligonucleotide
  Target: ATXN1; (-) strand; PAM type: NAAAAC; PAM sequence: GAAAAC
ggttttcaaatgtggcttca

SEQ ID NO: 5938 - DNA, 20 bp, Artificial Sequence
  Description of Artificial Sequence: Synthetic oligonucleotide
  Target: ATXN1; (-) strand; PAM type: NAAAAC; PAM sequence: AAAAAC
tccttaattcttcaaaaaaa

SEQ ID NO: 5939 - DNA, 20 bp, Artificial Sequence
  Description of Artificial Sequence: Synthetic oligonucleotide
  Target: ATXN1; (-) strand; PAM type: NAAAAC; PAM sequence: GAAAAC
tttgttcctccccagaaagg

SEQ ID NO: 5940 - DNA, 20 bp, Artificial Sequence
  Description of Artificial Sequence: Synthetic oligonucleotide
  Target: ATXN1; (-) strand; PAM type: NAAAAC; PAM sequence: AAAAAC
tgtatggaggacttttcaaa

SEQ ID NO: 5941 - DNA, 20 bp, Artificial Sequence
  Description of Artificial Sequence: Synthetic oligonucleotide
  Target: ATXN1; (-) strand; PAM type: NAAAAC; PAM sequence: AAAAAC
ctgtgtaacaaggtattacc

SEQ ID NO: 5942 - DNA, 20 bp, Artificial Sequence
  Description of Artificial Sequence: Synthetic oligonucleotide
  Target: ATXN1; (-) strand; PAM type: NAAAAC; PAM sequence: CAAAAC
agactcaagtattgcagttc

SEQ ID NO: 5943 - DNA, 20 bp, Artificial Sequence
  Description of Artificial Sequence: Synthetic oligonucleotide
  Target: ATXN1; (-) strand; PAM type: NAAAAC; PAM sequence: AAAAAC
tgataccctgtctcaaaagt

SEQ ID NO: 5944 - DNA, 20 bp, Artificial Sequence
  Description of Artificial Sequence: Synthetic oligonucleotide
  Target: ATXN1; (-) strand; PAM type: NAAAAC; PAM sequence: CAAAAC
tatagtatatgtagctatat

SEQ ID NO: 5945 - DNA, 20 bp, Artificial Sequence
  Description of Artificial Sequence: Synthetic oligonucleotide
  Target: ATXN1; (-) strand; PAM type: NAAAAC; PAM sequence: AAAAAC
cttcctctcttgtaatggat

SEQ ID NO: 5946 - DNA, 20 bp, Artificial Sequence
  Description of Artificial Sequence: Synthetic oligonucleotide
  Target: ATXN1; (-) strand; PAM type: NAAAAC; PAM sequence: AAAAAC
acatcaaaattaaaattaaa

SEQ ID NO: 5947 - DNA, 20 bp, Artificial Sequence
  Description of Artificial Sequence: Synthetic oligonucleotide
  Target: ATXN1; (-) strand; PAM type: NAAAAC; PAM sequence: AAAAAC
agagcaaaaacagtatttta

SEQ ID NO: 5948 - DNA, 20 bp, Artificial Sequence
  Description of Artificial Sequence: Synthetic oligonucleotide
  Target: ATXN1; (-) strand; PAM type: NAAAAC; PAM sequence: AAAAAC
tgaggctacccaatcagagc

SEQ ID NO: 5949 - DNA, 20 bp, Artificial Sequence
  Description of Artificial Sequence: Synthetic oligonucleotide
  Target: ATXN1; (-) strand; PAM type: NAAAAC; PAM sequence: TAAAAC
gaactgctggaaaagaactg

SEQ ID NO: 5950 - DNA, 20 bp, Artificial Sequence
  Description of Artificial Sequence: Synthetic oligonucleotide
  Target: ATXN1; (-) strand; PAM type: NAAAAC; PAM sequence: GAAAAC
ttctttcattttcctttaca

SEQ ID NO: 5951 - DNA, 20 bp, Artificial Sequence
  Description of Artificial Sequence: Synthetic oligonucleotide
  Target: ATXN1; (-) strand; PAM type: NAAAAC; PAM sequence: AAAAAC
ctcagctttttataaataca

SEQ ID NO: 5952 - DNA, 20 bp, Artificial Sequence
  Description of Artificial Sequence: Synthetic oligonucleotide
  Target: ATXN1; (-) strand; PAM type: NAAAAC; PAM sequence: CAAAAC
gaaaaaaaaaaaagaagtga

SEQ ID NO: 5953 - DNA, 20 bp, Artificial Sequence
  Description of Artificial Sequence: Synthetic oligonucleotide
  Target: ATXN1; (-) strand; PAM type: NAAAAC; PAM sequence: CAAAAC
tggaatttttatgcatgcat

SEQ ID NO: 5954 - DNA, 20 bp, Artificial Sequence
  Description of Artificial Sequence: Synthetic oligonucleotide
  Target: ATXN1; (-) strand; PAM type: NAAAAC; PAM sequence: GAAAAC
tgacattgttagaaagggga

SEQ ID NO: 5955 - DNA, 20 bp, Artificial Sequence
  Description of Artificial Sequence: Synthetic oligonucleotide
  Target: ATXN1; (-) strand; PAM type: NAAAAC; PAM sequence: CAAAAC
tcctctctacacagagaatg

SEQ ID NO: 5956 - DNA, 20 bp, Artificial Sequence
  Description of Artificial Sequence: Synthetic oligonucleotide
  Target: ATXN1; (-) strand; PAM type: NAAAAC; PAM sequence: GAAAAC
tcttggaaatgagaagggga

SEQ ID NO: 5957 - DNA, 20 bp, Artificial Sequence
  Description of Artificial Sequence: Synthetic oligonucleotide
  Target: ATXN1; (-) strand; PAM type: NAAAAC; PAM sequence: TAAAAC
aagcctcgccaacgcttcct

SEQ ID NO: 5958 - DNA, 20 bp, Artificial Sequence
  Description of Artificial Sequence: Synthetic oligonucleotide
  Target: ATXN1; (-) strand; PAM type: NAAAAC; PAM sequence: AAAAAC
gaaattataagtttggtggc

SEQ ID NO: 5959 - DNA, 20 bp, Artificial Sequence
  Description of Artificial Sequence: Synthetic oligonucleotide
  Target: ATXN1; (-) strand; PAM type: NAAAAC; PAM sequence: AAAAAC
cctcaccaaatgagtcaatt

SEQ ID NO: 5960 - DNA, 20 bp, Artificial Sequence
  Description of Artificial Sequence: Synthetic oligonucleotide
  Target: ATXN1; (-) strand; PAM type: NAAAAC; PAM sequence: GAAAAC
tggggtggctatttattggt

SEQ ID NO: 5961 - DNA, 20 bp, Artificial Sequence
  Description of Artificial Sequence: Synthetic oligonucleotide
  Target: ATXN1; (-) strand; PAM type: NAAAAC; PAM sequence: GAAAAC
tttgtttgatggctgaggct

SEQ ID NO: 5962 - DNA, 20 bp, Artificial Sequence
  Description of Artificial Sequence: Synthetic oligonucleotide
  Target: ATXN1; (-) strand; PAM type: NAAAAC; PAM sequence: GAAAAC
aagctgtacactgaacaata

SEQ ID NO: 5963 - DNA, 20 bp, Artificial Sequence
  Description of Artificial Sequence: Synthetic oligonucleotide
  Target: ATXN1; (-) strand; PAM type: NAAAAC; PAM sequence: TAAAAC
ggacatagttactcaatttg

SEQ ID NO: 5964 - DNA, 20 bp, Artificial Sequence
  Description of Artificial Sequence: Synthetic oligonucleotide
  Target: ATXN1; (-) strand; PAM type: NAAAAC; PAM sequence: AAAAAC
tggtgaggtcttacgttaat

SEQ ID NO: 5965 - DNA, 20 bp, Artificial Sequence
  Description of Artificial Sequence: Synthetic oligonucleotide
  Target: ATXN1; (-) strand; PAM type: NAAAAC; PAM sequence: TAAAAC
ggattaagaattttattttt

SEQ ID NO: 5966 - DNA, 20 bp, Artificial Sequence
  Description of Artificial Sequence: Synthetic oligonucleotide
  Target: ATXN1; (-) strand; PAM type: NAAAAC; PAM sequence: GAAAAC
tttccacttagaaatgaggt

SEQ ID NO: 5967 - DNA, 20 bp, Artificial Sequence
  Description of Artificial Sequence: Synthetic oligonucleotide
  Target: ATXN1; (-) strand; PAM type: NAAAAC; PAM sequence: TAAAAC
attccagagtttaaaggtgc

SEQ ID NO: 5968 - DNA, 20 bp, Artificial Sequence
  Description of Artificial Sequence: Synthetic oligonucleotide
  Target: ATXN1; (-) strand; PAM type: NAAAAC; PAM sequence: CAAAAC
tttaactcagtgcgcacctc

SEQ ID NO: 5969 - DNA, 20 bp, Artificial Sequence
  Description of Artificial Sequence: Synthetic oligonucleotide
  Target: ATXN1; (-) strand; PAM type: NAAAAC; PAM sequence: TAAAAC
atagttaaggaactgctccg

SEQ ID NO: 5970 - DNA, 20 bp, Artificial Sequence
  Description of Artificial Sequence: Synthetic oligonucleotide
  Target: ATXN1; (-) strand; PAM type: NAAAAC; PAM sequence: CAAAAC
aaaacctagtgtggggtgag

SEQ ID NO: 5971 - DNA, 20 bp, Artificial Sequence
  Description of Artificial Sequence: Synthetic oligonucleotide
  Target: ATXN1; (-) strand; PAM type: NAAAAC; PAM sequence: TAAAAC
tatccttatatctctttccc

SEQ ID NO: 5972 - DNA, 20 bp, Artificial Sequence
  Description of Artificial Sequence: Synthetic oligonucleotide
  Target: ATXN1; (-) strand; PAM type: NAAAAC; PAM sequence: GAAAAC
agagattcaatagctgttag

SEQ ID NO: 5973 - DNA, 20 bp, Artificial Sequence
  Description of Artificial Sequence: Synthetic oligonucleotide
  Target: ATXN1; (-) strand; PAM type: NAAAAC; PAM sequence: TAAAAC
tttaaatgaaataagacatg

SEQ ID NO: 5974 - DNA, 20 bp, Artificial Sequence
  Description of Artificial Sequence: Synthetic oligonucleotide
  Target: ATXN1; (-) strand; PAM type: NAAAAC; PAM sequence: AAAAAC
aagtttttaaaatttaattt

SEQ ID NO: 5975 - DNA, 20 bp, Artificial Sequence
  Description of Artificial Sequence: Synthetic oligonucleotide
  Target: ATXN1; (-) strand; PAM type: NAAAAC; PAM sequence: AAAAAC
caatattgaaacttcaattc

SEQ ID NO: 5976 - DNA, 20 bp, Artificial Sequence
  Description of Artificial Sequence: Synthetic oligonucleotide
  Target: ATXN1; (-) strand; PAM type: NAAAAC; PAM sequence: GAAAAC
atagctttatggtaaatctt

SEQ ID NO: 5977 - DNA, 20 bp, Artificial Sequence
  Description of Artificial Sequence: Synthetic oligonucleotide
  Target: ATXN1; (-) strand; PAM type: NAAAAC; PAM sequence: AAAAAC
aatgaataaatgttaaaatt

SEQ ID NO: 5978 - DNA, 20 bp, Artificial Sequence
  Description of Artificial Sequence: Synthetic oligonucleotide
  Target: ATXN1; (-) strand; PAM type: NAAAAC; PAM sequence: CAAAAC
gaccagcctgggcagcatag

SEQ ID NO: 5979 - DNA, 20 bp, Artificial Sequence
  Description of Artificial Sequence: Synthetic oligonucleotide
  Target: ATXN1; (-) strand; PAM type: NAAAAC; PAM sequence: CAAAAC
ggcaacagaatgatgtgtcg

SEQ ID NO: 5980 - DNA, 20 bp, Artificial Sequence
  Description of Artificial Sequence: Synthetic oligonucleotide
  Target: ATXN1; (-) strand; PAM type: NAAAAC; PAM sequence: AAAAAC
cctgtctctattaaaaatac

SEQ ID NO: 5981 - DNA, 20 bp, Artificial Sequence
  Description of Artificial Sequence: Synthetic oligonucleotide
  Target: ATXN1; (-) strand; PAM type: NAAAAC; PAM sequence: TAAAAC
ggaagagaacaatttccaaa

SEQ ID NO: 5982 - DNA, 20 bp, Artificial Sequence
  Description of Artificial Sequence: Synthetic oligonucleotide
  Target: ATXN1; (-) strand; PAM type: NAAAAC; PAM sequence: AAAAAC
aaaagaaaaaaaaaaaaagc

SEQ ID NO: 5983 - DNA, 20 bp, Artificial Sequence
  Description of Artificial Sequence: Synthetic oligonucleotide
  Target: ATXN1; (-) strand; PAM type: NAAAAC; PAM sequence: GAAAAC
tgttaacactatttcaaaag

SEQ ID NO: 5984 - DNA, 20 bp, Artificial Sequence
  Description of Artificial Sequence: Synthetic oligonucleotide
  Target: ATXN1; (-) strand; PAM type: NAAAAC; PAM sequence: TAAAAC
atgagtatctttttttgctc

SEQ ID NO: 5985 - DNA, 20 bp, Artificial Sequence
  Description of Artificial Sequence: Synthetic oligonucleotide
  Target: ATXN1; (-) strand; PAM type: NAAAAC; PAM sequence: CAAAAC
gttttctaatctgtagattc

SEQ ID NO: 5986 - DNA, 20 bp, Artificial Sequence
  Description of Artificial Sequence: Synthetic oligonucleotide
  Target: ATXN1; (-) strand; PAM type: NAAAAC; PAM sequence: CAAAAC
atatcctggcaagatttagg

SEQ ID NO: 5987 - DNA, 20 bp, Artificial Sequence
  Description of Artificial Sequence: Synthetic oligonucleotide
  Target: ATXN1; (-) strand; PAM type: NAAAAC; PAM sequence: TAAAAC
tctcactaaaatcacagtgt

SEQ ID NO: 5988 - DNA, 20 bp, Artificial Sequence
  Description of Artificial Sequence: Synthetic oligonucleotide
  Target: ATXN1; (-) strand; PAM type: NAAAAC; PAM sequence: GAAAAC
cagctaggctgaacttagct

SEQ ID NO: 5989 - DNA, 20 bp, Artificial Sequence
  Description of Artificial Sequence: Synthetic oligonucleotide
  Target: ATXN1; (-) strand; PAM type: NAAAAC; PAM sequence: GAAAAC
agctttgtatgaagctagct

SEQ ID NO: 5990 - DNA, 20 bp, Artificial Sequence
  Description of Artificial Sequence: Synthetic oligonucleotide
  Target: ATXN1; (-) strand; PAM type: NAAAAC; PAM sequence: AAAAAC
cctatgtgaaaattcccagt

SEQ ID NO: 5991 - DNA, 20 bp, Artificial Sequence
  Description of Artificial Sequence: Synthetic oligonucleotide
  Target: ATXN1; (-) strand; PAM type: NAAAAC; PAM sequence: AAAAAC
tcccaaattatggtgggtag

SEQ ID NO: 5992 - DNA, 20 bp, Artificial Sequence
  Description of Artificial Sequence: Synthetic oligonucleotide
  Target: ATXN1; (-) strand; PAM type: NAAAAC; PAM sequence: TAAAAC
ttaccagaaacttggtgggt

SEQ ID NO: 5993 - DNA, 20 bp, Artificial Sequence
  Description of Artificial Sequence: Synthetic oligonucleotide
  Target: ATXN1; (-) strand; PAM type: NAAAAC; PAM sequence: AAAAAC
aaatgtgtgagtaattgagt

SEQ ID NO: 5994 - DNA, 20 bp, Artificial Sequence
  Description of Artificial Sequence: Synthetic oligonucleotide
  Target: ATXN1; (-) strand; PAM type: NAAAAC; PAM sequence: GAAAAC
aatgttaaggctgagttaca

SEQ ID NO: 5995 - DNA, 20 bp, Artificial Sequence
  Description of Artificial Sequence: Synthetic oligonucleotide
  Target: ATXN1; (-) strand; PAM type: NAAAAC; PAM sequence: GAAAAC
agataggcacatcttctgag

SEQ ID NO: 5996 - DNA, 20 bp, Artificial Sequence
  Description of Artificial Sequence: Synthetic oligonucleotide
  Target: ATXN1; (-) strand; PAM type: NAAAAC; PAM sequence: GAAAAC
agatcttttgaagcagagca

SEQ ID NO: 5997 - DNA, 20 bp, Artificial Sequence
  Description of Artificial Sequence: Synthetic oligonucleotide
  Target: ATXN1; (-) strand; PAM type: NAAAAC; PAM sequence: AAAAAC
cacattcagagttgttgggt

SEQ ID NO: 5998 - DNA, 20 bp, Artificial Sequence
  Description of Artificial Sequence: Synthetic oligonucleotide
  Target: ATXN1; (-) strand; PAM type: NAAAAC; PAM sequence: AAAAAC
atgctttagtcttatgttaa

SEQ ID NO: 5999 - DNA, 20 bp, Artificial Sequence
  Description of Artificial Sequence: Synthetic oligonucleotide
  Target: ATXN1; (-) strand; PAM type: NAAAAC; PAM sequence: GAAAAC
atgaccatacatgcttagaa

SEQ ID NO: 6000 - DNA, 20 bp, Artificial Sequence
  Description of Artificial Sequence: Synthetic oligonucleotide
  Target: ATXN1; (-) strand; PAM type: NAAAAC; PAM sequence: CAAAAC
atatagccacttccattctt

SEQ ID NO: 6001 - DNA, 20 bp, Artificial Sequence
  Description of Artificial Sequence: Synthetic oligonucleotide
  Target: ATXN1; (-) strand; PAM type: NAAAAC; PAM sequence: TAAAAC
ttttccaagggatcatgtta

SEQ ID NO: 6002 - DNA, 20 bp, Artificial Sequence
  Description of Artificial Sequence: Synthetic oligonucleotide
  Target: ATXN1; (-) strand; PAM type: NAAAAC; PAM sequence: GAAAAC
tcgaaacctaaataaacaca

SEQ ID NO: 6003 - DNA, 20 bp, Artificial Sequence
  Description of Artificial Sequence: Synthetic oligonucleotide
  Target: ATXN1; (-) strand; PAM type: NAAAAC; PAM sequence: GAAAAC
caatcacactcctctggaat

SEQ ID NO: 6004 - DNA, 20 bp, Artificial Sequence
  Description of Artificial Sequence: Synthetic oligonucleotide
  Target: ATXN1; (-) strand; PAM type: NAAAAC; PAM sequence: AAAAAC
ctaaattcggtttctgattc

SEQ ID NO: 6005 - DNA, 20 bp, Artificial Sequence
  Description of Artificial Sequence: Synthetic oligonucleotide
  Target: ATXN1; (-) strand; PAM type: NAAAAC; PAM sequence: TAAAAC
aggaaggaagagaaatactt

SEQ ID NO: 6006 - DNA, 20 bp, Artificial Sequence
  Description of Artificial Sequence: Synthetic oligonucleotide
  Target: ATXN1; (-) strand; PAM type: NAAAAC; PAM sequence: GAAAAC
tttactagaggagagaaaga

SEQ ID NO: 6007 - DNA, 20 bp, Artificial Sequence
  Description of Artificial Sequence: Synthetic oligonucleotide
  Target: ATXN1; (-) strand; PAM type: NAAAAC; PAM sequence: TAAAAC
ttataagtacttaagagagt

SEQ ID NO: 6008 - DNA, 20 bp, Artificial Sequence
  Description of Artificial Sequence: Synthetic oligonucleotide
  Target: ATXN1; (-) strand; PAM type: NAAAAC; PAM sequence: TAAAAC
acagtaaaggaggatgtttt

SEQ ID NO: 6009 - DNA, 20 bp, Artificial Sequence
  Description of Artificial Sequence: Synthetic oligonucleotide
  Target: ATXN1; (-) strand; PAM type: NAAAAC; PAM sequence: CAAAAC
gtctgcctttggctactttg

SEQ ID NO: 6010 - DNA, 20 bp, Artificial Sequence
  Description of Artificial Sequence: Synthetic oligonucleotide
  Target: ATXN1; (-) strand; PAM type: NAAAAC; PAM sequence: GAAAAC
cagctcccaagtttagatga

SEQ ID NO: 6011 - DNA, 20 bp, Artificial Sequence
  Description of Artificial Sequence: Synthetic oligonucleotide
  Target: ATXN1; (-) strand; PAM type: NAAAAC; PAM sequence: GAAAAC
taaatacacaaaggaatttt

SEQ ID NO: 6012 - DNA, 20 bp, Artificial Sequence
  Description of Artificial Sequence: Synthetic oligonucleotide
  Target: ATXN1; (-) strand; PAM type: NAAAAC; PAM sequence: AAAAAC
tgcagttagtccattgtctc

SEQ ID NO: 6013 - DNA, 20 bp, Artificial Sequence
  Description of Artificial Sequence: Synthetic oligonucleotide
  Target: ATXN1; (-) strand; PAM type: NAAAAC; PAM sequence: AAAAAC
atttacttccatgaaattac

SEQ ID NO: 6014 - DNA, 20 bp, Artificial Sequence
  Description of Artificial Sequence: Synthetic oligonucleotide
  Target: ATXN1; (-) strand; PAM type: NAAAAC; PAM sequence: TAAAAC
aatacctggtatggtgggtg

SEQ ID NO: 6015 - DNA, 20 bp, Artificial Sequence
  Description of Artificial Sequence: Synthetic oligonucleotide
  Target: ATXN1; (-) strand; PAM type: NAAAAC; PAM sequence: AAAAAC
gggcacttcataacacaatc

SEQ ID NO: 6016 - DNA, 20 bp, Artificial Sequence
  Description of Artificial Sequence: Synthetic oligonucleotide
  Target: ATXN1; (-) strand; PAM type: NAAAAC; PAM sequence: AAAAAC
gtcagttcctttatgtttct

SEQ ID NO: 6017 - DNA, 20 bp, Artificial Sequence
  Description of Artificial Sequence: Synthetic oligonucleotide
  Target: ATXN1; (-) strand; PAM type: NAAAAC; PAM sequence: GAAAAC
ttgccttgttatgtgctgca

SEQ ID NO: 6018 - DNA, 20 bp, Artificial Sequence
  Description of Artificial Sequence: Synthetic oligonucleotide
  Target: ATXN1; (-) strand; PAM type: NAAAAC; PAM sequence: CAAAAC
ttccattcactgctcctagt

SEQ ID NO: 6019 - DNA, 20 bp, Artificial Sequence
  Description of Artificial Sequence: Synthetic oligonucleotide
  Target: ATXN1; (-) strand; PAM type: NAAAAC; PAM sequence: TAAAAC
atgcacagcacttaaaaata

SEQ ID NO: 6020 - DNA, 20 bp, Artificial Sequence
  Description of Artificial Sequence: Synthetic oligonucleotide
  Target: ATXN1; (-) strand; PAM type: NAAAAC; PAM sequence: AAAAAC
gtaacattttgttctctgtc

SEQ ID NO: 6021 - DNA, 20 bp, Artificial Sequence
  Description of Artificial Sequence: Synthetic oligonucleotide
  Target: ATXN1; (-) strand; PAM type: NAAAAC; PAM sequence: AAAAAC
tgctggacatttgtatctgc

SEQ ID NO: 6022 - DNA, 20 bp, Artificial Sequence
  Description of Artificial Sequence: Synthetic oligonucleotide
  Target: ATXN1; (-) strand; PAM type: NAAAAC; PAM sequence: GAAAAC
gcacccatgacagcaaggtt

SEQ ID NO: 6023 - DNA, 20 bp, Artificial Sequence
  Description of Artificial Sequence: Synthetic oligonucleotide
  Target: ATXN1; (-) strand; PAM type: NAAAAC; PAM sequence: GAAAAC
taccctcattttctagggga

SEQ ID NO: 6024 - DNA, 20 bp, Artificial Sequence
  Description of Artificial Sequence: Synthetic oligonucleotide
  Target: ATXN1; (-) strand; PAM type: NAAAAC; PAM sequence: TAAAAC
gatttagtaactacagcctt

SEQ ID NO: 6025 - DNA, 20 bp, Artificial Sequence
  Description of Artificial Sequence: Synthetic oligonucleotide
  Target: ATXN1; (-) strand; PAM type: NAAAAC; PAM sequence: TAAAAC
tcctttaaaaaaagtgttct

SEQ ID NO: 6026 - DNA, 20 bp, Artificial Sequence
  Description of Artificial Sequence: Synthetic oligonucleotide
  Target: ATXN1; (-) strand; PAM type: NAAAAC; PAM sequence: CAAAAC
gtactgcacttataaccaca

SEQ ID NO: 6027 - DNA, 20 bp, Artificial Sequence
  Description of Artificial Sequence: Synthetic oligonucleotide
  Target: ATXN1; (-) strand; PAM type: NAAAAC; PAM sequence: AAAAAC
gtagtatctcaataactaat

SEQ ID NO: 6028 - DNA, 20 bp, Artificial Sequence
  Description of Artificial Sequence: Synthetic oligonucleotide
  Target: ATXN1; (-) strand; PAM type: NAAAAC; PAM sequence: CAAAAC
ggtctcagttttcctgtctc

SEQ ID NO: 6029 - DNA, 20 bp, Artificial Sequence
  Description of Artificial Sequence: Synthetic oligonucleotide
  Target: ATXN1; (-) strand; PAM type: NAAAAC; PAM sequence: CAAAAC
tgcagttttccaaaagaaat

SEQ ID NO: 6030 - DNA, 20 bp, Artificial Sequence
  Description of Artificial Sequence: Synthetic oligonucleotide
  Target: ATXN1; (-) strand; PAM type: NAAAAC; PAM sequence: TAAAAC
ctgaacgcaagctctaagaa

SEQ ID NO: 6031 - DNA, 20 bp, Artificial Sequence
  Description of Artificial Sequence: Synthetic oligonucleotide
  Target: ATXN1; (-) strand; PAM type: NAAAAC; PAM sequence: CAAAAC
acagttcaatgaaatcttgt

SEQ ID NO: 6032 - DNA, 20 bp, Artificial Sequence
  Description of Artificial Sequence: Synthetic oligonucleotide
  Target: ATXN1; (-) strand; PAM type: NAAAAC; PAM sequence: TAAAAC
gacagtagagagtatgggaa

SEQ ID NO: 6033 - DNA, 20 bp, Artificial Sequence
  Description of Artificial Sequence: Synthetic oligonucleotide
  Target: ATXN1; (-) strand; PAM type: NAAAAC; PAM sequence: TAAAAC
ttattcattgtgaatttttt

SEQ ID NO: 6034 - DNA, 20 bp, Artificial Sequence
  Description of Artificial Sequence: Synthetic oligonucleotide
  Target: ATXN1; (-) strand; PAM type: NAAAAC; PAM sequence: AAAAAC
tctcaagaattttattgtga

SEQ ID NO: 6035 - DNA, 20 bp, Artificial Sequence
  Description of Artificial Sequence: Synthetic oligonucleotide
  Target: ATXN1; (-) strand; PAM type: NAAAAC; PAM sequence: AAAAAC
ctgaagtattatgcctcagg

SEQ ID NO: 6036 - DNA, 20 bp, Artificial Sequence
  Description of Artificial Sequence: Synthetic oligonucleotide
  Target: ATXN1; (-) strand; PAM type: NAAAAC; PAM sequence: AAAAAC
tggtctgagtaaaaataaac

SEQ ID NO: 6037 - DNA, 20 bp, Artificial Sequence
  Description of Artificial Sequence: Synthetic oligonucleotide
  Target: ATXN1; (-) strand; PAM type: NAAAAC; PAM sequence: CAAAAC
catttgaaaatttgaatttt

SEQ ID NO: 6038 - DNA, 20 bp, Artificial Sequence
  Description of Artificial Sequence: Synthetic oligonucleotide
  Target: ATXN1; (-) strand; PAM type: NAAAAC; PAM sequence: CAAAAC
gtagtataatatgtgcgtag

SEQ ID NO: 6039 - DNA, 20 bp, Artificial Sequence
  Description of Artificial Sequence: Synthetic oligonucleotide
  Target: ATXN1; (-) strand; PAM type: NAAAAC; PAM sequence: TAAAAC
aaattgccaagattgttttt

SEQ ID NO: 6040 - DNA, 20 bp, Artificial Sequence
  Description of Artificial Sequence: Synthetic oligonucleotide
  Target: ATXN1; (-) strand; PAM type: NAAAAC; PAM sequence: TAAAAC
tccctctgagccttgttgag

SEQ ID NO: 6041 - DNA, 20 bp, Artificial Sequence
  Description of Artificial Sequence: Synthetic oligonucleotide
  Target: ATXN1; (-) strand; PAM type: NAAAAC; PAM sequence: AAAAAC
atgcataggttttacctcac

SEQ ID NO: 6042 - DNA, 20 bp, Artificial Sequence
  Description of Artificial Sequence: Synthetic oligonucleotide
  Target: ATXN1; (-) strand; PAM type: NAAAAC; PAM sequence: TAAAAC
aggttgtaacttggactcta

SEQ ID NO: 6043 - DNA, 20 bp, Artificial Sequence
  Description of Artificial Sequence: Synthetic oligonucleotide
  Target: ATXN1; (-) strand; PAM type: NAAAAC; PAM sequence: CAAAAC
tactaccatcccaaatgtac

SEQ ID NO: 6044 - DNA, 20 bp, Artificial Sequence
  Description of Artificial Sequence: Synthetic oligonucleotide
  Target: ATXN1; (-) strand; PAM type: NAAAAC; PAM sequence: AAAAAC
aacttgacagccatcataac

SEQ ID NO: 6045 - DNA, 20 bp, Artificial Sequence
  Description of Artificial Sequence: Synthetic oligonucleotide
  Target: ATXN1; (-) strand; PAM type: NAAAAC; PAM sequence: TAAAAC
atattcccattgtcacattt

SEQ ID NO: 6046 - DNA, 20 bp, Artificial Sequence
  Description of Artificial Sequence: Synthetic oligonucleotide
  Target: ATXN1; (-) strand; PAM type: NAAAAC; PAM sequence: AAAAAC
ccctattacacccacagaat

SEQ ID NO: 6047 - DNA, 20 bp, Artificial Sequence
  Description of Artificial Sequence: Synthetic oligonucleotide
  Target: ATXN1; (-) strand; PAM type: NAAAAC; PAM sequence: AAAAAC
aaaaaaaaaaaaaaaaaaaa

SEQ ID NO: 6048 - DNA, 20 bp, Artificial Sequence
  Description of Artificial Sequence: Synthetic oligonucleotide
  Target: ATXN1; (-) strand; PAM type: NAAAAC; PAM sequence: CAAAAC
gactctgccagaaaacaaaa

SEQ ID NO: 6049 - DNA, 20 bp, Artificial Sequence
  Description of Artificial Sequence: Synthetic oligonucleotide
  Target: ATXN1; (-) strand; PAM type: NAAAAC; PAM sequence: CAAAAC
atcgagactctgccagaaaa

SEQ ID NO: 6050 - DNA, 20 bp, Artificial Sequence
  Description of Artificial Sequence: Synthetic oligonucleotide
  Target: ATXN1; (-) strand; PAM type: NAAAAC; PAM sequence: GAAAAC
tggtgatcgagactctgcca

SEQ ID NO: 6051 - DNA, 20 bp, Artificial Sequence
  Description of Artificial Sequence: Synthetic oligonucleotide
  Target: ATXN1; (-) strand; PAM type: NAAAAC; PAM sequence: GAAAAC
aaaccccaatcggctgcacg

SEQ ID NO: 6052 - DNA, 20 bp, Artificial Sequence
  Description of Artificial Sequence: Synthetic oligonucleotide
  Target: ATXN1; (-) strand; PAM type: NAAAAC; PAM sequence: CAAAAC
caacaaccagcaaacaaacc

SEQ ID NO: 6053 - DNA, 20 bp, Artificial Sequence
  Description of Artificial Sequence: Synthetic oligonucleotide
  Target: ATXN1; (-) strand; PAM type: NAAAAC; PAM sequence: CAAAAC
tgtttcactgcagggggatc

SEQ ID NO: 6054 - DNA, 20 bp, Artificial Sequence
  Description of Artificial Sequence: Synthetic oligonucleotide
  Target: ATXN1; (-) strand; PAM type: NAAAAC; PAM sequence: AAAAAC
cttgcaggccagagttgtgt

SEQ ID NO: 6055 - DNA, 20 bp, Artificial Sequence
  Description of Artificial Sequence: Synthetic oligonucleotide
  Target: ATXN1; (-) strand; PAM type: NAAAAC; PAM sequence: CAAAAC
acaaagcttgtcaacgaaaa

SEQ ID NO: 6056 - DNA, 20 bp, Artificial Sequence
  Description of Artificial Sequence: Synthetic oligonucleotide
  Target: ATXN1; (-) strand; PAM type: NAAAAC; PAM sequence: GAAAAC
ccttgacaaagcttgtcaac

SEQ ID NO: 6057 - DNA, 20 bp, Artificial Sequence
  Description of Artificial Sequence: Synthetic oligonucleotide
  Target: ATXN1; (-) strand; PAM type: NAAAAC; PAM sequence: AAAAAC
aaaaacatcgcagttaagcc

SEQ ID NO: 6058 - DNA, 20 bp, Artificial Sequence
  Description of Artificial Sequence: Synthetic oligonucleotide
  Target: ATXN1; (-) strand; PAM type: NAAAAC; PAM sequence: AAAAAC
tgcagattatgagttggaat

SEQ ID NO: 6059 - DNA, 20 bp, Artificial Sequence
  Description of Artificial Sequence: Synthetic oligonucleotide
  Target: ATXN1; (-) strand; PAM type: NAAAAC; PAM sequence: GAAAAC
cacttaatattttgccatct

SEQ ID NO: 6060 - DNA, 20 bp, Artificial Sequence
  Description of Artificial Sequence: Synthetic oligonucleotide
  Target: ATXN1; (-) strand; PAM type: NAAAAC; PAM sequence: CAAAAC
ccttcaagagtagataccac

SEQ ID NO: 6061 - DNA, 20 bp, Artificial Sequence
  Description of Artificial Sequence: Synthetic oligonucleotide
  Target: ATXN1; (-) strand; PAM type: NAAAAC; PAM sequence: GAAAAC
agtgctgctgtggcgacttt

SEQ ID NO: 6062 - DNA, 20 bp, Artificial Sequence
  Description of Artificial Sequence: Synthetic oligonucleotide
  Target: ATXN1; (-) strand; PAM type: NAAAAC; PAM sequence: GAAAAC
cataacaggctacttccaat

SEQ ID NO: 6063 - DNA, 20 bp, Artificial Sequence
  Description of Artificial Sequence: Synthetic oligonucleotide
  Target: ATXN1; (-) strand; PAM type: NAAAAC; PAM sequence: TAAAAC
ttcttttaagaattcaagcc

SEQ ID NO: 6064 - DNA, 20 bp, Artificial Sequence
  Description of Artificial Sequence: Synthetic oligonucleotide
  Target: ATXN1; (-) strand; PAM type: NAAAAC; PAM sequence: TAAAAC
gaataactttgaaaaacctt

SEQ ID NO: 6065 - DNA, 20 bp, Artificial Sequence
  Description of Artificial Sequence: Synthetic oligonucleotide
  Target: ATXN1; (-) strand; PAM type: NAAAAC; PAM sequence: AAAAAC
attatctaagaataactttg

SEQ ID NO: 6066 - DNA, 20 bp, Artificial Sequence
  Description of Artificial Sequence: Synthetic oligonucleotide
  Target: ATXN1; (+) strand; PAM type: NAAAAC; PAM sequence: CAAAAC
cagaaagacaggcaggctat

SEQ ID NO: 6067 - DNA, 20 bp, Artificial Sequence
  Description of Artificial Sequence: Synthetic oligonucleotide
  Target: ATXN1; (+) strand; PAM type: NAAAAC; PAM sequence: GAAAAC
ggcgggaaactagataaaaa

SEQ ID NO: 6068 - DNA, 20 bp, Artificial Sequence
  Description of Artificial Sequence: Synthetic oligonucleotide
  Target: ATXN1; (+) strand; PAM type: NAAAAC; PAM sequence: GAAAAC
ttccttacaaaggagatgtg

SEQ ID NO: 6069 - DNA, 20 bp, Artificial Sequence
  Description of Artificial Sequence: Synthetic oligonucleotide
  Target: ATXN1; (+) strand; PAM type: NAAAAC; PAM sequence: AAAAAC
aactgagtagttacaaaatc

SEQ ID NO: 6070 - DNA, 20 bp, Artificial Sequence
  Description of Artificial Sequence: Synthetic oligonucleotide
  Target: ATXN1; (+) strand; PAM type: NAAAAC; PAM sequence: CAAAAC
taaataatcagaggagagtc

SEQ ID NO: 6071 - DNA, 20 bp, Artificial Sequence
  Description of Artificial Sequence: Synthetic oligonucleotide
  Target: ATXN1; (+) strand; PAM type: NAAAAC; PAM sequence: CAAAAC
ctcacacgtactcttccccc

SEQ ID NO: 6072 - DNA, 20 bp, Artificial Sequence
  Description of Artificial Sequence: Synthetic oligonucleotide
  Target: ATXN1; (+) strand; PAM type: NAAAAC; PAM sequence: TAAAAC
tggtatacagacaatttatt

SEQ ID NO: 6073 - DNA, 20 bp, Artificial Sequence
  Description of Artificial Sequence: Synthetic oligonucleotide
  Target: ATXN1; (+) strand; PAM type: NAAAAC; PAM sequence: GAAAAC
aatgaaataatttctaccta

SEQ ID NO: 6074 - DNA, 20 bp, Artificial Sequence
  Description of Artificial Sequence: Synthetic oligonucleotide
  Target: ATXN1; (+) strand; PAM type: NAAAAC; PAM sequence: CAAAAC
attttcttttcaataaggtg

SEQ ID NO: 6075 - DNA, 20 bp, Artificial Sequence
  Description of Artificial Sequence: Synthetic oligonucleotide
  Target: ATXN1; (+) strand; PAM type: NAAAAC; PAM sequence: TAAAAC
ggtgggtaatgatctgatat

SEQ ID NO: 6076 - DNA, 20 bp, Artificial Sequence
  Description of Artificial Sequence: Synthetic oligonucleotide
  Target: ATXN1; (+) strand; PAM type: NAAAAC; PAM sequence: GAAAAC
tttaccccactcctgggcca

SEQ ID NO: 6077 - DNA, 20 bp, Artificial Sequence
  Description of Artificial Sequence: Synthetic oligonucleotide
  Target: ATXN1; (+) strand; PAM type: NAAAAC; PAM sequence: GAAAAC
tggttcctgtaagaaccaga

SEQ ID NO: 6078 - DNA, 20 bp, Artificial Sequence
  Description of Artificial Sequence: Synthetic oligonucleotide
  Target: ATXN1; (+) strand; PAM type: NAAAAC; PAM sequence: GAAAAC
gcaaacaaactaaagggaaa

SEQ ID NO: 6079 - DNA, 20 bp, Artificial Sequence
  Description of Artificial Sequence: Synthetic oligonucleotide
  Target: ATXN1; (+) strand; PAM type: NAAAAC; PAM sequence: AAAAAC
atgcaagtcatggggacatg

SEQ ID NO: 6080 - DNA, 20 bp, Artificial Sequence
  Description of Artificial Sequence: Synthetic oligonucleotide
  Target: ATXN1; (+) strand; PAM type: NAAAAC; PAM sequence: TAAAAC
atattaaataaaaatcaaaa

SEQ ID NO: 6081 - DNA, 20 bp, Artificial Sequence
  Description of Artificial Sequence: Synthetic oligonucleotide
  Target: ATXN1; (+) strand; PAM type: NAAAAC; PAM sequence: AAAAAC
tgacaaatttctatatacaa

SEQ ID NO: 6082 - DNA, 20 bp, Artificial Sequence
  Description of Artificial Sequence: Synthetic oligonucleotide
  Target: ATXN1; (+) strand; PAM type: NAAAAC; PAM sequence: TAAAAC
ttttcttttgtgcaattttt

SEQ ID NO: 6083 - DNA, 20 bp, Artificial Sequence
  Description of Artificial Sequence: Synthetic oligonucleotide
  Target: ATXN1; (+) strand; PAM type: NAAAAC; PAM sequence: AAAAAC
tatttcagaaattctgggtt

SEQ ID NO: 6084 - DNA, 20 bp, Artificial Sequence
  Description of Artificial Sequence: Synthetic oligonucleotide
  Target: ATXN1; (+) strand; PAM type: NAAAAC; PAM sequence: AAAAAC
tattgtcaatcgtttcctta

SEQ ID NO: 6085 - DNA, 20 bp, Artificial Sequence
  Description of Artificial Sequence: Synthetic oligonucleotide
  Target: ATXN1; (+) strand; PAM type: NAAAAC; PAM sequence: CAAAAC
tcaatcgtttccttaaaaaa

SEQ ID NO: 6086 - DNA, 20 bp, Artificial Sequence
  Description of Artificial Sequence: Synthetic oligonucleotide
  Target: ATXN1; (+) strand; PAM type: NAAAAC; PAM sequence: CAAAAC
cgtttccttaaaaaacaaaa

SEQ ID NO: 6087 - DNA, 20 bp, Artificial Sequence
  Description of Artificial Sequence: Synthetic oligonucleotide
  Target: ATXN1; (+) strand; PAM type: NAAAAC; PAM sequence: AAAAAC
gccacttcctggtgggggga

SEQ ID NO: 6088 - DNA, 20 bp, Artificial Sequence
  Description of Artificial Sequence: Synthetic oligonucleotide
  Target: ATXN1; (+) strand; PAM type: NAAAAC; PAM sequence: GAAAAC
cccaacacactcacctaaca

SEQ ID NO: 6089 - DNA, 20 bp, Artificial Sequence
  Description of Artificial Sequence: Synthetic oligonucleotide
  Target: ATXN1; (+) strand; PAM type: NAAAAC; PAM sequence: GAAAAC
actaaactgggtgagttagg

SEQ ID NO: 6090 - DNA, 20 bp, Artificial Sequence
  Description of Artificial Sequence: Synthetic oligonucleotide
  Target: ATXN1; (+) strand; PAM type: NAAAAC; PAM sequence: GAAAAC
ctgttactagtttaaaaatg

SEQ ID NO: 6091 - DNA, 20 bp, Artificial Sequence
  Description of Artificial Sequence: Synthetic oligonucleotide
  Target: ATXN1; (+) strand; PAM type: NAAAAC; PAM sequence: AAAAAC
cctcttaccatcaaaggcta

SEQ ID NO: 6092 - DNA, 20 bp, Artificial Sequence
  Description of Artificial Sequence: Synthetic oligonucleotide
  Target: ATXN1; (+) strand; PAM type: NAAAAC; PAM sequence: AAAAAC
aaaggctaaaaaacaaaaag

SEQ ID NO: 6093 - DNA, 20 bp, Artificial Sequence
  Description of Artificial Sequence: Synthetic oligonucleotide
  Target: ATXN1; (+) strand; PAM type: NAAAAC; PAM sequence: CAAAAC
ctaaaaaacaaaaagaaaaa

SEQ ID NO: 6094 - DNA, 20 bp, Artificial Sequence
  Description of Artificial Sequence: Synthetic oligonucleotide
  Target: ATXN1; (+) strand; PAM type: NAAAAC; PAM sequence: GAAAAC
aatgtttttggtacacccca

SEQ ID NO: 6095 - DNA, 20 bp, Artificial Sequence
  Description of Artificial Sequence: Synthetic oligonucleotide
  Target: ATXN1; (+) strand; PAM type: NAAAAC; PAM sequence: TAAAAC
taaaaatttctccctactta

SEQ ID NO: 6096 - DNA, 20 bp, Artificial Sequence
  Description of Artificial Sequence: Synthetic oligonucleotide
  Target: ATXN1; (+) strand; PAM type: NAAAAC; PAM sequence: CAAAAC
aagcactttaaagatgcatt

SEQ ID NO: 6097 - DNA, 20 bp, Artificial Sequence
  Description of Artificial Sequence: Synthetic oligonucleotide
  Target: ATXN1; (+) strand; PAM type: NAAAAC; PAM sequence: AAAAAC
tctctgggaatgaaaggttt

SEQ ID NO: 6098 - DNA, 20 bp, Artificial Sequence
  Description of Artificial Sequence: Synthetic oligonucleotide
  Target: ATXN1; (+) strand; PAM type: NAAAAC; PAM sequence: GAAAAC
catatataaatgtctttatg

SEQ ID NO: 6099 - DNA, 20 bp, Artificial Sequence
  Description of Artificial Sequence: Synthetic oligonucleotide
  Target: ATXN1; (+) strand; PAM type: NAAAAC; PAM sequence: AAAAAC
ttcccacaatgttattggat

SEQ ID NO: 6100 - DNA, 20 bp, Artificial Sequence
  Description of Artificial Sequence: Synthetic oligonucleotide
  Target: ATXN1; (+) strand; PAM type: NAAAAC; PAM sequence: AAAAAC
taaaagttcatcttaaaaag

SEQ ID NO: 6101 - DNA, 20 bp, Artificial Sequence
  Description of Artificial Sequence: Synthetic oligonucleotide
  Target: ATXN1; (+) strand; PAM type: NAAAAC; PAM sequence: CAAAAC
acaaaaaaaggatactctac

SEQ ID NO: 6102 - DNA, 20 bp, Artificial Sequence
  Description of Artificial Sequence: Synthetic oligonucleotide
  Target: ATXN1; (+) strand; PAM type: NAAAAC; PAM sequence: GAAAAC
gaagaaggaagggaacaaat

SEQ ID NO: 6103 - DNA, 20 bp, Artificial Sequence
  Description of Artificial Sequence: Synthetic oligonucleotide
  Target: ATXN1; (+) strand; PAM type: NAAAAC; PAM sequence: AAAAAC
ccctccttctgaggacaact

SEQ ID NO: 6104 - DNA, 20 bp, Artificial Sequence
  Description of Artificial Sequence: Synthetic oligonucleotide
  Target: ATXN1; (+) strand; PAM type: NAAAAC; PAM sequence: AAAAAC
ataagcaaacaaataaattt

SEQ ID NO: 6105 - DNA, 20 bp, Artificial Sequence
  Description of Artificial Sequence: Synthetic oligonucleotide
  Target: ATXN1; (+) strand; PAM type: NAAAAC; PAM sequence: CAAAAC
gaccagcctggctaccatgg

SEQ ID NO: 6106 - DNA, 20 bp, Artificial Sequence
  Description of Artificial Sequence: Synthetic oligonucleotide
  Target: ATXN1; (+) strand; PAM type: NAAAAC; PAM sequence: CAAAAC
ccccatctctactaaaaata

SEQ ID NO: 6107 - DNA, 20 bp, Artificial Sequence
  Description of Artificial Sequence: Synthetic oligonucleotide
  Target: ATXN1; (+) strand; PAM type: NAAAAC; PAM sequence: TAAAAC
gattgactcatctgagtccc

SEQ ID NO: 6108 - DNA, 20 bp, Artificial Sequence
  Description of Artificial Sequence: Synthetic oligonucleotide
  Target: ATXN1; (+) strand; PAM type: NAAAAC; PAM sequence: AAAAAC
aggtattctttaggtagaga

SEQ ID NO: 6109 - DNA, 20 bp, Artificial Sequence
  Description of Artificial Sequence: Synthetic oligonucleotide
  Target: ATXN1; (+) strand; PAM type: NAAAAC; PAM sequence: AAAAAC
ttatacacattcagacacac

SEQ ID NO: 6110 - DNA, 20 bp, Artificial Sequence
  Description of Artificial Sequence: Synthetic oligonucleotide
  Target: ATXN1; (+) strand; PAM type: NAAAAC; PAM sequence: AAAAAC
atgcataattgaagtaccaa

SEQ ID NO: 6111 - DNA, 20 bp, Artificial Sequence
  Description of Artificial Sequence: Synthetic oligonucleotide
  Target: ATXN1; (+) strand; PAM type: NAAAAC; PAM sequence: CAAAAC
tgtgtgacactatttggttt

SEQ ID NO: 6112 - DNA, 20 bp, Artificial Sequence
  Description of Artificial Sequence: Synthetic oligonucleotide
  Target: ATXN1; (+) strand; PAM type: NAAAAC; PAM sequence: TAAAAC
gcaaatccaagtcataaaaa

SEQ ID NO: 6113 - DNA, 20 bp, Artificial Sequence
  Description of Artificial Sequence: Synthetic oligonucleotide
  Target: ATXN1; (+) strand; PAM type: NAAAAC; PAM sequence: CAAAAC
ctttcattatttccgcatct

SEQ ID NO: 6114 - DNA, 20 bp, Artificial Sequence
  Description of Artificial Sequence: Synthetic oligonucleotide
  Target: ATXN1; (+) strand; PAM type: NAAAAC; PAM sequence: AAAAAC
cccccatacccccctcccat

SEQ ID NO: 6115 - DNA, 20 bp, Artificial Sequence
  Description of Artificial Sequence: Synthetic oligonucleotide
  Target: ATXN1; (+) strand; PAM type: NAAAAC; PAM sequence: AAAAAC
cagagcaagactctgtctct

SEQ ID NO: 6116 - DNA, 20 bp, Artificial Sequence
  Description of Artificial Sequence: Synthetic oligonucleotide
  Target: ATXN1; (+) strand; PAM type: NAAAAC; PAM sequence: TAAAAC
agaatatttgagatgcgtac

SEQ ID NO: 6117 - DNA, 20 bp, Artificial Sequence
  Description of Artificial Sequence: Synthetic oligonucleotide
  Target: ATXN1; (+) strand; PAM type: NAAAAC; PAM sequence: CAAAAC
gagaggagccttctccatct

SEQ ID NO: 6118 - DNA, 20 bp, Artificial Sequence
  Description of Artificial Sequence: Synthetic oligonucleotide
  Target: ATXN1; (+) strand; PAM type: NAAAAC; PAM sequence: TAAAAC
gtctgtgaattccttgaatt

SEQ ID NO: 6119 - DNA, 20 bp, Artificial Sequence
  Description of Artificial Sequence: Synthetic oligonucleotide
  Target: ATXN1; (+) strand; PAM type: NAAAAC; PAM sequence: CAAAAC
caggagacagaacatacacg

SEQ ID NO: 6120 - DNA, 20 bp, Artificial Sequence
  Description of Artificial Sequence: Synthetic oligonucleotide
  Target: ATXN1; (+) strand; PAM type: NAAAAC; PAM sequence: TAAAAC
aactcaaacttaaagtgacc

SEQ ID NO: 6121 - DNA, 20 bp, Artificial Sequence
  Description of Artificial Sequence: Synthetic oligonucleotide
  Target: ATXN1; (+) strand; PAM type: NAAAAC; PAM sequence: CAAAAC
tatgttggcctggctggttt

SEQ ID NO: 6122 - DNA, 20 bp, Artificial Sequence
  Description of Artificial Sequence: Synthetic oligonucleotide
  Target: ATXN1; (+) strand; PAM type: NAAAAC; PAM sequence: CAAAAC
gaggtggaacagtttcatcc

SEQ ID NO: 6123 - DNA, 20 bp, Artificial Sequence
  Description of Artificial Sequence: Synthetic oligonucleotide
  Target: ATXN1; (+) strand; PAM type: NAAAAC; PAM sequence: AAAAAC
gtgcaagactccgtcttaaa

SEQ ID NO: 6124 - DNA, 20 bp, Artificial Sequence
  Description of Artificial Sequence: Synthetic oligonucleotide
  Target: ATXN1; (+) strand; PAM type: NAAAAC; PAM sequence: AAAAAC
gactccgtcttaaaaaaaac

SEQ ID NO: 6125 - DNA, 20 bp, Artificial Sequence
  Description of Artificial Sequence: Synthetic oligonucleotide
  Target: ATXN1; (+) strand; PAM type: NAAAAC; PAM sequence: CAAAAC
cgtcttaaaaaaaacaaaaa

SEQ ID NO: 6126 - DNA, 20 bp, Artificial Sequence
  Description of Artificial Sequence: Synthetic oligonucleotide
  Target: ATXN1; (+) strand; PAM type: NAAAAC; PAM sequence: AAAAAC
aaacaaaaacaaaacaaaaa

SEQ ID NO: 6127 - DNA, 20 bp, Artificial Sequence
  Description of Artificial Sequence: Synthetic oligonucleotide
  Target: ATXN1; (+) strand; PAM type: NAAAAC; PAM sequence: AAAAAC
tctgtttgccttctgtatgg

SEQ ID NO: 6128 - DNA, 20 bp, Artificial Sequence
  Description of Artificial Sequence: Synthetic oligonucleotide
  Target: ATXN1; (+) strand; PAM type: NAAAAC; PAM sequence: AAAAAC
acacatatgtacatatcacc

SEQ ID NO: 6129 - DNA, 20 bp, Artificial Sequence
  Description of Artificial Sequence: Synthetic oligonucleotide
  Target: ATXN1; (+) strand; PAM type: NAAAAC; PAM sequence: GAAAAC
caccaaaaacaagatagaaa

SEQ ID NO: 6130 - DNA, 20 bp, Artificial Sequence
  Description of Artificial Sequence: Synthetic oligonucleotide
  Target: ATXN1; (+) strand; PAM type: NAAAAC; PAM sequence: CAAAAC
aaaacaagatagaaagaaaa

SEQ ID NO: 6131 - DNA, 20 bp, Artificial Sequence
  Description of Artificial Sequence: Synthetic oligonucleotide
  Target: ATXN1; (+) strand; PAM type: NAAAAC; PAM sequence: CAAAAC
tgcgaagggcatctgtttta

SEQ ID NO: 6132 - DNA, 20 bp, Artificial Sequence
  Description of Artificial Sequence: Synthetic oligonucleotide
  Target: ATXN1; (+) strand; PAM type: NAAAAC; PAM sequence: GAAAAC
tctcagcatgaaaaaaatca

SEQ ID NO: 6133 - DNA, 20 bp, Artificial Sequence
  Description of Artificial Sequence: Synthetic oligonucleotide
  Target: ATXN1; (+) strand; PAM type: NAAAAC; PAM sequence: AAAAAC
aatgtttaaaaatcattaat

SEQ ID NO: 6134 - DNA, 20 bp, Artificial Sequence
  Description of Artificial Sequence: Synthetic oligonucleotide
  Target: ATXN1; (+) strand; PAM type: NAAAAC; PAM sequence: CAAAAC
aaatcattaataaaaacagt

SEQ ID NO: 6135 - DNA, 20 bp, Artificial Sequence
  Description of Artificial Sequence: Synthetic oligonucleotide
  Target: ATXN1; (+) strand; PAM type: NAAAAC; PAM sequence: TAAAAC
atctctgtgagtgttctatt

SEQ ID NO: 6136 - DNA, 20 bp, Artificial Sequence
  Description of Artificial Sequence: Synthetic oligonucleotide
  Target: ATXN1; (+) strand; PAM type: NAAAAC; PAM sequence: CAAAAC
gcatggcattctggaacagg

SEQ ID NO: 6137 - DNA, 20 bp, Artificial Sequence
  Description of Artificial Sequence: Synthetic oligonucleotide
  Target: ATXN1; (+) strand; PAM type: NAAAAC; PAM sequence: AAAAAC
catgacatcataaattcatc

SEQ ID NO: 6138 - DNA, 20 bp, Artificial Sequence
  Description of Artificial Sequence: Synthetic oligonucleotide
  Target: ATXN1; (+) strand; PAM type: NAAAAC; PAM sequence: GAAAAC
tgcaagattttaataacagg

SEQ ID NO: 6139 - DNA, 20 bp, Artificial Sequence
  Description of Artificial Sequence: Synthetic oligonucleotide
  Target: ATXN1; (+) strand; PAM type: NAAAAC; PAM sequence: TAAAAC
ctctctacttgctgtacacc

SEQ ID NO: 6140 - DNA, 20 bp, Artificial Sequence
  Description of Artificial Sequence: Synthetic oligonucleotide
  Target: ATXN1; (+) strand; PAM type: NAAAAC; PAM sequence: CAAAAC
caacaacagtctgagagaat

SEQ ID NO: 6141 - DNA, 20 bp, Artificial Sequence
  Description of Artificial Sequence: Synthetic oligonucleotide
  Target: ATXN1; (+) strand; PAM type: NAAAAC; PAM sequence: GAAAAC
ctaagttgaagcagggaagg

SEQ ID NO: 6142 - DNA, 20 bp, Artificial Sequence
  Description of Artificial Sequence: Synthetic oligonucleotide
  Target: ATXN1; (+) strand; PAM type: NAAAAC; PAM sequence: AAAAAC
agtataaaagtgaagcatta

SEQ ID NO: 6143 - DNA, 20 bp, Artificial Sequence
  Description of Artificial Sequence: Synthetic oligonucleotide
  Target: ATXN1; (+) strand; PAM type: NAAAAC; PAM sequence: CAAAAC
gaccagcacgggcaagatag

SEQ ID NO: 6144 - DNA, 20 bp, Artificial Sequence
  Description of Artificial Sequence: Synthetic oligonucleotide
  Target: ATXN1; (+) strand; PAM type: NAAAAC; PAM sequence: AAAAAC
gcaaaaccctgtctctacaa

SEQ ID NO: 6145 - DNA, 20 bp, Artificial Sequence
  Description of Artificial Sequence: Synthetic oligonucleotide
  Target: ATXN1; (+) strand; PAM type: NAAAAC; PAM sequence: CAAAAC
gacagggcaagaccctgtct

SEQ ID NO: 6146 - DNA, 20 bp, Artificial Sequence
  Description of Artificial Sequence: Synthetic oligonucleotide
  Target: ATXN1; (+) strand; PAM type: NAAAAC; PAM sequence: AAAAAC
acaagcaaacaaacgaacac

SEQ ID NO: 6147 - DNA, 20 bp, Artificial Sequence
  Description of Artificial Sequence: Synthetic oligonucleotide
  Target: ATXN1; (+) strand; PAM type: NAAAAC; PAM sequence: AAAAAC
acgaacacaaaaacccacag

SEQ ID NO: 6148 - DNA, 20 bp, Artificial Sequence
  Description of Artificial Sequence: Synthetic oligonucleotide
  Target: ATXN1; (+) strand; PAM type: NAAAAC; PAM sequence: CAAAAC
cacaaaaacccacagaaaaa

SEQ ID NO: 6149 - DNA, 20 bp, Artificial Sequence
  Description of Artificial Sequence: Synthetic oligonucleotide
  Target: ATXN1; (+) strand; PAM type: NAAAAC; PAM sequence: GAAAAC
acaatgccatctgttttgga

SEQ ID NO: 6150 - DNA, 20 bp, Artificial Sequence
  Description of Artificial Sequence: Synthetic oligonucleotide
  Target: ATXN1; (+) strand; PAM type: NAAAAC; PAM sequence: GAAAAC
agattcttcaggctagggga

SEQ ID NO: 6151 - DNA, 20 bp, Artificial Sequence
  Description of Artificial Sequence: Synthetic oligonucleotide
  Target: ATXN1; (+) strand; PAM type: NAAAAC; PAM sequence: AAAAAC
ttagtgatctcactatggga

SEQ ID NO: 6152 - DNA, 20 bp, Artificial Sequence
  Description of Artificial Sequence: Synthetic oligonucleotide
  Target: ATXN1; (+) strand; PAM type: NAAAAC; PAM sequence: AAAAAC
ttgcaaagtttggagtaggg

SEQ ID NO: 6153 - DNA, 20 bp, Artificial Sequence
  Description of Artificial Sequence: Synthetic oligonucleotide
  Target: ATXN1; (+) strand; PAM type: NAAAAC; PAM sequence: CAAAAC
gaaccagtcgcatttctaaa

SEQ ID NO: 6154 - DNA, 20 bp, Artificial Sequence
  Description of Artificial Sequence: Synthetic oligonucleotide
  Target: ATXN1; (+) strand; PAM type: NAAAAC; PAM sequence: GAAAAC
gtcattcacgagtggttctg

SEQ ID NO: 6155 - DNA, 20 bp, Artificial Sequence
  Description of Artificial Sequence: Synthetic oligonucleotide
  Target: ATXN1; (+) strand; PAM type: NAAAAC; PAM sequence: CAAAAC
aaatgaaaaaaaaaaatgcc

SEQ ID NO: 6156 - DNA, 20 bp, Artificial Sequence
  Description of Artificial Sequence: Synthetic oligonucleotide
  Target: ATXN1; (+) strand; PAM type: NAAAAC; PAM sequence: TAAAAC
ccagctaataagacatattt

SEQ ID NO: 6157 - DNA, 20 bp, Artificial Sequence
  Description of Artificial Sequence: Synthetic oligonucleotide
  Target: ATXN1; (+) strand; PAM type: NAAAAC; PAM sequence: GAAAAC
accccaagcactgaagcaga

SEQ ID NO: 6158 - DNA, 20 bp, Artificial Sequence
  Description of Artificial Sequence: Synthetic oligonucleotide
  Target: ATXN1; (+) strand; PAM type: NAAAAC; PAM sequence: AAAAAC
tctaccaaaaataaaaaata

SEQ ID NO: 6159 - DNA, 20 bp, Artificial Sequence
  Description of Artificial Sequence: Synthetic oligonucleotide
  Target: ATXN1; (+) strand; PAM type: NAAAAC; PAM sequence: AAAAAC
cagagcgacactctgtctcc

SEQ ID NO: 6160 - DNA, 20 bp, Artificial Sequence
  Description of Artificial Sequence: Synthetic oligonucleotide
  Target: ATXN1; (+) strand; PAM type: NAAAAC; PAM sequence: CAAAAC
ctctgtctccaaaaacgaaa

SEQ ID NO: 6161 - DNA, 20 bp, Artificial Sequence
  Description of Artificial Sequence: Synthetic oligonucleotide
  Target: ATXN1; (+) strand; PAM type: NAAAAC; PAM sequence: AAAAAC
cgaaacaaaacaacaacaac

SEQ ID NO: 6162 - DNA, 20 bp, Artificial Sequence
  Description of Artificial Sequence: Synthetic oligonucleotide
  Target: ATXN1; (+) strand; PAM type: NAAAAC; PAM sequence: AAAAAC
aaaacaacaacaacaaaaac

SEQ ID NO: 6163 - DNA, 20 bp, Artificial Sequence
  Description of Artificial Sequence: Synthetic oligonucleotide
  Target: ATXN1; (+) strand; PAM type: NAAAAC; PAM sequence: AAAAAC
gatgacggagtgagactgtt

SEQ ID NO: 6164 - DNA, 20 bp, Artificial Sequence
  Description of Artificial Sequence: Synthetic oligonucleotide
  Target: ATXN1; (+) strand; PAM type: NAAAAC; PAM sequence: AAAAAC
accgaatttgattatggtta

SEQ ID NO: 6165 - DNA, 20 bp, Artificial Sequence
  Description of Artificial Sequence: Synthetic oligonucleotide
  Target: ATXN1; (+) strand; PAM type: NAAAAC; PAM sequence: TAAAAC
tgtagccaatgatccgattt

SEQ ID NO: 6166 - DNA, 20 bp, Artificial Sequence
  Description of Artificial Sequence: Synthetic oligonucleotide
  Target: ATXN1; (+) strand; PAM type: NAAAAC; PAM sequence: AAAAAC
gaaatgaaaaataaggttaa

SEQ ID NO: 6167 - DNA, 20 bp, Artificial Sequence
  Description of Artificial Sequence: Synthetic oligonucleotide
  Target: ATXN1; (+) strand; PAM type: NAAAAC; PAM sequence: TAAAAC
aaataaggttaaaaaaaccc

SEQ ID NO: 6168 - DNA, 20 bp, Artificial Sequence
  Description of Artificial Sequence: Synthetic oligonucleotide
  Target: ATXN1; (+) strand; PAM type: NAAAAC; PAM sequence: GAAAAC
tttccataccaacgagcaag

SEQ ID NO: 6169 - DNA, 20 bp, Artificial Sequence
  Description of Artificial Sequence: Synthetic oligonucleotide
  Target: ATXN1; (+) strand; PAM type: NAAAAC; PAM sequence: TAAAAC
ctcctgcagcactgatccaa

SEQ ID NO: 6170 - DNA, 20 bp, Artificial Sequence
  Description of Artificial Sequence: Synthetic oligonucleotide
  Target: ATXN1; (+) strand; PAM type: NAAAAC; PAM sequence: CAAAAC
acaattgaatgcacaataca

SEQ ID NO: 6171 - DNA, 20 bp, Artificial Sequence
  Description of Artificial Sequence: Synthetic oligonucleotide
  Target: ATXN1; (+) strand; PAM type: NAAAAC; PAM sequence: GAAAAC
atgcacaatacacaaaacta

SEQ ID NO: 6172 - DNA, 20 bp, Artificial Sequence
  Description of Artificial Sequence: Synthetic oligonucleotide
  Target: ATXN1; (+) strand; PAM type: NAAAAC; PAM sequence: GAAAAC
aaatccaaatttattcttct

SEQ ID NO: 6173 - DNA, 20 bp, Artificial Sequence
  Description of Artificial Sequence: Synthetic oligonucleotide
  Target: ATXN1; (+) strand; PAM type: NAAAAC; PAM sequence: AAAAAC
tgagcttgtgccaggactgg

SEQ ID NO: 6174 - DNA, 20 bp, Artificial Sequence
  Description of Artificial Sequence: Synthetic oligonucleotide
  Target: ATXN1; (+) strand; PAM type: NAAAAC; PAM sequence: AAAAAC
cttcattttggccaagcatt

SEQ ID NO: 6175 - DNA, 20 bp, Artificial Sequence
  Description of Artificial Sequence: Synthetic oligonucleotide
  Target: ATXN1; (+) strand; PAM type: NAAAAC; PAM sequence: GAAAAC
ctgtctcaagaaaagagaaa

SEQ ID NO: 6176 - DNA, 20 bp, Artificial Sequence
  Description of Artificial Sequence: Synthetic oligonucleotide
  Target: ATXN1; (+) strand; PAM type: NAAAAC; PAM sequence: GAAAAC
cctagaagccggctcacatg

SEQ ID NO: 6177 - DNA, 20 bp, Artificial Sequence
  Description of Artificial Sequence: Synthetic oligonucleotide
  Target: ATXN1; (+) strand; PAM type: NAAAAC; PAM sequence: TAAAAC
ccagtctacaacagagaaca

SEQ ID NO: 6178 - DNA, 20 bp, Artificial Sequence
  Description of Artificial Sequence: Synthetic oligonucleotide
  Target: ATXN1; (+) strand; PAM type: NAAAAC; PAM sequence: TAAAAC
gaggtactctgggagagtct

SEQ ID NO: 6179 - DNA, 20 bp, Artificial Sequence
  Description of Artificial Sequence: Synthetic oligonucleotide
  Target: ATXN1; (+) strand; PAM type: NAAAAC; PAM sequence: GAAAAC
cacacaaaaaatcctaatat

SEQ ID NO: 6180 - DNA, 20 bp, Artificial Sequence
  Description of Artificial Sequence: Synthetic oligonucleotide
  Target: ATXN1; (+) strand; PAM type: NAAAAC; PAM sequence: AAAAAC
agtagcaattgagctccaat

SEQ ID NO: 6181 - DNA, 20 bp, Artificial Sequence
  Description of Artificial Sequence: Synthetic oligonucleotide
  Target: ATXN1; (+) strand; PAM type: NAAAAC; PAM sequence: CAAAAC
gagtccttttactgaattat

SEQ ID NO: 6182 - DNA, 20 bp, Artificial Sequence
  Description of Artificial Sequence: Synthetic oligonucleotide
  Target: ATXN1; (+) strand; PAM type: NAAAAC; PAM sequence: AAAAAC
gactcacccagggagctttt

SEQ ID NO: 6183 - DNA, 20 bp, Artificial Sequence
  Description of Artificial Sequence: Synthetic oligonucleotide
  Target: ATXN1; (+) strand; PAM type: NAAAAC; PAM sequence: AAAAAC
atattcttttttttaaaaaa

SEQ ID NO: 6184 - DNA, 20 bp, Artificial Sequence
  Description of Artificial Sequence: Synthetic oligonucleotide
  Target: ATXN1; (+) strand; PAM type: NAAAAC; PAM sequence: CAAAAC
cttttttttaaaaaaaaaaa

SEQ ID NO: 6185 - DNA, 20 bp, Artificial Sequence
  Description of Artificial Sequence: Synthetic oligonucleotide
  Target: ATXN1; (+) strand; PAM type: NAAAAC; PAM sequence: GAAAAC
taaaatgatgcagctgcatg

SEQ ID NO: 6186 - DNA, 20 bp, Artificial Sequence
  Description of Artificial Sequence: Synthetic oligonucleotide
  Target: ATXN1; (+) strand; PAM type: NAAAAC; PAM sequence: GAAAAC
accctctgaatcagggactg

SEQ ID NO: 6187 - DNA, 20 bp, Artificial Sequence
  Description of Artificial Sequence: Synthetic oligonucleotide
  Target: ATXN1; (+) strand; PAM type: NAAAAC; PAM sequence: AAAAAC
agattttggatgtgatgata

SEQ ID NO: 6188 - DNA, 20 bp, Artificial Sequence
  Description of Artificial Sequence: Synthetic oligonucleotide
  Target: ATXN1; (+) strand; PAM type: NAAAAC; PAM sequence: CAAAAC
aacattcatatccaattatc

SEQ ID NO: 6189 - DNA, 20 bp, Artificial Sequence
  Description of Artificial Sequence: Synthetic oligonucleotide
  Target: ATXN1; (+) strand; PAM type: NAAAAC; PAM sequence: CAAAAC
tgcaccaatcagtaccctgt

SEQ ID NO: 6190 - DNA, 20 bp, Artificial Sequence
  Description of Artificial Sequence: Synthetic oligonucleotide
  Target: ATXN1; (+) strand; PAM type: NAAAAC; PAM sequence: AAAAAC
aaaagaaagaaagaaaaaaa

SEQ ID NO: 6191 - DNA, 20 bp, Artificial Sequence
  Description of Artificial Sequence: Synthetic oligonucleotide
  Target: ATXN1; (+) strand; PAM type: NAAAAC; PAM sequence: AAAAAC
tagaatctctacaacattat

SEQ ID NO: 6192 - DNA, 20 bp, Artificial Sequence
  Description of Artificial Sequence: Synthetic oligonucleotide
  Target: ATXN1; (+) strand; PAM type: NAAAAC; PAM sequence: AAAAAC
ttcaacaaatgtgaggtaga

SEQ ID NO: 6193 - DNA, 20 bp, Artificial Sequence
  Description of Artificial Sequence: Synthetic oligonucleotide
  Target: ATXN1; (+) strand; PAM type: NAAAAC; PAM sequence: AAAAAC
taagcagaggcttccatcag

SEQ ID NO: 6194 - DNA, 20 bp, Artificial Sequence
  Description of Artificial Sequence: Synthetic oligonucleotide
  Target: ATXN1; (+) strand; PAM type: NAAAAC; PAM sequence: CAAAAC
tgtagaagataatgttttaa

SEQ ID NO: 6195 - DNA, 20 bp, Artificial Sequence
  Description of Artificial Sequence: Synthetic oligonucleotide
  Target: ATXN1; (+) strand; PAM type: NAAAAC; PAM sequence: TAAAAC
actgagaacagcacgcaact

SEQ ID NO: 6196 - DNA, 20 bp, Artificial Sequence
  Description of Artificial Sequence: Synthetic oligonucleotide
  Target: ATXN1; (+) strand; PAM type: NAAAAC; PAM sequence: CAAAAC
gaccagcctggccaacatgc

SEQ ID NO: 6197 - DNA, 20 bp, Artificial Sequence
  Description of Artificial Sequence: Synthetic oligonucleotide
  Target: ATXN1; (+) strand; PAM type: NAAAAC; PAM sequence: TAAAAC
gccaaaacccccgtctctac

SEQ ID NO: 6198 - DNA, 20 bp, Artificial Sequence
  Description of Artificial Sequence: Synthetic oligonucleotide
  Target: ATXN1; (+) strand; PAM type: NAAAAC; PAM sequence: AAAAAC
accttgtctcaaaaaaagca

SEQ ID NO: 6199 - DNA, 20 bp, Artificial Sequence
  Description of Artificial Sequence: Synthetic oligonucleotide
  Target: ATXN1; (+) strand; PAM type: NAAAAC; PAM sequence: AAAAAC
ctcaaaaaaagcaaaaaaca

SEQ ID NO: 6200 - DNA, 20 bp, Artificial Sequence
  Description of Artificial Sequence: Synthetic oligonucleotide
  Target: ATXN1; (+) strand; PAM type: NAAAAC; PAM sequence: AAAAAC
ccattaaacttgaagcagtg

SEQ ID NO: 6201 - DNA, 20 bp, Artificial Sequence
  Description of Artificial Sequence: Synthetic oligonucleotide
  Target: ATXN1; (+) strand; PAM type: NAAAAC; PAM sequence: AAAAAC
gtctacgagaataaataaat

SEQ ID NO: 6202 - DNA, 20 bp, Artificial Sequence
  Description of Artificial Sequence: Synthetic oligonucleotide
  Target: ATXN1; (+) strand; PAM type: NAAAAC; PAM sequence: TAAAAC
tattcatgtatgtacctccc

SEQ ID NO: 6203 - DNA, 20 bp, Artificial Sequence
  Description of Artificial Sequence: Synthetic oligonucleotide
  Target: ATXN1; (+) strand; PAM type: NAAAAC; PAM sequence: GAAAAC
attaaaccaagcttttccca

SEQ ID NO: 6204 - DNA, 20 bp, Artificial Sequence
  Description of Artificial Sequence: Synthetic oligonucleotide
  Target: ATXN1; (+) strand; PAM type: NAAAAC; PAM sequence: TAAAAC
ctgcctcaaactaggctgca

SEQ ID NO: 6205 - DNA, 20 bp, Artificial Sequence
  Description of Artificial Sequence: Synthetic oligonucleotide
  Target: ATXN1; (+) strand; PAM type: NAAAAC; PAM sequence: TAAAAC
aaacttacatacagagcacc

SEQ ID NO: 6206 - DNA, 20 bp, Artificial Sequence
  Description of Artificial Sequence: Synthetic oligonucleotide
  Target: ATXN1; (+) strand; PAM type: NAAAAC; PAM sequence: TAAAAC
cacctaaaaccaggggcacc

SEQ ID NO: 6207 - DNA, 20 bp, Artificial Sequence
  Description of Artificial Sequence: Synthetic oligonucleotide
  Target: ATXN1; (+) strand; PAM type: NAAAAC; PAM sequence: GAAAAC
agtggtaatccaattttacg

SEQ ID NO: 6208 - DNA, 20 bp, Artificial Sequence
  Description of Artificial Sequence: Synthetic oligonucleotide
  Target: ATXN1; (+) strand; PAM type: NAAAAC; PAM sequence: TAAAAC
ttgctccaaccaccacttct

SEQ ID NO: 6209 - DNA, 20 bp, Artificial Sequence
  Description of Artificial Sequence: Synthetic oligonucleotide
  Target: ATXN1; (+) strand; PAM type: NAAAAC; PAM sequence: CAAAAC
tgcccacggcactctttgca

SEQ ID NO: 6210 - DNA, 20 bp, Artificial Sequence
  Description of Artificial Sequence: Synthetic oligonucleotide
  Target: ATXN1; (+) strand; PAM type: NAAAAC; PAM sequence: CAAAAC
ttaggaagatgaatcttgag

SEQ ID NO: 6211 - DNA, 20 bp, Artificial Sequence
  Description of Artificial Sequence: Synthetic oligonucleotide
  Target: ATXN1; (+) strand; PAM type: NAAAAC; PAM sequence: AAAAAC
caaacttttgattatattca

SEQ ID NO: 6212 - DNA, 20 bp, Artificial Sequence
  Description of Artificial Sequence: Synthetic oligonucleotide
  Target: ATXN1; (+) strand; PAM type: NAAAAC; PAM sequence: GAAAAC
agactaatacaaccactatg

SEQ ID NO: 6213 - DNA, 20 bp, Artificial Sequence
  Description of Artificial Sequence: Synthetic oligonucleotide
  Target: ATXN1; (+) strand; PAM type: NAAAAC; PAM sequence: GAAAAC
agtgaagtaactcaggaatg

SEQ ID NO: 6214 - DNA, 20 bp, Artificial Sequence
  Description of Artificial Sequence: Synthetic oligonucleotide
  Target: ATXN1; (+) strand; PAM type: NAAAAC; PAM sequence: TAAAAC
cgagttgttctaacactaaa

SEQ ID NO: 6215 - DNA, 20 bp, Artificial Sequence
  Description of Artificial Sequence: Synthetic oligonucleotide
  Target: ATXN1; (+) strand; PAM type: NAAAAC; PAM sequence: AAAAAC
attctttctggacgcaggac

SEQ ID NO: 6216 - DNA, 20 bp, Artificial Sequence
  Description of Artificial Sequence: Synthetic oligonucleotide
  Target: ATXN1; (+) strand; PAM type: NAAAAC; PAM sequence: CAAAAC
ccaaacaccacctgttcccc

SEQ ID NO: 6217 - DNA, 20 bp, Artificial Sequence
  Description of Artificial Sequence: Synthetic oligonucleotide
  Target: ATXN1; (+) strand; PAM type: NAAAAC; PAM sequence: GAAAAC
taagagaagtaagcctcttg

SEQ ID NO: 6218 - DNA, 20 bp, Artificial Sequence
  Description of Artificial Sequence: Synthetic oligonucleotide
  Target: ATXN1; (+) strand; PAM type: NAAAAC; PAM sequence: GAAAAC
gtttgaagaaatccagtgga

SEQ ID NO: 6219 - DNA, 20 bp, Artificial Sequence
  Description of Artificial Sequence: Synthetic oligonucleotide
  Target: ATXN1; (+) strand; PAM type: NAAAAC; PAM sequence: TAAAAC
ctacagcattcagatctctt

SEQ ID NO: 6220 - DNA, 20 bp, Artificial Sequence
  Description of Artificial Sequence: Synthetic oligonucleotide
  Target: ATXN1; (+) strand; PAM type: NAAAAC; PAM sequence: AAAAAC
aaatgtagattatatgctaa

SEQ ID NO: 6221 - DNA, 20 bp, Artificial Sequence
  Description of Artificial Sequence: Synthetic oligonucleotide
  Target: ATXN1; (+) strand; PAM type: NAAAAC; PAM sequence: TAAAAC
aaaaaacgtaacttgtcccc

SEQ ID NO: 6222 - DNA, 20 bp, Artificial Sequence
  Description of Artificial Sequence: Synthetic oligonucleotide
  Target: ATXN1; (+) strand; PAM type: NAAAAC; PAM sequence: GAAAAC
ctgtgggcatgtggccatat

SEQ ID NO: 6223 - DNA, 20 bp, Artificial Sequence
  Description of Artificial Sequence: Synthetic oligonucleotide
  Target: ATXN1; (+) strand; PAM type: NAAAAC; PAM sequence: TAAAAC
ggagcttaacacaagaagct

SEQ ID NO: 6224 - DNA, 20 bp, Artificial Sequence
  Description of Artificial Sequence: Synthetic oligonucleotide
  Target: ATXN1; (+) strand; PAM type: NAAAAC; PAM sequence: GAAAAC
aatacaagtggagaaacttg

SEQ ID NO: 6225 - DNA, 20 bp, Artificial Sequence
  Description of Artificial Sequence: Synthetic oligonucleotide
  Target: ATXN1; (+) strand; PAM type: NAAAAC; PAM sequence: CAAAAC
tctgatactccactgaagga

SEQ ID NO: 6226 - DNA, 20 bp, Artificial Sequence
  Description of Artificial Sequence: Synthetic oligonucleotide
  Target: ATXN1; (+) strand; PAM type: NAAAAC; PAM sequence: TAAAAC
tggctcccacccgtaccgtt

SEQ ID NO: 6227 - DNA, 20 bp, Artificial Sequence
  Description of Artificial Sequence: Synthetic oligonucleotide
  Target: ATXN1; (+) strand; PAM type: NAAAAC; PAM sequence: CAAAAC
catagcagagcaaggagttc

SEQ ID NO: 6228 - DNA, 20 bp, Artificial Sequence
  Description of Artificial Sequence: Synthetic oligonucleotide
  Target: ATXN1; (+) strand; PAM type: NAAAAC; PAM sequence: CAAAAC
tcaaagggtgcattcagtcc

SEQ ID NO: 6229 - DNA, 20 bp, Artificial Sequence
  Description of Artificial Sequence: Synthetic oligonucleotide
  Target: ATXN1; (+) strand; PAM type: NAAAAC; PAM sequence: AAAAAC
tcatgacaggtctgcttgtt

SEQ ID NO: 6230 - DNA, 20 bp, Artificial Sequence
  Description of Artificial Sequence: Synthetic oligonucleotide
  Target: ATXN1; (+) strand; PAM type: NAAAAC; PAM sequence: AAAAAC
aaaaaaaaaaagaaaaagaa

SEQ ID NO: 6231 - DNA, 20 bp, Artificial Sequence
  Description of Artificial Sequence: Synthetic oligonucleotide
  Target: ATXN1; (+) strand; PAM type: NAAAAC; PAM sequence: CAAAAC
cgatcacggctttttgagct

SEQ ID NO: 6232 - DNA, 20 bp, Artificial Sequence
  Description of Artificial Sequence: Synthetic oligonucleotide
  Target: ATXN1; (+) strand; PAM type: NAAAAC; PAM sequence: CAAAAC
accctggactgcttacctct

SEQ ID NO: 6233 - DNA, 20 bp, Artificial Sequence
  Description of Artificial Sequence: Synthetic oligonucleotide
  Target: ATXN1; (+) strand; PAM type: NAAAAC; PAM sequence: CAAAAC
catcttagtacataaatcta

SEQ ID NO: 6234 - DNA, 20 bp, Artificial Sequence
  Description of Artificial Sequence: Synthetic oligonucleotide
  Target: ATXN1; (+) strand; PAM type: NAAAAC; PAM sequence: CAAAAC
aatggatattgctaaactga

SEQ ID NO: 6235 - DNA, 20 bp, Artificial Sequence
  Description of Artificial Sequence: Synthetic oligonucleotide
  Target: ATXN1; (+) strand; PAM type: NAAAAC; PAM sequence: TAAAAC
aaatcatctaccttgtcttc

SEQ ID NO: 6236 - DNA, 20 bp, Artificial Sequence
  Description of Artificial Sequence: Synthetic oligonucleotide
  Target: ATXN1; (+) strand; PAM type: NAAAAC; PAM sequence: AAAAAC
gcaactgtgacagaagaaat

SEQ ID NO: 6237 - DNA, 20 bp, Artificial Sequence
  Description of Artificial Sequence: Synthetic oligonucleotide
  Target: ATXN1; (+) strand; PAM type: NAAAAC; PAM sequence: CAAAAC
acttgtgtttaggttatctt

SEQ ID NO: 6238 - DNA, 20 bp, Artificial Sequence
  Description of Artificial Sequence: Synthetic oligonucleotide
  Target: ATXN1; (+) strand; PAM type: NAAAAC; PAM sequence: GAAAAC
tgatcatatgtggaaacaca

SEQ ID NO: 6239 - DNA, 20 bp, Artificial Sequence
  Description of Artificial Sequence: Synthetic oligonucleotide
  Target: ATXN1; (+) strand; PAM type: NAAAAC; PAM sequence: TAAAAC
cacagaaaacttaaaaaata

SEQ ID NO: 6240 - DNA, 20 bp, Artificial Sequence
  Description of Artificial Sequence: Synthetic oligonucleotide
  Target: ATXN1; (+) strand; PAM type: NAAAAC; PAM sequence: AAAAAC
gaagaatgaagtaaagccag

SEQ ID NO: 6241 - DNA, 20 bp, Artificial Sequence
  Description of Artificial Sequence: Synthetic oligonucleotide
  Target: ATXN1; (+) strand; PAM type: NAAAAC; PAM sequence: AAAAAC
gaggatttattgtaccatgc

SEQ ID NO: 6242 - DNA, 20 bp, Artificial Sequence
  Description of Artificial Sequence: Synthetic oligonucleotide
  Target: ATXN1; (+) strand; PAM type: NAAAAC; PAM sequence: TAAAAC
tccaatctatttttctttta

SEQ ID NO: 6243 - DNA, 20 bp, Artificial Sequence
  Description of Artificial Sequence: Synthetic oligonucleotide
  Target: ATXN1; (+) strand; PAM type: NAAAAC; PAM sequence: TAAAAC
tatttatagctcagacactt

SEQ ID NO: 6244 - DNA, 20 bp, Artificial Sequence
  Description of Artificial Sequence: Synthetic oligonucleotide
  Target: ATXN1; (+) strand; PAM type: NAAAAC; PAM sequence: GAAAAC
tatgtctttattagcagcat

SEQ ID NO: 6245 - DNA, 20 bp, Artificial Sequence
  Description of Artificial Sequence: Synthetic oligonucleotide
  Target: ATXN1; (+) strand; PAM type: NAAAAC; PAM sequence: AAAAAC
attagaaataacagtagctt

SEQ ID NO: 6246 - DNA, 20 bp, Artificial Sequence
  Description of Artificial Sequence: Synthetic oligonucleotide
  Target: ATXN1; (+) strand; PAM type: NAAAAC; PAM sequence: AAAAAC
cttaaaaacttccctactat

SEQ ID NO: 6247 - DNA, 20 bp, Artificial Sequence
  Description of Artificial Sequence: Synthetic oligonucleotide
  Target: ATXN1; (+) strand; PAM type: NAAAAC; PAM sequence: GAAAAC
catgactaagccacttgaca

SEQ ID NO: 6248 - DNA, 20 bp, Artificial Sequence
  Description of Artificial Sequence: Synthetic oligonucleotide
  Target: ATXN1; (+) strand; PAM type: NAAAAC; PAM sequence: CAAAAC
aaattacactctggactgaa

SEQ ID NO: 6249 - DNA, 20 bp, Artificial Sequence
  Description of Artificial Sequence: Synthetic oligonucleotide
  Target: ATXN1; (+) strand; PAM type: NAAAAC; PAM sequence: AAAAAC
attctactttttggactcaa

SEQ ID NO: 6250 - DNA, 20 bp, Artificial Sequence
  Description of Artificial Sequence: Synthetic oligonucleotide
  Target: ATXN1; (+) strand; PAM type: NAAAAC; PAM sequence: TAAAAC
taaacgctgaaaaatgcttg

SEQ ID NO: 6251 - DNA, 20 bp, Artificial Sequence
  Description of Artificial Sequence: Synthetic oligonucleotide
  Target: ATXN1; (+) strand; PAM type: NAAAAC; PAM sequence: GAAAAC
aacttgtggagccaggacta

SEQ ID NO: 6252 - DNA, 20 bp, Artificial Sequence
  Description of Artificial Sequence: Synthetic oligonucleotide
  Target: ATXN1; (+) strand; PAM type: NAAAAC; PAM sequence: GAAAAC
agtgaagtaactcaagaatg

SEQ ID NO: 6253 - DNA, 20 bp, Artificial Sequence
  Description of Artificial Sequence: Synthetic oligonucleotide
  Target: ATXN1; (+) strand; PAM type: NAAAAC; PAM sequence: GAAAAC
taagaaaagaggaaggaaag

SEQ ID NO: 6254 - DNA, 20 bp, Artificial Sequence
  Description of Artificial Sequence: Synthetic oligonucleotide
  Target: ATXN1; (+) strand; PAM type: NAAAAC; PAM sequence: CAAAAC
gccagacacatttcagatgt

SEQ ID NO: 6255 - DNA, 20 bp, Artificial Sequence
  Description of Artificial Sequence: Synthetic oligonucleotide
  Target: ATXN1; (+) strand; PAM type: NAAAAC; PAM sequence: AAAAAC
tagactcaccctgaccccca

SEQ ID NO: 6256 - DNA, 20 bp, Artificial Sequence
  Description of Artificial Sequence: Synthetic oligonucleotide
  Target: ATXN1; (+) strand; PAM type: NAAAAC; PAM sequence: AAAAAC
gaaagtttattcaaatagat

SEQ ID NO: 6257 - DNA, 20 bp, Artificial Sequence
  Description of Artificial Sequence: Synthetic oligonucleotide
  Target: ATXN1; (+) strand; PAM type: NAAAAC; PAM sequence: CAAAAC
tggctattagtaattctacc

SEQ ID NO: 6258 - DNA, 20 bp, Artificial Sequence
  Description of Artificial Sequence: Synthetic oligonucleotide
  Target: ATXN1; (+) strand; PAM type: NAAAAC; PAM sequence: TAAAAC
ttttccttcttttcaaacta

SEQ ID NO: 6259 - DNA, 20 bp, Artificial Sequence
  Description of Artificial Sequence: Synthetic oligonucleotide
  Target: ATXN1; (+) strand; PAM type: NAAAAC; PAM sequence: TAAAAC
tgaaataattcaccacttat

SEQ ID NO: 6260 - DNA, 20 bp, Artificial Sequence
  Description of Artificial Sequence: Synthetic oligonucleotide
  Target: ATXN1; (+) strand; PAM type: NAAAAC; PAM sequence: AAAAAC
cacccagctagtctggggac

SEQ ID NO: 6261 - DNA, 20 bp, Artificial Sequence
  Description of Artificial Sequence: Synthetic oligonucleotide
  Target: ATXN1; (+) strand; PAM type: NAAAAC; PAM sequence: TAAAAC
cctactatgcatcagacata

SEQ ID NO: 6262 - DNA, 20 bp, Artificial Sequence
  Description of Artificial Sequence: Synthetic oligonucleotide
  Target: ATXN1; (+) strand; PAM type: NAAAAC; PAM sequence: TAAAAC
atgcaaggagaaacctatga

SEQ ID NO: 6263 - DNA, 20 bp, Artificial Sequence
  Description of Artificial Sequence: Synthetic oligonucleotide
  Target: ATXN1; (+) strand; PAM type: NAAAAC; PAM sequence: TAAAAC
acatatctctgaatgctgag

SEQ ID NO: 6264 - DNA, 20 bp, Artificial Sequence
  Description of Artificial Sequence: Synthetic oligonucleotide
  Target: ATXN1; (+) strand; PAM type: NAAAAC; PAM sequence: TAAAAC
gtggggccattctgaatcct

SEQ ID NO: 6265 - DNA, 20 bp, Artificial Sequence
  Description of Artificial Sequence: Synthetic oligonucleotide
  Target: ATXN1; (+) strand; PAM type: NAAAAC; PAM sequence: TAAAAC
tgaatttagtggatactttt

SEQ ID NO: 6266 - DNA, 20 bp, Artificial Sequence
  Description of Artificial Sequence: Synthetic oligonucleotide
  Target: ATXN1; (+) strand; PAM type: NAAAAC; PAM sequence: AAAAAC
ctgagagtgattcttcacat

SEQ ID NO: 6267 - DNA, 20 bp, Artificial Sequence
  Description of Artificial Sequence: Synthetic oligonucleotide
  Target: ATXN1; (+) strand; PAM type: NAAAAC; PAM sequence: AAAAAC
aaacacatgaaattcctcaa

SEQ ID NO: 6268 - DNA, 20 bp, Artificial Sequence
  Description of Artificial Sequence: Synthetic oligonucleotide
  Target: ATXN1; (+) strand; PAM type: NAAAAC; PAM sequence: GAAAAC
attttccttctggaggaaaa

SEQ ID NO: 6269 - DNA, 20 bp, Artificial Sequence
  Description of Artificial Sequence: Synthetic oligonucleotide
  Target: ATXN1; (+) strand; PAM type: NAAAAC; PAM sequence: AAAAAC
gtggcgttaatccatttacg

SEQ ID NO: 6270 - DNA, 20 bp, Artificial Sequence
  Description of Artificial Sequence: Synthetic oligonucleotide
  Target: ATXN1; (+) strand; PAM type: NAAAAC; PAM sequence: GAAAAC
aaaagttatgaaggtcttct

SEQ ID NO: 6271 - DNA, 20 bp, Artificial Sequence
  Description of Artificial Sequence: Synthetic oligonucleotide
  Target: ATXN1; (+) strand; PAM type: NAAAAC; PAM sequence: GAAAAC
tgaaggtcttctgaaaacaa

SEQ ID NO: 6272 - DNA, 20 bp, Artificial Sequence
  Description of Artificial Sequence: Synthetic oligonucleotide
  Target: ATXN1; (+) strand; PAM type: NAAAAC; PAM sequence: GAAAAC
caagaaaacactattcagat

SEQ ID NO: 6273 - DNA, 20 bp, Artificial Sequence
  Description of Artificial Sequence: Synthetic oligonucleotide
  Target: ATXN1; (+) strand; PAM type: NAAAAC; PAM sequence: AAAAAC
cacaggtaatggtatttttt

SEQ ID NO: 6274 - DNA, 20 bp, Artificial Sequence
  Description of Artificial Sequence: Synthetic oligonucleotide
  Target: ATXN1; (+) strand; PAM type: NAAAAC; PAM sequence: CAAAAC
tattcgagtaaattcataag

SEQ ID NO: 6275 - DNA, 20 bp, Artificial Sequence
  Description of Artificial Sequence: Synthetic oligonucleotide
  Target: ATXN1; (+) strand; PAM type: NAAAAC; PAM sequence: AAAAAC
atggtttaataaattatatt

SEQ ID NO: 6276 - DNA, 20 bp, Artificial Sequence
  Description of Artificial Sequence: Synthetic oligonucleotide
  Target: ATXN1; (+) strand; PAM type: NAAAAC; PAM sequence: AAAAAC
tctcaaaaaaaaaaaaaaaa

SEQ ID NO: 6277 - DNA, 20 bp, Artificial Sequence
  Description of Artificial Sequence: Synthetic oligonucleotide
  Target: ATXN1; (+) strand; PAM type: NAAAAC; PAM sequence: AAAAAC
aaaaaaaaaaaaacaagaac

SEQ ID NO: 6278 - DNA, 20 bp, Artificial Sequence
  Description of Artificial Sequence: Synthetic oligonucleotide
  Target: ATXN1; (+) strand; PAM type: NAAAAC; PAM sequence: AAAAAC
aaaaaaacaagaacaaaaac

SEQ ID NO: 6279 - DNA, 20 bp, Artificial Sequence
  Description of Artificial Sequence: Synthetic oligonucleotide
  Target: ATXN1; (+) strand; PAM type: NAAAAC; PAM sequence: GAAAAC
ttgtgtcttagtttttaaca

SEQ ID NO: 6280 - DNA, 20 bp, Artificial Sequence
  Description of Artificial Sequence: Synthetic oligonucleotide
  Target: ATXN1; (+) strand; PAM type: NAAAAC; PAM sequence: AAAAAC
taacagaaaacttaaaaaaa

SEQ ID NO: 6281 - DNA, 20 bp, Artificial Sequence
  Description of Artificial Sequence: Synthetic oligonucleotide
  Target: ATXN1; (+) strand; PAM type: NAAAAC; PAM sequence: AAAAAC
tagtgagacttagtttctac

SEQ ID NO: 6282 - DNA, 20 bp, Artificial Sequence
  Description of Artificial Sequence: Synthetic oligonucleotide
  Target: ATXN1; (+) strand; PAM type: NAAAAC; PAM sequence: AAAAAC
atcaaagaaagaacaattta

SEQ ID NO: 6283 - DNA, 20 bp, Artificial Sequence
  Description of Artificial Sequence: Synthetic oligonucleotide
  Target: ATXN1; (+) strand; PAM type: NAAAAC; PAM sequence: AAAAAC
tattctatgtctagatgcac

SEQ ID NO: 6284 - DNA, 20 bp, Artificial Sequence
  Description of Artificial Sequence: Synthetic oligonucleotide
  Target: ATXN1; (+) strand; PAM type: NAAAAC; PAM sequence: AAAAAC
agaatactatcttcaagaac

SEQ ID NO: 6285 - DNA, 20 bp, Artificial Sequence
  Description of Artificial Sequence: Synthetic oligonucleotide
  Target: ATXN1; (+) strand; PAM type: NAAAAC; PAM sequence: GAAAAC
cacacacatttcatgagggg

SEQ ID NO: 6286 - DNA, 20 bp, Artificial Sequence
  Description of Artificial Sequence: Synthetic oligonucleotide
  Target: ATXN1; (+) strand; PAM type: NAAAAC; PAM sequence: AAAAAC
agatggcaagcttttccagt

SEQ ID NO: 6287 - DNA, 20 bp, Artificial Sequence
  Description of Artificial Sequence: Synthetic oligonucleotide
  Target: ATXN1; (+) strand; PAM type: NAAAAC; PAM sequence: TAAAAC
ctcacgactccagccagggt

SEQ ID NO: 6288 - DNA, 20 bp, Artificial Sequence
  Description of Artificial Sequence: Synthetic oligonucleotide
  Target: ATXN1; (+) strand; PAM type: NAAAAC; PAM sequence: AAAAAC
gaactaaccatcacaaaggc

SEQ ID NO: 6289 - DNA, 20 bp, Artificial Sequence
  Description of Artificial Sequence: Synthetic oligonucleotide
  Target: ATXN1; (+) strand; PAM type: NAAAAC; PAM sequence: GAAAAC
atggactgaccttgtggctg

SEQ ID NO: 6290 - DNA, 20 bp, Artificial Sequence
  Description of Artificial Sequence: Synthetic oligonucleotide
  Target: ATXN1; (+) strand; PAM type: NAAAAC; PAM sequence: TAAAAC
gactttccctgctgttctat

SEQ ID NO: 6291 - DNA, 20 bp, Artificial Sequence
  Description of Artificial Sequence: Synthetic oligonucleotide
  Target: ATXN1; (+) strand; PAM type: NAAAAC; PAM sequence: GAAAAC
cttcctttttaaaaagatta

SEQ ID NO: 6292 - DNA, 20 bp, Artificial Sequence
  Description of Artificial Sequence: Synthetic oligonucleotide
  Target: ATXN1; (+) strand; PAM type: NAAAAC; PAM sequence: TAAAAC
ctagtaccccattaattttc

SEQ ID NO: 6293 - DNA, 20 bp, Artificial Sequence
  Description of Artificial Sequence: Synthetic oligonucleotide
  Target: ATXN1; (+) strand; PAM type: NAAAAC; PAM sequence: AAAAAC
aggtgagacccttgactcta

SEQ ID NO: 6294 - DNA, 20 bp, Artificial Sequence
  Description of Artificial Sequence: Synthetic oligonucleotide
  Target: ATXN1; (+) strand; PAM type: NAAAAC; PAM sequence: AAAAAC
gtctaaggttagacagcaac

SEQ ID NO: 6295 - DNA, 20 bp, Artificial Sequence
  Description of Artificial Sequence: Synthetic oligonucleotide
  Target: ATXN1; (+) strand; PAM type: NAAAAC; PAM sequence: TAAAAC
tgcaggggaatgcctctttt

SEQ ID NO: 6296 - DNA, 20 bp, Artificial Sequence
  Description of Artificial Sequence: Synthetic oligonucleotide
  Target: ATXN1; (+) strand; PAM type: NAAAAC; PAM sequence: AAAAAC
agttgatctatatggctgga

SEQ ID NO: 6297 - DNA, 20 bp, Artificial Sequence
  Description of Artificial Sequence: Synthetic oligonucleotide
  Target: ATXN1; (+) strand; PAM type: NAAAAC; PAM sequence: CAAAAC
tttaccctttaatgttttca

SEQ ID NO: 6298 - DNA, 20 bp, Artificial Sequence
  Description of Artificial Sequence: Synthetic oligonucleotide
  Target: ATXN1; (+) strand; PAM type: NAAAAC; PAM sequence: TAAAAC
tggtttttctaattcgtttt

SEQ ID NO: 6299 - DNA, 20 bp, Artificial Sequence
  Description of Artificial Sequence: Synthetic oligonucleotide
  Target: ATXN1; (+) strand; PAM type: NAAAAC; PAM sequence: TAAAAC
gaggagagacagaaagaaca

SEQ ID NO: 6300 - DNA, 20 bp, Artificial Sequence
  Description of Artificial Sequence: Synthetic oligonucleotide
  Target: ATXN1; (+) strand; PAM type: NAAAAC; PAM sequence: CAAAAC
cagaaaaaattcacgaactc

SEQ ID NO: 6301 - DNA, 20 bp, Artificial Sequence
  Description of Artificial Sequence: Synthetic oligonucleotide
  Target: ATXN1; (+) strand; PAM type: NAAAAC; PAM sequence: TAAAAC
tgaattttttttaactctct

SEQ ID NO: 6302 - DNA, 20 bp, Artificial Sequence
  Description of Artificial Sequence: Synthetic oligonucleotide
  Target: ATXN1; (+) strand; PAM type: NAAAAC; PAM sequence: CAAAAC
acttcatcttcttctacctc

SEQ ID NO: 6303 - DNA, 20 bp, Artificial Sequence
  Description of Artificial Sequence: Synthetic oligonucleotide
  Target: ATXN1; (+) strand; PAM type: NAAAAC; PAM sequence: TAAAAC
caggaggtggggggagcaaa

SEQ ID NO: 6304 - DNA, 20 bp, Artificial Sequence
  Description of Artificial Sequence: Synthetic oligonucleotide
  Target: ATXN1; (+) strand; PAM type: NAAAAC; PAM sequence: TAAAAC
agcactatttattgcacacc

SEQ ID NO: 6305 - DNA, 20 bp, Artificial Sequence
  Description of Artificial Sequence: Synthetic oligonucleotide
  Target: ATXN1; (+) strand; PAM type: NAAAAC; PAM sequence: GAAAAC
cagggagctgggagcaaaga

SEQ ID NO: 6306 - DNA, 20 bp, Artificial Sequence
  Description of Artificial Sequence: Synthetic oligonucleotide
  Target: ATXN1; (+) strand; PAM type: NAAAAC; PAM sequence: TAAAAC
attggtgatgcaggaagcaa

SEQ ID NO: 6307 - DNA, 20 bp, Artificial Sequence
  Description of Artificial Sequence: Synthetic oligonucleotide
  Target: ATXN1; (+) strand; PAM type: NAAAAC; PAM sequence: TAAAAC
gattgttcaacgtgaggtct

SEQ ID NO: 6308 - DNA, 20 bp, Artificial Sequence
  Description of Artificial Sequence: Synthetic oligonucleotide
  Target: ATXN1; (+) strand; PAM type: NAAAAC; PAM sequence: TAAAAC
aattttttcaagaatctaaa

SEQ ID NO: 6309 - DNA, 20 bp, Artificial Sequence
  Description of Artificial Sequence: Synthetic oligonucleotide
  Target: ATXN1; (+) strand; PAM type: NAAAAC; PAM sequence: CAAAAC
tgttccgtgtactcttgtgg

SEQ ID NO: 6310 - DNA, 20 bp, Artificial Sequence
  Description of Artificial Sequence: Synthetic oligonucleotide
  Target: ATXN1; (+) strand; PAM type: NAAAAC; PAM sequence: AAAAAC
taaataacttatgcaaattg

SEQ ID NO: 6311 - DNA, 20 bp, Artificial Sequence
  Description of Artificial Sequence: Synthetic oligonucleotide
  Target: ATXN1; (+) strand; PAM type: NAAAAC; PAM sequence: AAAAAC
tgtgtttaattccaatttta

SEQ ID NO: 6312 - DNA, 20 bp, Artificial Sequence
  Description of Artificial Sequence: Synthetic oligonucleotide
  Target: ATXN1; (+) strand; PAM type: NAAAAC; PAM sequence: TAAAAC
ttgctttgacatttattttc

SEQ ID NO: 6313 - DNA, 20 bp, Artificial Sequence
  Description of Artificial Sequence: Synthetic oligonucleotide
  Target: ATXN1; (+) strand; PAM type: NAAAAC; PAM sequence: AAAAAC
tctttatgaaactaaaaaaa

SEQ ID NO: 6314 - DNA, 20 bp, Artificial Sequence
  Description of Artificial Sequence: Synthetic oligonucleotide
  Target: ATXN1; (+) strand; PAM type: NAAAAC; PAM sequence: CAAAAC
cgagttctagagaagttcca

SEQ ID NO: 6315 - DNA, 20 bp, Artificial Sequence
  Description of Artificial Sequence: Synthetic oligonucleotide
  Target: ATXN1; (+) strand; PAM type: NAAAAC; PAM sequence: GAAAAC
atgctggttgcgggttgagc

SEQ ID NO: 6316 - DNA, 20 bp, Artificial Sequence
  Description of Artificial Sequence: Synthetic oligonucleotide
  Target: ATXN1; (+) strand; PAM type: NAAAAC; PAM sequence: GAAAAC
aaaaagatgtaaaataattt

SEQ ID NO: 6317 - DNA, 20 bp, Artificial Sequence
  Description of Artificial Sequence: Synthetic oligonucleotide
  Target: ATXN1; (+) strand; PAM type: NAAAAC; PAM sequence: CAAAAC
agaactttcacccggaaact

SEQ ID NO: 6318 - DNA, 20 bp, Artificial Sequence
  Description of Artificial Sequence: Synthetic oligonucleotide
  Target: ATXN1; (+) strand; PAM type: NAAAAC; PAM sequence: TAAAAC
aaagaaaccaaacaacaaaa

SEQ ID NO: 6319 - DNA, 20 bp, Artificial Sequence
  Description of Artificial Sequence: Synthetic oligonucleotide
  Target: ATXN1; (+) strand; PAM type: NAAAAC; PAM sequence: TAAAAC
taatgcttatcggtcactgt

SEQ ID NO: 6320 - DNA, 20 bp, Artificial Sequence
  Description of Artificial Sequence: Synthetic oligonucleotide
  Target: ATXN1; (+) strand; PAM type: NAAAAC; PAM sequence: TAAAAC
tattataagaaagctaaaga

SEQ ID NO: 6321 - DNA, 20 bp, Artificial Sequence
  Description of Artificial Sequence: Synthetic oligonucleotide
  Target: ATXN1; (+) strand; PAM type: NAAAAC; PAM sequence: AAAAAC
tatgaaccataaactgattt

SEQ ID NO: 6322 - DNA, 20 bp, Artificial Sequence
  Description of Artificial Sequence: Synthetic oligonucleotide
  Target: ATXN1; (+) strand; PAM type: NAAAAC; PAM sequence: CAAAAC
ctgatttaaaaacacacatg

SEQ ID NO: 6323 - DNA, 20 bp, Artificial Sequence
  Description of Artificial Sequence: Synthetic oligonucleotide
  Target: ATXN1; (+) strand; PAM type: NAAAAC; PAM sequence: AAAAAC
aaactgaacaacaacaacaa

SEQ ID NO: 6324 - DNA, 20 bp, Artificial Sequence
  Description of Artificial Sequence: Synthetic oligonucleotide
  Target: ATXN1; (+) strand; PAM type: NAAAAC; PAM sequence: TAAAAC
ctgggaaatagggcttcgca

SEQ ID NO: 6325 - DNA, 20 bp, Artificial Sequence
  Description of Artificial Sequence: Synthetic oligonucleotide
  Target: ATXN1; (+) strand; PAM type: NAAAAC; PAM sequence: AAAAAC
gaaaccatcttacttatagc

SEQ ID NO: 6326 - DNA, 20 bp, Artificial Sequence
  Description of Artificial Sequence: Synthetic oligonucleotide
  Target: ATXN1; (+) strand; PAM type: NAAAAC; PAM sequence: CAAAAC
gctgggagcaaaaataatct

SEQ ID NO: 6327 - DNA, 20 bp, Artificial Sequence
  Description of Artificial Sequence: Synthetic oligonucleotide
  Target: ATXN1; (+) strand; PAM type: NAAAAC; PAM sequence: AAAAAC
agctttcaaaaaaaaaaaaa

SEQ ID NO: 6328 - DNA, 20 bp, Artificial Sequence
  Description of Artificial Sequence: Synthetic oligonucleotide
  Target: ATXN1; (+) strand; PAM type: NAAAAC; PAM sequence: AAAAAC
acctcagagctcttgaggtt

SEQ ID NO: 6329 - DNA, 20 bp, Artificial Sequence
  Description of Artificial Sequence: Synthetic oligonucleotide
  Target: ATXN1; (+) strand; PAM type: NAAAAC; PAM sequence: AAAAAC
attaatccctggctcctggc

SEQ ID NO: 6330 - DNA, 20 bp, Artificial Sequence
  Description of Artificial Sequence: Synthetic oligonucleotide
  Target: ATXN1; (+) strand; PAM type: NAAAAC; PAM sequence: TAAAAC
gttactctgcctaaaatgga

SEQ ID NO: 6331 - DNA, 20 bp, Artificial Sequence
  Description of Artificial Sequence: Synthetic oligonucleotide
  Target: ATXN1; (+) strand; PAM type: NAAAAC; PAM sequence: CAAAAC
aaaatggataaaactcggaa

SEQ ID NO: 6332 - DNA, 20 bp, Artificial Sequence
  Description of Artificial Sequence: Synthetic oligonucleotide
  Target: ATXN1; (+) strand; PAM type: NAAAAC; PAM sequence: GAAAAC
aagtaattattagaaagtga

SEQ ID NO: 6333 - DNA, 20 bp, Artificial Sequence
  Description of Artificial Sequence: Synthetic oligonucleotide
  Target: ATXN1; (+) strand; PAM type: NAAAAC; PAM sequence: CAAAAC
agacttaaactgctaagaga

SEQ ID NO: 6334 - DNA, 20 bp, Artificial Sequence
  Description of Artificial Sequence: Synthetic oligonucleotide
  Target: ATXN1; (+) strand; PAM type: NAAAAC; PAM sequence: GAAAAC
aactgctaagagacaaaact

SEQ ID NO: 6335 - DNA, 20 bp, Artificial Sequence
  Description of Artificial Sequence: Synthetic oligonucleotide
  Target: ATXN1; (+) strand; PAM type: NAAAAC; PAM sequence: GAAAAC
catttactggtttatggtag

SEQ ID NO: 6336 - DNA, 20 bp, Artificial Sequence
  Description of Artificial Sequence: Synthetic oligonucleotide
  Target: ATXN1; (+) strand; PAM type: NAAAAC; PAM sequence: AAAAAC
cagggtagcatgagcttttt

SEQ ID NO: 6337 - DNA, 20 bp, Artificial Sequence
  Description of Artificial Sequence: Synthetic oligonucleotide
  Target: ATXN1; (+) strand; PAM type: NAAAAC; PAM sequence: CAAAAC
tcctctgaatgggcattttt

SEQ ID NO: 6338 - DNA, 20 bp, Artificial Sequence
  Description of Artificial Sequence: Synthetic oligonucleotide
  Target: ATXN1; (+) strand; PAM type: NAAAAC; PAM sequence: AAAAAC
actgcaggggcaatatggaa

SEQ ID NO: 6339 - DNA, 20 bp, Artificial Sequence
  Description of Artificial Sequence: Synthetic oligonucleotide
  Target: ATXN1; (+) strand; PAM type: NAAAAC; PAM sequence: GAAAAC
caacagcctcctcaagtagg

SEQ ID NO: 6340 - DNA, 20 bp, Artificial Sequence
  Description of Artificial Sequence: Synthetic oligonucleotide
  Target: ATXN1; (+) strand; PAM type: NAAAAC; PAM sequence: GAAAAC
acttgttagccatcaggtct

SEQ ID NO: 6341 - DNA, 20 bp, Artificial Sequence
  Description of Artificial Sequence: Synthetic oligonucleotide
  Target: ATXN1; (+) strand; PAM type: NAAAAC; PAM sequence: CAAAAC
tcaggtattactttgtcctt

SEQ ID NO: 6342 - DNA, 20 bp, Artificial Sequence
  Description of Artificial Sequence: Synthetic oligonucleotide
  Target: ATXN1; (+) strand; PAM type: NAAAAC; PAM sequence: TAAAAC
gcagatttcagacgcattta

SEQ ID NO: 6343 - DNA, 20 bp, Artificial Sequence
  Description of Artificial Sequence: Synthetic oligonucleotide
  Target: ATXN1; (+) strand; PAM type: NAAAAC; PAM sequence: GAAAAC
tggcagcaaaatctcttgct

SEQ ID NO: 6344 - DNA, 20 bp, Artificial Sequence
  Description of Artificial Sequence: Synthetic oligonucleotide
  Target: ATXN1; (+) strand; PAM type: NAAAAC; PAM sequence: AAAAAC
cctgtggaactataagatcc

SEQ ID NO: 6345 - DNA, 20 bp, Artificial Sequence
  Description of Artificial Sequence: Synthetic oligonucleotide
  Target: ATXN1; (+) strand; PAM type: NAAAAC; PAM sequence: GAAAAC
gagttggctggttctaagtg

SEQ ID NO: 6346 - DNA, 20 bp, Artificial Sequence
  Description of Artificial Sequence: Synthetic oligonucleotide
  Target: ATXN1; (+) strand; PAM type: NAAAAC; PAM sequence: TAAAAC
aggctttcattcagcttcta

SEQ ID NO: 6347 - DNA, 20 bp, Artificial Sequence
  Description of Artificial Sequence: Synthetic oligonucleotide
  Target: ATXN1; (+) strand; PAM type: NAAAAC; PAM sequence: AAAAAC
gtccttttagcattaaaaaa

SEQ ID NO: 6348 - DNA, 20 bp, Artificial Sequence
  Description of Artificial Sequence: Synthetic oligonucleotide
  Target: ATXN1; (+) strand; PAM type: NAAAAC; PAM sequence: AAAAAC
taggcccattcgatccacat

SEQ ID NO: 6349 - DNA, 20 bp, Artificial Sequence
  Description of Artificial Sequence: Synthetic oligonucleotide
  Target: ATXN1; (+) strand; PAM type: NAAAAC; PAM sequence: TAAAAC
ctgccttgattttgcagaag

SEQ ID NO: 6350 - DNA, 20 bp, Artificial Sequence
  Description of Artificial Sequence: Synthetic oligonucleotide
  Target: ATXN1; (+) strand; PAM type: NAAAAC; PAM sequence: AAAAAC
ataccaaatggtactaatat

SEQ ID NO: 6351 - DNA, 20 bp, Artificial Sequence
  Description of Artificial Sequence: Synthetic oligonucleotide
  Target: ATXN1; (+) strand; PAM type: NAAAAC; PAM sequence: TAAAAC
gaccaaacagatttaatagt

SEQ ID NO: 6352 - DNA, 20 bp, Artificial Sequence
  Description of Artificial Sequence: Synthetic oligonucleotide
  Target: ATXN1; (+) strand; PAM type: NAAAAC; PAM sequence: CAAAAC
ttctatgtatttcaatctct

SEQ ID NO: 6353 - DNA, 20 bp, Artificial Sequence
  Description of Artificial Sequence: Synthetic oligonucleotide
  Target: ATXN1; (+) strand; PAM type: NAAAAC; PAM sequence: TAAAAC
atctctcaaaactaatgttt

SEQ ID NO: 6354 - DNA, 20 bp, Artificial Sequence
  Description of Artificial Sequence: Synthetic oligonucleotide
  Target: ATXN1; (+) strand; PAM type: NAAAAC; PAM sequence: AAAAAC
ggagattttagaggtgggca

SEQ ID NO: 6355 - DNA, 20 bp, Artificial Sequence
  Description of Artificial Sequence: Synthetic oligonucleotide
  Target: ATXN1; (+) strand; PAM type: NAAAAC; PAM sequence: TAAAAC
ccaaatcagactgaaacaag

SEQ ID NO: 6356 - DNA, 20 bp, Artificial Sequence
  Description of Artificial Sequence: Synthetic oligonucleotide
  Target: ATXN1; (+) strand; PAM type: NAAAAC; PAM sequence: CAAAAC
acagaaacatgtgcacacat

SEQ ID NO: 6357 - DNA, 20 bp, Artificial Sequence
  Description of Artificial Sequence: Synthetic oligonucleotide
  Target: ATXN1; (+) strand; PAM type: NAAAAC; PAM sequence: GAAAAC
tttgtcctcagaattggatg

SEQ ID NO: 6358 - DNA, 20 bp, Artificial Sequence
  Description of Artificial Sequence: Synthetic oligonucleotide
  Target: ATXN1; (+) strand; PAM type: NAAAAC; PAM sequence: TAAAAC
cttaatttctctttcccttc

SEQ ID NO: 6359 - DNA, 20 bp, Artificial Sequence
  Description of Artificial Sequence: Synthetic oligonucleotide
  Target: ATXN1; (+) strand; PAM type: NAAAAC; PAM sequence: AAAAAC
ggaacagttggaagaggtgt

SEQ ID NO: 6360 - DNA, 20 bp, Artificial Sequence
  Description of Artificial Sequence: Synthetic oligonucleotide
  Target: ATXN1; (+) strand; PAM type: NAAAAC; PAM sequence: AAAAAC
gtgagatgagaactcctatt

SEQ ID NO: 6361 - DNA, 20 bp, Artificial Sequence
  Description of Artificial Sequence: Synthetic oligonucleotide
  Target: ATXN1; (+) strand; PAM type: NAAAAC; PAM sequence: TAAAAC
gggctcaattttctcacctg

SEQ ID NO: 6362 - DNA, 20 bp, Artificial Sequence
  Description of Artificial Sequence: Synthetic oligonucleotide
  Target: ATXN1; (+) strand; PAM type: NAAAAC; PAM sequence: AAAAAC
atggtttgaaggcatcaaca

SEQ ID NO: 6363 - DNA, 20 bp, Artificial Sequence
  Description of Artificial Sequence: Synthetic oligonucleotide
  Target: ATXN1; (+) strand; PAM type: NAAAAC; PAM sequence: GAAAAC
tgttgtattattttctaaca

SEQ ID NO: 6364 - DNA, 20 bp, Artificial Sequence
  Description of Artificial Sequence: Synthetic oligonucleotide
  Target: ATXN1; (+) strand; PAM type: NAAAAC; PAM sequence: CAAAAC
ctccagcctgggcaacatgg

SEQ ID NO: 6365 - DNA, 20 bp, Artificial Sequence
  Description of Artificial Sequence: Synthetic oligonucleotide
  Target: ATXN1; (+) strand; PAM type: NAAAAC; PAM sequence: CAAAAC
ttaccacagagacatgcccc

SEQ ID NO: 6366 - DNA, 20 bp, Artificial Sequence
  Description of Artificial Sequence: Synthetic oligonucleotide
  Target: ATXN1; (+) strand; PAM type: NAAAAC; PAM sequence: GAAAAC
gacatgcccccaaaacagat

SEQ ID NO: 6367 - DNA, 20 bp, Artificial Sequence
  Description of Artificial Sequence: Synthetic oligonucleotide
  Target: ATXN1; (+) strand; PAM type: NAAAAC; PAM sequence: AAAAAC
aaaggaacactaatcccaat

SEQ ID NO: 6368 - DNA, 20 bp, Artificial Sequence
  Description of Artificial Sequence: Synthetic oligonucleotide
  Target: ATXN1; (+) strand; PAM type: NAAAAC; PAM sequence: GAAAAC
tcagaaatgaagtgattgga

SEQ ID NO: 6369 - DNA, 20 bp, Artificial Sequence
  Description of Artificial Sequence: Synthetic oligonucleotide
  Target: ATXN1; (+) strand; PAM type: NAAAAC; PAM sequence: AAAAAC
tttgaagtaaaagaaaaaaa

SEQ ID NO: 6370 - DNA, 20 bp, Artificial Sequence
  Description of Artificial Sequence: Synthetic oligonucleotide
  Target: ATXN1; (+) strand; PAM type: NAAAAC; PAM sequence: AAAAAC
acaatagcaatgataacaac

SEQ ID NO: 6371 - DNA, 20 bp, Artificial Sequence
  Description of Artificial Sequence: Synthetic oligonucleotide
  Target: ATXN1; (+) strand; PAM type: NAAAAC; PAM sequence: AAAAAC
gaaattggaattacacagcc

SEQ ID NO: 6372 - DNA, 20 bp, Artificial Sequence
  Description of Artificial Sequence: Synthetic oligonucleotide
  Target: ATXN1; (+) strand; PAM type: NAAAAC; PAM sequence: GAAAAC
ccttatccctaaaaatacaa

SEQ ID NO: 6373 - DNA, 20 bp, Artificial Sequence
  Description of Artificial Sequence: Synthetic oligonucleotide
  Target: ATXN1; (+) strand; PAM type: NAAAAC; PAM sequence: CAAAAC
ttaccacagagacatgcccc

SEQ ID NO: 6374 - DNA, 20 bp, Artificial Sequence
  Description of Artificial Sequence: Synthetic oligonucleotide
  Target: ATXN1; (+) strand; PAM type: NAAAAC; PAM sequence: GAAAAC
gacatgcccccaaaacagat

SEQ ID NO: 6375 - DNA, 20 bp, Artificial Sequence
  Description of Artificial Sequence: Synthetic oligonucleotide
  Target: ATXN1; (+) strand; PAM type: NAAAAC; PAM sequence: AAAAAC
aaaggaacactaatcccaat

SEQ ID NO: 6376 - DNA, 20 bp, Artificial Sequence
  Description of Artificial Sequence: Synthetic oligonucleotide
  Target: ATXN1; (+) strand; PAM type: NAAAAC; PAM sequence: GAAAAC
aacgtgggaaagaatttgaa

SEQ ID NO: 6377 - DNA, 20 bp, Artificial Sequence
  Description of Artificial Sequence: Synthetic oligonucleotide
  Target: ATXN1; (+) strand; PAM type: NAAAAC; PAM sequence: GAAAAC
agaaaaggaacatgagcaaa

SEQ ID NO: 6378 - DNA, 20 bp, Artificial Sequence
  Description of Artificial Sequence: Synthetic oligonucleotide
  Target: ATXN1; (+) strand; PAM type: NAAAAC; PAM sequence: AAAAAC
ctttgaagaagaaaagcaat

SEQ ID NO: 6379 - DNA, 20 bp, Artificial Sequence
  Description of Artificial Sequence: Synthetic oligonucleotide
  Target: ATXN1; (+) strand; PAM type: NAAAAC; PAM sequence: AAAAAC
agaatactccatgcacctgg

SEQ ID NO: 6380 - DNA, 20 bp, Artificial Sequence
  Description of Artificial Sequence: Synthetic oligonucleotide
  Target: ATXN1; (+) strand; PAM type: NAAAAC; PAM sequence: GAAAAC
ggaaaaactgacctaggaaa

SEQ ID NO: 6381 - DNA, 20 bp, Artificial Sequence
  Description of Artificial Sequence: Synthetic oligonucleotide
  Target: ATXN1; (+) strand; PAM type: NAAAAC; PAM sequence: AAAAAC
agatagtataatgattaaaa

SEQ ID NO: 6382 - DNA, 20 bp, Artificial Sequence
  Description of Artificial Sequence: Synthetic oligonucleotide
  Target: ATXN1; (+) strand; PAM type: NAAAAC; PAM sequence: CAAAAC
gactagcctggccaacatgg

SEQ ID NO: 6383 - DNA, 20 bp, Artificial Sequence
  Description of Artificial Sequence: Synthetic oligonucleotide
  Target: ATXN1; (+) strand; PAM type: NAAAAC; PAM sequence: AAAAAC
cagagcaaggcttggtctgg

SEQ ID NO: 6384 - DNA, 20 bp, Artificial Sequence
  Description of Artificial Sequence: Synthetic oligonucleotide
  Target: ATXN1; (+) strand; PAM type: NAAAAC; PAM sequence: AAAAAC
aaaaaaaaaaaaaaaaaaaa

SEQ ID NO: 6385 - DNA, 20 bp, Artificial Sequence
  Description of Artificial Sequence: Synthetic oligonucleotide
  Target: ATXN1; (+) strand; PAM type: NAAAAC; PAM sequence: AAAAAC
catctctagcccagtggact

SEQ ID NO: 6386 - DNA, 20 bp, Artificial Sequence
  Description of Artificial Sequence: Synthetic oligonucleotide
  Target: ATXN1; (+) strand; PAM type: NAAAAC; PAM sequence: CAAAAC
cagtggactaaaaaccaata

SEQ ID NO: 6387 - DNA, 20 bp, Artificial Sequence
  Description of Artificial Sequence: Synthetic oligonucleotide
  Target: ATXN1; (+) strand; PAM type: NAAAAC; PAM sequence: AAAAAC
aactaaacaatcaaaataaa

SEQ ID NO: 6388 - DNA, 20 bp, Artificial Sequence
  Description of Artificial Sequence: Synthetic oligonucleotide
  Target: ATXN1; (+) strand; PAM type: NAAAAC; PAM sequence: AAAAAC
agtgaaaccccgtctctact

SEQ ID NO: 6389 - DNA, 20 bp, Artificial Sequence
  Description of Artificial Sequence: Synthetic oligonucleotide
  Target: ATXN1; (+) strand; PAM type: NAAAAC; PAM sequence: AAAAAC
ggctgtgtccactggaaagg

SEQ ID NO: 6390 - DNA, 20 bp, Artificial Sequence
  Description of Artificial Sequence: Synthetic oligonucleotide
  Target: ATXN1; (+) strand; PAM type: NAAAAC; PAM sequence: GAAAAC
agtgttatactagaaagcaa

SEQ ID NO: 6391 - DNA, 20 bp, Artificial Sequence
  Description of Artificial Sequence: Synthetic oligonucleotide
  Target: ATXN1; (+) strand; PAM type: NAAAAC; PAM sequence: CAAAAC
tgaatttacagtcatgcttt

SEQ ID NO: 6392 - DNA, 20 bp, Artificial Sequence
  Description of Artificial Sequence: Synthetic oligonucleotide
  Target: ATXN1; (+) strand; PAM type: NAAAAC; PAM sequence: CAAAAC
atattatcctgcttttccta

SEQ ID NO: 6393 - DNA, 20 bp, Artificial Sequence
  Description of Artificial Sequence: Synthetic oligonucleotide
  Target: ATXN1; (+) strand; PAM type: NAAAAC; PAM sequence: CAAAAC
gtcaggcaaagcaaagcaaa

SEQ ID NO: 6394 - DNA, 20 bp, Artificial Sequence
  Description of Artificial Sequence: Synthetic oligonucleotide
  Target: ATXN1; (+) strand; PAM type: NAAAAC; PAM sequence: AAAAAC
tggtctggtttctcaacaga

SEQ ID NO: 6395 - DNA, 20 bp, Artificial Sequence
  Description of Artificial Sequence: Synthetic oligonucleotide
  Target: ATXN1; (+) strand; PAM type: NAAAAC; PAM sequence: TAAAAC
aaaaatcctacaacataaaa

SEQ ID NO: 6396 - DNA, 20 bp, Artificial Sequence
  Description of Artificial Sequence: Synthetic oligonucleotide
  Target: ATXN1; (+) strand; PAM type: NAAAAC; PAM sequence: GAAAAC
aggtgcagaggtggagtaga

SEQ ID NO: 6397 - DNA, 20 bp, Artificial Sequence
  Description of Artificial Sequence: Synthetic oligonucleotide
  Target: ATXN1; (+) strand; PAM type: NAAAAC; PAM sequence: GAAAAC
attcctgggagtgaagccca

SEQ ID NO: 6398 - DNA, 20 bp, Artificial Sequence
  Description of Artificial Sequence: Synthetic oligonucleotide
  Target: ATXN1; (+) strand; PAM type: NAAAAC; PAM sequence: AAAAAC
cttcctattacatttatggt

SEQ ID NO: 6399 - DNA, 20 bp, Artificial Sequence
  Description of Artificial Sequence: Synthetic oligonucleotide
  Target: ATXN1; (+) strand; PAM type: NAAAAC; PAM sequence: TAAAAC
tgatatgtactattgaatcc

SEQ ID NO: 6400 - DNA, 20 bp, Artificial Sequence
  Description of Artificial Sequence: Synthetic oligonucleotide
  Target: ATXN1; (+) strand; PAM type: NAAAAC; PAM sequence: GAAAAC
gctcacatacagtggaattt

SEQ ID NO: 6401 - DNA, 20 bp, Artificial Sequence
  Description of Artificial Sequence: Synthetic oligonucleotide
  Target: ATXN1; (+) strand; PAM type: NAAAAC; PAM sequence: CAAAAC
aattaacggccaagaccaga

SEQ ID NO: 6402 - DNA, 20 bp, Artificial Sequence
  Description of Artificial Sequence: Synthetic oligonucleotide
  Target: ATXN1; (+) strand; PAM type: NAAAAC; PAM sequence: GAAAAC
ttaagtggataagtttaaag

SEQ ID NO: 6403 - DNA, 20 bp, Artificial Sequence
  Description of Artificial Sequence: Synthetic oligonucleotide
  Target: ATXN1; (+) strand; PAM type: NAAAAC; PAM sequence: TAAAAC
aaggtaactgtttaaaaaaa

SEQ ID NO: 6404 - DNA, 20 bp, Artificial Sequence
  Description of Artificial Sequence: Synthetic oligonucleotide
  Target: ATXN1; (+) strand; PAM type: NAAAAC; PAM sequence: AAAAAC
aaagagaagcaaaagtttac

SEQ ID NO: 6405 - DNA, 20 bp, Artificial Sequence
  Description of Artificial Sequence: Synthetic oligonucleotide
  Target: ATXN1; (+) strand; PAM type: NAAAAC; PAM sequence: TAAAAC
aatatctcataaaaataaca

SEQ ID NO: 6406 - DNA, 20 bp, Artificial Sequence
  Description of Artificial Sequence: Synthetic oligonucleotide
  Target: ATXN1; (+) strand; PAM type: NAAAAC; PAM sequence: CAAAAC
tccagcgtgggcaacaagag

SEQ ID NO: 6407 - DNA, 20 bp, Artificial Sequence
  Description of Artificial Sequence: Synthetic oligonucleotide
  Target: ATXN1; (+) strand; PAM type: NAAAAC; PAM sequence: AAAAAC
caaacagaaacaaatttcac

SEQ ID NO: 6408 - DNA, 20 bp, Artificial Sequence
  Description of Artificial Sequence: Synthetic oligonucleotide
  Target: ATXN1; (+) strand; PAM type: NAAAAC; PAM sequence: GAAAAC
attaaattcagctggaaaag

SEQ ID NO: 6409 - DNA, 20 bp, Artificial Sequence
  Description of Artificial Sequence: Synthetic oligonucleotide
  Target: ATXN1; (+) strand; PAM type: NAAAAC; PAM sequence: AAAAAC
tgtgtgtcagtcttcagagg

SEQ ID NO: 6410 - DNA, 20 bp, Artificial Sequence
  Description of Artificial Sequence: Synthetic oligonucleotide
  Target: ATXN1; (+) strand; PAM type: NAAAAC; PAM sequence: GAAAAC
ccagtgggacagtcatttct

SEQ ID NO: 6411 - DNA, 20 bp, Artificial Sequence
  Description of Artificial Sequence: Synthetic oligonucleotide
  Target: ATXN1; (+) strand; PAM type: NAAAAC; PAM sequence: CAAAAC
ctgaaaactcatttgtgaat

SEQ ID NO: 6412 - DNA, 20 bp, Artificial Sequence
  Description of Artificial Sequence: Synthetic oligonucleotide
  Target: ATXN1; (+) strand; PAM type: NAAAAC; PAM sequence: TAAAAC
tacagacaattaattcacat

SEQ ID NO: 6413 - DNA, 20 bp, Artificial Sequence
  Description of Artificial Sequence: Synthetic oligonucleotide
  Target: ATXN1; (+) strand; PAM type: NAAAAC; PAM sequence: AAAAAC
aagttgacgtgagaaaataa

SEQ ID NO: 6414 - DNA, 20 bp, Artificial Sequence
  Description of Artificial Sequence: Synthetic oligonucleotide
  Target: ATXN1; (+) strand; PAM type: NAAAAC; PAM sequence: AAAAAC
aataaaataaagagggggta

SEQ ID NO: 6415 - DNA, 20 bp, Artificial Sequence
  Description of Artificial Sequence: Synthetic oligonucleotide
  Target: ATXN1; (+) strand; PAM type: NAAAAC; PAM sequence: AAAAAC
tcatcttcacctgatacttt

SEQ ID NO: 6416 - DNA, 20 bp, Artificial Sequence
  Description of Artificial Sequence: Synthetic oligonucleotide
  Target: ATXN1; (+) strand; PAM type: NAAAAC; PAM sequence: CAAAAC
gaccagcctggccaacatgg

SEQ ID NO: 6417 - DNA, 20 bp, Artificial Sequence
  Description of Artificial Sequence: Synthetic oligonucleotide
  Target: ATXN1; (+) strand; PAM type: NAAAAC; PAM sequence: TAAAAC
tggcaaaaccccgtctctac

SEQ ID NO: 6418 - DNA, 20 bp, Artificial Sequence
  Description of Artificial Sequence: Synthetic oligonucleotide
  Target: ATXN1; (+) strand; PAM type: NAAAAC; PAM sequence: AAAAAC
aaaaaaaaaaaaaaaaaaaa

SEQ ID NO: 6419 - DNA, 20 bp, Artificial Sequence
  Description of Artificial Sequence: Synthetic oligonucleotide
  Target: ATXN1; (+) strand; PAM type: NAAAAC; PAM sequence: CAAAAC
gcaggtcagcaagatgaggt

SEQ ID NO: 6420 - DNA, 20 bp, Artificial Sequence
  Description of Artificial Sequence: Synthetic oligonucleotide
  Target: ATXN1; (+) strand; PAM type: NAAAAC; PAM sequence: CAAAAC
caacctttgtagtcagcaga

SEQ ID NO: 6421 - DNA, 20 bp, Artificial Sequence
  Description of Artificial Sequence: Synthetic oligonucleotide
  Target: ATXN1; (+) strand; PAM type: NAAAAC; PAM sequence: CAAAAC
taaattattatagtagacag

SEQ ID NO: 6422 - DNA, 20 bp, Artificial Sequence
  Description of Artificial Sequence: Synthetic oligonucleotide
  Target: ATXN1; (+) strand; PAM type: NAAAAC; PAM sequence: GAAAAC
aaccacacaacagagctgta

SEQ ID NO: 6423 - DNA, 20 bp, Artificial Sequence
  Description of Artificial Sequence: Synthetic oligonucleotide
  Target: ATXN1; (+) strand; PAM type: NAAAAC; PAM sequence: GAAAAC
tgtagaaaacttcactatta

SEQ ID NO: 6424 - DNA, 20 bp, Artificial Sequence
  Description of Artificial Sequence: Synthetic oligonucleotide
  Target: ATXN1; (+) strand; PAM type: NAAAAC; PAM sequence: TAAAAC
atcactagggaactgtgaat

SEQ ID NO: 6425 - DNA, 20 bp, Artificial Sequence
  Description of Artificial Sequence: Synthetic oligonucleotide
  Target: ATXN1; (+) strand; PAM type: NAAAAC; PAM sequence: GAAAAC
gcaaatagtaagctacttgg

SEQ ID NO: 6426 - DNA, 20 bp, Artificial Sequence
  Description of Artificial Sequence: Synthetic oligonucleotide
  Target: ATXN1; (+) strand; PAM type: NAAAAC; PAM sequence: AAAAAC
ggtatctacacaaataaact

SEQ ID NO: 6427 - DNA, 20 bp, Artificial Sequence
  Description of Artificial Sequence: Synthetic oligonucleotide
  Target: ATXN1; (+) strand; PAM type: NAAAAC; PAM sequence: AAAAAC
ctaaaaacttaagtccacac

SEQ ID NO: 6428 - DNA, 20 bp, Artificial Sequence
  Description of Artificial Sequence: Synthetic oligonucleotide
  Target: ATXN1; (+) strand; PAM type: NAAAAC; PAM sequence: AAAAAC
atagaatattattcagcact

SEQ ID NO: 6429 - DNA, 20 bp, Artificial Sequence
  Description of Artificial Sequence: Synthetic oligonucleotide
  Target: ATXN1; (+) strand; PAM type: NAAAAC; PAM sequence: TAAAAC
cccgtcctacaaaaggattg

SEQ ID NO: 6430 - DNA, 20 bp, Artificial Sequence
  Description of Artificial Sequence: Synthetic oligonucleotide
  Target: ATXN1; (+) strand; PAM type: NAAAAC; PAM sequence: TAAAAC
tttccttagaattcaggggc

SEQ ID NO: 6431 - DNA, 20 bp, Artificial Sequence
  Description of Artificial Sequence: Synthetic oligonucleotide
  Target: ATXN1; (+) strand; PAM type: NAAAAC; PAM sequence: AAAAAC
ccaaggttagtcttgcttct

SEQ ID NO: 6432 - DNA, 20 bp, Artificial Sequence
  Description of Artificial Sequence: Synthetic oligonucleotide
  Target: ATXN1; (+) strand; PAM type: NAAAAC; PAM sequence: CAAAAC
attcatatgataagtgagga

SEQ ID NO: 6433 - DNA, 20 bp, Artificial Sequence
  Description of Artificial Sequence: Synthetic oligonucleotide
  Target: ATXN1; (+) strand; PAM type: NAAAAC; PAM sequence: GAAAAC
aggtcctaataacaacagga

SEQ ID NO: 6434 - DNA, 20 bp, Artificial Sequence
  Description of Artificial Sequence: Synthetic oligonucleotide
  Target: ATXN1; (+) strand; PAM type: NAAAAC; PAM sequence: GAAAAC
tcctttttgtggtctaggag

SEQ ID NO: 6435 - DNA, 20 bp, Artificial Sequence
  Description of Artificial Sequence: Synthetic oligonucleotide
  Target: ATXN1; (+) strand; PAM type: NAAAAC; PAM sequence: AAAAAC
agggagaagagaaaaaaaaa

SEQ ID NO: 6436 - DNA, 20 bp, Artificial Sequence
  Description of Artificial Sequence: Synthetic oligonucleotide
  Target: ATXN1; (+) strand; PAM type: NAAAAC; PAM sequence: AAAAAC
caccccaattctaggagtac

SEQ ID NO: 6437 - DNA, 20 bp, Artificial Sequence
  Description of Artificial Sequence: Synthetic oligonucleotide
  Target: ATXN1; (+) strand; PAM type: NAAAAC; PAM sequence: CAAAAC
tttgaggatcccacagacca

SEQ ID NO: 6438 - DNA, 20 bp, Artificial Sequence
  Description of Artificial Sequence: Synthetic oligonucleotide
  Target: ATXN1; (+) strand; PAM type: NAAAAC; PAM sequence: TAAAAC
ttgtccttgccctaacacat

SEQ ID NO: 6439 - DNA, 20 bp, Artificial Sequence
  Description of Artificial Sequence: Synthetic oligonucleotide
  Target: ATXN1; (+) strand; PAM type: NAAAAC; PAM sequence: CAAAAC
ccagaggcagaaacagcctt

SEQ ID NO: 6440 - DNA, 20 bp, Artificial Sequence
  Description of Artificial Sequence: Synthetic oligonucleotide
  Target: ATXN1; (+) strand; PAM type: NAAAAC; PAM sequence: CAAAAC
gacttaagccttccccagga

SEQ ID NO: 6441 - DNA, 20 bp, Artificial Sequence
  Description of Artificial Sequence: Synthetic oligonucleotide
  Target: ATXN1; (+) strand; PAM type: NAAAAC; PAM sequence: GAAAAC
aaggaaatttatggctatca

SEQ ID NO: 6442 - DNA, 20 bp, Artificial Sequence
  Description of Artificial Sequence: Synthetic oligonucleotide
  Target: ATXN1; (+) strand; PAM type: NAAAAC; PAM sequence: AAAAAC
ggagttattgcacacagtgc

SEQ ID NO: 6443 - DNA, 20 bp, Artificial Sequence
  Description of Artificial Sequence: Synthetic oligonucleotide
  Target: ATXN1; (+) strand; PAM type: NAAAAC; PAM sequence: CAAAAC
ttgggcttccccaaagctta

SEQ ID NO: 6444 - DNA, 20 bp, Artificial Sequence
  Description of Artificial Sequence: Synthetic oligonucleotide
  Target: ATXN1; (+) strand; PAM type: NAAAAC; PAM sequence: CAAAAC
cttctttggcaaaataccaa

SEQ ID NO: 6445 - DNA, 20 bp, Artificial Sequence
  Description of Artificial Sequence: Synthetic oligonucleotide
  Target: ATXN1; (+) strand; PAM type: NAAAAC; PAM sequence: AAAAAC
caaaataccaacaaaacgtt

SEQ ID NO: 6446 - DNA, 20 bp, Artificial Sequence
  Description of Artificial Sequence: Synthetic oligonucleotide
  Target: ATXN1; (+) strand; PAM type: NAAAAC; PAM sequence: AAAAAC
ccctatagctgatcctaagg

SEQ ID NO: 6447 - DNA, 20 bp, Artificial Sequence
  Description of Artificial Sequence: Synthetic oligonucleotide
  Target: ATXN1; (+) strand; PAM type: NAAAAC; PAM sequence: GAAAAC
cctatttaaaaaggataagt

SEQ ID NO: 6448 - DNA, 20 bp, Artificial Sequence
  Description of Artificial Sequence: Synthetic oligonucleotide
  Target: ATXN1; (+) strand; PAM type: NAAAAC; PAM sequence: CAAAAC
tgaatggttcctagtagata

SEQ ID NO: 6449 - DNA, 20 bp, Artificial Sequence
  Description of Artificial Sequence: Synthetic oligonucleotide
  Target: ATXN1; (+) strand; PAM type: NAAAAC; PAM sequence: GAAAAC
ctctaggagtatgggaaaat

SEQ ID NO: 6450 - DNA, 20 bp, Artificial Sequence
  Description of Artificial Sequence: Synthetic oligonucleotide
  Target: ATXN1; (+) strand; PAM type: NAAAAC; PAM sequence: CAAAAC
ctttggcagtagtgaatatc

SEQ ID NO: 6451 - DNA, 20 bp, Artificial Sequence
  Description of Artificial Sequence: Synthetic oligonucleotide
  Target: ATXN1; (+) strand; PAM type: NAAAAC; PAM sequence: TAAAAC
atgcaccaataagtgctctg

SEQ ID NO: 6452 - DNA, 20 bp, Artificial Sequence
  Description of Artificial Sequence: Synthetic oligonucleotide
  Target: ATXN1; (+) strand; PAM type: NAAAAC; PAM sequence: TAAAAC
aatcaatttttctgtaaacc

SEQ ID NO: 6453 - DNA, 20 bp, Artificial Sequence
  Description of Artificial Sequence: Synthetic oligonucleotide
  Target: ATXN1; (+) strand; PAM type: NAAAAC; PAM sequence: AAAAAC
ataaaaaagcctattaatta

SEQ ID NO: 6454 - DNA, 20 bp, Artificial Sequence
  Description of Artificial Sequence: Synthetic oligonucleotide
  Target: ATXN1; (+) strand; PAM type: NAAAAC; PAM sequence: AAAAAC
aagcctattaattaaaaaac

SEQ ID NO: 6455 - DNA, 20 bp, Artificial Sequence
  Description of Artificial Sequence: Synthetic oligonucleotide
  Target: ATXN1; (+) strand; PAM type: NAAAAC; PAM sequence: AAAAAC
aagagtgaaattccatttcc

SEQ ID NO: 6456 - DNA, 20 bp, Artificial Sequence
  Description of Artificial Sequence: Synthetic oligonucleotide
  Target: ATXN1; (+) strand; PAM type: NAAAAC; PAM sequence: CAAAAC
tgaaattccatttccaaaaa

SEQ ID NO: 6457 - DNA, 20 bp, Artificial Sequence
  Description of Artificial Sequence: Synthetic oligonucleotide
  Target: ATXN1; (+) strand; PAM type: NAAAAC; PAM sequence: CAAAAC
ttccatttccaaaaacaaaa

SEQ ID NO: 6458 - DNA, 20 bp, Artificial Sequence
  Description of Artificial Sequence: Synthetic oligonucleotide
  Target: ATXN1; (+) strand; PAM type: NAAAAC; PAM sequence: CAAAAC
tttccaaaaacaaaacaaaa

SEQ ID NO: 6459 - DNA, 20 bp, Artificial Sequence
  Description of Artificial Sequence: Synthetic oligonucleotide
  Target: ATXN1; (+) strand; PAM type: NAAAAC; PAM sequence: GAAAAC
ccatagaaaatcttctggaa

SEQ ID NO: 6460 - DNA, 20 bp, Artificial Sequence
  Description of Artificial Sequence: Synthetic oligonucleotide
  Target: ATXN1; (+) strand; PAM type: NAAAAC; PAM sequence: GAAAAC
ccacatcctgatgcacaagg

SEQ ID NO: 6461 - DNA, 20 bp, Artificial Sequence
  Description of Artificial Sequence: Synthetic oligonucleotide
  Target: ATXN1; (+) strand; PAM type: NAAAAC; PAM sequence: CAAAAC
tactgtttggttttatttgt

SEQ ID NO: 6462 - DNA, 20 bp, Artificial Sequence
  Description of Artificial Sequence: Synthetic oligonucleotide
  Target: ATXN1; (+) strand; PAM type: NAAAAC; PAM sequence: GAAAAC
agtatgaaaaagtcagaaag

SEQ ID NO: 6463 - DNA, 20 bp, Artificial Sequence
  Description of Artificial Sequence: Synthetic oligonucleotide
  Target: ATXN1; (+) strand; PAM type: NAAAAC; PAM sequence: TAAAAC
aaaagtcagaaaggaaaact

SEQ ID NO: 6464 - DNA, 20 bp, Artificial Sequence
  Description of Artificial Sequence: Synthetic oligonucleotide
  Target: ATXN1; (+) strand; PAM type: NAAAAC; PAM sequence: TAAAAC
tacttgtttcctgttctctg

SEQ ID NO: 6465 - DNA, 20 bp, Artificial Sequence
  Description of Artificial Sequence: Synthetic oligonucleotide
  Target: ATXN1; (+) strand; PAM type: NAAAAC; PAM sequence: AAAAAC
attgcagtggcagtaacaat

SEQ ID NO: 6466 - DNA, 20 bp, Artificial Sequence
  Description of Artificial Sequence: Synthetic oligonucleotide
  Target: ATXN1; (+) strand; PAM type: NAAAAC; PAM sequence: AAAAAC
ctaagagaatgcaagcattt

SEQ ID NO: 6467 - DNA, 20 bp, Artificial Sequence
  Description of Artificial Sequence: Synthetic oligonucleotide
  Target: ATXN1; (+) strand; PAM type: NAAAAC; PAM sequence: GAAAAC
aaaaaggtaggactgtgata

SEQ ID NO: 6468 - DNA, 20 bp, Artificial Sequence
  Description of Artificial Sequence: Synthetic oligonucleotide
  Target: ATXN1; (+) strand; PAM type: NAAAAC; PAM sequence: CAAAAC
ttaaggtttctaaaatctgc

SEQ ID NO: 6469 - DNA, 20 bp, Artificial Sequence
  Description of Artificial Sequence: Synthetic oligonucleotide
  Target: ATXN1; (+) strand; PAM type: NAAAAC; PAM sequence: AAAAAC
tgacattctattagggcctg

SEQ ID NO: 6470 - DNA, 20 bp, Artificial Sequence
  Description of Artificial Sequence: Synthetic oligonucleotide
  Target: ATXN1; (+) strand; PAM type: NAAAAC; PAM sequence: GAAAAC
ggatcatttgcattttaata

SEQ ID NO: 6471 - DNA, 20 bp, Artificial Sequence
  Description of Artificial Sequence: Synthetic oligonucleotide
  Target: ATXN1; (+) strand; PAM type: NAAAAC; PAM sequence: CAAAAC
gaccagcctgaccaacatgg

SEQ ID NO: 6472 - DNA, 20 bp, Artificial Sequence
  Description of Artificial Sequence: Synthetic oligonucleotide
  Target: ATXN1; (+) strand; PAM type: NAAAAC; PAM sequence: CAAAAC
tccagcctgggcaacaagag

SEQ ID NO: 6473 - DNA, 20 bp, Artificial Sequence
  Description of Artificial Sequence: Synthetic oligonucleotide
  Target: ATXN1; (+) strand; PAM type: NAAAAC; PAM sequence: AAAAAC
gtgtactttactataataaa

SEQ ID NO: 6474 - DNA, 20 bp, Artificial Sequence
  Description of Artificial Sequence: Synthetic oligonucleotide
  Target: ATXN1; (+) strand; PAM type: NAAAAC; PAM sequence: TAAAAC
tctgaaagacttctggcaat

SEQ ID NO: 6475 - DNA, 20 bp, Artificial Sequence
  Description of Artificial Sequence: Synthetic oligonucleotide
  Target: ATXN1; (+) strand; PAM type: NAAAAC; PAM sequence: CAAAAC
acacacacacacacacaatt

SEQ ID NO: 6476 - DNA, 20 bp, Artificial Sequence
  Description of Artificial Sequence: Synthetic oligonucleotide
  Target: ATXN1; (+) strand; PAM type: NAAAAC; PAM sequence: CAAAAC
tgagtaagaaaagaacctga

SEQ ID NO: 6477 - DNA, 20 bp, Artificial Sequence
  Description of Artificial Sequence: Synthetic oligonucleotide
  Target: ATXN1; (+) strand; PAM type: NAAAAC; PAM sequence: CAAAAC
tattgtttcaatattttatg

SEQ ID NO: 6478 - DNA, 20 bp, Artificial Sequence
  Description of Artificial Sequence: Synthetic oligonucleotide
  Target: ATXN1; (+) strand; PAM type: NAAAAC; PAM sequence: CAAAAC
ggtcatgtgtttgtacagca

SEQ ID NO: 6479 - DNA, 20 bp, Artificial Sequence
  Description of Artificial Sequence: Synthetic oligonucleotide
  Target: ATXN1; (+) strand; PAM type: NAAAAC; PAM sequence: CAAAAC
ataagcagaatcaggaattc

SEQ ID NO: 6480 - DNA, 20 bp, Artificial Sequence
  Description of Artificial Sequence: Synthetic oligonucleotide
  Target: ATXN1; (+) strand; PAM type: NAAAAC; PAM sequence: GAAAAC
ttttttaatgaaaaaaatta

SEQ ID NO: 6481 - DNA, 20 bp, Artificial Sequence
  Description of Artificial Sequence: Synthetic oligonucleotide
  Target: ATXN1; (+) strand; PAM type: NAAAAC; PAM sequence: GAAAAC
tggtccccaaacgtaccggt

SEQ ID NO: 6482 - DNA, 20 bp, Artificial Sequence
  Description of Artificial Sequence: Synthetic oligonucleotide
  Target: ATXN1; (+) strand; PAM type: NAAAAC; PAM sequence: AAAAAC
tttattttgaggtcaaaggg

SEQ ID NO: 6483 - DNA, 20 bp, Artificial Sequence
  Description of Artificial Sequence: Synthetic oligonucleotide
  Target: ATXN1; (+) strand; PAM type: NAAAAC; PAM sequence: AAAAAC
tagggagcaatcactgggct

SEQ ID NO: 6484 - DNA, 20 bp, Artificial Sequence
  Description of Artificial Sequence: Synthetic oligonucleotide
  Target: ATXN1; (+) strand; PAM type: NAAAAC; PAM sequence: AAAAAC
ttatataataatccaaaaaa

SEQ ID NO: 6485 - DNA, 20 bp, Artificial Sequence
  Description of Artificial Sequence: Synthetic oligonucleotide
  Target: ATXN1; (+) strand; PAM type: NAAAAC; PAM sequence: AAAAAC
ataatccaaaaaaaaaaaca

SEQ ID NO: 6486 - DNA, 20 bp, Artificial Sequence
  Description of Artificial Sequence: Synthetic oligonucleotide
  Target: ATXN1; (+) strand; PAM type: NAAAAC; PAM sequence: AAAAAC
caaaaaaaaaaacaaaaaac

SEQ ID NO: 6487 - DNA, 20 bp, Artificial Sequence
  Description of Artificial Sequence: Synthetic oligonucleotide
  Target: ATXN1; (+) strand; PAM type: NAAAAC; PAM sequence: CAAAAC
gcacactacaccctgtcaaa

SEQ ID NO: 6488 - DNA, 20 bp, Artificial Sequence
  Description of Artificial Sequence: Synthetic oligonucleotide
  Target: ATXN1; (+) strand; PAM type: NAAAAC; PAM sequence: CAAAAC
ctgatttactttatctcata

SEQ ID NO: 6489 - DNA, 20 bp, Artificial Sequence
  Description of Artificial Sequence: Synthetic oligonucleotide
  Target: ATXN1; (+) strand; PAM type: NAAAAC; PAM sequence: CAAAAC
tataccttctgttgagtata

SEQ ID NO: 6490 - DNA, 20 bp, Artificial Sequence
  Description of Artificial Sequence: Synthetic oligonucleotide
  Target: ATXN1; (+) strand; PAM type: NAAAAC; PAM sequence: AAAAAC
acaacggtcattgagactac

SEQ ID NO: 6491 - DNA, 20 bp, Artificial Sequence
  Description of Artificial Sequence: Synthetic oligonucleotide
  Target: ATXN1; (+) strand; PAM type: NAAAAC; PAM sequence: CAAAAC
tgccagtgctgataaacaag

SEQ ID NO: 6492 - DNA, 20 bp, Artificial Sequence
  Description of Artificial Sequence: Synthetic oligonucleotide
  Target: ATXN1; (+) strand; PAM type: NAAAAC; PAM sequence: AAAAAC
acattaacctaattcacaag

SEQ ID NO: 6493 - DNA, 20 bp, Artificial Sequence
  Description of Artificial Sequence: Synthetic oligonucleotide
  Target: ATXN1; (+) strand; PAM type: NAAAAC; PAM sequence: AAAAAC
gaggttgccaaacagaagga

SEQ ID NO: 6494 - DNA, 20 bp, Artificial Sequence
  Description of Artificial Sequence: Synthetic oligonucleotide
  Target: ATXN1; (+) strand; PAM type: NAAAAC; PAM sequence: GAAAAC
ggaaaaggcaaaggaaaccg

SEQ ID NO: 6495 - DNA, 20 bp, Artificial Sequence
  Description of Artificial Sequence: Synthetic oligonucleotide
  Target: ATXN1; (+) strand; PAM type: NAAAAC; PAM sequence: GAAAAC
gcaacctaatggaaacttta

SEQ ID NO: 6496 - DNA, 20 bp, Artificial Sequence
  Description of Artificial Sequence: Synthetic oligonucleotide
  Target: ATXN1; (+) strand; PAM type: NAAAAC; PAM sequence: AAAAAC
agtccaaagagcatgatgat

SEQ ID NO: 6497 - DNA, 20 bp, Artificial Sequence
  Description of Artificial Sequence: Synthetic oligonucleotide
  Target: ATXN1; (+) strand; PAM type: NAAAAC; PAM sequence: GAAAAC
atacaaaaaaaaattgctct

SEQ ID NO: 6498 - DNA, 20 bp, Artificial Sequence
  Description of Artificial Sequence: Synthetic oligonucleotide
  Target: ATXN1; (+) strand; PAM type: NAAAAC; PAM sequence: GAAAAC
agagagaaatgggtgaaaga

SEQ ID NO: 6499 - DNA, 20 bp, Artificial Sequence
  Description of Artificial Sequence: Synthetic oligonucleotide
  Target: ATXN1; (+) strand; PAM type: NAAAAC; PAM sequence: CAAAAC
aatgatgtgatgataagaga

SEQ ID NO: 6500 - DNA, 20 bp, Artificial Sequence
  Description of Artificial Sequence: Synthetic oligonucleotide
  Target: ATXN1; (+) strand; PAM type: NAAAAC; PAM sequence: AAAAAC
atatgtaaggtgcttaaaag

SEQ ID NO: 6501 - DNA, 20 bp, Artificial Sequence
  Description of Artificial Sequence: Synthetic oligonucleotide
  Target: ATXN1; (+) strand; PAM type: NAAAAC; PAM sequence: GAAAAC
tgagcacagaggtggtttta

SEQ ID NO: 6502 - DNA, 20 bp, Artificial Sequence
  Description of Artificial Sequence: Synthetic oligonucleotide
  Target: ATXN1; (+) strand; PAM type: NAAAAC; PAM sequence: AAAAAC
aagactgtgctcaatgtttt

SEQ ID NO: 6503 - DNA, 20 bp, Artificial Sequence
  Description of Artificial Sequence: Synthetic oligonucleotide
  Target: ATXN1; (+) strand; PAM type: NAAAAC; PAM sequence: AAAAAC
caacttgagacacttagggt

SEQ ID NO: 6504 - DNA, 20 bp, Artificial Sequence
  Description of Artificial Sequence: Synthetic oligonucleotide
  Target: ATXN1; (+) strand; PAM type: NAAAAC; PAM sequence: GAAAAC
acactaaacccaggaagaca

SEQ ID NO: 6505 - DNA, 20 bp, Artificial Sequence
  Description of Artificial Sequence: Synthetic oligonucleotide
  Target: ATXN1; (+) strand; PAM type: NAAAAC; PAM sequence: GAAAAC
ccaacatcacagtttactaa

SEQ ID NO: 6506 - DNA, 20 bp, Artificial Sequence
  Description of Artificial Sequence: Synthetic oligonucleotide
  Target: ATXN1; (+) strand; PAM type: NAAAAC; PAM sequence: GAAAAC
gtacacttcagaagtccttt

SEQ ID NO: 6507 - DNA, 20 bp, Artificial Sequence
  Description of Artificial Sequence: Synthetic oligonucleotide
  Target: ATXN1; (+) strand; PAM type: NAAAAC; PAM sequence: TAAAAC
gaacagttcaaagcaacggt

SEQ ID NO: 6508 - DNA, 20 bp, Artificial Sequence
  Description of Artificial Sequence: Synthetic oligonucleotide
  Target: ATXN1; (+) strand; PAM type: NAAAAC; PAM sequence: AAAAAC
caacggttaaaacaacaaca

SEQ ID NO: 6509 - DNA, 20 bp, Artificial Sequence
  Description of Artificial Sequence: Synthetic oligonucleotide
  Target: ATXN1; (+) strand; PAM type: NAAAAC; PAM sequence: TAAAAC
attgggaaaatgatttctag

SEQ ID NO: 6510 - DNA, 20 bp, Artificial Sequence
  Description of Artificial Sequence: Synthetic oligonucleotide
  Target: ATXN1; (+) strand; PAM type: NAAAAC; PAM sequence: CAAAAC
tggtggctcatgcctgtaat

SEQ ID NO: 6511 - DNA, 20 bp, Artificial Sequence
  Description of Artificial Sequence: Synthetic oligonucleotide
  Target: ATXN1; (+) strand; PAM type: NAAAAC; PAM sequence: AAAAAC
atatgtatttatatatacac

SEQ ID NO: 6512 - DNA, 20 bp, Artificial Sequence
  Description of Artificial Sequence: Synthetic oligonucleotide
  Target: ATXN1; (+) strand; PAM type: NAAAAC; PAM sequence: AAAAAC
atatacacaaaaacaacaac

SEQ ID NO: 6513 - DNA, 20 bp, Artificial Sequence
  Description of Artificial Sequence: Synthetic oligonucleotide
  Target: ATXN1; (+) strand; PAM type: NAAAAC; PAM sequence: TAAAAC
tctcttccattacctgacac

SEQ ID NO: 6514 - DNA, 20 bp, Artificial Sequence
  Description of Artificial Sequence: Synthetic oligonucleotide
  Target: ATXN1; (+) strand; PAM type: NAAAAC; PAM sequence: CAAAAC
atcccaagccagtaactgat

SEQ ID NO: 6515 - DNA, 20 bp, Artificial Sequence
  Description of Artificial Sequence: Synthetic oligonucleotide
  Target: ATXN1; (+) strand; PAM type: NAAAAC; PAM sequence: CAAAAC
atgcaaacttgcaaaagcct

SEQ ID NO: 6516 - DNA, 20 bp, Artificial Sequence
  Description of Artificial Sequence: Synthetic oligonucleotide
  Target: ATXN1; (+) strand; PAM type: NAAAAC; PAM sequence: AAAAAC
aaatcatgagcatgcacaga

SEQ ID NO: 6517 - DNA, 20 bp, Artificial Sequence
  Description of Artificial Sequence: Synthetic oligonucleotide
  Target: ATXN1; (+) strand; PAM type: NAAAAC; PAM sequence: AAAAAC
taatagcatttctgaggaaa

SEQ ID NO: 6518 - DNA, 20 bp, Artificial Sequence
  Description of Artificial Sequence: Synthetic oligonucleotide
  Target: ATXN1; (+) strand; PAM type: NAAAAC; PAM sequence: GAAAAC
ttaggagatgcataaaattt

SEQ ID NO: 6519 - DNA, 20 bp, Artificial Sequence
  Description of Artificial Sequence: Synthetic oligonucleotide
  Target: ATXN1; (+) strand; PAM type: NAAAAC; PAM sequence: CAAAAC
tctcaggaaggcttctctta

SEQ ID NO: 6520 - DNA, 20 bp, Artificial Sequence
  Description of Artificial Sequence: Synthetic oligonucleotide
  Target: ATXN1; (+) strand; PAM type: NAAAAC; PAM sequence: GAAAAC
catgccacagctgaagttaa

SEQ ID NO: 6521 - DNA, 20 bp, Artificial Sequence
  Description of Artificial Sequence: Synthetic oligonucleotide
  Target: ATXN1; (+) strand; PAM type: NAAAAC; PAM sequence: GAAAAC
accctcccccaaaaaggact

SEQ ID NO: 6522 - DNA, 20 bp, Artificial Sequence
  Description of Artificial Sequence: Synthetic oligonucleotide
  Target: ATXN1; (+) strand; PAM type: NAAAAC; PAM sequence: AAAAAC
acattacttgtagacttctg

SEQ ID NO: 6523 - DNA, 20 bp, Artificial Sequence
  Description of Artificial Sequence: Synthetic oligonucleotide
  Target: ATXN1; (+) strand; PAM type: NAAAAC; PAM sequence: CAAAAC
taacttaaatgatccatatc

SEQ ID NO: 6524 - DNA, 20 bp, Artificial Sequence
  Description of Artificial Sequence: Synthetic oligonucleotide
  Target: ATXN1; (+) strand; PAM type: NAAAAC; PAM sequence: AAAAAC
aaatgaccaaaaaaaaaaaa

SEQ ID NO: 6525 - DNA, 20 bp, Artificial Sequence
  Description of Artificial Sequence: Synthetic oligonucleotide
  Target: ATXN1; (+) strand; PAM type: NAAAAC; PAM sequence: AAAAAC
caaaaaaaaaaaaaaaaacc

SEQ ID NO: 6526 - DNA, 20 bp, Artificial Sequence
  Description of Artificial Sequence: Synthetic oligonucleotide
  Target: ATXN1; (+) strand; PAM type: NAAAAC; PAM sequence: AAAAAC
aaaccaaaaaccaaacaaca

SEQ ID NO: 6527 - DNA, 20 bp, Artificial Sequence
  Description of Artificial Sequence: Synthetic oligonucleotide
  Target: ATXN1; (+) strand; PAM type: NAAAAC; PAM sequence: TAAAAC
gtatttcaccgcctacatct

SEQ ID NO: 6528 - DNA, 20 bp, Artificial Sequence
  Description of Artificial Sequence: Synthetic oligonucleotide
  Target: ATXN1; (+) strand; PAM type: NAAAAC; PAM sequence: AAAAAC
accacaagaaactaaataca

SEQ ID NO: 6529 - DNA, 20 bp, Artificial Sequence
  Description of Artificial Sequence: Synthetic oligonucleotide
  Target: ATXN1; (+) strand; PAM type: NAAAAC; PAM sequence: TAAAAC
cacattgtgcacatgtaccc

SEQ ID NO: 6530 - DNA, 20 bp, Artificial Sequence
  Description of Artificial Sequence: Synthetic oligonucleotide
  Target: ATXN1; (+) strand; PAM type: NAAAAC; PAM sequence: GAAAAC
tagtttgtcatacagcaata

SEQ ID NO: 6531 - DNA, 20 bp, Artificial Sequence
  Description of Artificial Sequence: Synthetic oligonucleotide
  Target: ATXN1; (+) strand; PAM type: NAAAAC; PAM sequence: AAAAAC
agtggcaggcaaactgggcc

SEQ ID NO: 6532 - DNA, 20 bp, Artificial Sequence
  Description of Artificial Sequence: Synthetic oligonucleotide
  Target: ATXN1; (+) strand; PAM type: NAAAAC; PAM sequence: CAAAAC
ggtcagcgtgggaggtaggc

SEQ ID NO: 6533 - DNA, 20 bp, Artificial Sequence
  Description of Artificial Sequence: Synthetic oligonucleotide
  Target: ATXN1; (+) strand; PAM type: NAAAAC; PAM sequence: AAAAAC
cagaatttaccaaaagtatt

SEQ ID NO: 6534 - DNA, 20 bp, Artificial Sequence
  Description of Artificial Sequence: Synthetic oligonucleotide
  Target: ATXN1; (+) strand; PAM type: NAAAAC; PAM sequence: AAAAAC
gtaaaagccattcaaagctc

SEQ ID NO: 6535 - DNA, 20 bp, Artificial Sequence
  Description of Artificial Sequence: Synthetic oligonucleotide
  Target: ATXN1; (+) strand; PAM type: NAAAAC; PAM sequence: GAAAAC
tgcaagacaaaggtgctatt

SEQ ID NO: 6536 - DNA, 20 bp, Artificial Sequence
  Description of Artificial Sequence: Synthetic oligonucleotide
  Target: ATXN1; (+) strand; PAM type: NAAAAC; PAM sequence: TAAAAC
ttcataaaagcattctagct

SEQ ID NO: 6537 - DNA, 20 bp, Artificial Sequence
  Description of Artificial Sequence: Synthetic oligonucleotide
  Target: ATXN1; (+) strand; PAM type: NAAAAC; PAM sequence: AAAAAC
cctgatgatcgcgtttcatt

SEQ ID NO: 6538 - DNA, 20 bp, Artificial Sequence
  Description of Artificial Sequence: Synthetic oligonucleotide
  Target: ATXN1; (+) strand; PAM type: NAAAAC; PAM sequence: TAAAAC
tctctttaagactaaatatt

SEQ ID NO: 6539 - DNA, 20 bp, Artificial Sequence
  Description of Artificial Sequence: Synthetic oligonucleotide
  Target: ATXN1; (+) strand; PAM type: NAAAAC; PAM sequence: TAAAAC
ttttacaaaaattctattgc

SEQ ID NO: 6540 - DNA, 20 bp, Artificial Sequence
  Description of Artificial Sequence: Synthetic oligonucleotide
  Target: ATXN1; (+) strand; PAM type: NAAAAC; PAM sequence: AAAAAC
agaagttgaacattagagga

SEQ ID NO: 6541 - DNA, 20 bp, Artificial Sequence
  Description of Artificial Sequence: Synthetic oligonucleotide
  Target: ATXN1; (+) strand; PAM type: NAAAAC; PAM sequence: TAAAAC
taatgaagataaaattcaca

SEQ ID NO: 6542 - DNA, 20 bp, Artificial Sequence
  Description of Artificial Sequence: Synthetic oligonucleotide
  Target: ATXN1; (+) strand; PAM type: NAAAAC; PAM sequence: AAAAAC
attttagtcttttctcttga

SEQ ID NO: 6543 - DNA, 20 bp, Artificial Sequence
  Description of Artificial Sequence: Synthetic oligonucleotide
  Target: ATXN1; (+) strand; PAM type: NAAAAC; PAM sequence: CAAAAC
agtcttttctcttgaaaaaa

SEQ ID NO: 6544 - DNA, 20 bp, Artificial Sequence
  Description of Artificial Sequence: Synthetic oligonucleotide
  Target: ATXN1; (+) strand; PAM type: NAAAAC; PAM sequence: GAAAAC
attaagattggctctttgga

SEQ ID NO: 6545 - DNA, 20 bp, Artificial Sequence
  Description of Artificial Sequence: Synthetic oligonucleotide
  Target: ATXN1; (+) strand; PAM type: NAAAAC; PAM sequence: TAAAAC
aaagtcttatgatgtccgat

SEQ ID NO: 6546 - DNA, 20 bp, Artificial Sequence
  Description of Artificial Sequence: Synthetic oligonucleotide
  Target: ATXN1; (+) strand; PAM type: NAAAAC; PAM sequence: CAAAAC
tgatgtccgattaaaactaa

SEQ ID NO: 6547 - DNA, 20 bp, Artificial Sequence
  Description of Artificial Sequence: Synthetic oligonucleotide
  Target: ATXN1; (+) strand; PAM type: NAAAAC; PAM sequence: AAAAAC
gataaaaaaaaaaaaaaaaa

SEQ ID NO: 6548 - DNA, 20 bp, Artificial Sequence
  Description of Artificial Sequence: Synthetic oligonucleotide
  Target: ATXN1; (+) strand; PAM type: NAAAAC; PAM sequence: TAAAAC
cctaacaacttacttttcct

SEQ ID NO: 6549 - DNA, 20 bp, Artificial Sequence
  Description of Artificial Sequence: Synthetic oligonucleotide
  Target: ATXN1; (+) strand; PAM type: NAAAAC; PAM sequence: AAAAAC
tacttctcaaagtgctgttt

SEQ ID NO: 6550 - DNA, 20 bp, Artificial Sequence
  Description of Artificial Sequence: Synthetic oligonucleotide
  Target: ATXN1; (+) strand; PAM type: NAAAAC; PAM sequence: AAAAAC
tgttgcatttaaacaaattg

SEQ ID NO: 6551 - DNA, 20 bp, Artificial Sequence
  Description of Artificial Sequence: Synthetic oligonucleotide
  Target: ATXN1; (+) strand; PAM type: NAAAAC; PAM sequence: CAAAAC
ggctatagaccgtaaagaaa

SEQ ID NO: 6552 - DNA, 20 bp, Artificial Sequence
  Description of Artificial Sequence: Synthetic oligonucleotide
  Target: ATXN1; (+) strand; PAM type: NAAAAC; PAM sequence: TAAAAC
aggtccaaagcatcaaatta

SEQ ID NO: 6553 - DNA, 20 bp, Artificial Sequence
  Description of Artificial Sequence: Synthetic oligonucleotide
  Target: ATXN1; (+) strand; PAM type: NAAAAC; PAM sequence: GAAAAC
gatgtctcagaaatagacaa

SEQ ID NO: 6554 - DNA, 20 bp, Artificial Sequence
  Description of Artificial Sequence: Synthetic oligonucleotide
  Target: ATXN1; (+) strand; PAM type: NAAAAC; PAM sequence: TAAAAC
atatccctaagtcatagccc

SEQ ID NO: 6555 - DNA, 20 bp, Artificial Sequence
  Description of Artificial Sequence: Synthetic oligonucleotide
  Target: ATXN1; (+) strand; PAM type: NAAAAC; PAM sequence: TAAAAC
gaatgcagaatattgatttt

SEQ ID NO: 6556 - DNA, 20 bp, Artificial Sequence
  Description of Artificial Sequence: Synthetic oligonucleotide
  Target: ATXN1; (+) strand; PAM type: NAAAAC; PAM sequence: CAAAAC
cccccaaactcttcattttg

SEQ ID NO: 6557 - DNA, 20 bp, Artificial Sequence
  Description of Artificial Sequence: Synthetic oligonucleotide
  Target: ATXN1; (+) strand; PAM type: NAAAAC; PAM sequence: GAAAAC
gtgacactacagaaatcaaa

SEQ ID NO: 6558 - DNA, 20 bp, Artificial Sequence
  Description of Artificial Sequence: Synthetic oligonucleotide
  Target: ATXN1; (+) strand; PAM type: NAAAAC; PAM sequence: GAAAAC
tcagtccttgcctgaaagaa

SEQ ID NO: 6559 - DNA, 20 bp, Artificial Sequence
  Description of Artificial Sequence: Synthetic oligonucleotide
  Target: ATXN1; (+) strand; PAM type: NAAAAC; PAM sequence: TAAAAC
gaaaagcagtctttgttcct

SEQ ID NO: 6560 - DNA, 20 bp, Artificial Sequence
  Description of Artificial Sequence: Synthetic oligonucleotide
  Target: ATXN1; (+) strand; PAM type: NAAAAC; PAM sequence: AAAAAC
tgccagagtaaatgagttat

SEQ ID NO: 6561 - DNA, 20 bp, Artificial Sequence
  Description of Artificial Sequence: Synthetic oligonucleotide
  Target: ATXN1; (+) strand; PAM type: NAAAAC; PAM sequence: GAAAAC
caggatattgaaattctctg

SEQ ID NO: 6562 - DNA, 20 bp, Artificial Sequence
  Description of Artificial Sequence: Synthetic oligonucleotide
  Target: ATXN1; (+) strand; PAM type: NAAAAC; PAM sequence: GAAAAC
ataactttgcagcaagaggg

SEQ ID NO: 6563 - DNA, 20 bp, Artificial Sequence
  Description of Artificial Sequence: Synthetic oligonucleotide
  Target: ATXN1; (+) strand; PAM type: NAAAAC; PAM sequence: CAAAAC
gtccaattttttcagtaatg

SEQ ID NO: 6564 - DNA, 20 bp, Artificial Sequence
  Description of Artificial Sequence: Synthetic oligonucleotide
  Target: ATXN1; (+) strand; PAM type: NAAAAC; PAM sequence: TAAAAC
ttatggaagacatattacct

SEQ ID NO: 6565 - DNA, 20 bp, Artificial Sequence
  Description of Artificial Sequence: Synthetic oligonucleotide
  Target: ATXN1; (+) strand; PAM type: NAAAAC; PAM sequence: GAAAAC
ccttttgttttttaatggaa

SEQ ID NO: 6566 - DNA, 20 bp, Artificial Sequence
  Description of Artificial Sequence: Synthetic oligonucleotide
  Target: ATXN1; (+) strand; PAM type: NAAAAC; PAM sequence: AAAAAC
cactcacaggaagaatgaag

SEQ ID NO: 6567 - DNA, 20 bp, Artificial Sequence
  Description of Artificial Sequence: Synthetic oligonucleotide
  Target: ATXN1; (+) strand; PAM type: NAAAAC; PAM sequence: GAAAAC
cgtcaagatgatgtgctttg

SEQ ID NO: 6568 - DNA, 20 bp, Artificial Sequence
  Description of Artificial Sequence: Synthetic oligonucleotide
  Target: ATXN1; (+) strand; PAM type: NAAAAC; PAM sequence: CAAAAC
acatgacctgccatgtagtt

SEQ ID NO: 6569 - DNA, 20 bp, Artificial Sequence
  Description of Artificial Sequence: Synthetic oligonucleotide
  Target: ATXN1; (+) strand; PAM type: NAAAAC; PAM sequence: GAAAAC
aaagtggtgcagccactgtg

SEQ ID NO: 6570 - DNA, 20 bp, Artificial Sequence
  Description of Artificial Sequence: Synthetic oligonucleotide
  Target: ATXN1; (+) strand; PAM type: NAAAAC; PAM sequence: GAAAAC
tgactggttgaactgactag

SEQ ID NO: 6571 - DNA, 20 bp, Artificial Sequence
  Description of Artificial Sequence: Synthetic oligonucleotide
  Target: ATXN1; (+) strand; PAM type: NAAAAC; PAM sequence: TAAAAC
tgactaatgctttacctata

SEQ ID NO: 6572 - DNA, 20 bp, Artificial Sequence
  Description of Artificial Sequence: Synthetic oligonucleotide
  Target: ATXN1; (+) strand; PAM type: NAAAAC; PAM sequence: AAAAAC
taagggtgggaagtcagcag

SEQ ID NO: 6573 - DNA, 20 bp, Artificial Sequence
  Description of Artificial Sequence: Synthetic oligonucleotide
  Target: ATXN1; (+) strand; PAM type: NAAAAC; PAM sequence: AAAAAC
gcaacaagtccgaaacctcc

SEQ ID NO: 6574 - DNA, 20 bp, Artificial Sequence
  Description of Artificial Sequence: Synthetic oligonucleotide
  Target: ATXN1; (+) strand; PAM type: NAAAAC; PAM sequence: CAAAAC
ttcaagaccagccatgtctc

SEQ ID NO: 6575 - DNA, 20 bp, Artificial Sequence
  Description of Artificial Sequence: Synthetic oligonucleotide
  Target: ATXN1; (+) strand; PAM type: NAAAAC; PAM sequence: AAAAAC
gccatgtctccaaaacttcc

SEQ ID NO: 6576 - DNA, 20 bp, Artificial Sequence
  Description of Artificial Sequence: Synthetic oligonucleotide
  Target: ATXN1; (+) strand; PAM type: NAAAAC; PAM sequence: GAAAAC
accaggaaatagctgaatgt

SEQ ID NO: 6577 - DNA, 20 bp, Artificial Sequence
  Description of Artificial Sequence: Synthetic oligonucleotide
  Target: ATXN1; (+) strand; PAM type: NAAAAC; PAM sequence: AAAAAC
tagcttttcaaatactaaat

SEQ ID NO: 6578 - DNA, 20 bp, Artificial Sequence
  Description of Artificial Sequence: Synthetic oligonucleotide
  Target: ATXN1; (+) strand; PAM type: NAAAAC; PAM sequence: AAAAAC
ctgagttgagaagacatatt

SEQ ID NO: 6579 - DNA, 20 bp, Artificial Sequence
  Description of Artificial Sequence: Synthetic oligonucleotide
  Target: ATXN1; (+) strand; PAM type: NAAAAC; PAM sequence: CAAAAC
gaccagccagccccagaaag

SEQ ID NO: 6580 - DNA, 20 bp, Artificial Sequence
  Description of Artificial Sequence: Synthetic oligonucleotide
  Target: ATXN1; (+) strand; PAM type: NAAAAC; PAM sequence: CAAAAC
cttcctcctttctcccaaat

SEQ ID NO: 6581 - DNA, 20 bp, Artificial Sequence
  Description of Artificial Sequence: Synthetic oligonucleotide
  Target: ATXN1; (+) strand; PAM type: NAAAAC; PAM sequence: AAAAAC
ttgtggagcttaaaaaaaag

SEQ ID NO: 6582 - DNA, 20 bp, Artificial Sequence
  Description of Artificial Sequence: Synthetic oligonucleotide
  Target: ATXN1; (+) strand; PAM type: NAAAAC; PAM sequence: CAAAAC
aacacgcccacagtagttct

SEQ ID NO: 6583 - DNA, 20 bp, Artificial Sequence
  Description of Artificial Sequence: Synthetic oligonucleotide
  Target: ATXN1; (+) strand; PAM type: NAAAAC; PAM sequence: TAAAAC
agctgtaaagctcatctcac

SEQ ID NO: 6584 - DNA, 20 bp, Artificial Sequence
  Description of Artificial Sequence: Synthetic oligonucleotide
  Target: ATXN1; (+) strand; PAM type: NAAAAC; PAM sequence: CAAAAC
gtccccagtttcctttccca

SEQ ID NO: 6585 - DNA, 20 bp, Artificial Sequence
  Description of Artificial Sequence: Synthetic oligonucleotide
  Target: ATXN1; (+) strand; PAM type: NAAAAC; PAM sequence: GAAAAC
agaagcccaagcgccacgaa

SEQ ID NO: 6586 - DNA, 20 bp, Artificial Sequence
  Description of Artificial Sequence: Synthetic oligonucleotide
  Target: ATXN1; (+) strand; PAM type: NAAAAC; PAM sequence: CAAAAC
cagacaggtgcctgtagact

SEQ ID NO: 6587 - DNA, 20 bp, Artificial Sequence
  Description of Artificial Sequence: Synthetic oligonucleotide
  Target: ATXN1; (+) strand; PAM type: NAAAAC; PAM sequence: AAAAAC
gataaaagtttccataagat

SEQ ID NO: 6588 - DNA, 20 bp, Artificial Sequence
  Description of Artificial Sequence: Synthetic oligonucleotide
  Target: ATXN1; (+) strand; PAM type: NAAAAC; PAM sequence: CAAAAC
tccctcccctaaacagacct

SEQ ID NO: 6589 - DNA, 20 bp, Artificial Sequence
  Description of Artificial Sequence: Synthetic oligonucleotide
  Target: ATXN1; (+) strand; PAM type: NAAAAC; PAM sequence: CAAAAC
aaatctcttacttaatagtc

SEQ ID NO: 6590 - DNA, 20 bp, Artificial Sequence
  Description of Artificial Sequence: Synthetic oligonucleotide
  Target: ATXN1; (+) strand; PAM type: NAAAAC; PAM sequence: TAAAAC
ggatgattttggtgccagta

SEQ ID NO: 6591 - DNA, 20 bp, Artificial Sequence
  Description of Artificial Sequence: Synthetic oligonucleotide
  Target: ATXN1; (+) strand; PAM type: NAAAAC; PAM sequence: AAAAAC
tgactttatatctgcattaa

SEQ ID NO: 6592 - DNA, 20 bp, Artificial Sequence
  Description of Artificial Sequence: Synthetic oligonucleotide
  Target: ATXN1; (+) strand; PAM type: NAAAAC; PAM sequence: GAAAAC
aagggcttagcctcgaccta

SEQ ID NO: 6593 - DNA, 20 bp, Artificial Sequence
  Description of Artificial Sequence: Synthetic oligonucleotide
  Target: ATXN1; (+) strand; PAM type: NAAAAC; PAM sequence: GAAAAC
gagtagatagtaaccattac

SEQ ID NO: 6594 - DNA, 20 bp, Artificial Sequence
  Description of Artificial Sequence: Synthetic oligonucleotide
  Target: ATXN1; (+) strand; PAM type: NAAAAC; PAM sequence: AAAAAC
atttaacctaggatgtctaa

SEQ ID NO: 6595 - DNA, 20 bp, Artificial Sequence
  Description of Artificial Sequence: Synthetic oligonucleotide
  Target: ATXN1; (+) strand; PAM type: NAAAAC; PAM sequence: AAAAAC
gcacaactgcactcttatgt

SEQ ID NO: 6596 - DNA, 20 bp, Artificial Sequence
  Description of Artificial Sequence: Synthetic oligonucleotide
  Target: ATXN1; (+) strand; PAM type: NAAAAC; PAM sequence: AAAAAC
aaaaccaacataactttaaa

SEQ ID NO: 6597 - DNA, 20 bp, Artificial Sequence
  Description of Artificial Sequence: Synthetic oligonucleotide
  Target: ATXN1; (+) strand; PAM type: NAAAAC; PAM sequence: CAAAAC
caaaaagaatctgcagattc

SEQ ID NO: 6598 - DNA, 20 bp, Artificial Sequence
  Description of Artificial Sequence: Synthetic oligonucleotide
  Target: ATXN1; (+) strand; PAM type: NAAAAC; PAM sequence: GAAAAC
taccttggttccaagcagga

SEQ ID NO: 6599 - DNA, 20 bp, Artificial Sequence
  Description of Artificial Sequence: Synthetic oligonucleotide
  Target: ATXN1; (+) strand; PAM type: NAAAAC; PAM sequence: GAAAAC
caaaggatcactcaccctat

SEQ ID NO: 6600 - DNA, 20 bp, Artificial Sequence
  Description of Artificial Sequence: Synthetic oligonucleotide
  Target: ATXN1; (+) strand; PAM type: NAAAAC; PAM sequence: GAAAAC
aaaatggtctaatttctttg

SEQ ID NO: 6601 - DNA, 20 bp, Artificial Sequence
  Description of Artificial Sequence: Synthetic oligonucleotide
  Target: ATXN1; (+) strand; PAM type: NAAAAC; PAM sequence: AAAAAC
aaggttatgctccaattgaa

SEQ ID NO: 6602 - DNA, 20 bp, Artificial Sequence
  Description of Artificial Sequence: Synthetic oligonucleotide
  Target: ATXN1; (+) strand; PAM type: NAAAAC; PAM sequence: GAAAAC
gtacgaattcttgagaccac

SEQ ID NO: 6603 - DNA, 20 bp, Artificial Sequence
  Description of Artificial Sequence: Synthetic oligonucleotide
  Target: ATXN1; (+) strand; PAM type: NAAAAC; PAM sequence: TAAAAC
ggtacacagaagagactgaa

SEQ ID NO: 6604 - DNA, 20 bp, Artificial Sequence
  Description of Artificial Sequence: Synthetic oligonucleotide
  Target: ATXN1; (+) strand; PAM type: NAAAAC; PAM sequence: TAAAAC
gaccagcctggccaccatgg

SEQ ID NO: 6605 - DNA, 20 bp, Artificial Sequence
  Description of Artificial Sequence: Synthetic oligonucleotide
  Target: ATXN1; (+) strand; PAM type: NAAAAC; PAM sequence: CAAAAC
tccagcctgggcaacaagag

SEQ ID NO: 6606 - DNA, 20 bp, Artificial Sequence
  Description of Artificial Sequence: Synthetic oligonucleotide
  Target: ATXN1; (+) strand; PAM type: NAAAAC; PAM sequence: AAAAAC
ctgggcaacaagagcaaaac

SEQ ID NO: 6607 - DNA, 20 bp, Artificial Sequence
  Description of Artificial Sequence: Synthetic oligonucleotide
  Target: ATXN1; (+) strand; PAM type: NAAAAC; PAM sequence: CAAAAC
tttattttacatgtctgtat

SEQ ID NO: 6608 - DNA, 20 bp, Artificial Sequence
  Description of Artificial Sequence: Synthetic oligonucleotide
  Target: ATXN1; (+) strand; PAM type: NAAAAC; PAM sequence: TAAAAC
tgagacaaatgagaacaaaa

SEQ ID NO: 6609 - DNA, 20 bp, Artificial Sequence
  Description of Artificial Sequence: Synthetic oligonucleotide
  Target: ATXN1; (+) strand; PAM type: NAAAAC; PAM sequence: AAAAAC
tataataattagataaatag

SEQ ID NO: 6610 - DNA, 20 bp, Artificial Sequence
  Description of Artificial Sequence: Synthetic oligonucleotide
  Target: ATXN1; (+) strand; PAM type: NAAAAC; PAM sequence: GAAAAC
ttttacttattaattatatt

SEQ ID NO: 6611 - DNA, 20 bp, Artificial Sequence
  Description of Artificial Sequence: Synthetic oligonucleotide
  Target: ATXN1; (+) strand; PAM type: NAAAAC; PAM sequence: CAAAAC
tccagcctgggcaacaagag

SEQ ID NO: 6612 - DNA, 20 bp, Artificial Sequence
  Description of Artificial Sequence: Synthetic oligonucleotide
  Target: ATXN1; (+) strand; PAM type: NAAAAC; PAM sequence: AAAAAC
tacagaggaaagttaactga

SEQ ID NO: 6613 - DNA, 20 bp, Artificial Sequence
  Description of Artificial Sequence: Synthetic oligonucleotide
  Target: ATXN1; (+) strand; PAM type: NAAAAC; PAM sequence: GAAAAC
ttaaatcactatttgaaggt

SEQ ID NO: 6614 - DNA, 20 bp, Artificial Sequence
  Description of Artificial Sequence: Synthetic oligonucleotide
  Target: ATXN1; (+) strand; PAM type: NAAAAC; PAM sequence: AAAAAC
gtgggggtcatgctcttaga

SEQ ID NO: 6615 - DNA, 20 bp, Artificial Sequence
  Description of Artificial Sequence: Synthetic oligonucleotide
  Target: ATXN1; (+) strand; PAM type: NAAAAC; PAM sequence: CAAAAC
gacaagcctgggcaacatgg

SEQ ID NO: 6616 - DNA, 20 bp, Artificial Sequence
  Description of Artificial Sequence: Synthetic oligonucleotide
  Target: ATXN1; (+) strand; PAM type: NAAAAC; PAM sequence: AAAAAC
tcaaaaaaaaaaaaaaaaag

SEQ ID NO: 6617 - DNA, 20 bp, Artificial Sequence
  Description of Artificial Sequence: Synthetic oligonucleotide
  Target: ATXN1; (+) strand; PAM type: NAAAAC; PAM sequence: TAAAAC
atgtattccagatctagcca

SEQ ID NO: 6618 - DNA, 20 bp, Artificial Sequence
  Description of Artificial Sequence: Synthetic oligonucleotide
  Target: ATXN1; (+) strand; PAM type: NAAAAC; PAM sequence: TAAAAC
ggtaaacatgacttgcccag

SEQ ID NO: 6619 - DNA, 20 bp, Artificial Sequence
  Description of Artificial Sequence: Synthetic oligonucleotide
  Target: ATXN1; (+) strand; PAM type: NAAAAC; PAM sequence: TAAAAC
gatatctgttcttaaggaat

SEQ ID NO: 6620 - DNA, 20 bp, Artificial Sequence
  Description of Artificial Sequence: Synthetic oligonucleotide
  Target: ATXN1; (+) strand; PAM type: NAAAAC; PAM sequence: CAAAAC
ggaatcttatttggactgta

SEQ ID NO: 6621 - DNA, 20 bp, Artificial Sequence
  Description of Artificial Sequence: Synthetic oligonucleotide
  Target: ATXN1; (+) strand; PAM type: NAAAAC; PAM sequence: TAAAAC
cctggtgacaaaataatctg

SEQ ID NO: 6622 - DNA, 20 bp, Artificial Sequence
  Description of Artificial Sequence: Synthetic oligonucleotide
  Target: ATXN1; (+) strand; PAM type: NAAAAC; PAM sequence: GAAAAC
aagttaaatgaataaaaaaa

SEQ ID NO: 6623 - DNA, 20 bp, Artificial Sequence
  Description of Artificial Sequence: Synthetic oligonucleotide
  Target: ATXN1; (+) strand; PAM type: NAAAAC; PAM sequence: CAAAAC
gcttaatactcttcaactgc

SEQ ID NO: 6624 - DNA, 20 bp, Artificial Sequence
  Description of Artificial Sequence: Synthetic oligonucleotide
  Target: ATXN1; (+) strand; PAM type: NAAAAC; PAM sequence: CAAAAC
ggtattgaagagaatttgta

SEQ ID NO: 6625 - DNA, 20 bp, Artificial Sequence
  Description of Artificial Sequence: Synthetic oligonucleotide
  Target: ATXN1; (+) strand; PAM type: NAAAAC; PAM sequence: AAAAAC
gaaagccattgccccaatca

SEQ ID NO: 6626 - DNA, 20 bp, Artificial Sequence
  Description of Artificial Sequence: Synthetic oligonucleotide
  Target: ATXN1; (+) strand; PAM type: NAAAAC; PAM sequence: TAAAAC
tatcttattcagtaaatact

SEQ ID NO: 6627 - DNA, 20 bp, Artificial Sequence
  Description of Artificial Sequence: Synthetic oligonucleotide
  Target: ATXN1; (+) strand; PAM type: NAAAAC; PAM sequence: TAAAAC
caggcatgtcggtgttccaa

SEQ ID NO: 6628 - DNA, 20 bp, Artificial Sequence
  Description of Artificial Sequence: Synthetic oligonucleotide
  Target: ATXN1; (+) strand; PAM type: NAAAAC; PAM sequence: AAAAAC
aagactcttgagcaacaaca

SEQ ID NO: 6629 - DNA, 20 bp, Artificial Sequence
  Description of Artificial Sequence: Synthetic oligonucleotide
  Target: ATXN1; (+) strand; PAM type: NAAAAC; PAM sequence: CAAAAC
atcattaggaaaatgcaaat

SEQ ID NO: 6630 - DNA, 20 bp, Artificial Sequence
  Description of Artificial Sequence: Synthetic oligonucleotide
  Target: ATXN1; (+) strand; PAM type: NAAAAC; PAM sequence: AAAAAC
tggctctgattaacaacaaa

SEQ ID NO: 6631 - DNA, 20 bp, Artificial Sequence
  Description of Artificial Sequence: Synthetic oligonucleotide
  Target: ATXN1; (+) strand; PAM type: NAAAAC; PAM sequence: CAAAAC
acaacaaaaaaaacaacccc

SEQ ID NO: 6632 - DNA, 20 bp, Artificial Sequence
  Description of Artificial Sequence: Synthetic oligonucleotide
  Target: ATXN1; (+) strand; PAM type: NAAAAC; PAM sequence: AAAAAC
acttctaggtatatacccaa

SEQ ID NO: 6633 - DNA, 20 bp, Artificial Sequence
  Description of Artificial Sequence: Synthetic oligonucleotide
  Target: ATXN1; (+) strand; PAM type: NAAAAC; PAM sequence: GAAAAC
cagttttgctttgggaagat

SEQ ID NO: 6634 - DNA, 20 bp, Artificial Sequence
  Description of Artificial Sequence: Synthetic oligonucleotide
  Target: ATXN1; (+) strand; PAM type: NAAAAC; PAM sequence: GAAAAC
ctatctttcaggatcacagt

SEQ ID NO: 6635 - DNA, 20 bp, Artificial Sequence
  Description of Artificial Sequence: Synthetic oligonucleotide
  Target: ATXN1; (+) strand; PAM type: NAAAAC; PAM sequence: TAAAAC
ttcctaacaccattctccaa

SEQ ID NO: 6636 - DNA, 20 bp, Artificial Sequence
  Description of Artificial Sequence: Synthetic oligonucleotide
  Target: ATXN1; (+) strand; PAM type: NAAAAC; PAM sequence: TAAAAC
gagctgccaatggccagaac

SEQ ID NO: 6637 - DNA, 20 bp, Artificial Sequence
  Description of Artificial Sequence: Synthetic oligonucleotide
  Target: ATXN1; (+) strand; PAM type: NAAAAC; PAM sequence: GAAAAC
aataaattttaaaagaggaa

SEQ ID NO: 6638 - DNA, 20 bp, Artificial Sequence
  Description of Artificial Sequence: Synthetic oligonucleotide
  Target: ATXN1; (+) strand; PAM type: NAAAAC; PAM sequence: CAAAAC
gaagtttgacaccagcctgg

SEQ ID NO: 6639 - DNA, 20 bp, Artificial Sequence
  Description of Artificial Sequence: Synthetic oligonucleotide
  Target: ATXN1; (+) strand; PAM type: NAAAAC; PAM sequence: AAAAAC
aaaccctgactctaccaaaa

SEQ ID NO: 6640 - DNA, 20 bp, Artificial Sequence
  Description of Artificial Sequence: Synthetic oligonucleotide
  Target: ATXN1; (+) strand; PAM type: NAAAAC; PAM sequence: AAAAAC
gactctaccaaaaaaaaacc

SEQ ID NO: 6641 - DNA, 20 bp, Artificial Sequence
  Description of Artificial Sequence: Synthetic oligonucleotide
  Target: ATXN1; (+) strand; PAM type: NAAAAC; PAM sequence: AAAAAC
ccaaaaaaaaaccaaaaacc

SEQ ID NO: 6642 - DNA, 20 bp, Artificial Sequence
  Description of Artificial Sequence: Synthetic oligonucleotide
  Target: ATXN1; (+) strand; PAM type: NAAAAC; PAM sequence: TAAAAC
tagtcttgaagggcatcaac

SEQ ID NO: 6643 - DNA, 20 bp, Artificial Sequence
  Description of Artificial Sequence: Synthetic oligonucleotide
  Target: ATXN1; (+) strand; PAM type: NAAAAC; PAM sequence: GAAAAC
tccttttaacctcttttaca

SEQ ID NO: 6644 - DNA, 20 bp, Artificial Sequence
  Description of Artificial Sequence: Synthetic oligonucleotide
  Target: ATXN1; (+) strand; PAM type: NAAAAC; PAM sequence: GAAAAC
agttaattaaaagatttaag

SEQ ID NO: 6645 - DNA, 20 bp, Artificial Sequence
  Description of Artificial Sequence: Synthetic oligonucleotide
  Target: ATXN1; (+) strand; PAM type: NAAAAC; PAM sequence: AAAAAC
aatacaaccatgatacaggc

SEQ ID NO: 6646 - DNA, 20 bp, Artificial Sequence
  Description of Artificial Sequence: Synthetic oligonucleotide
  Target: ATXN1; (+) strand; PAM type: NAAAAC; PAM sequence: TAAAAC
tttgcttgccatcatttctt

SEQ ID NO: 6647 - DNA, 20 bp, Artificial Sequence
  Description of Artificial Sequence: Synthetic oligonucleotide
  Target: ATXN1; (+) strand; PAM type: NAAAAC; PAM sequence: GAAAAC
gatgcatcttctggggaaga

SEQ ID NO: 6648 - DNA, 20 bp, Artificial Sequence
  Description of Artificial Sequence: Synthetic oligonucleotide
  Target: ATXN1; (+) strand; PAM type: NAAAAC; PAM sequence: GAAAAC
taaccacaggacctttctaa

SEQ ID NO: 6649 - DNA, 20 bp, Artificial Sequence
  Description of Artificial Sequence: Synthetic oligonucleotide
  Target: ATXN1; (+) strand; PAM type: NAAAAC; PAM sequence: TAAAAC
aagctacgcagtggcacaac

SEQ ID NO: 6650 - DNA, 20 bp, Artificial Sequence
  Description of Artificial Sequence: Synthetic oligonucleotide
  Target: ATXN1; (+) strand; PAM type: NAAAAC; PAM sequence: CAAAAC
acatcttgcccctgagcacc

SEQ ID NO: 6651 - DNA, 20 bp, Artificial Sequence
  Description of Artificial Sequence: Synthetic oligonucleotide
  Target: ATXN1; (+) strand; PAM type: NAAAAC; PAM sequence: TAAAAC
aaattgataggtgtatctat

SEQ ID NO: 6652 - DNA, 20 bp, Artificial Sequence
  Description of Artificial Sequence: Synthetic oligonucleotide
  Target: ATXN1; (+) strand; PAM type: NAAAAC; PAM sequence: GAAAAC
tctcttaaggccttctgggg

SEQ ID NO: 6653 - DNA, 20 bp, Artificial Sequence
  Description of Artificial Sequence: Synthetic oligonucleotide
  Target: ATXN1; (+) strand; PAM type: NAAAAC; PAM sequence: TAAAAC
ccaagaccccagtggacgcc

SEQ ID NO: 6654 - DNA, 20 bp, Artificial Sequence
  Description of Artificial Sequence: Synthetic oligonucleotide
  Target: ATXN1; (+) strand; PAM type: NAAAAC; PAM sequence: AAAAAC
cacagtaagagattaacaac

SEQ ID NO: 6655 - DNA, 20 bp, Artificial Sequence
  Description of Artificial Sequence: Synthetic oligonucleotide
  Target: ATXN1; (+) strand; PAM type: NAAAAC; PAM sequence: GAAAAC
ggttccctttcccatgacag

SEQ ID NO: 6656 - DNA, 20 bp, Artificial Sequence
  Description of Artificial Sequence: Synthetic oligonucleotide
  Target: ATXN1; (+) strand; PAM type: NAAAAC; PAM sequence: GAAAAC
aagactcgattgcagcatgg

SEQ ID NO: 6657 - DNA, 20 bp, Artificial Sequence
  Description of Artificial Sequence: Synthetic oligonucleotide
  Target: ATXN1; (+) strand; PAM type: NAAAAC; PAM sequence: TAAAAC
cacctcagtttcctaatcag

SEQ ID NO: 6658 - DNA, 20 bp, Artificial Sequence
  Description of Artificial Sequence: Synthetic oligonucleotide
  Target: ATXN1; (+) strand; PAM type: NAAAAC; PAM sequence: TAAAAC
cagccaggcttccagggtta

SEQ ID NO: 6659 - DNA, 20 bp, Artificial Sequence
  Description of Artificial Sequence: Synthetic oligonucleotide
  Target: ATXN1; (+) strand; PAM type: NAAAAC; PAM sequence: TAAAAC
ctagaccataaggactctta

SEQ ID NO: 6660 - DNA, 20 bp, Artificial Sequence
  Description of Artificial Sequence: Synthetic oligonucleotide
  Target: ATXN1; (+) strand; PAM type: NAAAAC; PAM sequence: AAAAAC
ctgaaatggaagtttctatg

SEQ ID NO: 6661 - DNA, 20 bp, Artificial Sequence
  Description of Artificial Sequence: Synthetic oligonucleotide
  Target: ATXN1; (+) strand; PAM type: NAAAAC; PAM sequence: TAAAAC
tactttataaacacattatt

SEQ ID NO: 6662 - DNA, 20 bp, Artificial Sequence
  Description of Artificial Sequence: Synthetic oligonucleotide
  Target: ATXN1; (+) strand; PAM type: NAAAAC; PAM sequence: TAAAAC
tcttgtaataatacttagct

SEQ ID NO: 6663 - DNA, 20 bp, Artificial Sequence
  Description of Artificial Sequence: Synthetic oligonucleotide
  Target: ATXN1; (+) strand; PAM type: NAAAAC; PAM sequence: TAAAAC
aaattttaaacttttttttt

SEQ ID NO: 6664 - DNA, 20 bp, Artificial Sequence
  Description of Artificial Sequence: Synthetic oligonucleotide
  Target: ATXN1; (+) strand; PAM type: NAAAAC; PAM sequence: TAAAAC
gaccagcctgaccaacagag

SEQ ID NO: 6665 - DNA, 20 bp, Artificial Sequence
  Description of Artificial Sequence: Synthetic oligonucleotide
  Target: ATXN1; (+) strand; PAM type: NAAAAC; PAM sequence: TAAAAC
taagtagaagaaatacagtc

SEQ ID NO: 6666 - DNA, 20 bp, Artificial Sequence
  Description of Artificial Sequence: Synthetic oligonucleotide
  Target: ATXN1; (+) strand; PAM type: NAAAAC; PAM sequence: GAAAAC
catgtttgtattccatattt

SEQ ID NO: 6667 - DNA, 20 bp, Artificial Sequence
  Description of Artificial Sequence: Synthetic oligonucleotide
  Target: ATXN1; (+) strand; PAM type: NAAAAC; PAM sequence: AAAAAC
gaatcactgcatcctaattc

SEQ ID NO: 6668 - DNA, 20 bp, Artificial Sequence
  Description of Artificial Sequence: Synthetic oligonucleotide
  Target: ATXN1; (+) strand; PAM type: NAAAAC; PAM sequence: GAAAAC
atacaagacttgtgattggt

SEQ ID NO: 6669 - DNA, 20 bp, Artificial Sequence
  Description of Artificial Sequence: Synthetic oligonucleotide
  Target: ATXN1; (+) strand; PAM type: NAAAAC; PAM sequence: TAAAAC
ctgagctaatgctaaagaaa

SEQ ID NO: 6670 - DNA, 20 bp, Artificial Sequence
  Description of Artificial Sequence: Synthetic oligonucleotide
  Target: ATXN1; (+) strand; PAM type: NAAAAC; PAM sequence: GAAAAC
gaaaatttgacatttccctt

SEQ ID NO: 6671 - DNA, 20 bp, Artificial Sequence
  Description of Artificial Sequence: Synthetic oligonucleotide
  Target: ATXN1; (+) strand; PAM type: NAAAAC; PAM sequence: TAAAAC
atgacagaatagcaaatcat

SEQ ID NO: 6672 - DNA, 20 bp, Artificial Sequence
  Description of Artificial Sequence: Synthetic oligonucleotide
  Target: ATXN1; (+) strand; PAM type: NAAAAC; PAM sequence: GAAAAC
gcgccaggacacagcataaa

SEQ ID NO: 6673 - DNA, 20 bp, Artificial Sequence
  Description of Artificial Sequence: Synthetic oligonucleotide
  Target: ATXN1; (+) strand; PAM type: NAAAAC; PAM sequence: CAAAAC
catggaaaagatgatcctgg

SEQ ID NO: 6674 - DNA, 20 bp, Artificial Sequence
  Description of Artificial Sequence: Synthetic oligonucleotide
  Target: ATXN1; (+) strand; PAM type: NAAAAC; PAM sequence: TAAAAC
aggccaggggtgtgtgtgtc

SEQ ID NO: 6675 - DNA, 20 bp, Artificial Sequence
  Description of Artificial Sequence: Synthetic oligonucleotide
  Target: ATXN1; (+) strand; PAM type: NAAAAC; PAM sequence: CAAAAC
tggctttctttgcaagagat

SEQ ID NO: 6676 - DNA, 20 bp, Artificial Sequence
  Description of Artificial Sequence: Synthetic oligonucleotide
  Target: ATXN1; (+) strand; PAM type: NAAAAC; PAM sequence: AAAAAC
ggtaataatattttggggaa

SEQ ID NO: 6677 - DNA, 20 bp, Artificial Sequence
  Description of Artificial Sequence: Synthetic oligonucleotide
  Target: ATXN1; (+) strand; PAM type: NAAAAC; PAM sequence: CAAAAC
tccgtcagattcagcatttc

SEQ ID NO: 6678 - DNA, 20 bp, Artificial Sequence
  Description of Artificial Sequence: Synthetic oligonucleotide
  Target: ATXN1; (+) strand; PAM type: NAAAAC; PAM sequence: TAAAAC
accagcctaaccaaacatgg

SEQ ID NO: 6679 - DNA, 20 bp, Artificial Sequence
  Description of Artificial Sequence: Synthetic oligonucleotide
  Target: ATXN1; (+) strand; PAM type: NAAAAC; PAM sequence: AAAAAC
atttcaaaaaaaaaaaaaaa

SEQ ID NO: 6680 - DNA, 20 bp, Artificial Sequence
  Description of Artificial Sequence: Synthetic oligonucleotide
  Target: ATXN1; (+) strand; PAM type: NAAAAC; PAM sequence: TAAAAC
tattataaagccttagaaag

SEQ ID NO: 6681 - DNA, 20 bp, Artificial Sequence
  Description of Artificial Sequence: Synthetic oligonucleotide
  Target: ATXN1; (+) strand; PAM type: NAAAAC; PAM sequence: GAAAAC
aaaatatgagaaagaacctt

SEQ ID NO: 6682 - DNA, 20 bp, Artificial Sequence
  Description of Artificial Sequence: Synthetic oligonucleotide
  Target: ATXN1; (+) strand; PAM type: NAAAAC; PAM sequence: TAAAAC
gacaggcaaatccatagaga

SEQ ID NO: 6683 - DNA, 20 bp, Artificial Sequence
  Description of Artificial Sequence: Synthetic oligonucleotide
  Target: ATXN1; (+) strand; PAM type: NAAAAC; PAM sequence: AAAAAC
tataattctatgaatagatt

SEQ ID NO: 6684 - DNA, 20 bp, Artificial Sequence
  Description of Artificial Sequence: Synthetic oligonucleotide
  Target: ATXN1; (+) strand; PAM type: NAAAAC; PAM sequence: TAAAAC
atatatgaatcatatctcaa

SEQ ID NO: 6685 - DNA, 20 bp, Artificial Sequence
  Description of Artificial Sequence: Synthetic oligonucleotide
  Target: ATXN1; (+) strand; PAM type: NAAAAC; PAM sequence: AAAAAC
atttattattattattatgt

SEQ ID NO: 6686 - DNA, 20 bp, Artificial Sequence
  Description of Artificial Sequence: Synthetic oligonucleotide
  Target: ATXN1; (+) strand; PAM type: NAAAAC; PAM sequence: CAAAAC
catgaaccattgtgcctggc

SEQ ID NO: 6687 - DNA, 20 bp, Artificial Sequence
  Description of Artificial Sequence: Synthetic oligonucleotide
  Target: ATXN1; (+) strand; PAM type: NAAAAC; PAM sequence: TAAAAC
ataagatgactttaattttt

SEQ ID NO: 6688 - DNA, 20 bp, Artificial Sequence
  Description of Artificial Sequence: Synthetic oligonucleotide
  Target: ATXN1; (+) strand; PAM type: NAAAAC; PAM sequence: GAAAAC
tttttaaaaccctgcatgaa

SEQ ID NO: 6689 - DNA, 20 bp, Artificial Sequence
  Description of Artificial Sequence: Synthetic oligonucleotide
  Target: ATXN1; (+) strand; PAM type: NAAAAC; PAM sequence: AAAAAC
gtcaattcacaggataaacc

SEQ ID NO: 6690 - DNA, 20 bp, Artificial Sequence
  Description of Artificial Sequence: Synthetic oligonucleotide
  Target: ATXN1; (+) strand; PAM type: NAAAAC; PAM sequence: AAAAAC
tggcaaagatcgtgaagttt

SEQ ID NO: 6691 - DNA, 20 bp, Artificial Sequence
  Description of Artificial Sequence: Synthetic oligonucleotide
  Target: ATXN1; (+) strand; PAM type: NAAAAC; PAM sequence: TAAAAC
ttggcaaggtttaccaaaat

SEQ ID NO: 6692 - DNA, 20 bp, Artificial Sequence
  Description of Artificial Sequence: Synthetic oligonucleotide
  Target: ATXN1; (+) strand; PAM type: NAAAAC; PAM sequence: AAAAAC
ggggtgtaaacattgtttta

SEQ ID NO: 6693 - DNA, 20 bp, Artificial Sequence
  Description of Artificial Sequence: Synthetic oligonucleotide
  Target: ATXN1; (+) strand; PAM type: NAAAAC; PAM sequence: CAAAAC
cttctgtatatctagcaatt

SEQ ID NO: 6694 - DNA, 20 bp, Artificial Sequence
  Description of Artificial Sequence: Synthetic oligonucleotide
  Target: ATXN1; (+) strand; PAM type: NAAAAC; PAM sequence: GAAAAC
tcatcagttagggttagaac

SEQ ID NO: 6695 - DNA, 20 bp, Artificial Sequence
  Description of Artificial Sequence: Synthetic oligonucleotide
  Target: ATXN1; (+) strand; PAM type: NAAAAC; PAM sequence: AAAAAC
accttgcctcttcaaaatga

SEQ ID NO: 6696 - DNA, 20 bp, Artificial Sequence
  Description of Artificial Sequence: Synthetic oligonucleotide
  Target: ATXN1; (+) strand; PAM type: NAAAAC; PAM sequence: TAAAAC
agaatcatttaatatttccc

SEQ ID NO: 6697 - DNA, 20 bp, Artificial Sequence
  Description of Artificial Sequence: Synthetic oligonucleotide
  Target: ATXN1; (+) strand; PAM type: NAAAAC; PAM sequence: GAAAAC
tgtgtttcaacaaataattt

SEQ ID NO: 6698 - DNA, 20 bp, Artificial Sequence
  Description of Artificial Sequence: Synthetic oligonucleotide
  Target: ATXN1; (+) strand; PAM type: NAAAAC; PAM sequence: GAAAAC
ccagagatgcaacagaagca

SEQ ID NO: 6699 - DNA, 20 bp, Artificial Sequence
  Description of Artificial Sequence: Synthetic oligonucleotide
  Target: ATXN1; (+) strand; PAM type: NAAAAC; PAM sequence: CAAAAC
gaccagcctgggcaacacag

SEQ ID NO: 6700 - DNA, 20 bp, Artificial Sequence
  Description of Artificial Sequence: Synthetic oligonucleotide
  Target: ATXN1; (+) strand; PAM type: NAAAAC; PAM sequence: CAAAAC
tagaacacagactatgtttt

SEQ ID NO: 6701 - DNA, 20 bp, Artificial Sequence
  Description of Artificial Sequence: Synthetic oligonucleotide
  Target: ATXN1; (+) strand; PAM type: NAAAAC; PAM sequence: GAAAAC
tcagggtagagagggatcca

SEQ ID NO: 6702 - DNA, 20 bp, Artificial Sequence
  Description of Artificial Sequence: Synthetic oligonucleotide
  Target: ATXN1; (+) strand; PAM type: NAAAAC; PAM sequence: AAAAAC
aaatgaaactatgtctacac

SEQ ID NO: 6703 - DNA, 20 bp, Artificial Sequence
  Description of Artificial Sequence: Synthetic oligonucleotide
  Target: ATXN1; (+) strand; PAM type: NAAAAC; PAM sequence: GAAAAC
gaacattccaggaatcaaat

SEQ ID NO: 6704 - DNA, 20 bp, Artificial Sequence
  Description of Artificial Sequence: Synthetic oligonucleotide
  Target: ATXN1; (+) strand; PAM type: NAAAAC; PAM sequence: TAAAAC
tgaagacacagaacaaatga

SEQ ID NO: 6705 - DNA, 20 bp, Artificial Sequence
  Description of Artificial Sequence: Synthetic oligonucleotide
  Target: ATXN1; (+) strand; PAM type: NAAAAC; PAM sequence: TAAAAC
ctgtaaactccaacttgtca

SEQ ID NO: 6706 - DNA, 20 bp, Artificial Sequence
  Description of Artificial Sequence: Synthetic oligonucleotide
  Target: ATXN1; (+) strand; PAM type: NAAAAC; PAM sequence: AAAAAC
tttttgcttgggtgaggcta

SEQ ID NO: 6707 - DNA, 20 bp, Artificial Sequence
  Description of Artificial Sequence: Synthetic oligonucleotide
  Target: ATXN1; (+) strand; PAM type: NAAAAC; PAM sequence: AAAAAC
tcaccatgcctggccaatta

SEQ ID NO: 6708 - DNA, 20 bp, Artificial Sequence
  Description of Artificial Sequence: Synthetic oligonucleotide
  Target: ATXN1; (+) strand; PAM type: NAAAAC; PAM sequence: AAAAAC
acagagtgagactccgtctc

SEQ ID NO: 6709 - DNA, 20 bp, Artificial Sequence
  Description of Artificial Sequence: Synthetic oligonucleotide
  Target: ATXN1; (+) strand; PAM type: NAAAAC; PAM sequence: AAAAAC
acaacaacaacaacaacaac

SEQ ID NO: 6710 - DNA, 20 bp, Artificial Sequence
  Description of Artificial Sequence: Synthetic oligonucleotide
  Target: ATXN1; (+) strand; PAM type: NAAAAC; PAM sequence: CAAAAC
gctttgcagttcaatttttg

SEQ ID NO: 6711 - DNA, 20 bp, Artificial Sequence
  Description of Artificial Sequence: Synthetic oligonucleotide
  Target: ATXN1; (+) strand; PAM type: NAAAAC; PAM sequence: AAAAAC
tgccaactgaagatggcaga

SEQ ID NO: 6712 - DNA, 20 bp, Artificial Sequence
  Description of Artificial Sequence: Synthetic oligonucleotide
  Target: ATXN1; (+) strand; PAM type: NAAAAC; PAM sequence: AAAAAC
tcacagttttgacagtagag

SEQ ID NO: 6713 - DNA, 20 bp, Artificial Sequence
  Description of Artificial Sequence: Synthetic oligonucleotide
  Target: ATXN1; (+) strand; PAM type: NAAAAC; PAM sequence: AAAAAC
tgaattatgtctctgtattg

SEQ ID NO: 6714 - DNA, 20 bp, Artificial Sequence
  Description of Artificial Sequence: Synthetic oligonucleotide
  Target: ATXN1; (+) strand; PAM type: NAAAAC; PAM sequence: AAAAAC
tcagagctcttttaaccttt

SEQ ID NO: 6715 - DNA, 20 bp, Artificial Sequence
  Description of Artificial Sequence: Synthetic oligonucleotide
  Target: ATXN1; (+) strand; PAM type: NAAAAC; PAM sequence: CAAAAC
tttaagagagaggctatcat

SEQ ID NO: 6716 - DNA, 20 bp, Artificial Sequence
  Description of Artificial Sequence: Synthetic oligonucleotide
  Target: ATXN1; (+) strand; PAM type: NAAAAC; PAM sequence: AAAAAC
gtctcagaaaaaaaaaaaaa

SEQ ID NO: 6717 - DNA, 20 bp, Artificial Sequence
  Description of Artificial Sequence: Synthetic oligonucleotide
  Target: ATXN1; (+) strand; PAM type: NAAAAC; PAM sequence: AAAAAC
agaaactggttagttgttga

SEQ ID NO: 6718 - DNA, 20 bp, Artificial Sequence
  Description of Artificial Sequence: Synthetic oligonucleotide
  Target: ATXN1; (+) strand; PAM type: NAAAAC; PAM sequence: GAAAAC
ggcaccaagtgaactttgtt

SEQ ID NO: 6719 - DNA, 20 bp, Artificial Sequence
  Description of Artificial Sequence: Synthetic oligonucleotide
  Target: ATXN1; (+) strand; PAM type: NAAAAC; PAM sequence: AAAAAC
aagttgttagagggtacaat

SEQ ID NO: 6720 - DNA, 20 bp, Artificial Sequence
  Description of Artificial Sequence: Synthetic oligonucleotide
  Target: ATXN1; (+) strand; PAM type: NAAAAC; PAM sequence: CAAAAC
gaaatggagtctgtctaatc

SEQ ID NO: 6721 - DNA, 20 bp, Artificial Sequence
  Description of Artificial Sequence: Synthetic oligonucleotide
  Target: ATXN1; (+) strand; PAM type: NAAAAC; PAM sequence: AAAAAC
actcccacttctgctgctaa

SEQ ID NO: 6722 - DNA, 20 bp, Artificial Sequence
  Description of Artificial Sequence: Synthetic oligonucleotide
  Target: ATXN1; (+) strand; PAM type: NAAAAC; PAM sequence: AAAAAC
cactcagctaattaaaaaaa

SEQ ID NO: 6723 - DNA, 20 bp, Artificial Sequence
  Description of Artificial Sequence: Synthetic oligonucleotide
  Target: ATXN1; (+) strand; PAM type: NAAAAC; PAM sequence: AAAAAC
cctctttctaaattctacaa

SEQ ID NO: 6724 - DNA, 20 bp, Artificial Sequence
  Description of Artificial Sequence: Synthetic oligonucleotide
  Target: ATXN1; (+) strand; PAM type: NAAAAC; PAM sequence: CAAAAC
cggagatcttcgaagacctt

SEQ ID NO: 6725 - DNA, 20 bp, Artificial Sequence
  Description of Artificial Sequence: Synthetic oligonucleotide
  Target: ATXN1; (+) strand; PAM type: NAAAAC; PAM sequence: GAAAAC
aaattcgtgaaataagtgat

SEQ ID NO: 6726 - DNA, 20 bp, Artificial Sequence
  Description of Artificial Sequence: Synthetic oligonucleotide
  Target: ATXN1; (+) strand; PAM type: NAAAAC; PAM sequence: GAAAAC
agtgagacacaagcccaaga

SEQ ID NO: 6727 - DNA, 20 bp, Artificial Sequence
  Description of Artificial Sequence: Synthetic oligonucleotide
  Target: ATXN1; (+) strand; PAM type: NAAAAC; PAM sequence: CAAAAC
caaagccatagaaccacgat

SEQ ID NO: 6728 - DNA, 20 bp, Artificial Sequence
  Description of Artificial Sequence: Synthetic oligonucleotide
  Target: ATXN1; (+) strand; PAM type: NAAAAC; PAM sequence: TAAAAC
ggtgttagagttacaagaaa

SEQ ID NO: 6729 - DNA, 20 bp, Artificial Sequence
  Description of Artificial Sequence: Synthetic oligonucleotide
  Target: ATXN1; (+) strand; PAM type: NAAAAC; PAM sequence: GAAAAC
agtacagcaatggcccagaa

SEQ ID NO: 6730 - DNA, 20 bp, Artificial Sequence
  Description of Artificial Sequence: Synthetic oligonucleotide
  Target: ATXN1; (+) strand; PAM type: NAAAAC; PAM sequence: CAAAAC
gtagagggctctacaattta

SEQ ID NO: 6731 - DNA, 20 bp, Artificial Sequence
  Description of Artificial Sequence: Synthetic oligonucleotide
  Target: ATXN1; (+) strand; PAM type: NAAAAC; PAM sequence: AAAAAC
ctattttatagagatgcgga

SEQ ID NO: 6732 - DNA, 20 bp, Artificial Sequence
  Description of Artificial Sequence: Synthetic oligonucleotide
  Target: ATXN1; (+) strand; PAM type: NAAAAC; PAM sequence: CAAAAC
taagttgcagaactgagatt

SEQ ID NO: 6733 - DNA, 20 bp, Artificial Sequence
  Description of Artificial Sequence: Synthetic oligonucleotide
  Target: ATXN1; (+) strand; PAM type: NAAAAC; PAM sequence: AAAAAC
aaatcttccttttgcttttt

SEQ ID NO: 6734 - DNA, 20 bp, Artificial Sequence
  Description of Artificial Sequence: Synthetic oligonucleotide
  Target: ATXN1; (+) strand; PAM type: NAAAAC; PAM sequence: AAAAAC
aagatggaagacacacacca

SEQ ID NO: 6735 - DNA, 20 bp, Artificial Sequence
  Description of Artificial Sequence: Synthetic oligonucleotide
  Target: ATXN1; (+) strand; PAM type: NAAAAC; PAM sequence: GAAAAC
cagccactaaaatgcacggg

SEQ ID NO: 6736 - DNA, 20 bp, Artificial Sequence
  Description of Artificial Sequence: Synthetic oligonucleotide
  Target: ATXN1; (+) strand; PAM type: NAAAAC; PAM sequence: GAAAAC
agaatgattattttggaaga

SEQ ID NO: 6737 - DNA, 20 bp, Artificial Sequence
  Description of Artificial Sequence: Synthetic oligonucleotide
  Target: ATXN1; (+) strand; PAM type: NAAAAC; PAM sequence: AAAAAC
atataattgccaactcaaaa

SEQ ID NO: 6738 - DNA, 20 bp, Artificial Sequence
  Description of Artificial Sequence: Synthetic oligonucleotide
  Target: ATXN1; (+) strand; PAM type: NAAAAC; PAM sequence: TAAAAC
actaccttcccaaattttac

SEQ ID NO: 6739 - DNA, 20 bp, Artificial Sequence
  Description of Artificial Sequence: Synthetic oligonucleotide
  Target: ATXN1; (+) strand; PAM type: NAAAAC; PAM sequence: GAAAAC
atctcacattcctgaattta

SEQ ID NO: 6740 - DNA, 20 bp, Artificial Sequence
  Description of Artificial Sequence: Synthetic oligonucleotide
  Target: ATXN1; (+) strand; PAM type: NAAAAC; PAM sequence: TAAAAC
accagaaatcatattattta

SEQ ID NO: 6741 - DNA, 20 bp, Artificial Sequence
  Description of Artificial Sequence: Synthetic oligonucleotide
  Target: ATXN1; (+) strand; PAM type: NAAAAC; PAM sequence: TAAAAC
agaagcctggtaagttattt

SEQ ID NO: 6742 - DNA, 20 bp, Artificial Sequence
  Description of Artificial Sequence: Synthetic oligonucleotide
  Target: ATXN1; (+) strand; PAM type: NAAAAC; PAM sequence: TAAAAC
ttaaaagctacgcctacata

SEQ ID NO: 6743 - DNA, 20 bp, Artificial Sequence
  Description of Artificial Sequence: Synthetic oligonucleotide
  Target: ATXN1; (+) strand; PAM type: NAAAAC; PAM sequence: GAAAAC
tggacatgttaaagaaagaa

SEQ ID NO: 6744 - DNA, 20 bp, Artificial Sequence
  Description of Artificial Sequence: Synthetic oligonucleotide
  Target: ATXN1; (+) strand; PAM type: NAAAAC; PAM sequence: AAAAAC
tgcagtatatggaaacaacc

SEQ ID NO: 6745 - DNA, 20 bp, Artificial Sequence
  Description of Artificial Sequence: Synthetic oligonucleotide
  Target: ATXN1; (+) strand; PAM type: NAAAAC; PAM sequence: CAAAAC
attagaccagaaattagggc

SEQ ID NO: 6746 - DNA, 20 bp, Artificial Sequence
  Description of Artificial Sequence: Synthetic oligonucleotide
  Target: ATXN1; (+) strand; PAM type: NAAAAC; PAM sequence: GAAAAC
gaaaaatgggtctctgactt

SEQ ID NO: 6747 - DNA, 20 bp, Artificial Sequence
  Description of Artificial Sequence: Synthetic oligonucleotide
  Target: ATXN1; (+) strand; PAM type: NAAAAC; PAM sequence: GAAAAC
tgcccaatgtcacacttcaa

SEQ ID NO: 6748 - DNA, 20 bp, Artificial Sequence
  Description of Artificial Sequence: Synthetic oligonucleotide
  Target: ATXN1; (+) strand; PAM type: NAAAAC; PAM sequence: CAAAAC
tctaatggaggaaggttcta

SEQ ID NO: 6749 - DNA, 20 bp, Artificial Sequence
  Description of Artificial Sequence: Synthetic oligonucleotide
  Target: ATXN1; (+) strand; PAM type: NAAAAC; PAM sequence: CAAAAC
caaatgaccccccccacccc

SEQ ID NO: 6750 - DNA, 20 bp, Artificial Sequence
  Description of Artificial Sequence: Synthetic oligonucleotide
  Target: ATXN1; (+) strand; PAM type: NAAAAC; PAM sequence: AAAAAC
ttttgcataatcagtcagca

SEQ ID NO: 6751 - DNA, 20 bp, Artificial Sequence
  Description of Artificial Sequence: Synthetic oligonucleotide
  Target: ATXN1; (+) strand; PAM type: NAAAAC; PAM sequence: GAAAAC
tttcaaaattctcagcattg

SEQ ID NO: 6752 - DNA, 20 bp, Artificial Sequence
  Description of Artificial Sequence: Synthetic oligonucleotide
  Target: ATXN1; (+) strand; PAM type: NAAAAC; PAM sequence: TAAAAC
caacaagttaccaaaagccg

SEQ ID NO: 6753 - DNA, 20 bp, Artificial Sequence
  Description of Artificial Sequence: Synthetic oligonucleotide
  Target: ATXN1; (+) strand; PAM type: NAAAAC; PAM sequence: GAAAAC
taccaaaagccgtaaaactt

SEQ ID NO: 6754 - DNA, 20 bp, Artificial Sequence
  Description of Artificial Sequence: Synthetic oligonucleotide
  Target: ATXN1; (+) strand; PAM type: NAAAAC; PAM sequence: CAAAAC
gaccagcctgggcaacatgg

SEQ ID NO: 6755 - DNA, 20 bp, Artificial Sequence
  Description of Artificial Sequence: Synthetic oligonucleotide
  Target: ATXN1; (+) strand; PAM type: NAAAAC; PAM sequence: TAAAAC
ggcagtggagaatctcagtg

SEQ ID NO: 6756 - DNA, 20 bp, Artificial Sequence
  Description of Artificial Sequence: Synthetic oligonucleotide
  Target: ATXN1; (+) strand; PAM type: NAAAAC; PAM sequence: AAAAAC
acgcctagacctgtaattat

SEQ ID NO: 6757 - DNA, 20 bp, Artificial Sequence
  Description of Artificial Sequence: Synthetic oligonucleotide
  Target: ATXN1; (+) strand; PAM type: NAAAAC; PAM sequence: AAAAAC
ggtttttaaatcagaatgtc

SEQ ID NO: 6758 - DNA, 20 bp, Artificial Sequence
  Description of Artificial Sequence: Synthetic oligonucleotide
  Target: ATXN1; (+) strand; PAM type: NAAAAC; PAM sequence: GAAAAC
tacctctgcattattgacaa

SEQ ID NO: 6759 - DNA, 20 bp, Artificial Sequence
  Description of Artificial Sequence: Synthetic oligonucleotide
  Target: ATXN1; (+) strand; PAM type: NAAAAC; PAM sequence: TAAAAC
aacacttctgtagttagtat

SEQ ID NO: 6760 - DNA, 20 bp, Artificial Sequence
  Description of Artificial Sequence: Synthetic oligonucleotide
  Target: ATXN1; (+) strand; PAM type: NAAAAC; PAM sequence: CAAAAC
gtaatcccaaatccagatgc

SEQ ID NO: 6761 - DNA, 20 bp, Artificial Sequence
  Description of Artificial Sequence: Synthetic oligonucleotide
  Target: ATXN1; (+) strand; PAM type: NAAAAC; PAM sequence: AAAAAC
accccatctatactaaaaaa

SEQ ID NO: 6762 - DNA, 20 bp, Artificial Sequence
  Description of Artificial Sequence: Synthetic oligonucleotide
  Target: ATXN1; (+) strand; PAM type: NAAAAC; PAM sequence: CAAAAC
ccatttctaaacatggcccc

SEQ ID NO: 6763 - DNA, 20 bp, Artificial Sequence
  Description of Artificial Sequence: Synthetic oligonucleotide
  Target: ATXN1; (+) strand; PAM type: NAAAAC; PAM sequence: AAAAAC
gctggggacgcttctctgtg

SEQ ID NO: 6764 - DNA, 20 bp, Artificial Sequence
  Description of Artificial Sequence: Synthetic oligonucleotide
  Target: ATXN1; (+) strand; PAM type: NAAAAC; PAM sequence: TAAAAC
catttatcactgataaaaga

SEQ ID NO: 6765 - DNA, 20 bp, Artificial Sequence
  Description of Artificial Sequence: Synthetic oligonucleotide
  Target: ATXN1; (+) strand; PAM type: NAAAAC; PAM sequence: CAAAAC
aaatgagaaggtagaataga

SEQ ID NO: 6766 - DNA, 20 bp, Artificial Sequence
  Description of Artificial Sequence: Synthetic oligonucleotide
  Target: ATXN1; (+) strand; PAM type: NAAAAC; PAM sequence: TAAAAC
agttactgtcagcctccccc

SEQ ID NO: 6767 - DNA, 20 bp, Artificial Sequence
  Description of Artificial Sequence: Synthetic oligonucleotide
  Target: ATXN1; (+) strand; PAM type: NAAAAC; PAM sequence: AAAAAC
tgttaggaaatagagatgga

SEQ ID NO: 6768 - DNA, 20 bp, Artificial Sequence
  Description of Artificial Sequence: Synthetic oligonucleotide
  Target: ATXN1; (+) strand; PAM type: NAAAAC; PAM sequence: TAAAAC
cagtgcaccccaccattttt

SEQ ID NO: 6769 - DNA, 20 bp, Artificial Sequence
  Description of Artificial Sequence: Synthetic oligonucleotide
  Target: ATXN1; (+) strand; PAM type: NAAAAC; PAM sequence: CAAAAC
gtacatgaagtgccaggggc

SEQ ID NO: 6770 - DNA, 20 bp, Artificial Sequence
  Description of Artificial Sequence: Synthetic oligonucleotide
  Target: ATXN1; (+) strand; PAM type: NAAAAC; PAM sequence: AAAAAC
attttaaaatagcaaaatcg

SEQ ID NO: 6771 - DNA, 20 bp, Artificial Sequence
  Description of Artificial Sequence: Synthetic oligonucleotide
  Target: ATXN1; (+) strand; PAM type: NAAAAC; PAM sequence: TAAAAC
ggtatgagaagagacaacga

SEQ ID NO: 6772 - DNA, 20 bp, Artificial Sequence
  Description of Artificial Sequence: Synthetic oligonucleotide
  Target: ATXN1; (+) strand; PAM type: NAAAAC; PAM sequence: GAAAAC
ctgtacgaaggatgtctctg

SEQ ID NO: 6773 - DNA, 20 bp, Artificial Sequence
  Description of Artificial Sequence: Synthetic oligonucleotide
  Target: ATXN1; (+) strand; PAM type: NAAAAC; PAM sequence: AAAAAC
acctcaggtgaaaccccagc

SEQ ID NO: 6774 - DNA, 20 bp, Artificial Sequence
  Description of Artificial Sequence: Synthetic oligonucleotide
  Target: ATXN1; (+) strand; PAM type: NAAAAC; PAM sequence: TAAAAC
ctgatatgtaaagatcccat

SEQ ID NO: 6775 - DNA, 20 bp, Artificial Sequence
  Description of Artificial Sequence: Synthetic oligonucleotide
  Target: ATXN1; (+) strand; PAM type: NAAAAC; PAM sequence: TAAAAC
gtgagccaccatgcctggcc

SEQ ID NO: 6776 - DNA, 20 bp, Artificial Sequence
  Description of Artificial Sequence: Synthetic oligonucleotide
  Target: ATXN1; (+) strand; PAM type: NAAAAC; PAM sequence: AAAAAC
tgttataatgtatgcattat

SEQ ID NO: 6777 - DNA, 20 bp, Artificial Sequence
  Description of Artificial Sequence: Synthetic oligonucleotide
  Target: ATXN1; (+) strand; PAM type: NAAAAC; PAM sequence: TAAAAC
tgcctataaatataaaaagt

SEQ ID NO: 6778 - DNA, 20 bp, Artificial Sequence
  Description of Artificial Sequence: Synthetic oligonucleotide
  Target: ATXN1; (+) strand; PAM type: NAAAAC; PAM sequence: TAAAAC
tcagaaggttgttacgtata

SEQ ID NO: 6779 - DNA, 20 bp, Artificial Sequence
  Description of Artificial Sequence: Synthetic oligonucleotide
  Target: ATXN1; (+) strand; PAM type: NAAAAC; PAM sequence: AAAAAC
gactttcctgccaacttgcc

SEQ ID NO: 6780 - DNA, 20 bp, Artificial Sequence
  Description of Artificial Sequence: Synthetic oligonucleotide
  Target: ATXN1; (+) strand; PAM type: NAAAAC; PAM sequence: AAAAAC
gccctatagcagcctcatgc

SEQ ID NO: 6781 - DNA, 20 bp, Artificial Sequence
  Description of Artificial Sequence: Synthetic oligonucleotide
  Target: ATXN1; (+) strand; PAM type: NAAAAC; PAM sequence: AAAAAC
tcattgttattcattaaaaa

SEQ ID NO: 6782 - DNA, 20 bp, Artificial Sequence
  Description of Artificial Sequence: Synthetic oligonucleotide
  Target: ATXN1; (+) strand; PAM type: NAAAAC; PAM sequence: CAAAAC
caattttaatactatctaag

SEQ ID NO: 6783 - DNA, 20 bp, Artificial Sequence
  Description of Artificial Sequence: Synthetic oligonucleotide
  Target: ATXN1; (+) strand; PAM type: NAAAAC; PAM sequence: AAAAAC
ctccgtgatattagctatgc

SEQ ID NO: 6784 - DNA, 20 bp, Artificial Sequence
  Description of Artificial Sequence: Synthetic oligonucleotide
  Target: ATXN1; (+) strand; PAM type: NAAAAC; PAM sequence: TAAAAC
ttgtctgattattctaaatt

SEQ ID NO: 6785 - DNA, 20 bp, Artificial Sequence
  Description of Artificial Sequence: Synthetic oligonucleotide
  Target: ATXN1; (+) strand; PAM type: NAAAAC; PAM sequence: AAAAAC
gaaattatacgggtagtcaa

SEQ ID NO: 6786 - DNA, 20 bp, Artificial Sequence
  Description of Artificial Sequence: Synthetic oligonucleotide
  Target: ATXN1; (+) strand; PAM type: NAAAAC; PAM sequence: TAAAAC
atttagcctacatcaaaagc

SEQ ID NO: 6787 - DNA, 20 bp, Artificial Sequence
  Description of Artificial Sequence: Synthetic oligonucleotide
  Target: ATXN1; (+) strand; PAM type: NAAAAC; PAM sequence: CAAAAC
gagcttcggctactcattta

SEQ ID NO: 6788 - DNA, 20 bp, Artificial Sequence
  Description of Artificial Sequence: Synthetic oligonucleotide
  Target: ATXN1; (+) strand; PAM type: NAAAAC; PAM sequence: GAAAAC
ttagcggccagaacctcatt

SEQ ID NO: 6789 - DNA, 20 bp, Artificial Sequence
  Description of Artificial Sequence: Synthetic oligonucleotide
  Target: ATXN1; (+) strand; PAM type: NAAAAC; PAM sequence: AAAAAC
gaatttcaaaaatcaaatac

SEQ ID NO: 6790 - DNA, 20 bp, Artificial Sequence
  Description of Artificial Sequence: Synthetic oligonucleotide
  Target: ATXN1; (+) strand; PAM type: NAAAAC; PAM sequence: GAAAAC
aaccaagtctgcacatggga

SEQ ID NO: 6791 - DNA, 20 bp, Artificial Sequence
  Description of Artificial Sequence: Synthetic oligonucleotide
  Target: ATXN1; (+) strand; PAM type: NAAAAC; PAM sequence: CAAAAC
gaccagcctgggcaacacag

SEQ ID NO: 6792 - DNA, 20 bp, Artificial Sequence
  Description of Artificial Sequence: Synthetic oligonucleotide
  Target: ATXN1; (+) strand; PAM type: NAAAAC; PAM sequence: AAAAAC
tctgtctcaaaaaaaaaaaa

SEQ ID NO: 6793 - DNA, 20 bp, Artificial Sequence
  Description of Artificial Sequence: Synthetic oligonucleotide
  Target: ATXN1; (+) strand; PAM type: NAAAAC; PAM sequence: GAAAAC
gaccctgtatctaaaaaaaa

SEQ ID NO: 6794 - DNA, 20 bp, Artificial Sequence
  Description of Artificial Sequence: Synthetic oligonucleotide
  Target: ATXN1; (+) strand; PAM type: NAAAAC; PAM sequence: GAAAAC
acctggattttggaaaagag

SEQ ID NO: 6795 - DNA, 20 bp, Artificial Sequence
  Description of Artificial Sequence: Synthetic oligonucleotide
  Target: ATXN1; (+) strand; PAM type: NAAAAC; PAM sequence: GAAAAC
taaacacactagagacatta

SEQ ID NO: 6796 - DNA, 20 bp, Artificial Sequence
  Description of Artificial Sequence: Synthetic oligonucleotide
  Target: ATXN1; (+) strand; PAM type: NAAAAC; PAM sequence: AAAAAC
acagagcgagaccctgtctc

SEQ ID NO: 6797 - DNA, 20 bp, Artificial Sequence
  Description of Artificial Sequence: Synthetic oligonucleotide
  Target: ATXN1; (+) strand; PAM type: NAAAAC; PAM sequence: TAAAAC
gagatggggtttcaccagtt

SEQ ID NO: 6798 - DNA, 20 bp, Artificial Sequence
  Description of Artificial Sequence: Synthetic oligonucleotide
  Target: ATXN1; (+) strand; PAM type: NAAAAC; PAM sequence: GAAAAC
ggcaaccatggtcaactgtt

SEQ ID NO: 6799 - DNA, 20 bp, Artificial Sequence
  Description of Artificial Sequence: Synthetic oligonucleotide
  Target: ATXN1; (+) strand; PAM type: NAAAAC; PAM sequence: GAAAAC
tacatcaaaatgtgttagta

SEQ ID NO: 6800 - DNA, 20 bp, Artificial Sequence
  Description of Artificial Sequence: Synthetic oligonucleotide
  Target: ATXN1; (+) strand; PAM type: NAAAAC; PAM sequence: AAAAAC
acaaatttgtgcagctgctg

SEQ ID NO: 6801 - DNA, 20 bp, Artificial Sequence
  Description of Artificial Sequence: Synthetic oligonucleotide
  Target: ATXN1; (+) strand; PAM type: NAAAAC; PAM sequence: CAAAAC
cattcaatgatgagcagacc

SEQ ID NO: 6802 - DNA, 20 bp, Artificial Sequence
  Description of Artificial Sequence: Synthetic oligonucleotide
  Target: ATXN1; (+) strand; PAM type: NAAAAC; PAM sequence: CAAAAC
gcttataaggacttggttaa

SEQ ID NO: 6803 - DNA, 20 bp, Artificial Sequence
  Description of Artificial Sequence: Synthetic oligonucleotide
  Target: ATXN1; (+) strand; PAM type: NAAAAC; PAM sequence: GAAAAC
ggcgtgaatgacaagtaaat

SEQ ID NO: 6804 - DNA, 20 bp, Artificial Sequence
  Description of Artificial Sequence: Synthetic oligonucleotide
  Target: ATXN1; (+) strand; PAM type: NAAAAC; PAM sequence: TAAAAC
tgattttccaaagtattatt

SEQ ID NO: 6805 - DNA, 20 bp, Artificial Sequence
  Description of Artificial Sequence: Synthetic oligonucleotide
  Target: ATXN1; (+) strand; PAM type: NAAAAC; PAM sequence: AAAAAC
cattcgatgcaatgaaaagg

SEQ ID NO: 6806 - DNA, 20 bp, Artificial Sequence
  Description of Artificial Sequence: Synthetic oligonucleotide
  Target: ATXN1; (+) strand; PAM type: NAAAAC; PAM sequence: AAAAAC
aaccaaccaaccaaccaacc

SEQ ID NO: 6807 - DNA, 20 bp, Artificial Sequence
  Description of Artificial Sequence: Synthetic oligonucleotide
  Target: ATXN1; (+) strand; PAM type: NAAAAC; PAM sequence: GAAAAC
ctatacaagaagaaaaaaat

SEQ ID NO: 6808 - DNA, 20 bp, Artificial Sequence
  Description of Artificial Sequence: Synthetic oligonucleotide
  Target: ATXN1; (+) strand; PAM type: NAAAAC; PAM sequence: GAAAAC
atataaattaataaattaaa

SEQ ID NO: 6809 - DNA, 20 bp, Artificial Sequence
  Description of Artificial Sequence: Synthetic oligonucleotide
  Target: ATXN1; (+) strand; PAM type: NAAAAC; PAM sequence: CAAAAC
tctggtgcaacttttgaggt

SEQ ID NO: 6810 - DNA, 20 bp, Artificial Sequence
  Description of Artificial Sequence: Synthetic oligonucleotide
  Target: ATXN1; (+) strand; PAM type: NAAAAC; PAM sequence: TAAAAC
atttctgacaatagaagaaa

SEQ ID NO: 6811 - DNA, 20 bp, Artificial Sequence
  Description of Artificial Sequence: Synthetic oligonucleotide
  Target: ATXN1; (+) strand; PAM type: NAAAAC; PAM sequence: AAAAAC
cttggatcccaaggagcaac

SEQ ID NO: 6812 - DNA, 20 bp, Artificial Sequence
  Description of Artificial Sequence: Synthetic oligonucleotide
  Target: ATXN1; (+) strand; PAM type: NAAAAC; PAM sequence: TAAAAC
gaaaaggggtagttgtgctt

SEQ ID NO: 6813 - DNA, 20 bp, Artificial Sequence
  Description of Artificial Sequence: Synthetic oligonucleotide
  Target: ATXN1; (+) strand; PAM type: NAAAAC; PAM sequence: TAAAAC
attgcttgaggccaagagtt

SEQ ID NO: 6814 - DNA, 20 bp, Artificial Sequence
  Description of Artificial Sequence: Synthetic oligonucleotide
  Target: ATXN1; (+) strand; PAM type: NAAAAC; PAM sequence: CAAAAC
aaagtaatcataaactggat

SEQ ID NO: 6815 - DNA, 20 bp, Artificial Sequence
  Description of Artificial Sequence: Synthetic oligonucleotide
  Target: ATXN1; (+) strand; PAM type: NAAAAC; PAM sequence: TAAAAC
agggaaatatcaaggaatca

SEQ ID NO: 6816 - DNA, 20 bp, Artificial Sequence
  Description of Artificial Sequence: Synthetic oligonucleotide
  Target: ATXN1; (+) strand; PAM type: NAAAAC; PAM sequence: TAAAAC
atggaaatatataaagaaaa

SEQ ID NO: 6817 - DNA, 20 bp, Artificial Sequence
  Description of Artificial Sequence: Synthetic oligonucleotide
  Target: ATXN1; (+) strand; PAM type: NAAAAC; PAM sequence: CAAAAC
attctgtgaccacaatgcaa

SEQ ID NO: 6818 - DNA, 20 bp, Artificial Sequence
  Description of Artificial Sequence: Synthetic oligonucleotide
  Target: ATXN1; (+) strand; PAM type: NAAAAC; PAM sequence: CAAAAC
gaccatcctggccaacatgg

SEQ ID NO: 6819 - DNA, 20 bp, Artificial Sequence
  Description of Artificial Sequence: Synthetic oligonucleotide
  Target: ATXN1; (+) strand; PAM type: NAAAAC; PAM sequence: TAAAAC
caatataaaggaaaagcaca

SEQ ID NO: 6820 - DNA, 20 bp, Artificial Sequence
  Description of Artificial Sequence: Synthetic oligonucleotide
  Target: ATXN1; (+) strand; PAM type: NAAAAC; PAM sequence: AAAAAC
ccaatattatattaaaagtt

SEQ ID NO: 6821 - DNA, 20 bp, Artificial Sequence
  Description of Artificial Sequence: Synthetic oligonucleotide
  Target: ATXN1; (+) strand; PAM type: NAAAAC; PAM sequence: AAAAAC
ccaatattatattaaaagtt

SEQ ID NO: 6822 - DNA, 20 bp, Artificial Sequence
  Description of Artificial Sequence: Synthetic oligonucleotide
  Target: ATXN1; (+) strand; PAM type: NAAAAC; PAM sequence: TAAAAC
agacatactaatagttttcc

SEQ ID NO: 6823 - DNA, 20 bp, Artificial Sequence
  Description of Artificial Sequence: Synthetic oligonucleotide
  Target: ATXN1; (+) strand; PAM type: NAAAAC; PAM sequence: AAAAAC
catggtgtgtacgtacagga

SEQ ID NO: 6824 - DNA, 20 bp, Artificial Sequence
  Description of Artificial Sequence: Synthetic oligonucleotide
  Target: ATXN1; (+) strand; PAM type: NAAAAC; PAM sequence: GAAAAC
aacactgtaaaatctctaaa

SEQ ID NO: 6825 - DNA, 20 bp, Artificial Sequence
  Description of Artificial Sequence: Synthetic oligonucleotide
  Target: ATXN1; (+) strand; PAM type: NAAAAC; PAM sequence: AAAAAC
aagaactgctcagattctat

SEQ ID NO: 6826 - DNA, 20 bp, Artificial Sequence
  Description of Artificial Sequence: Synthetic oligonucleotide
  Target: ATXN1; (+) strand; PAM type: NAAAAC; PAM sequence: AAAAAC
aaacagaaaatgcattacta

SEQ ID NO: 6827 - DNA, 20 bp, Artificial Sequence
  Description of Artificial Sequence: Synthetic oligonucleotide
  Target: ATXN1; (+) strand; PAM type: NAAAAC; PAM sequence: AAAAAC
cattactaaaaaactaaagg

SEQ ID NO: 6828 - DNA, 20 bp, Artificial Sequence
  Description of Artificial Sequence: Synthetic oligonucleotide
  Target: ATXN1; (+) strand; PAM type: NAAAAC; PAM sequence: AAAAAC
aatcaaaagcaaaatagaaa

SEQ ID NO: 6829 - DNA, 20 bp, Artificial Sequence
  Description of Artificial Sequence: Synthetic oligonucleotide
  Target: ATXN1; (+) strand; PAM type: NAAAAC; PAM sequence: AAAAAC
agtgaaaccccgtctctact

SEQ ID NO: 6830 - DNA, 20 bp, Artificial Sequence
  Description of Artificial Sequence: Synthetic oligonucleotide
  Target: ATXN1; (+) strand; PAM type: NAAAAC; PAM sequence: AAAAAC
agaaatatactcatgtttct

SEQ ID NO: 6831 - DNA, 20 bp, Artificial Sequence
  Description of Artificial Sequence: Synthetic oligonucleotide
  Target: ATXN1; (+) strand; PAM type: NAAAAC; PAM sequence: GAAAAC
agcaaactaacccaggaaca

SEQ ID NO: 6832 - DNA, 20 bp, Artificial Sequence
  Description of Artificial Sequence: Synthetic oligonucleotide
  Target: ATXN1; (+) strand; PAM type: NAAAAC; PAM sequence: TAAAAC
taccgaatgcatgcagggct

SEQ ID NO: 6833 - DNA, 20 bp, Artificial Sequence
  Description of Artificial Sequence: Synthetic oligonucleotide
  Target: ATXN1; (+) strand; PAM type: NAAAAC; PAM sequence: TAAAAC
gtgtatcccagaacttaaag

SEQ ID NO: 6834 - DNA, 20 bp, Artificial Sequence
  Description of Artificial Sequence: Synthetic oligonucleotide
  Target: ATXN1; (+) strand; PAM type: NAAAAC; PAM sequence: CAAAAC
agaacttaaagtaaaacaaa

SEQ ID NO: 6835 - DNA, 20 bp, Artificial Sequence
  Description of Artificial Sequence: Synthetic oligonucleotide
  Target: ATXN1; (+) strand; PAM type: NAAAAC; PAM sequence: CAAAAC
actgtgggaaaaaaaaaaag

SEQ ID NO: 6836 - DNA, 20 bp, Artificial Sequence
  Description of Artificial Sequence: Synthetic oligonucleotide
  Target: ATXN1; (+) strand; PAM type: NAAAAC; PAM sequence: AAAAAC
atgtaattgtgagtaaaagg

SEQ ID NO: 6837 - DNA, 20 bp, Artificial Sequence
  Description of Artificial Sequence: Synthetic oligonucleotide
  Target: ATXN1; (+) strand; PAM type: NAAAAC; PAM sequence: AAAAAC
caatttaaaaaagaaatgta

SEQ ID NO: 6838 - DNA, 20 bp, Artificial Sequence
  Description of Artificial Sequence: Synthetic oligonucleotide
  Target: ATXN1; (+) strand; PAM type: NAAAAC; PAM sequence: TAAAAC
ctacactaaaaaaagcaaat

SEQ ID NO: 6839 - DNA, 20 bp, Artificial Sequence
  Description of Artificial Sequence: Synthetic oligonucleotide
  Target: ATXN1; (+) strand; PAM type: NAAAAC; PAM sequence: TAAAAC
tacagtatctatgagtgatg

SEQ ID NO: 6840 - DNA, 20 bp, Artificial Sequence
  Description of Artificial Sequence: Synthetic oligonucleotide
  Target: ATXN1; (+) strand; PAM type: NAAAAC; PAM sequence: AAAAAC
gaaaaaaaaaaagaaaaaaa

SEQ ID NO: 6841 - DNA, 20 bp, Artificial Sequence
  Description of Artificial Sequence: Synthetic oligonucleotide
  Target: ATXN1; (+) strand; PAM type: NAAAAC; PAM sequence: TAAAAC
tattagtattattttgattt

SEQ ID NO: 6842 - DNA, 20 bp, Artificial Sequence
  Description of Artificial Sequence: Synthetic oligonucleotide
  Target: ATXN1; (+) strand; PAM type: NAAAAC; PAM sequence: GAAAAC
aaagaagctagatgatctaa

SEQ ID NO: 6843 - DNA, 20 bp, Artificial Sequence
  Description of Artificial Sequence: Synthetic oligonucleotide
  Target: ATXN1; (+) strand; PAM type: NAAAAC; PAM sequence: CAAAAC
gagtaaagtctttgtatatg

SEQ ID NO: 6844 - DNA, 20 bp, Artificial Sequence
  Description of Artificial Sequence: Synthetic oligonucleotide
  Target: ATXN1; (+) strand; PAM type: NAAAAC; PAM sequence: AAAAAC
acagagcgagattccatctc

SEQ ID NO: 6845 - DNA, 20 bp, Artificial Sequence
  Description of Artificial Sequence: Synthetic oligonucleotide
  Target: ATXN1; (+) strand; PAM type: NAAAAC; PAM sequence: AAAAAC
gagattccatctcaaaaaca

SEQ ID NO: 6846 - DNA, 20 bp, Artificial Sequence
  Description of Artificial Sequence: Synthetic oligonucleotide
  Target: ATXN1; (+) strand; PAM type: NAAAAC; PAM sequence: AAAAAC
attaaaccggtgaaggggat

SEQ ID NO: 6847 - DNA, 20 bp, Artificial Sequence
  Description of Artificial Sequence: Synthetic oligonucleotide
  Target: ATXN1; (+) strand; PAM type: NAAAAC; PAM sequence: TAAAAC
ggagcttagctcagggctca

SEQ ID NO: 6848 - DNA, 20 bp, Artificial Sequence
  Description of Artificial Sequence: Synthetic oligonucleotide
  Target: ATXN1; (+) strand; PAM type: NAAAAC; PAM sequence: AAAAAC
catgtactctcagaacagag

SEQ ID NO: 6849 - DNA, 20 bp, Artificial Sequence
  Description of Artificial Sequence: Synthetic oligonucleotide
  Target: ATXN1; (+) strand; PAM type: NAAAAC; PAM sequence: AAAAAC
attggttttactgtctcttc

SEQ ID NO: 6850 - DNA, 20 bp, Artificial Sequence
  Description of Artificial Sequence: Synthetic oligonucleotide
  Target: ATXN1; (+) strand; PAM type: NAAAAC; PAM sequence: AAAAAC
atatccgatgtgaatagact

SEQ ID NO: 6851 - DNA, 20 bp, Artificial Sequence
  Description of Artificial Sequence: Synthetic oligonucleotide
  Target: ATXN1; (+) strand; PAM type: NAAAAC; PAM sequence: AAAAAC
ccttgacacaacgactctgc

SEQ ID NO: 6852 - DNA, 20 bp, Artificial Sequence
  Description of Artificial Sequence: Synthetic oligonucleotide
  Target: ATXN1; (+) strand; PAM type: NAAAAC; PAM sequence: AAAAAC
acttttttaaatgttaaata

SEQ ID NO: 6853 - DNA, 20 bp, Artificial Sequence
  Description of Artificial Sequence: Synthetic oligonucleotide
  Target: ATXN1; (+) strand; PAM type: NAAAAC; PAM sequence: AAAAAC
tcaacgattactgggaatgg

SEQ ID NO: 6854 - DNA, 20 bp, Artificial Sequence
  Description of Artificial Sequence: Synthetic oligonucleotide
  Target: ATXN1; (+) strand; PAM type: NAAAAC; PAM sequence: AAAAAC
agtgagcattctggcaatga

SEQ ID NO: 6855 - DNA, 20 bp, Artificial Sequence
  Description of Artificial Sequence: Synthetic oligonucleotide
  Target: ATXN1; (+) strand; PAM type: NAAAAC; PAM sequence: TAAAAC
ccaccatggaagatgtgaat

SEQ ID NO: 6856 - DNA, 20 bp, Artificial Sequence
  Description of Artificial Sequence: Synthetic oligonucleotide
  Target: ATXN1; (+) strand; PAM type: NAAAAC; PAM sequence: AAAAAC
ctgacacatagtaagcaatt

SEQ ID NO: 6857 - DNA, 20 bp, Artificial Sequence
  Description of Artificial Sequence: Synthetic oligonucleotide
  Target: ATXN1; (+) strand; PAM type: NAAAAC; PAM sequence: TAAAAC
tggaccttttgagaggtaat

SEQ ID NO: 6858 - DNA, 20 bp, Artificial Sequence
  Description of Artificial Sequence: Synthetic oligonucleotide
  Target: ATXN1; (+) strand; PAM type: NAAAAC; PAM sequence: AAAAAC
caaagcaaacaaacaaacaa

SEQ ID NO: 6859 - DNA, 20 bp, Artificial Sequence
  Description of Artificial Sequence: Synthetic oligonucleotide
  Target: ATXN1; (+) strand; PAM type: NAAAAC; PAM sequence: CAAAAC
caataaagaatactaattag

SEQ ID NO: 6860 - DNA, 20 bp, Artificial Sequence
  Description of Artificial Sequence: Synthetic oligonucleotide
  Target: ATXN1; (+) strand; PAM type: NAAAAC; PAM sequence: AAAAAC
ctgtctctactaaaaataca

SEQ ID NO: 6861 - DNA, 20 bp, Artificial Sequence
  Description of Artificial Sequence: Synthetic oligonucleotide
  Target: ATXN1; (+) strand; PAM type: NAAAAC; PAM sequence: CAAAAC
tccagcctgggcaacaaaag

SEQ ID NO: 6862 - DNA, 20 bp, Artificial Sequence
  Description of Artificial Sequence: Synthetic oligonucleotide
  Target: ATXN1; (+) strand; PAM type: NAAAAC; PAM sequence: AAAAAC
actctcttgaggcaaacagg

SEQ ID NO: 6863 - DNA, 20 bp, Artificial Sequence
  Description of Artificial Sequence: Synthetic oligonucleotide
  Target: ATXN1; (+) strand; PAM type: NAAAAC; PAM sequence: TAAAAC
caggtagtaaatgaacactt

SEQ ID NO: 6864 - DNA, 20 bp, Artificial Sequence
  Description of Artificial Sequence: Synthetic oligonucleotide
  Target: ATXN1; (+) strand; PAM type: NAAAAC; PAM sequence: GAAAAC
tattcatgttttaaagctga

SEQ ID NO: 6865 - DNA, 20 bp, Artificial Sequence
  Description of Artificial Sequence: Synthetic oligonucleotide
  Target: ATXN1; (+) strand; PAM type: NAAAAC; PAM sequence: CAAAAC
ctgaaatcccaaggtgattg

SEQ ID NO: 6866 - DNA, 20 bp, Artificial Sequence
  Description of Artificial Sequence: Synthetic oligonucleotide
  Target: ATXN1; (+) strand; PAM type: NAAAAC; PAM sequence: TAAAAC
tcaatttgccatgatataac

SEQ ID NO: 6867 - DNA, 20 bp, Artificial Sequence
  Description of Artificial Sequence: Synthetic oligonucleotide
  Target: ATXN1; (+) strand; PAM type: NAAAAC; PAM sequence: TAAAAC
cttttgtctcacaccacctg

SEQ ID NO: 6868 - DNA, 20 bp, Artificial Sequence
  Description of Artificial Sequence: Synthetic oligonucleotide
  Target: ATXN1; (+) strand; PAM type: NAAAAC; PAM sequence: GAAAAC
atgagattgttaggcagaag

SEQ ID NO: 6869 - DNA, 20 bp, Artificial Sequence
  Description of Artificial Sequence: Synthetic oligonucleotide
  Target: ATXN1; (+) strand; PAM type: NAAAAC; PAM sequence: AAAAAC
gttaagaaaaaaaaaatgca

SEQ ID NO: 6870 - DNA, 20 bp, Artificial Sequence
  Description of Artificial Sequence: Synthetic oligonucleotide
  Target: ATXN1; (+) strand; PAM type: NAAAAC; PAM sequence: CAAAAC
tctagcctgggcaacaagag

SEQ ID NO: 6871 - DNA, 20 bp, Artificial Sequence
  Description of Artificial Sequence: Synthetic oligonucleotide
  Target: ATXN1; (+) strand; PAM type: NAAAAC; PAM sequence: CAAAAC
ggcactgccataaatctttt

SEQ ID NO: 6872 - DNA, 20 bp, Artificial Sequence
  Description of Artificial Sequence: Synthetic oligonucleotide
  Target: ATXN1; (+) strand; PAM type: NAAAAC; PAM sequence: GAAAAC
atcactactctttcttctta

SEQ ID NO: 6873 - DNA, 20 bp, Artificial Sequence
  Description of Artificial Sequence: Synthetic oligonucleotide
  Target: ATXN1; (+) strand; PAM type: NAAAAC; PAM sequence: AAAAAC
aattaaacatttatttttaa

SEQ ID NO: 6874 - DNA, 20 bp, Artificial Sequence
  Description of Artificial Sequence: Synthetic oligonucleotide
  Target: ATXN1; (+) strand; PAM type: NAAAAC; PAM sequence: TAAAAC
ttagtatagtcactgttttg

SEQ ID NO: 6875 - DNA, 20 bp, Artificial Sequence
  Description of Artificial Sequence: Synthetic oligonucleotide
  Target: ATXN1; (+) strand; PAM type: NAAAAC; PAM sequence: GAAAAC
atgggaccgttttgttgcag

SEQ ID NO: 6876 - DNA, 20 bp, Artificial Sequence
  Description of Artificial Sequence: Synthetic oligonucleotide
  Target: ATXN1; (+) strand; PAM type: NAAAAC; PAM sequence: CAAAAC
taaatgcatttgaatcatcc

SEQ ID NO: 6877 - DNA, 20 bp, Artificial Sequence
  Description of Artificial Sequence: Synthetic oligonucleotide
  Target: ATXN1; (+) strand; PAM type: NAAAAC; PAM sequence: AAAAAC
cgctccaccctagtctgtgg

SEQ ID NO: 6878 - DNA, 20 bp, Artificial Sequence
  Description of Artificial Sequence: Synthetic oligonucleotide
  Target: ATXN1; (+) strand; PAM type: NAAAAC; PAM sequence: AAAAAC
tcatatgtgtgagttcaggc

SEQ ID NO: 6879 - DNA, 20 bp, Artificial Sequence
  Description of Artificial Sequence: Synthetic oligonucleotide
  Target: ATXN1; (+) strand; PAM type: NAAAAC; PAM sequence: GAAAAC
gaagcatccaaaagcatcct

SEQ ID NO: 6880 - DNA, 20 bp, Artificial Sequence
  Description of Artificial Sequence: Synthetic oligonucleotide
  Target: ATXN1; (+) strand; PAM type: NAAAAC; PAM sequence: AAAAAC
agcaaattatcgcaaggaca

SEQ ID NO: 6881 - DNA, 20 bp, Artificial Sequence
  Description of Artificial Sequence: Synthetic oligonucleotide
  Target: ATXN1; (+) strand; PAM type: NAAAAC; PAM sequence: AAAAAC
tcagttctgctaaacaccta

SEQ ID NO: 6882 - DNA, 20 bp, Artificial Sequence
  Description of Artificial Sequence: Synthetic oligonucleotide
  Target: ATXN1; (+) strand; PAM type: NAAAAC; PAM sequence: TAAAAC
tctgtgaggtctgcagttta

SEQ ID NO: 6883 - DNA, 20 bp, Artificial Sequence
  Description of Artificial Sequence: Synthetic oligonucleotide
  Target: ATXN1; (+) strand; PAM type: NAAAAC; PAM sequence: CAAAAC
ttgagcccaggagttcaaga

SEQ ID NO: 6884 - DNA, 20 bp, Artificial Sequence
  Description of Artificial Sequence: Synthetic oligonucleotide
  Target: ATXN1; (+) strand; PAM type: NAAAAC; PAM sequence: AAAAAC
tcaaaaaaaaaaaaaaaaaa

SEQ ID NO: 6885 - DNA, 20 bp, Artificial Sequence
  Description of Artificial Sequence: Synthetic oligonucleotide
  Target: ATXN1; (+) strand; PAM type: NAAAAC; PAM sequence: TAAAAC
aagtgtcactagcttccaga

SEQ ID NO: 6886 - DNA, 20 bp, Artificial Sequence
  Description of Artificial Sequence: Synthetic oligonucleotide
  Target: ATXN1; (+) strand; PAM type: NAAAAC; PAM sequence: GAAAAC
tggctttactacctcatcag

SEQ ID NO: 6887 - DNA, 20 bp, Artificial Sequence
  Description of Artificial Sequence: Synthetic oligonucleotide
  Target: ATXN1; (+) strand; PAM type: NAAAAC; PAM sequence: AAAAAC
tgcaccaatgagtgctctgt

SEQ ID NO: 6888 - DNA, 20 bp, Artificial Sequence
  Description of Artificial Sequence: Synthetic oligonucleotide
  Target: ATXN1; (+) strand; PAM type: NAAAAC; PAM sequence: GAAAAC
atacctctcaatttaaataa

SEQ ID NO: 6889 - DNA, 20 bp, Artificial Sequence
  Description of Artificial Sequence: Synthetic oligonucleotide
  Target: ATXN1; (+) strand; PAM type: NAAAAC; PAM sequence: GAAAAC
ggatctgggaaaagtaaatt

SEQ ID NO: 6890 - DNA, 20 bp, Artificial Sequence
  Description of Artificial Sequence: Synthetic oligonucleotide
  Target: ATXN1; (+) strand; PAM type: NAAAAC; PAM sequence: CAAAAC
gacagaacgagactccgtct

SEQ ID NO: 6891 - DNA, 20 bp, Artificial Sequence
  Description of Artificial Sequence: Synthetic oligonucleotide
  Target: ATXN1; (+) strand; PAM type: NAAAAC; PAM sequence: AAAAAC
acaaacaaacaaacaaacaa

SEQ ID NO: 6892 - DNA, 20 bp, Artificial Sequence
  Description of Artificial Sequence: Synthetic oligonucleotide
  Target: ATXN1; (+) strand; PAM type: NAAAAC; PAM sequence: CAAAAC
acgtaaagaccctttaccaa

SEQ ID NO: 6893 - DNA, 20 bp, Artificial Sequence
  Description of Artificial Sequence: Synthetic oligonucleotide
  Target: ATXN1; (+) strand; PAM type: NAAAAC; PAM sequence: GAAAAC
aacataacttatatgcactg

SEQ ID NO: 6894 - DNA, 20 bp, Artificial Sequence
  Description of Artificial Sequence: Synthetic oligonucleotide
  Target: ATXN1; (+) strand; PAM type: NAAAAC; PAM sequence: CAAAAC
tgtagagcagataaccactc

SEQ ID NO: 6895 - DNA, 20 bp, Artificial Sequence
  Description of Artificial Sequence: Synthetic oligonucleotide
  Target: ATXN1; (+) strand; PAM type: NAAAAC; PAM sequence: GAAAAC
gaaatacttagtggagactg

SEQ ID NO: 6896 - DNA, 20 bp, Artificial Sequence
  Description of Artificial Sequence: Synthetic oligonucleotide
  Target: ATXN1; (+) strand; PAM type: NAAAAC; PAM sequence: CAAAAC
tctttaaaaaggaaattgta

SEQ ID NO: 6897 - DNA, 20 bp, Artificial Sequence
  Description of Artificial Sequence: Synthetic oligonucleotide
  Target: ATXN1; (+) strand; PAM type: NAAAAC; PAM sequence: GAAAAC
agttttgttaaggaagcttt

SEQ ID NO: 6898 - DNA, 20 bp, Artificial Sequence
  Description of Artificial Sequence: Synthetic oligonucleotide
  Target: ATXN1; (+) strand; PAM type: NAAAAC; PAM sequence: CAAAAC
gcaagactctgtctcttaaa

SEQ ID NO: 6899 - DNA, 20 bp, Artificial Sequence
  Description of Artificial Sequence: Synthetic oligonucleotide
  Target: ATXN1; (+) strand; PAM type: NAAAAC; PAM sequence: GAAAAC
atttattgtgaactacctaa

SEQ ID NO: 6900 - DNA, 20 bp, Artificial Sequence
  Description of Artificial Sequence: Synthetic oligonucleotide
  Target: ATXN1; (+) strand; PAM type: NAAAAC; PAM sequence: AAAAAC
caagaacgaaactccatctc

SEQ ID NO: 6901 - DNA, 20 bp, Artificial Sequence
  Description of Artificial Sequence: Synthetic oligonucleotide
  Target: ATXN1; (+) strand; PAM type: NAAAAC; PAM sequence: TAAAAC
aaaaacaaaataaaataaaa

SEQ ID NO: 6902 - DNA, 20 bp, Artificial Sequence
  Description of Artificial Sequence: Synthetic oligonucleotide
  Target: ATXN1; (+) strand; PAM type: NAAAAC; PAM sequence: CAAAAC
agctaaggttctttactctg

SEQ ID NO: 6903 - DNA, 20 bp, Artificial Sequence
  Description of Artificial Sequence: Synthetic oligonucleotide
  Target: ATXN1; (+) strand; PAM type: NAAAAC; PAM sequence: GAAAAC
tggcatgactttataaacaa

SEQ ID NO: 6904 - DNA, 20 bp, Artificial Sequence
  Description of Artificial Sequence: Synthetic oligonucleotide
  Target: ATXN1; (+) strand; PAM type: NAAAAC; PAM sequence: AAAAAC
actctaaagcattaatagga

SEQ ID NO: 6905 - DNA, 20 bp, Artificial Sequence
  Description of Artificial Sequence: Synthetic oligonucleotide
  Target: ATXN1; (+) strand; PAM type: NAAAAC; PAM sequence: TAAAAC
cgacatggttatgcatgaca

SEQ ID NO: 6906 - DNA, 20 bp, Artificial Sequence
  Description of Artificial Sequence: Synthetic oligonucleotide
  Target: ATXN1; (+) strand; PAM type: NAAAAC; PAM sequence: AAAAAC
ctgaatccaactattactgt

SEQ ID NO: 6907 - DNA, 20 bp, Artificial Sequence
  Description of Artificial Sequence: Synthetic oligonucleotide
  Target: ATXN1; (+) strand; PAM type: NAAAAC; PAM sequence: AAAAAC
actgtaaaaactgtttaacc

SEQ ID NO: 6908 - DNA, 20 bp, Artificial Sequence
  Description of Artificial Sequence: Synthetic oligonucleotide
  Target: ATXN1; (+) strand; PAM type: NAAAAC; PAM sequence: AAAAAC
aattagtactaagcttatcc

SEQ ID NO: 6909 - DNA, 20 bp, Artificial Sequence
  Description of Artificial Sequence: Synthetic oligonucleotide
  Target: ATXN1; (+) strand; PAM type: NAAAAC; PAM sequence: GAAAAC
atacatagtatgtttaagaa

SEQ ID NO: 6910 - DNA, 20 bp, Artificial Sequence
  Description of Artificial Sequence: Synthetic oligonucleotide
  Target: ATXN1; (+) strand; PAM type: NAAAAC; PAM sequence: AAAAAC
ttgctaccaaaggagtatta

SEQ ID NO: 6911 - DNA, 20 bp, Artificial Sequence
  Description of Artificial Sequence: Synthetic oligonucleotide
  Target: ATXN1; (+) strand; PAM type: NAAAAC; PAM sequence: CAAAAC
tggttttactcacagctata

SEQ ID NO: 6912 - DNA, 20 bp, Artificial Sequence
  Description of Artificial Sequence: Synthetic oligonucleotide
  Target: ATXN1; (+) strand; PAM type: NAAAAC; PAM sequence: CAAAAC
catggaccactaaagacctc

SEQ ID NO: 6913 - DNA, 20 bp, Artificial Sequence
  Description of Artificial Sequence: Synthetic oligonucleotide
  Target: ATXN1; (+) strand; PAM type: NAAAAC; PAM sequence: AAAAAC
gctcttgccttctgcaaccc

SEQ ID NO: 6914 - DNA, 20 bp, Artificial Sequence
  Description of Artificial Sequence: Synthetic oligonucleotide
  Target: ATXN1; (+) strand; PAM type: NAAAAC; PAM sequence: CAAAAC
ctcgccaaacctcctttagt

SEQ ID NO: 6915 - DNA, 20 bp, Artificial Sequence
  Description of Artificial Sequence: Synthetic oligonucleotide
  Target: ATXN1; (+) strand; PAM type: NAAAAC; PAM sequence: CAAAAC
attgccacaacttctccaag

SEQ ID NO: 6916 - DNA, 20 bp, Artificial Sequence
  Description of Artificial Sequence: Synthetic oligonucleotide
  Target: ATXN1; (+) strand; PAM type: NAAAAC; PAM sequence: CAAAAC
cgggaccgctcttctgccac

SEQ ID NO: 6917 - DNA, 20 bp, Artificial Sequence
  Description of Artificial Sequence: Synthetic oligonucleotide
  Target: ATXN1; (+) strand; PAM type: NAAAAC; PAM sequence: GAAAAC
ggagaggaagatacaggata

SEQ ID NO: 6918 - DNA, 20 bp, Artificial Sequence
  Description of Artificial Sequence: Synthetic oligonucleotide
  Target: ATXN1; (+) strand; PAM type: NAAAAC; PAM sequence: CAAAAC
tactgtcaccaggagaatca

SEQ ID NO: 6919 - DNA, 20 bp, Artificial Sequence
  Description of Artificial Sequence: Synthetic oligonucleotide
  Target: ATXN1; (+) strand; PAM type: NAAAAC; PAM sequence: TAAAAC
ataataaatgctattcaacg

SEQ ID NO: 6920 - DNA, 20 bp, Artificial Sequence
  Description of Artificial Sequence: Synthetic oligonucleotide
  Target: ATXN1; (+) strand; PAM type: NAAAAC; PAM sequence: AAAAAC
aaaagtcagatcccctaaag

SEQ ID NO: 6921 - DNA, 20 bp, Artificial Sequence
  Description of Artificial Sequence: Synthetic oligonucleotide
  Target: ATXN1; (+) strand; PAM type: NAAAAC; PAM sequence: AAAAAC
gactccatctcaaaaaaaaa

SEQ ID NO: 6922 - DNA, 20 bp, Artificial Sequence
  Description of Artificial Sequence: Synthetic oligonucleotide
  Target: ATXN1; (+) strand; PAM type: NAAAAC; PAM sequence: AAAAAC
gtatttgatcacaagacgca

SEQ ID NO: 6923 - DNA, 20 bp, Artificial Sequence
  Description of Artificial Sequence: Synthetic oligonucleotide
  Target: ATXN1; (+) strand; PAM type: NAAAAC; PAM sequence: AAAAAC
agtcttttggatgacttacc

SEQ ID NO: 6924 - DNA, 20 bp, Artificial Sequence
  Description of Artificial Sequence: Synthetic oligonucleotide
  Target: ATXN1; (+) strand; PAM type: NAAAAC; PAM sequence: CAAAAC
tccagtatgctgcagtcaaa

SEQ ID NO: 6925 - DNA, 20 bp, Artificial Sequence
  Description of Artificial Sequence: Synthetic oligonucleotide
  Target: ATXN1; (+) strand; PAM type: NAAAAC; PAM sequence: AAAAAC
aaggaagaaagaaagaaaaa

SEQ ID NO: 6926 - DNA, 20 bp, Artificial Sequence
  Description of Artificial Sequence: Synthetic oligonucleotide
  Target: ATXN1; (+) strand; PAM type: NAAAAC; PAM sequence: GAAAAC
agctcatcctcatctatgtt

SEQ ID NO: 6927 - DNA, 20 bp, Artificial Sequence
  Description of Artificial Sequence: Synthetic oligonucleotide
  Target: ATXN1; (+) strand; PAM type: NAAAAC; PAM sequence: AAAAAC
gttaaattcctgggaacact

SEQ ID NO: 6928 - DNA, 20 bp, Artificial Sequence
  Description of Artificial Sequence: Synthetic oligonucleotide
  Target: ATXN1; (+) strand; PAM type: NAAAAC; PAM sequence: AAAAAC
ctttactttaccggcttggt

SEQ ID NO: 6929 - DNA, 20 bp, Artificial Sequence
  Description of Artificial Sequence: Synthetic oligonucleotide
  Target: ATXN1; (+) strand; PAM type: NAAAAC; PAM sequence: GAAAAC
tgaggcaactcttatcaaaa

SEQ ID NO: 6930 - DNA, 20 bp, Artificial Sequence
  Description of Artificial Sequence: Synthetic oligonucleotide
  Target: ATXN1; (+) strand; PAM type: NAAAAC; PAM sequence: CAAAAC
ataccgttaataataatcaa

SEQ ID NO: 6931 - DNA, 20 bp, Artificial Sequence
  Description of Artificial Sequence: Synthetic oligonucleotide
  Target: ATXN1; (+) strand; PAM type: NAAAAC; PAM sequence: AAAAAC
atgcagtgattcacacttag

SEQ ID NO: 6932 - DNA, 20 bp, Artificial Sequence
  Description of Artificial Sequence: Synthetic oligonucleotide
  Target: ATXN1; (+) strand; PAM type: NAAAAC; PAM sequence: GAAAAC
agctatattcagttgtcaaa

SEQ ID NO: 6933 - DNA, 20 bp, Artificial Sequence
  Description of Artificial Sequence: Synthetic oligonucleotide
  Target: ATXN1; (+) strand; PAM type: NAAAAC; PAM sequence: CAAAAC
aatcataaaaagaaatacaa

SEQ ID NO: 6934 - DNA, 20 bp, Artificial Sequence
  Description of Artificial Sequence: Synthetic oligonucleotide
  Target: ATXN1; (+) strand; PAM type: NAAAAC; PAM sequence: TAAAAC
aattaacacacaaaaatgtc

SEQ ID NO: 6935 - DNA, 20 bp, Artificial Sequence
  Description of Artificial Sequence: Synthetic oligonucleotide
  Target: ATXN1; (+) strand; PAM type: NAAAAC; PAM sequence: AAAAAC
tgtctaaaacagagctttaa

SEQ ID NO: 6936 - DNA, 20 bp, Artificial Sequence
  Description of Artificial Sequence: Synthetic oligonucleotide
  Target: ATXN1; (+) strand; PAM type: NAAAAC; PAM sequence: CAAAAC
attctttttttatatcatac

SEQ ID NO: 6937 - DNA, 20 bp, Artificial Sequence
  Description of Artificial Sequence: Synthetic oligonucleotide
  Target: ATXN1; (+) strand; PAM type: NAAAAC; PAM sequence: AAAAAC
cacacatcatatagcctctg

SEQ ID NO: 6938 - DNA, 20 bp, Artificial Sequence
  Description of Artificial Sequence: Synthetic oligonucleotide
  Target: ATXN1; (+) strand; PAM type: NAAAAC; PAM sequence: GAAAAC
ggaagagttatctgtgggcg

SEQ ID NO: 6939 - DNA, 20 bp, Artificial Sequence
  Description of Artificial Sequence: Synthetic oligonucleotide
  Target: ATXN1; (+) strand; PAM type: NAAAAC; PAM sequence: TAAAAC
cacgctggattctgtgaggt

SEQ ID NO: 6940 - DNA, 20 bp, Artificial Sequence
  Description of Artificial Sequence: Synthetic oligonucleotide
  Target: ATXN1; (+) strand; PAM type: NAAAAC; PAM sequence: AAAAAC
tctgctaacccacaatcgtt

SEQ ID NO: 6941 - DNA, 20 bp, Artificial Sequence
  Description of Artificial Sequence: Synthetic oligonucleotide
  Target: ATXN1; (+) strand; PAM type: NAAAAC; PAM sequence: TAAAAC
taatagatgacagatgttct

SEQ ID NO: 6942 - DNA, 20 bp, Artificial Sequence
  Description of Artificial Sequence: Synthetic oligonucleotide
  Target: ATXN1; (+) strand; PAM type: NAAAAC; PAM sequence: GAAAAC
atccttgtactctccaaact

SEQ ID NO: 6943 - DNA, 20 bp, Artificial Sequence
  Description of Artificial Sequence: Synthetic oligonucleotide
  Target: ATXN1; (+) strand; PAM type: NAAAAC; PAM sequence: GAAAAC
caagaaaaaagagatctgga

SEQ ID NO: 6944 - DNA, 20 bp, Artificial Sequence
  Description of Artificial Sequence: Synthetic oligonucleotide
  Target: ATXN1; (+) strand; PAM type: NAAAAC; PAM sequence: CAAAAC
tgcttgaaaggccacatatt

SEQ ID NO: 6945 - DNA, 20 bp, Artificial Sequence
  Description of Artificial Sequence: Synthetic oligonucleotide
  Target: ATXN1; (+) strand; PAM type: NAAAAC; PAM sequence: TAAAAC
ggatatttttaagcagttac

SEQ ID NO: 6946 - DNA, 20 bp, Artificial Sequence
  Description of Artificial Sequence: Synthetic oligonucleotide
  Target: ATXN1; (+) strand; PAM type: NAAAAC; PAM sequence: GAAAAC
ttttacatttctaaacaagt

SEQ ID NO: 6947 - DNA, 20 bp, Artificial Sequence
  Description of Artificial Sequence: Synthetic oligonucleotide
  Target: ATXN1; (+) strand; PAM type: NAAAAC; PAM sequence: CAAAAC
tgacaaggatttgaatacgt

SEQ ID NO: 6948 - DNA, 20 bp, Artificial Sequence
  Description of Artificial Sequence: Synthetic oligonucleotide
  Target: ATXN1; (+) strand; PAM type: NAAAAC; PAM sequence: AAAAAC
ggaaaaaaaaaggctttttt

SEQ ID NO: 6949 - DNA, 20 bp, Artificial Sequence
  Description of Artificial Sequence: Synthetic oligonucleotide
  Target: ATXN1; (+) strand; PAM type: NAAAAC; PAM sequence: GAAAAC
aaaaaagaaaagaaaagaaa

SEQ ID NO: 6950 - DNA, 20 bp, Artificial Sequence
  Description of Artificial Sequence: Synthetic oligonucleotide
  Target: ATXN1; (+) strand; PAM type: NAAAAC; PAM sequence: AAAAAC
gacctgcagaactgtcagat

SEQ ID NO: 6951 - DNA, 20 bp, Artificial Sequence
  Description of Artificial Sequence: Synthetic oligonucleotide
  Target: ATXN1; (+) strand; PAM type: NAAAAC; PAM sequence: AAAAAC
aagttgttacagcagcaatg

SEQ ID NO: 6952 - DNA, 20 bp, Artificial Sequence
  Description of Artificial Sequence: Synthetic oligonucleotide
  Target: ATXN1; (+) strand; PAM type: NAAAAC; PAM sequence: TAAAAC
attcagtctgtttgacattt

SEQ ID NO: 6953 - DNA, 20 bp, Artificial Sequence
  Description of Artificial Sequence: Synthetic oligonucleotide
  Target: ATXN1; (+) strand; PAM type: NAAAAC; PAM sequence: CAAAAC
tgaaaggctggctctgatgg

SEQ ID NO: 6954 - DNA, 20 bp, Artificial Sequence
  Description of Artificial Sequence: Synthetic oligonucleotide
  Target: ATXN1; (+) strand; PAM type: NAAAAC; PAM sequence: TAAAAC
cctttcagatattttaaaat

SEQ ID NO: 6955 - DNA, 20 bp, Artificial Sequence
  Description of Artificial Sequence: Synthetic oligonucleotide
  Target: ATXN1; (+) strand; PAM type: NAAAAC; PAM sequence: GAAAAC
ccaaatgctgcattatgaat

SEQ ID NO: 6956 - DNA, 20 bp, Artificial Sequence
  Description of Artificial Sequence: Synthetic oligonucleotide
  Target: ATXN1; (+) strand; PAM type: NAAAAC; PAM sequence: CAAAAC
tacaaagtagtacattattt

SEQ ID NO: 6957 - DNA, 20 bp, Artificial Sequence
  Description of Artificial Sequence: Synthetic oligonucleotide
  Target: ATXN1; (+) strand; PAM type: NAAAAC; PAM sequence: GAAAAC
acccacaattaacagcctat

SEQ ID NO: 6958 - DNA, 20 bp, Artificial Sequence
  Description of Artificial Sequence: Synthetic oligonucleotide
  Target: ATXN1; (+) strand; PAM type: NAAAAC; PAM sequence: CAAAAC
cttcctaccagatttaacta

SEQ ID NO: 6959 - DNA, 20 bp, Artificial Sequence
  Description of Artificial Sequence: Synthetic oligonucleotide
  Target: ATXN1; (+) strand; PAM type: NAAAAC; PAM sequence: TAAAAC
taactagttaacactttttt

SEQ ID NO: 6960 - DNA, 20 bp, Artificial Sequence
  Description of Artificial Sequence: Synthetic oligonucleotide
  Target: ATXN1; (+) strand; PAM type: NAAAAC; PAM sequence: CAAAAC
agagcaaaaagatggggata

SEQ ID NO: 6961 - DNA, 20 bp, Artificial Sequence
  Description of Artificial Sequence: Synthetic oligonucleotide
  Target: ATXN1; (+) strand; PAM type: NAAAAC; PAM sequence: AAAAAC
ttatcaggggctgtttgcct

SEQ ID NO: 6962 - DNA, 20 bp, Artificial Sequence
  Description of Artificial Sequence: Synthetic oligonucleotide
  Target: ATXN1; (+) strand; PAM type: NAAAAC; PAM sequence: AAAAAC
tggtgaaaccccatctctac

SEQ ID NO: 6963 - DNA, 20 bp, Artificial Sequence
  Description of Artificial Sequence: Synthetic oligonucleotide
  Target: ATXN1; (+) strand; PAM type: NAAAAC; PAM sequence: GAAAAC
agagcaaggggcaggttcca

SEQ ID NO: 6964 - DNA, 20 bp, Artificial Sequence
  Description of Artificial Sequence: Synthetic oligonucleotide
  Target: ATXN1; (+) strand; PAM type: NAAAAC; PAM sequence: GAAAAC
ttctgaatgtattagagcct

SEQ ID NO: 6965 - DNA, 20 bp, Artificial Sequence
  Description of Artificial Sequence: Synthetic oligonucleotide
  Target: ATXN1; (+) strand; PAM type: NAAAAC; PAM sequence: GAAAAC
tacttgaaacctcccagcag

SEQ ID NO: 6966 - DNA, 20 bp, Artificial Sequence
  Description of Artificial Sequence: Synthetic oligonucleotide
  Target: ATXN1; (+) strand; PAM type: NAAAAC; PAM sequence: CAAAAC
gcataaaaagccttgaccgc

SEQ ID NO: 6967 - DNA, 20 bp, Artificial Sequence
  Description of Artificial Sequence: Synthetic oligonucleotide
  Target: ATXN1; (+) strand; PAM type: NAAAAC; PAM sequence: CAAAAC
gttgatgagatctaggtttc

SEQ ID NO: 6968 - DNA, 20 bp, Artificial Sequence
  Description of Artificial Sequence: Synthetic oligonucleotide
  Target: ATXN1; (+) strand; PAM type: NAAAAC; PAM sequence: CAAAAC
cttctccatggacagtgttc

SEQ ID NO: 6969 - DNA, 20 bp, Artificial Sequence
  Description of Artificial Sequence: Synthetic oligonucleotide
  Target: ATXN1; (+) strand; PAM type: NAAAAC; PAM sequence: AAAAAC
aacctttcatatgagtcctt

SEQ ID NO: 6970 - DNA, 20 bp, Artificial Sequence
  Description of Artificial Sequence: Synthetic oligonucleotide
  Target: ATXN1; (+) strand; PAM type: NAAAAC; PAM sequence: GAAAAC
ggttttctgaagccacattt

SEQ ID NO: 6971 - DNA, 20 bp, Artificial Sequence
  Description of Artificial Sequence: Synthetic oligonucleotide
  Target: ATXN1; (+) strand; PAM type: NAAAAC; PAM sequence: TAAAAC
tctgagcatttagcgttcag

SEQ ID NO: 6972 - DNA, 20 bp, Artificial Sequence
  Description of Artificial Sequence: Synthetic oligonucleotide
  Target: ATXN1; (+) strand; PAM type: NAAAAC; PAM sequence: TAAAAC
acacactgatcataaagcaa

SEQ ID NO: 6973 - DNA, 20 bp, Artificial Sequence
  Description of Artificial Sequence: Synthetic oligonucleotide
  Target: ATXN1; (+) strand; PAM type: NAAAAC; PAM sequence: AAAAAC
cacccacaccacacgcacac

SEQ ID NO: 6974 - DNA, 20 bp, Artificial Sequence
  Description of Artificial Sequence: Synthetic oligonucleotide
  Target: ATXN1; (+) strand; PAM type: NAAAAC; PAM sequence: AAAAAC
ttattcattctttaaactgt

SEQ ID NO: 6975 - DNA, 20 bp, Artificial Sequence
  Description of Artificial Sequence: Synthetic oligonucleotide
  Target: ATXN1; (+) strand; PAM type: NAAAAC; PAM sequence: TAAAAC
ttttaaaaatatctgacatt

SEQ ID NO: 6976 - DNA, 20 bp, Artificial Sequence
  Description of Artificial Sequence: Synthetic oligonucleotide
  Target: ATXN1; (+) strand; PAM type: NAAAAC; PAM sequence: CAAAAC
cagattatttatagtcatcc

SEQ ID NO: 6977 - DNA, 20 bp, Artificial Sequence
  Description of Artificial Sequence: Synthetic oligonucleotide
  Target: ATXN1; (+) strand; PAM type: NAAAAC; PAM sequence: TAAAAC
taacacagagtcttaaattt

SEQ ID NO: 6978 - DNA, 20 bp, Artificial Sequence
  Description of Artificial Sequence: Synthetic oligonucleotide
  Target: ATXN1; (+) strand; PAM type: NAAAAC; PAM sequence: CAAAAC
accatctcaccttattgtag

SEQ ID NO: 6979 - DNA, 20 bp, Artificial Sequence
  Description of Artificial Sequence: Synthetic oligonucleotide
  Target: ATXN1; (+) strand; PAM type: NAAAAC; PAM sequence: AAAAAC
aaacctatttaatgtatctg

SEQ ID NO: 6980 - DNA, 20 bp, Artificial Sequence
  Description of Artificial Sequence: Synthetic oligonucleotide
  Target: ATXN1; (+) strand; PAM type: NAAAAC; PAM sequence: AAAAAC
tgtccgcaagagggaaaaaa

SEQ ID NO: 6981 - DNA, 20 bp, Artificial Sequence
  Description of Artificial Sequence: Synthetic oligonucleotide
  Target: ATXN1; (+) strand; PAM type: NAAAAC; PAM sequence: GAAAAC
gtataaaatcatagcaacca

SEQ ID NO: 6982 - DNA, 20 bp, Artificial Sequence
  Description of Artificial Sequence: Synthetic oligonucleotide
  Target: ATXN1; (+) strand; PAM type: NAAAAC; PAM sequence: GAAAAC
aaggtatgggacaattccat

SEQ ID NO: 6983 - DNA, 20 bp, Artificial Sequence
  Description of Artificial Sequence: Synthetic oligonucleotide
  Target: ATXN1; (+) strand; PAM type: NAAAAC; PAM sequence: TAAAAC
agtaaccagataggagacag

SEQ ID NO: 6984 - DNA, 20 bp, Artificial Sequence
  Description of Artificial Sequence: Synthetic oligonucleotide
  Target: ATXN1; (+) strand; PAM type: NAAAAC; PAM sequence: AAAAAC
atcatttaggagctttactt

SEQ ID NO: 6985 - DNA, 20 bp, Artificial Sequence
  Description of Artificial Sequence: Synthetic oligonucleotide
  Target: ATXN1; (+) strand; PAM type: NAAAAC; PAM sequence: GAAAAC
ctcccatgcttatgaattga

SEQ ID NO: 6986 - DNA, 20 bp, Artificial Sequence
  Description of Artificial Sequence: Synthetic oligonucleotide
  Target: ATXN1; (+) strand; PAM type: NAAAAC; PAM sequence: CAAAAC
gtctctacctcaatgacaga

SEQ ID NO: 6987 - DNA, 20 bp, Artificial Sequence
  Description of Artificial Sequence: Synthetic oligonucleotide
  Target: ATXN1; (+) strand; PAM type: NAAAAC; PAM sequence: CAAAAC
tcaacataatattgcaaacc

SEQ ID NO: 6988 - DNA, 20 bp, Artificial Sequence
  Description of Artificial Sequence: Synthetic oligonucleotide
  Target: ATXN1; (+) strand; PAM type: NAAAAC; PAM sequence: TAAAAC
cctaaaatgcaatgccattc

SEQ ID NO: 6989 - DNA, 20 bp, Artificial Sequence
  Description of Artificial Sequence: Synthetic oligonucleotide
  Target: ATXN1; (+) strand; PAM type: NAAAAC; PAM sequence: CAAAAC
atgatatccctgacaaccac

SEQ ID NO: 6990 - DNA, 20 bp, Artificial Sequence
  Description of Artificial Sequence: Synthetic oligonucleotide
  Target: ATXN1; (+) strand; PAM type: NAAAAC; PAM sequence: AAAAAC
tttttataatgaagacattt

SEQ ID NO: 6991 - DNA, 20 bp, Artificial Sequence
  Description of Artificial Sequence: Synthetic oligonucleotide
  Target: ATXN1; (+) strand; PAM type: NAAAAC; PAM sequence: GAAAAC
gtagattggcagaggcctta

SEQ ID NO: 6992 - DNA, 20 bp, Artificial Sequence
  Description of Artificial Sequence: Synthetic oligonucleotide
  Target: ATXN1; (+) strand; PAM type: NAAAAC; PAM sequence: GAAAAC
tcgacttctactaataatga

SEQ ID NO: 6993 - DNA, 20 bp, Artificial Sequence
  Description of Artificial Sequence: Synthetic oligonucleotide
  Target: ATXN1; (+) strand; PAM type: NAAAAC; PAM sequence: GAAAAC
cgaaataatgactaagctct

SEQ ID NO: 6994 - DNA, 20 bp, Artificial Sequence
  Description of Artificial Sequence: Synthetic oligonucleotide
  Target: ATXN1; (+) strand; PAM type: NAAAAC; PAM sequence: AAAAAC
aatttactgaaaggctgaat

SEQ ID NO: 6995 - DNA, 20 bp, Artificial Sequence
  Description of Artificial Sequence: Synthetic oligonucleotide
  Target: ATXN1; (+) strand; PAM type: NAAAAC; PAM sequence: TAAAAC
aagaagacctgtttaaaatt

SEQ ID NO: 6996 - DNA, 20 bp, Artificial Sequence
  Description of Artificial Sequence: Synthetic oligonucleotide
  Target: ATXN1; (+) strand; PAM type: NAAAAC; PAM sequence: GAAAAC
aggctgaagtacaatgtcaa

SEQ ID NO: 6997 - DNA, 20 bp, Artificial Sequence
  Description of Artificial Sequence: Synthetic oligonucleotide
  Target: ATXN1; (+) strand; PAM type: NAAAAC; PAM sequence: GAAAAC
gtacaaatacctaatttttg

SEQ ID NO: 6998 - DNA, 20 bp, Artificial Sequence
  Description of Artificial Sequence: Synthetic oligonucleotide
  Target: ATXN1; (+) strand; PAM type: NAAAAC; PAM sequence: AAAAAC
ctaccgccaccaccaacaac

SEQ ID NO: 6999 - DNA, 20 bp, Artificial Sequence
  Description of Artificial Sequence: Synthetic oligonucleotide
  Target: ATXN1; (+) strand; PAM type: NAAAAC; PAM sequence: TAAAAC
aaacaatagcaaccactttc

SEQ ID NO: 7000 - DNA, 20 bp, Artificial Sequence
  Description of Artificial Sequence: Synthetic oligonucleotide
  Target: ATXN1; (+) strand; PAM type: NAAAAC; PAM sequence: CAAAAC
caaattggcagatctgggtt

SEQ ID NO: 7001 - DNA, 20 bp, Artificial Sequence
  Description of Artificial Sequence: Synthetic oligonucleotide
  Target: ATXN1; (+) strand; PAM type: NAAAAC; PAM sequence: CAAAAC
ttaatactaagcatcagttc

SEQ ID NO: 7002 - DNA, 20 bp, Artificial Sequence
  Description of Artificial Sequence: Synthetic oligonucleotide
  Target: ATXN1; (+) strand; PAM type: NAAAAC; PAM sequence: AAAAAC
acagtccaccctagggtagg

SEQ ID NO: 7003 - DNA, 20 bp, Artificial Sequence
  Description of Artificial Sequence: Synthetic oligonucleotide
  Target: ATXN1; (+) strand; PAM type: NAAAAC; PAM sequence: CAAAAC
atgtgcagaaatacaaaagt

SEQ ID NO: 7004 - DNA, 20 bp, Artificial Sequence
  Description of Artificial Sequence: Synthetic oligonucleotide
  Target: ATXN1; (+) strand; PAM type: NAAAAC; PAM sequence: AAAAAC
ttatcagtactcaaaaatat

SEQ ID NO: 7005 - DNA, 20 bp, Artificial Sequence
  Description of Artificial Sequence: Synthetic oligonucleotide
  Target: ATXN1; (+) strand; PAM type: NAAAAC; PAM sequence: AAAAAC
gtctttacaaaaaataaatt

SEQ ID NO: 7006 - DNA, 20 bp, Artificial Sequence
  Description of Artificial Sequence: Synthetic oligonucleotide
  Target: ATXN1; (+) strand; PAM type: NAAAAC; PAM sequence: TAAAAC
aggcgacctgagagaatttt

SEQ ID NO: 7007 - DNA, 20 bp, Artificial Sequence
  Description of Artificial Sequence: Synthetic oligonucleotide
  Target: ATXN1; (+) strand; PAM type: NAAAAC; PAM sequence: AAAAAC
accctcttcatgtctcatat

SEQ ID NO: 7008 - DNA, 20 bp, Artificial Sequence
  Description of Artificial Sequence: Synthetic oligonucleotide
  Target: ATXN1; (+) strand; PAM type: NAAAAC; PAM sequence: TAAAAC
aaccttttgctaaagtggat

SEQ ID NO: 7009 - DNA, 20 bp, Artificial Sequence
  Description of Artificial Sequence: Synthetic oligonucleotide
  Target: ATXN1; (+) strand; PAM type: NAAAAC; PAM sequence: CAAAAC
ctcactattaaactgcattt

SEQ ID NO: 7010 - DNA, 20 bp, Artificial Sequence
  Description of Artificial Sequence: Synthetic oligonucleotide
  Target: ATXN1; (+) strand; PAM type: NAAAAC; PAM sequence: AAAAAC
aactgcatttcaaaacctac

SEQ ID NO: 7011 - DNA, 20 bp, Artificial Sequence
  Description of Artificial Sequence: Synthetic oligonucleotide
  Target: ATXN1; (+) strand; PAM type: NAAAAC; PAM sequence: GAAAAC
gactcatcagagtgaggtct

SEQ ID NO: 7012 - DNA, 20 bp, Artificial Sequence
  Description of Artificial Sequence: Synthetic oligonucleotide
  Target: ATXN1; (+) strand; PAM type: NAAAAC; PAM sequence: AAAAAC
tcaactgtgtcccttagaag

SEQ ID NO: 7013 - DNA, 20 bp, Artificial Sequence
  Description of Artificial Sequence: Synthetic oligonucleotide
  Target: ATXN1; (+) strand; PAM type: NAAAAC; PAM sequence: GAAAAC
agtttgtgctttgcagcaga

SEQ ID NO: 7014 - DNA, 20 bp, Artificial Sequence
  Description of Artificial Sequence: Synthetic oligonucleotide
  Target: ATXN1; (+) strand; PAM type: NAAAAC; PAM sequence: CAAAAC
tggccatttacagagcagca

SEQ ID NO: 7015 - DNA, 20 bp, Artificial Sequence
  Description of Artificial Sequence: Synthetic oligonucleotide
  Target: ATXN1; (+) strand; PAM type: NAAAAC; PAM sequence: GAAAAC
aaacgtgggcaggaggaggt

SEQ ID NO: 7016 - DNA, 20 bp, Artificial Sequence
  Description of Artificial Sequence: Synthetic oligonucleotide
  Target: ATXN1; (+) strand; PAM type: NAAAAC; PAM sequence: GAAAAC
tttcacctcatttctaagtg

SEQ ID NO: 7017 - DNA, 20 bp, Artificial Sequence
  Description of Artificial Sequence: Synthetic oligonucleotide
  Target: ATXN1; (+) strand; PAM type: NAAAAC; PAM sequence: AAAAAC
agaagaaaaagaaaccagct

SEQ ID NO: 7018 - DNA, 20 bp, Artificial Sequence
  Description of Artificial Sequence: Synthetic oligonucleotide
  Target: ATXN1; (+) strand; PAM type: NAAAAC; PAM sequence: CAAAAC
tggaatgaaccgtgaaccag

SEQ ID NO: 7019 - DNA, 20 bp, Artificial Sequence
  Description of Artificial Sequence: Synthetic oligonucleotide
  Target: ATXN1; (+) strand; PAM type: NAAAAC; PAM sequence: AAAAAC
gcaaaacaaatggaaaaaaa

SEQ ID NO: 7020 - DNA, 20 bp, Artificial Sequence
  Description of Artificial Sequence: Synthetic oligonucleotide
  Target: ATXN1; (+) strand; PAM type: NAAAAC; PAM sequence: TAAAAC
cgtgttgtgacgttctggtt

SEQ ID NO: 7021 - DNA, 20 bp, Artificial Sequence
  Description of Artificial Sequence: Synthetic oligonucleotide
  Target: ATXN1; (+) strand; PAM type: NAAAAC; PAM sequence: GAAAAC
atgacatgatcatatatcta

SEQ ID NO: 7022 - DNA, 20 bp, Artificial Sequence
  Description of Artificial Sequence: Synthetic oligonucleotide
  Target: ATXN1; (+) strand; PAM type: NAAAAC; PAM sequence: AAAAAC
actttcttcacagaattgga

SEQ ID NO: 7023 - DNA, 20 bp, Artificial Sequence
  Description of Artificial Sequence: Synthetic oligonucleotide
  Target: ATXN1; (+) strand; PAM type: NAAAAC; PAM sequence: CAAAAC
tactacaaggctacagtaat

SEQ ID NO: 7024 - DNA, 20 bp, Artificial Sequence
  Description of Artificial Sequence: Synthetic oligonucleotide
  Target: ATXN1; (+) strand; PAM type: NAAAAC; PAM sequence: CAAAAC
aaacagcatggtactggtac

SEQ ID NO: 7025 - DNA, 20 bp, Artificial Sequence
  Description of Artificial Sequence: Synthetic oligonucleotide
  Target: ATXN1; (+) strand; PAM type: NAAAAC; PAM sequence: AAAAAC
cgatctttgacaaacctgac

SEQ ID NO: 7026 - DNA, 20 bp, Artificial Sequence
  Description of Artificial Sequence: Synthetic oligonucleotide
  Target: ATXN1; (+) strand; PAM type: NAAAAC; PAM sequence: GAAAAC
tatttaataaatggtgctgg

SEQ ID NO: 7027 - DNA, 20 bp, Artificial Sequence
  Description of Artificial Sequence: Synthetic oligonucleotide
  Target: ATXN1; (+) strand; PAM type: NAAAAC; PAM sequence: TAAAAC
aaagacttaaatgttagacc

SEQ ID NO: 7028 - DNA, 20 bp, Artificial Sequence
  Description of Artificial Sequence: Synthetic oligonucleotide
  Target: ATXN1; (+) strand; PAM type: NAAAAC; PAM sequence: AAAAAC
aatgttagacctaaaaccat

SEQ ID NO: 7029 - DNA, 20 bp, Artificial Sequence
  Description of Artificial Sequence: Synthetic oligonucleotide
  Target: ATXN1; (+) strand; PAM type: NAAAAC; PAM sequence: GAAAAC
aaaccataaaaaccctagaa

SEQ ID NO: 7030 - DNA, 20 bp, Artificial Sequence
  Description of Artificial Sequence: Synthetic oligonucleotide
  Target: ATXN1; (+) strand; PAM type: NAAAAC; PAM sequence: TAAAAC
atgggcaacgacttcatgtc

SEQ ID NO: 7031 - DNA, 20 bp, Artificial Sequence
  Description of Artificial Sequence: Synthetic oligonucleotide
  Target: ATXN1; (+) strand; PAM type: NAAAAC; PAM sequence: AAAAAC
ctcaaacaaatttacaagaa

SEQ ID NO: 7032 - DNA, 20 bp, Artificial Sequence
  Description of Artificial Sequence: Synthetic oligonucleotide
  Target: ATXN1; (+) strand; PAM type: NAAAAC; PAM sequence: CAAAAC
gccatcagagaaatgcaaat

SEQ ID NO: 7033 - DNA, 20 bp, Artificial Sequence
  Description of Artificial Sequence: Synthetic oligonucleotide
  Target: ATXN1; (+) strand; PAM type: NAAAAC; PAM sequence: AAAAAC
agcaaactatcgcaaggaca

SEQ ID NO: 7034 - DNA, 20 bp, Artificial Sequence
  Description of Artificial Sequence: Synthetic oligonucleotide
  Target: ATXN1; (+) strand; PAM type: NAAAAC; PAM sequence: TAAAAC
caagttgtgcacatctaccc

SEQ ID NO: 7035 - DNA, 20 bp, Artificial Sequence
  Description of Artificial Sequence: Synthetic oligonucleotide
  Target: ATXN1; (+) strand; PAM type: NAAAAC; PAM sequence: CAAAAC
ccccgtctctactaaaaata

SEQ ID NO: 7036 - DNA, 20 bp, Artificial Sequence
  Description of Artificial Sequence: Synthetic oligonucleotide
  Target: ATXN1; (+) strand; PAM type: NAAAAC; PAM sequence: AAAAAC
agagcgagattccatctcaa

SEQ ID NO: 7037 - DNA, 20 bp, Artificial Sequence
  Description of Artificial Sequence: Synthetic oligonucleotide
  Target: ATXN1; (+) strand; PAM type: NAAAAC; PAM sequence: AAAAAC
agtgtctctaactaccattt

SEQ ID NO: 7038 - DNA, 20 bp, Artificial Sequence
  Description of Artificial Sequence: Synthetic oligonucleotide
  Target: ATXN1; (+) strand; PAM type: NAAAAC; PAM sequence: CAAAAC
aatctgtataagagagcagg

SEQ ID NO: 7039 - DNA, 20 bp, Artificial Sequence
  Description of Artificial Sequence: Synthetic oligonucleotide
  Target: ATXN1; (+) strand; PAM type: NAAAAC; PAM sequence: AAAAAC
tgcgcactgagttaaaaata

SEQ ID NO: 7040 - DNA, 20 bp, Artificial Sequence
  Description of Artificial Sequence: Synthetic oligonucleotide
  Target: ATXN1; (+) strand; PAM type: NAAAAC; PAM sequence: AAAAAC
ttgcttctttttaaagtata

SEQ ID NO: 7041 - DNA, 20 bp, Artificial Sequence
  Description of Artificial Sequence: Synthetic oligonucleotide
  Target: ATXN1; (+) strand; PAM type: NAAAAC; PAM sequence: CAAAAC
gagggggagggggcacagtg

SEQ ID NO: 7042 - DNA, 20 bp, Artificial Sequence
  Description of Artificial Sequence: Synthetic oligonucleotide
  Target: ATXN1; (+) strand; PAM type: NAAAAC; PAM sequence: AAAAAC
ggtgaaaccctgtctctact

SEQ ID NO: 7043 - DNA, 20 bp, Artificial Sequence
  Description of Artificial Sequence: Synthetic oligonucleotide
  Target: ATXN1; (+) strand; PAM type: NAAAAC; PAM sequence: CAAAAC
atctatccaaaggaagaaag

SEQ ID NO: 7044 - DNA, 20 bp, Artificial Sequence
  Description of Artificial Sequence: Synthetic oligonucleotide
  Target: ATXN1; (+) strand; PAM type: NAAAAC; PAM sequence: CAAAAC
tccaaaggaagaaagcaaaa

SEQ ID NO: 7045 - DNA, 20 bp, Artificial Sequence
  Description of Artificial Sequence: Synthetic oligonucleotide
  Target: ATXN1; (+) strand; PAM type: NAAAAC; PAM sequence: CAAAAC
aggaagaaagcaaaacaaaa

SEQ ID NO: 7046 - DNA, 20 bp, Artificial Sequence
  Description of Artificial Sequence: Synthetic oligonucleotide
  Target: ATXN1; (+) strand; PAM type: NAAAAC; PAM sequence: GAAAAC
acaaaaagtaaagccaagta

SEQ ID NO: 7047 - DNA, 20 bp, Artificial Sequence
  Description of Artificial Sequence: Synthetic oligonucleotide
  Target: ATXN1; (+) strand; PAM type: NAAAAC; PAM sequence: TAAAAC
atgaacatatacaatgacat

SEQ ID NO: 7048 - DNA, 20 bp, Artificial Sequence
  Description of Artificial Sequence: Synthetic oligonucleotide
  Target: ATXN1; (+) strand; PAM type: NAAAAC; PAM sequence: CAAAAC
tttaaaaaagaaaatataag

SEQ ID NO: 7049 - DNA, 20 bp, Artificial Sequence
  Description of Artificial Sequence: Synthetic oligonucleotide
  Target: ATXN1; (+) strand; PAM type: NAAAAC; PAM sequence: AAAAAC
aagaaaatataagcaaaact

SEQ ID NO: 7050 - DNA, 20 bp, Artificial Sequence
  Description of Artificial Sequence: Synthetic oligonucleotide
  Target: ATXN1; (+) strand; PAM type: NAAAAC; PAM sequence: AAAAAC
atataagcaaaactaaaaac

SEQ ID NO: 7051 - DNA, 20 bp, Artificial Sequence
  Description of Artificial Sequence: Synthetic oligonucleotide
  Target: ATXN1; (+) strand; PAM type: NAAAAC; PAM sequence: TAAAAC
caaaatttgtacaatgcaat

SEQ ID NO: 7052 - DNA, 20 bp, Artificial Sequence
  Description of Artificial Sequence: Synthetic oligonucleotide
  Target: ATXN1; (+) strand; PAM type: NAAAAC; PAM sequence: CAAAAC
taaaattaattaacatctag

SEQ ID NO: 7053 - DNA, 20 bp, Artificial Sequence
  Description of Artificial Sequence: Synthetic oligonucleotide
  Target: ATXN1; (+) strand; PAM type: NAAAAC; PAM sequence: GAAAAC
aatcacaaaaataagtaaat

SEQ ID NO: 7054 - DNA, 20 bp, Artificial Sequence
  Description of Artificial Sequence: Synthetic oligonucleotide
  Target: ATXN1; (+) strand; PAM type: NAAAAC; PAM sequence: AAAAAC
gataagaagaaagtattact

SEQ ID NO: 7055 - DNA, 20 bp, Artificial Sequence
  Description of Artificial Sequence: Synthetic oligonucleotide
  Target: ATXN1; (+) strand; PAM type: NAAAAC; PAM sequence: AAAAAC
ctcacaacttggatgaaata

SEQ ID NO: 7056 - DNA, 20 bp, Artificial Sequence
  Description of Artificial Sequence: Synthetic oligonucleotide
  Target: ATXN1; (+) strand; PAM type: NAAAAC; PAM sequence: AAAAAC
atgtttttaaattaaatttt

SEQ ID NO: 7057 - DNA, 20 bp, Artificial Sequence
  Description of Artificial Sequence: Synthetic oligonucleotide
  Target: ATXN1; (+) strand; PAM type: NAAAAC; PAM sequence: AAAAAC
aattctttcagaaaatagta

SEQ ID NO: 7058 - DNA, 20 bp, Artificial Sequence
  Description of Artificial Sequence: Synthetic oligonucleotide
  Target: ATXN1; (+) strand; PAM type: NAAAAC; PAM sequence: TAAAAC
ctcaagtttggtttaacact

SEQ ID NO: 7059 - DNA, 20 bp, Artificial Sequence
  Description of Artificial Sequence: Synthetic oligonucleotide
  Target: ATXN1; (+) strand; PAM type: NAAAAC; PAM sequence: GAAAAC
ataattcaccacataaagcg

SEQ ID NO: 7060 - DNA, 20 bp, Artificial Sequence
  Description of Artificial Sequence: Synthetic oligonucleotide
  Target: ATXN1; (+) strand; PAM type: NAAAAC; PAM sequence: AAAAAC
attcaacacacattcccgat

SEQ ID NO: 7061 - DNA, 20 bp, Artificial Sequence
  Description of Artificial Sequence: Synthetic oligonucleotide
  Target: ATXN1; (+) strand; PAM type: NAAAAC; PAM sequence: AAAAAC
aatccaataaaaggcaaatg

SEQ ID NO: 7062 - DNA, 20 bp, Artificial Sequence
  Description of Artificial Sequence: Synthetic oligonucleotide
  Target: ATXN1; (+) strand; PAM type: NAAAAC; PAM sequence: AAAAAC
atatgcaatgtctctgcagg

SEQ ID NO: 7063 - DNA, 20 bp, Artificial Sequence
  Description of Artificial Sequence: Synthetic oligonucleotide
  Target: ATXN1; (+) strand; PAM type: NAAAAC; PAM sequence: AAAAAC
accaaaataatcttgaggga

SEQ ID NO: 7064 - DNA, 20 bp, Artificial Sequence
  Description of Artificial Sequence: Synthetic oligonucleotide
  Target: ATXN1; (+) strand; PAM type: NAAAAC; PAM sequence: TAAAAC
atcagtggaacagagagtct

SEQ ID NO: 7065 - DNA, 20 bp, Artificial Sequence
  Description of Artificial Sequence: Synthetic oligonucleotide
  Target: ATXN1; (+) strand; PAM type: NAAAAC; PAM sequence: TAAAAC
agagagtcttaaaacacata

SEQ ID NO: 7066 - DNA, 20 bp, Artificial Sequence
  Description of Artificial Sequence: Synthetic oligonucleotide
  Target: ATXN1; (+) strand; PAM type: NAAAAC; PAM sequence: AAAAAC
gttgtttcatacattttaat

SEQ ID NO: 7067 - DNA, 20 bp, Artificial Sequence
  Description of Artificial Sequence: Synthetic oligonucleotide
  Target: ATXN1; (+) strand; PAM type: NAAAAC; PAM sequence: GAAAAC
aaactagaaatcttccagga

SEQ ID NO: 7068 - DNA, 20 bp, Artificial Sequence
  Description of Artificial Sequence: Synthetic oligonucleotide
  Target: ATXN1; (+) strand; PAM type: NAAAAC; PAM sequence: AAAAAC
taagttcacaaaataaaaaa

SEQ ID NO: 7069 - DNA, 20 bp, Artificial Sequence
  Description of Artificial Sequence: Synthetic oligonucleotide
  Target: ATXN1; (+) strand; PAM type: NAAAAC; PAM sequence: CAAAAC
atgtggatgtatgcattcat

SEQ ID NO: 7070 - DNA, 20 bp, Artificial Sequence
  Description of Artificial Sequence: Synthetic oligonucleotide
  Target: ATXN1; (+) strand; PAM type: NAAAAC; PAM sequence: GAAAAC
aacagtgaacatgcttgagt

SEQ ID NO: 7071 - DNA, 20 bp, Artificial Sequence
  Description of Artificial Sequence: Synthetic oligonucleotide
  Target: ATXN1; (+) strand; PAM type: NAAAAC; PAM sequence: CAAAAC
gccccttaatcagccacctt

SEQ ID NO: 7072 - DNA, 20 bp, Artificial Sequence
  Description of Artificial Sequence: Synthetic oligonucleotide
  Target: ATXN1; (+) strand; PAM type: NAAAAC; PAM sequence: GAAAAC
atcatttgggctacttgtgt

SEQ ID NO: 7073 - DNA, 20 bp, Artificial Sequence
  Description of Artificial Sequence: Synthetic oligonucleotide
  Target: ATXN1; (+) strand; PAM type: NAAAAC; PAM sequence: GAAAAC
cagacagggaaagaatctga

SEQ ID NO: 7074 - DNA, 20 bp, Artificial Sequence
  Description of Artificial Sequence: Synthetic oligonucleotide
  Target: ATXN1; (+) strand; PAM type: NAAAAC; PAM sequence: AAAAAC
tagaaaaaaagaaagaaaaa

SEQ ID NO: 7075 - DNA, 20 bp, Artificial Sequence
  Description of Artificial Sequence: Synthetic oligonucleotide
  Target: ATXN1; (+) strand; PAM type: NAAAAC; PAM sequence: CAAAAC
acacacacacacacacacac

SEQ ID NO: 7076 - DNA, 20 bp, Artificial Sequence
  Description of Artificial Sequence: Synthetic oligonucleotide
  Target: ATXN1; (+) strand; PAM type: NAAAAC; PAM sequence: AAAAAC
gaaatggcaaagaagaaagt

SEQ ID NO: 7077 - DNA, 20 bp, Artificial Sequence
  Description of Artificial Sequence: Synthetic oligonucleotide
  Target: ATXN1; (+) strand; PAM type: NAAAAC; PAM sequence: GAAAAC
gttttggaatctacagatta

SEQ ID NO: 7078 - DNA, 20 bp, Artificial Sequence
  Description of Artificial Sequence: Synthetic oligonucleotide
  Target: ATXN1; (+) strand; PAM type: NAAAAC; PAM sequence: GAAAAC
ggttaatcatctgtaaacca

SEQ ID NO: 7079 - DNA, 20 bp, Artificial Sequence
  Description of Artificial Sequence: Synthetic oligonucleotide
  Target: ATXN1; (+) strand; PAM type: NAAAAC; PAM sequence: AAAAAC
aaattctgccagtgtagtgc

SEQ ID NO: 7080 - DNA, 20 bp, Artificial Sequence
  Description of Artificial Sequence: Synthetic oligonucleotide
  Target: ATXN1; (+) strand; PAM type: NAAAAC; PAM sequence: TAAAAC
tggatgtagctatgtgctaa

SEQ ID NO: 7081 - DNA, 20 bp, Artificial Sequence
  Description of Artificial Sequence: Synthetic oligonucleotide
  Target: ATXN1; (+) strand; PAM type: NAAAAC; PAM sequence: AAAAAC
aagatttaattaagtgatgt

SEQ ID NO: 7082 - DNA, 20 bp, Artificial Sequence
  Description of Artificial Sequence: Synthetic oligonucleotide
  Target: ATXN1; (+) strand; PAM type: NAAAAC; PAM sequence: GAAAAC
ctcttttgccctattaagca

SEQ ID NO: 7083 - DNA, 20 bp, Artificial Sequence
  Description of Artificial Sequence: Synthetic oligonucleotide
  Target: ATXN1; (+) strand; PAM type: NAAAAC; PAM sequence: GAAAAC
ggctcagtgtatagaagtta

SEQ ID NO: 7084 - DNA, 20 bp, Artificial Sequence
  Description of Artificial Sequence: Synthetic oligonucleotide
  Target: ATXN1; (+) strand; PAM type: NAAAAC; PAM sequence: GAAAAC
atgcccccaaaccaaggaag

SEQ ID NO: 7085 - DNA, 20 bp, Artificial Sequence
  Description of Artificial Sequence: Synthetic oligonucleotide
  Target: ATXN1; (+) strand; PAM type: NAAAAC; PAM sequence: CAAAAC
cccaaaccaaggaaggaaaa

SEQ ID NO: 7086 - DNA, 20 bp, Artificial Sequence
  Description of Artificial Sequence: Synthetic oligonucleotide
  Target: ATXN1; (+) strand; PAM type: NAAAAC; PAM sequence: TAAAAC
agtgaaggtatgtagcatga

SEQ ID NO: 7087 - DNA, 20 bp, Artificial Sequence
  Description of Artificial Sequence: Synthetic oligonucleotide
  Target: ATXN1; (+) strand; PAM type: NAAAAC; PAM sequence: GAAAAC
gtcctctgtcttcttatata

SEQ ID NO: 7088 - DNA, 20 bp, Artificial Sequence
  Description of Artificial Sequence: Synthetic oligonucleotide
  Target: ATXN1; (+) strand; PAM type: NAAAAC; PAM sequence: AAAAAC
gtcgcaagcagcatgctgtc

SEQ ID NO: 7089 - DNA, 20 bp, Artificial Sequence
  Description of Artificial Sequence: Synthetic oligonucleotide
  Target: ATXN1; (+) strand; PAM type: NAAAAC; PAM sequence: AAAAAC
ttgattggtgcattaaaatt

SEQ ID NO: 7090 - DNA, 20 bp, Artificial Sequence
  Description of Artificial Sequence: Synthetic oligonucleotide
  Target: ATXN1; (+) strand; PAM type: NAAAAC; PAM sequence: AAAAAC
agcatgtcatctacaactag

SEQ ID NO: 7091 - DNA, 20 bp, Artificial Sequence
  Description of Artificial Sequence: Synthetic oligonucleotide
  Target: ATXN1; (+) strand; PAM type: NAAAAC; PAM sequence: GAAAAC
cacagaggagaaggccatgt

SEQ ID NO: 7092 - DNA, 20 bp, Artificial Sequence
  Description of Artificial Sequence: Synthetic oligonucleotide
  Target: ATXN1; (+) strand; PAM type: NAAAAC; PAM sequence: GAAAAC
aatttattagagcagccctg

SEQ ID NO: 7093 - DNA, 20 bp, Artificial Sequence
  Description of Artificial Sequence: Synthetic oligonucleotide
  Target: ATXN1; (+) strand; PAM type: NAAAAC; PAM sequence: TAAAAC
tctctccaatgctcttctat

SEQ ID NO: 7094 - DNA, 20 bp, Artificial Sequence
  Description of Artificial Sequence: Synthetic oligonucleotide
  Target: ATXN1; (+) strand; PAM type: NAAAAC; PAM sequence: TAAAAC
gagcctgtagaaaagaatga

SEQ ID NO: 7095 - DNA, 20 bp, Artificial Sequence
  Description of Artificial Sequence: Synthetic oligonucleotide
  Target: ATXN1; (+) strand; PAM type: NAAAAC; PAM sequence: AAAAAC
aagctacaatcctctcccag

SEQ ID NO: 7096 - DNA, 20 bp, Artificial Sequence
  Description of Artificial Sequence: Synthetic oligonucleotide
  Target: ATXN1; (+) strand; PAM type: NAAAAC; PAM sequence: TAAAAC
ctgccccactgtttgttcaa

SEQ ID NO: 7097 - DNA, 20 bp, Artificial Sequence
  Description of Artificial Sequence: Synthetic oligonucleotide
  Target: ATXN1; (+) strand; PAM type: NAAAAC; PAM sequence: CAAAAC
gggctacatgtatatgagcg

SEQ ID NO: 7098 - DNA, 20 bp, Artificial Sequence
  Description of Artificial Sequence: Synthetic oligonucleotide
  Target: ATXN1; (+) strand; PAM type: NAAAAC; PAM sequence: CAAAAC
ctgagtctctattggcttta

SEQ ID NO: 7099 - DNA, 20 bp, Artificial Sequence
  Description of Artificial Sequence: Synthetic oligonucleotide
  Target: ATXN1; (+) strand; PAM type: NAAAAC; PAM sequence: AAAAAC
ctattaatatttcctgtaat

SEQ ID NO: 7100 - DNA, 20 bp, Artificial Sequence
  Description of Artificial Sequence: Synthetic oligonucleotide
  Target: ATXN1; (+) strand; PAM type: NAAAAC; PAM sequence: TAAAAC
atctgttatgtttaagaatt

SEQ ID NO: 7101 - DNA, 20 bp, Artificial Sequence
  Description of Artificial Sequence: Synthetic oligonucleotide
  Target: ATXN1; (+) strand; PAM type: NAAAAC; PAM sequence: AAAAAC
tattactataaatcaactat

SEQ ID NO: 7102 - DNA, 20 bp, Artificial Sequence
  Description of Artificial Sequence: Synthetic oligonucleotide
  Target: ATXN1; (+) strand; PAM type: NAAAAC; PAM sequence: CAAAAC
ctaaaaggaggaggaagaga

SEQ ID NO: 7103 - DNA, 20 bp, Artificial Sequence
  Description of Artificial Sequence: Synthetic oligonucleotide
  Target: ATXN1; (+) strand; PAM type: NAAAAC; PAM sequence: AAAAAC
ggcagtgtgtctaaatatgg

SEQ ID NO: 7104 - DNA, 20 bp, Artificial Sequence
  Description of Artificial Sequence: Synthetic oligonucleotide
  Target: ATXN1; (+) strand; PAM type: NAAAAC; PAM sequence: AAAAAC
agcaacccatgaacagggtg

SEQ ID NO: 7105 - DNA, 20 bp, Artificial Sequence
  Description of Artificial Sequence: Synthetic oligonucleotide
  Target: ATXN1; (+) strand; PAM type: NAAAAC; PAM sequence: TAAAAC
tttacaaccttgctctgctc

SEQ ID NO: 7106 - DNA, 20 bp, Artificial Sequence
  Description of Artificial Sequence: Synthetic oligonucleotide
  Target: ATXN1; (+) strand; PAM type: NAAAAC; PAM sequence: TAAAAC
gagaaggcaggtcagatgac

SEQ ID NO: 7107 - DNA, 20 bp, Artificial Sequence
  Description of Artificial Sequence: Synthetic oligonucleotide
  Target: ATXN1; (+) strand; PAM type: NAAAAC; PAM sequence: CAAAAC
ttgcgagttccttaaggagt

SEQ ID NO: 7108 - DNA, 20 bp, Artificial Sequence
  Description of Artificial Sequence: Synthetic oligonucleotide
  Target: ATXN1; (+) strand; PAM type: NAAAAC; PAM sequence: AAAAAC
gaatcagaaaccgaatttag

SEQ ID NO: 7109 - DNA, 20 bp, Artificial Sequence
  Description of Artificial Sequence: Synthetic oligonucleotide
  Target: ATXN1; (+) strand; PAM type: NAAAAC; PAM sequence: CAAAAC
gaccagcctggccaacatgg

SEQ ID NO: 7110 - DNA, 20 bp, Artificial Sequence
  Description of Artificial Sequence: Synthetic oligonucleotide
  Target: ATXN1; (+) strand; PAM type: NAAAAC; PAM sequence: TAAAAC
tcttagtgtcactgctaaac

SEQ ID NO: 7111 - DNA, 20 bp, Artificial Sequence
  Description of Artificial Sequence: Synthetic oligonucleotide
  Target: ATXN1; (+) strand; PAM type: NAAAAC; PAM sequence: AAAAAC
ccatctctactaaaaagaca

SEQ ID NO: 7112 - DNA, 20 bp, Artificial Sequence
  Description of Artificial Sequence: Synthetic oligonucleotide
  Target: ATXN1; (+) strand; PAM type: NAAAAC; PAM sequence: AAAAAC
agcgaaacttcatctcaaaa

SEQ ID NO: 7113 - DNA, 20 bp, Artificial Sequence
  Description of Artificial Sequence: Synthetic oligonucleotide
  Target: ATXN1; (+) strand; PAM type: NAAAAC; PAM sequence: TAAAAC
ttacaattttcaagtatcag

SEQ ID NO: 7114 - DNA, 20 bp, Artificial Sequence
  Description of Artificial Sequence: Synthetic oligonucleotide
  Target: ATXN1; (+) strand; PAM type: NAAAAC; PAM sequence: GAAAAC
aagacatctaatatgaataa

SEQ ID NO: 7115 - DNA, 20 bp, Artificial Sequence
  Description of Artificial Sequence: Synthetic oligonucleotide
  Target: ATXN1; (+) strand; PAM type: NAAAAC; PAM sequence: AAAAAC
caggaacttccaaagtgctt

SEQ ID NO: 7116 - DNA, 20 bp, Artificial Sequence
  Description of Artificial Sequence: Synthetic oligonucleotide
  Target: ATXN1; (+) strand; PAM type: NAAAAC; PAM sequence: GAAAAC
tttgggctgaagcagctggg

SEQ ID NO: 7117 - DNA, 20 bp, Artificial Sequence
  Description of Artificial Sequence: Synthetic oligonucleotide
  Target: ATXN1; (+) strand; PAM type: NAAAAC; PAM sequence: GAAAAC
aatgctacacaaataagtta

SEQ ID NO: 7118 - DNA, 20 bp, Artificial Sequence
  Description of Artificial Sequence: Synthetic oligonucleotide
  Target: ATXN1; (+) strand; PAM type: NAAAAC; PAM sequence: AAAAAC
ggcaactgagaatgggtttt

SEQ ID NO: 7119 - DNA, 20 bp, Artificial Sequence
  Description of Artificial Sequence: Synthetic oligonucleotide
  Target: ATXN1; (+) strand; PAM type: NAAAAC; PAM sequence: AAAAAC
cctttttccccaaatgaatg

SEQ ID NO: 7120 - DNA, 20 bp, Artificial Sequence
  Description of Artificial Sequence: Synthetic oligonucleotide
  Target: ATXN1; (+) strand; PAM type: NAAAAC; PAM sequence: TAAAAC
agctttctggagttaaaggg

SEQ ID NO: 7121 - DNA, 20 bp, Artificial Sequence
  Description of Artificial Sequence: Synthetic oligonucleotide
  Target: ATXN1; (+) strand; PAM type: NAAAAC; PAM sequence: TAAAAC
tggttattaacatatgcatg

SEQ ID NO: 7122 - DNA, 20 bp, Artificial Sequence
  Description of Artificial Sequence: Synthetic oligonucleotide
  Target: ATXN1; (+) strand; PAM type: NAAAAC; PAM sequence: AAAAAC
gcaagatgcattcaggggaa

SEQ ID NO: 7123 - DNA, 20 bp, Artificial Sequence
  Description of Artificial Sequence: Synthetic oligonucleotide
  Target: ATXN1; (+) strand; PAM type: NAAAAC; PAM sequence: AAAAAC
tttttttttttttttttaat

SEQ ID NO: 7124 - DNA, 20 bp, Artificial Sequence
  Description of Artificial Sequence: Synthetic oligonucleotide
  Target: ATXN1; (+) strand; PAM type: NAAAAC; PAM sequence: CAAAAC
cttgaaaaatattaagcaac

SEQ ID NO: 7125 - DNA, 20 bp, Artificial Sequence
  Description of Artificial Sequence: Synthetic oligonucleotide
  Target: ATXN1; (+) strand; PAM type: NAAAAC; PAM sequence: AAAAAC
acagaattgtatggcccttg

SEQ ID NO: 7126 - DNA, 20 bp, Artificial Sequence
  Description of Artificial Sequence: Synthetic oligonucleotide
  Target: ATXN1; (+) strand; PAM type: NAAAAC; PAM sequence: CAAAAC
ggatgagtgcaatttgcaac

SEQ ID NO: 7127 - DNA, 20 bp, Artificial Sequence
  Description of Artificial Sequence: Synthetic oligonucleotide
  Target: ATXN1; (+) strand; PAM type: NAAAAC; PAM sequence: CAAAAC
tccagcctgggcaacaagag

SEQ ID NO: 7128 - DNA, 20 bp, Artificial Sequence
  Description of Artificial Sequence: Synthetic oligonucleotide
  Target: ATXN1; (+) strand; PAM type: NAAAAC; PAM sequence: CAAAAC
atttcttgtggtcaggagtt

SEQ ID NO: 7129 - DNA, 20 bp, Artificial Sequence
  Description of Artificial Sequence: Synthetic oligonucleotide
  Target: ATXN1; (+) strand; PAM type: NAAAAC; PAM sequence: CAAAAC
ctcaggtgttctgtttgcta

SEQ ID NO: 7130 - DNA, 20 bp, Artificial Sequence
  Description of Artificial Sequence: Synthetic oligonucleotide
  Target: ATXN1; (+) strand; PAM type: NAAAAC; PAM sequence: GAAAAC
aaaagaagagaaaaaggaga

SEQ ID NO: 7131 - DNA, 20 bp, Artificial Sequence
  Description of Artificial Sequence: Synthetic oligonucleotide
  Target: ATXN1; (+) strand; PAM type: NAAAAC; PAM sequence: TAAAAC
gcctagtcttaaaaatattt

SEQ ID NO: 7132 - DNA, 20 bp, Artificial Sequence
  Description of Artificial Sequence: Synthetic oligonucleotide
  Target: ATXN1; (+) strand; PAM type: NAAAAC; PAM sequence: AAAAAC
tattttattttatatttagt

SEQ ID NO: 7133 - DNA, 20 bp, Artificial Sequence
  Description of Artificial Sequence: Synthetic oligonucleotide
  Target: ATXN1; (+) strand; PAM type: NAAAAC; PAM sequence: TAAAAC
attaacaatgatttattgaa

SEQ ID NO: 7134 - DNA, 20 bp, Artificial Sequence
  Description of Artificial Sequence: Synthetic oligonucleotide
  Target: ATXN1; (+) strand; PAM type: NAAAAC; PAM sequence: AAAAAC
ctccatctcaaaaaagaaaa

SEQ ID NO: 7135 - DNA, 20 bp, Artificial Sequence
  Description of Artificial Sequence: Synthetic oligonucleotide
  Target: ATXN1; (+) strand; PAM type: NAAAAC; PAM sequence: CAAAAC
atcatagctgtacaattagc

SEQ ID NO: 7136 - DNA, 20 bp, Artificial Sequence
  Description of Artificial Sequence: Synthetic oligonucleotide
  Target: ATXN1; (+) strand; PAM type: NAAAAC; PAM sequence: CAAAAC
ttgaaggattaaattcctgt

SEQ ID NO: 7137 - DNA, 20 bp, Artificial Sequence
  Description of Artificial Sequence: Synthetic oligonucleotide
  Target: ATXN1; (+) strand; PAM type: NAAAAC; PAM sequence: AAAAAC
tctgcagcacataacaaggc

SEQ ID NO: 7138 - DNA, 20 bp, Artificial Sequence
  Description of Artificial Sequence: Synthetic oligonucleotide
  Target: ATXN1; (+) strand; PAM type: NAAAAC; PAM sequence: CAAAAC
gtaaataaagaatgtatgca

SEQ ID NO: 7139 - DNA, 20 bp, Artificial Sequence
  Description of Artificial Sequence: Synthetic oligonucleotide
  Target: ATXN1; (+) strand; PAM type: NAAAAC; PAM sequence: CAAAAC
ttttaagtgctgtgcattta

SEQ ID NO: 7140 - DNA, 20 bp, Artificial Sequence
  Description of Artificial Sequence: Synthetic oligonucleotide
  Target: ATXN1; (+) strand; PAM type: NAAAAC; PAM sequence: GAAAAC
aaaaagtagtttctaagtaa

SEQ ID NO: 7141 - DNA, 20 bp, Artificial Sequence
  Description of Artificial Sequence: Synthetic oligonucleotide
  Target: ATXN1; (+) strand; PAM type: NAAAAC; PAM sequence: GAAAAC
attagttataaacacagaaa

SEQ ID NO: 7142 - DNA, 20 bp, Artificial Sequence
  Description of Artificial Sequence: Synthetic oligonucleotide
  Target: ATXN1; (+) strand; PAM type: NAAAAC; PAM sequence: TAAAAC
ttttgaaagcagaatagggc

SEQ ID NO: 7143 - DNA, 20 bp, Artificial Sequence
  Description of Artificial Sequence: Synthetic oligonucleotide
  Target: ATXN1; (+) strand; PAM type: NAAAAC; PAM sequence: GAAAAC
ttaagtccttaatgtacttg

SEQ ID NO: 7144 - DNA, 20 bp, Artificial Sequence
  Description of Artificial Sequence: Synthetic oligonucleotide
  Target: ATXN1; (+) strand; PAM type: NAAAAC; PAM sequence: AAAAAC
cagaatgatctgggaattta

SEQ ID NO: 7145 - DNA, 20 bp, Artificial Sequence
  Description of Artificial Sequence: Synthetic oligonucleotide
  Target: ATXN1; (+) strand; PAM type: NAAAAC; PAM sequence: CAAAAC
tgatctgggaatttaaaaaa

SEQ ID NO: 7146 - DNA, 20 bp, Artificial Sequence
  Description of Artificial Sequence: Synthetic oligonucleotide
  Target: ATXN1; (+) strand; PAM type: NAAAAC; PAM sequence: CAAAAC
tgggaatttaaaaaacaaaa

SEQ ID NO: 7147 - DNA, 20 bp, Artificial Sequence
  Description of Artificial Sequence: Synthetic oligonucleotide
  Target: ATXN1; (+) strand; PAM type: NAAAAC; PAM sequence: AAAAAC
ggagagtagaaatggagaat

SEQ ID NO: 7148 - DNA, 20 bp, Artificial Sequence
  Description of Artificial Sequence: Synthetic oligonucleotide
  Target: ATXN1; (+) strand; PAM type: NAAAAC; PAM sequence: AAAAAC
ggcaaaagactagaatttta

SEQ ID NO: 7149 - DNA, 20 bp, Artificial Sequence
  Description of Artificial Sequence: Synthetic oligonucleotide
  Target: ATXN1; (+) strand; PAM type: NAAAAC; PAM sequence: TAAAAC
ttgacccgtgtctttgtcca

SEQ ID NO: 7150 - DNA, 20 bp, Artificial Sequence
  Description of Artificial Sequence: Synthetic oligonucleotide
  Target: ATXN1; (+) strand; PAM type: NAAAAC; PAM sequence: CAAAAC
ccattttgaccctttcctga

SEQ ID NO: 7151 - DNA, 20 bp, Artificial Sequence
  Description of Artificial Sequence: Synthetic oligonucleotide
  Target: ATXN1; (+) strand; PAM type: NAAAAC; PAM sequence: AAAAAC
ttgttaaaaaaaaaaaaaaa

SEQ ID NO: 7152 - DNA, 20 bp, Artificial Sequence
  Description of Artificial Sequence: Synthetic oligonucleotide
  Target: ATXN1; (+) strand; PAM type: NAAAAC; PAM sequence: CAAAAC
acaatccacacattcctaca

SEQ ID NO: 7153 - DNA, 20 bp, Artificial Sequence
  Description of Artificial Sequence: Synthetic oligonucleotide
  Target: ATXN1; (+) strand; PAM type: NAAAAC; PAM sequence: TAAAAC
acgtcagactatgggacagc

SEQ ID NO: 7154 - DNA, 20 bp, Artificial Sequence
  Description of Artificial Sequence: Synthetic oligonucleotide
  Target: ATXN1; (+) strand; PAM type: NAAAAC; PAM sequence: AAAAAC
agtttaggctccggcactat

SEQ ID NO: 7155 - DNA, 20 bp, Artificial Sequence
  Description of Artificial Sequence: Synthetic oligonucleotide
  Target: ATXN1; (+) strand; PAM type: NAAAAC; PAM sequence: AAAAAC
ttggtcatttacacatatta

SEQ ID NO: 7156 - DNA, 20 bp, Artificial Sequence
  Description of Artificial Sequence: Synthetic oligonucleotide
  Target: ATXN1; (+) strand; PAM type: NAAAAC; PAM sequence: TAAAAC
acagaacaggaaagccaaaa

SEQ ID NO: 7157 - DNA, 20 bp, Artificial Sequence
  Description of Artificial Sequence: Synthetic oligonucleotide
  Target: ATXN1; (+) strand; PAM type: NAAAAC; PAM sequence: CAAAAC
aaaatccaaatcaaaccaaa

SEQ ID NO: 7158 - DNA, 20 bp, Artificial Sequence
  Description of Artificial Sequence: Synthetic oligonucleotide
  Target: ATXN1; (+) strand; PAM type: NAAAAC; PAM sequence: CAAAAC
tggaaaaggggaagaataat

SEQ ID NO: 7159 - DNA, 20 bp, Artificial Sequence
  Description of Artificial Sequence: Synthetic oligonucleotide
  Target: ATXN1; (+) strand; PAM type: NAAAAC; PAM sequence: GAAAAC
aaggagactgatcaaagtca

SEQ ID NO: 7160 - DNA, 20 bp, Artificial Sequence
  Description of Artificial Sequence: Synthetic oligonucleotide
  Target: ATXN1; (+) strand; PAM type: NAAAAC; PAM sequence: AAAAAC
gaagacagtcttagacgttc

SEQ ID NO: 7161 - DNA, 20 bp, Artificial Sequence
  Description of Artificial Sequence: Synthetic oligonucleotide
  Target: ATXN1; (+) strand; PAM type: NAAAAC; PAM sequence: TAAAAC
tggttataagtgcagtacta

SEQ ID NO: 7162 - DNA, 20 bp, Artificial Sequence
  Description of Artificial Sequence: Synthetic oligonucleotide
  Target: ATXN1; (+) strand; PAM type: NAAAAC; PAM sequence: AAAAAC
catgtctaaaggctggagca

SEQ ID NO: 7163 - DNA, 20 bp, Artificial Sequence
  Description of Artificial Sequence: Synthetic oligonucleotide
  Target: ATXN1; (+) strand; PAM type: NAAAAC; PAM sequence: CAAAAC
ggagagataaggaaggtcct

SEQ ID NO: 7164 - DNA, 20 bp, Artificial Sequence
  Description of Artificial Sequence: Synthetic oligonucleotide
  Target: ATXN1; (+) strand; PAM type: NAAAAC; PAM sequence: AAAAAC
aacccagggagggagttaag

SEQ ID NO: 7165 - DNA, 20 bp, Artificial Sequence
  Description of Artificial Sequence: Synthetic oligonucleotide
  Target: ATXN1; (+) strand; PAM type: NAAAAC; PAM sequence: AAAAAC
tcattttggcttcaaagagg

SEQ ID NO: 7166 - DNA, 20 bp, Artificial Sequence
  Description of Artificial Sequence: Synthetic oligonucleotide
  Target: ATXN1; (+) strand; PAM type: NAAAAC; PAM sequence: TAAAAC
gctcagcagagccactcagc

SEQ ID NO: 7167 - DNA, 20 bp, Artificial Sequence
  Description of Artificial Sequence: Synthetic oligonucleotide
  Target: ATXN1; (+) strand; PAM type: NAAAAC; PAM sequence: GAAAAC
tctctggttcctacatggat

SEQ ID NO: 7168 - DNA, 20 bp, Artificial Sequence
  Description of Artificial Sequence: Synthetic oligonucleotide
  Target: ATXN1; (+) strand; PAM type: NAAAAC; PAM sequence: AAAAAC
aaaagagaggctgatcatat

SEQ ID NO: 7169 - DNA, 20 bp, Artificial Sequence
  Description of Artificial Sequence: Synthetic oligonucleotide
  Target: ATXN1; (+) strand; PAM type: NAAAAC; PAM sequence: GAAAAC
gagctcatatacatagatta

SEQ ID NO: 7170 - DNA, 20 bp, Artificial Sequence
  Description of Artificial Sequence: Synthetic oligonucleotide
  Target: ATXN1; (+) strand; PAM type: NAAAAC; PAM sequence: GAAAAC
ctgagagggatcaaaggaat

SEQ ID NO: 7171 - DNA, 20 bp, Artificial Sequence
  Description of Artificial Sequence: Synthetic oligonucleotide
  Target: ATXN1; (+) strand; PAM type: NAAAAC; PAM sequence: TAAAAC
gatcaaaggaatgaaaactt

SEQ ID NO: 7172 - DNA, 20 bp, Artificial Sequence
  Description of Artificial Sequence: Synthetic oligonucleotide
  Target: ATXN1; (+) strand; PAM type: NAAAAC; PAM sequence: TAAAAC
aggaaacttaaaaattaaga

SEQ ID NO: 7173 - DNA, 20 bp, Artificial Sequence
  Description of Artificial Sequence: Synthetic oligonucleotide
  Target: ATXN1; (+) strand; PAM type: NAAAAC; PAM sequence: CAAAAC
tttatgctaaatgggaaaca

SEQ ID NO: 7174 - DNA, 20 bp, Artificial Sequence
  Description of Artificial Sequence: Synthetic oligonucleotide
  Target: ATXN1; (+) strand; PAM type: NAAAAC; PAM sequence: AAAAAC
agttacatcatcaagaacta

SEQ ID NO: 7175 - DNA, 20 bp, Artificial Sequence
  Description of Artificial Sequence: Synthetic oligonucleotide
  Target: ATXN1; (+) strand; PAM type: NAAAAC; PAM sequence: AAAAAC
ggtttgggcaatacatgttt

SEQ ID NO: 7176 - DNA, 20 bp, Artificial Sequence
  Description of Artificial Sequence: Synthetic oligonucleotide
  Target: ATXN1; (+) strand; PAM type: NAAAAC; PAM sequence: GAAAAC
gtagagcagagctacctgcg

SEQ ID NO: 7177 - DNA, 20 bp, Artificial Sequence
  Description of Artificial Sequence: Synthetic oligonucleotide
  Target: ATXN1; (+) strand; PAM type: NAAAAC; PAM sequence: GAAAAC
cttcccaagagctacctgca

SEQ ID NO: 7178 - DNA, 20 bp, Artificial Sequence
  Description of Artificial Sequence: Synthetic oligonucleotide
  Target: ATXN1; (+) strand; PAM type: NAAAAC; PAM sequence: TAAAAC
gagattcaaactctgcctac

SEQ ID NO: 7179 - DNA, 20 bp, Artificial Sequence
  Description of Artificial Sequence: Synthetic oligonucleotide
  Target: ATXN1; (+) strand; PAM type: NAAAAC; PAM sequence: TAAAAC
tgtctatgaaacaaataaat

SEQ ID NO: 7180 - DNA, 20 bp, Artificial Sequence
  Description of Artificial Sequence: Synthetic oligonucleotide
  Target: ATXN1; (+) strand; PAM type: NAAAAC; PAM sequence: TAAAAC
aaaaggaattacctagagac

SEQ ID NO: 7181 - DNA, 20 bp, Artificial Sequence
  Description of Artificial Sequence: Synthetic oligonucleotide
  Target: ATXN1; (+) strand; PAM type: NAAAAC; PAM sequence: TAAAAC
ctaaaacctgcacctgcagg

SEQ ID NO: 7182 - DNA, 20 bp, Artificial Sequence
  Description of Artificial Sequence: Synthetic oligonucleotide
  Target: ATXN1; (+) strand; PAM type: NAAAAC; PAM sequence: CAAAAC
caggtaaaaccaaatgacat

SEQ ID NO: 7183 - DNA, 20 bp, Artificial Sequence
  Description of Artificial Sequence: Synthetic oligonucleotide
  Target: ATXN1; (+) strand; PAM type: NAAAAC; PAM sequence: GAAAAC
tccttgtgttttggagacag

SEQ ID NO: 7184 - DNA, 20 bp, Artificial Sequence
  Description of Artificial Sequence: Synthetic oligonucleotide
  Target: ATXN1; (+) strand; PAM type: NAAAAC; PAM sequence: GAAAAC
cctggttttgatttcttttg

SEQ ID NO: 7185 - DNA, 20 bp, Artificial Sequence
  Description of Artificial Sequence: Synthetic oligonucleotide
  Target: ATXN1; (+) strand; PAM type: NAAAAC; PAM sequence: AAAAAC
gtaaagctaaacagaactcg

SEQ ID NO: 7186 - DNA, 20 bp, Artificial Sequence
  Description of Artificial Sequence: Synthetic oligonucleotide
  Target: ATXN1; (+) strand; PAM type: NAAAAC; PAM sequence: AAAAAC
ccttgaagaccaaaaaaaaa

SEQ ID NO: 7187 - DNA, 20 bp, Artificial Sequence
  Description of Artificial Sequence: Synthetic oligonucleotide
  Target: ATXN1; (+) strand; PAM type: NAAAAC; PAM sequence: GAAAAC
gtaagagtgaaagaaaggga

SEQ ID NO: 7188 - DNA, 20 bp, Artificial Sequence
  Description of Artificial Sequence: Synthetic oligonucleotide
  Target: ATXN1; (+) strand; PAM type: NAAAAC; PAM sequence: AAAAAC
actaactcagcaccaaaaaa

SEQ ID NO: 7189 - DNA, 20 bp, Artificial Sequence
  Description of Artificial Sequence: Synthetic oligonucleotide
  Target: ATXN1; (+) strand; PAM type: NAAAAC; PAM sequence: AAAAAC
tacagtatacacgcacgcac

SEQ ID NO: 7190 - DNA, 20 bp, Artificial Sequence
  Description of Artificial Sequence: Synthetic oligonucleotide
  Target: ATXN1; (+) strand; PAM type: NAAAAC; PAM sequence: CAAAAC
cagggaatcctctaaagtta

SEQ ID NO: 7191 - DNA, 20 bp, Artificial Sequence
  Description of Artificial Sequence: Synthetic oligonucleotide
  Target: ATXN1; (+) strand; PAM type: NAAAAC; PAM sequence: TAAAAC
agaaatgctggaattgttgt

SEQ ID NO: 7192 - DNA, 20 bp, Artificial Sequence
  Description of Artificial Sequence: Synthetic oligonucleotide
  Target: ATXN1; (+) strand; PAM type: NAAAAC; PAM sequence: TAAAAC
ggcttcactgaaaatcttaa

SEQ ID NO: 7193 - DNA, 20 bp, Artificial Sequence
  Description of Artificial Sequence: Synthetic oligonucleotide
  Target: ATXN1; (+) strand; PAM type: NAAAAC; PAM sequence: AAAAAC
ctataatgtaggtttaagaa

SEQ ID NO: 7194 - DNA, 20 bp, Artificial Sequence
  Description of Artificial Sequence: Synthetic oligonucleotide
  Target: ATXN1; (+) strand; PAM type: NAAAAC; PAM sequence: AAAAAC
aaacttgcctaacatattat

SEQ ID NO: 7195 - DNA, 20 bp, Artificial Sequence
  Description of Artificial Sequence: Synthetic oligonucleotide
  Target: ATXN1; (+) strand; PAM type: NAAAAC; PAM sequence: AAAAAC
ttacaacaatctaaaaaaaa

SEQ ID NO: 7196 - DNA, 20 bp, Artificial Sequence
  Description of Artificial Sequence: Synthetic oligonucleotide
  Target: ATXN1; (+) strand; PAM type: NAAAAC; PAM sequence: AAAAAC
ttcagaatttaaaattcagc

SEQ ID NO: 7197 - DNA, 20 bp, Artificial Sequence
  Description of Artificial Sequence: Synthetic oligonucleotide
  Target: ATXN1; (+) strand; PAM type: NAAAAC; PAM sequence: TAAAAC
tggttcaggagcaaccatca

SEQ ID NO: 7198 - DNA, 20 bp, Artificial Sequence
  Description of Artificial Sequence: Synthetic oligonucleotide
  Target: ATXN1; (+) strand; PAM type: NAAAAC; PAM sequence: AAAAAC
tgcatgactctccaggccag

SEQ ID NO: 7199 - DNA, 20 bp, Artificial Sequence
  Description of Artificial Sequence: Synthetic oligonucleotide
  Target: ATXN1; (+) strand; PAM type: NAAAAC; PAM sequence: AAAAAC
acaacagtaatctaaaatgc

SEQ ID NO: 7200 - DNA, 20 bp, Artificial Sequence
  Description of Artificial Sequence: Synthetic oligonucleotide
  Target: ATXN1; (+) strand; PAM type: NAAAAC; PAM sequence: GAAAAC
gcattcttaattgtattaag

SEQ ID NO: 7201 - DNA, 20 bp, Artificial Sequence
  Description of Artificial Sequence: Synthetic oligonucleotide
  Target: ATXN1; (+) strand; PAM type: NAAAAC; PAM sequence: AAAAAC
atactttaatcgaagtttta

SEQ ID NO: 7202 - DNA, 20 bp, Artificial Sequence
  Description of Artificial Sequence: Synthetic oligonucleotide
  Target: ATXN1; (+) strand; PAM type: NAAAAC; PAM sequence: GAAAAC
caggactttatcctcagatg

SEQ ID NO: 7203 - DNA, 20 bp, Artificial Sequence
  Description of Artificial Sequence: Synthetic oligonucleotide
  Target: ATXN1; (+) strand; PAM type: NAAAAC; PAM sequence: CAAAAC
atggaaaacagagagcatcg

SEQ ID NO: 7204 - DNA, 20 bp, Artificial Sequence
  Description of Artificial Sequence: Synthetic oligonucleotide
  Target: ATXN1; (+) strand; PAM type: NAAAAC; PAM sequence: AAAAAC
aggagaggaaatccaaaatg

SEQ ID NO: 7205 - DNA, 20 bp, Artificial Sequence
  Description of Artificial Sequence: Synthetic oligonucleotide
  Target: ATXN1; (+) strand; PAM type: NAAAAC; PAM sequence: TAAAAC
ttgtagtagtttttgtgagg

SEQ ID NO: 7206 - DNA, 20 bp, Artificial Sequence
  Description of Artificial Sequence: Synthetic oligonucleotide
  Target: ATXN1; (+) strand; PAM type: NAAAAC; PAM sequence: AAAAAC
aggcagcacgtattcactgc

SEQ ID NO: 7207 - DNA, 20 bp, Artificial Sequence
  Description of Artificial Sequence: Synthetic oligonucleotide
  Target: ATXN1; (+) strand; PAM type: NAAAAC; PAM sequence: TAAAAC
aatggaatactcaatatttt

SEQ ID NO: 7208 - DNA, 20 bp, Artificial Sequence
  Description of Artificial Sequence: Synthetic oligonucleotide
  Target: ATXN1; (+) strand; PAM type: NAAAAC; PAM sequence: CAAAAC
aacaagaaagacggcctaaa

SEQ ID NO: 7209 - DNA, 20 bp, Artificial Sequence
  Description of Artificial Sequence: Synthetic oligonucleotide
  Target: ATXN1; (+) strand; PAM type: NAAAAC; PAM sequence: AAAAAC
tagctacaataactgtcacg

SEQ ID NO: 7210 - DNA, 20 bp, Artificial Sequence
  Description of Artificial Sequence: Synthetic oligonucleotide
  Target: ATXN1; (+) strand; PAM type: NAAAAC; PAM sequence: CAAAAC
cttctgctacctaactcatt

SEQ ID NO: 7211 - DNA, 20 bp, Artificial Sequence
  Description of Artificial Sequence: Synthetic oligonucleotide
  Target: ATXN1; (+) strand; PAM type: NAAAAC; PAM sequence: CAAAAC
gagttcctcttagcccaaat

SEQ ID NO: 7212 - DNA, 20 bp, Artificial Sequence
  Description of Artificial Sequence: Synthetic oligonucleotide
  Target: ATXN1; (+) strand; PAM type: NAAAAC; PAM sequence: AAAAAC
aattataaaagaataaaata

SEQ ID NO: 7213 - DNA, 20 bp, Artificial Sequence
  Description of Artificial Sequence: Synthetic oligonucleotide
  Target: ATXN1; (+) strand; PAM type: NAAAAC; PAM sequence: TAAAAC
aactttccataagatttgtc

SEQ ID NO: 7214 - DNA, 20 bp, Artificial Sequence
  Description of Artificial Sequence: Synthetic oligonucleotide
  Target: ATXN1; (+) strand; PAM type: NAAAAC; PAM sequence: TAAAAC
ccaacatttaaaaaattctg

SEQ ID NO: 7215 - DNA, 20 bp, Artificial Sequence
  Description of Artificial Sequence: Synthetic oligonucleotide
  Target: ATXN1; (+) strand; PAM type: NAAAAC; PAM sequence: TAAAAC
aagttctatatgtaaggtcc

SEQ ID NO: 7216 - DNA, 20 bp, Artificial Sequence
  Description of Artificial Sequence: Synthetic oligonucleotide
  Target: ATXN1; (+) strand; PAM type: NAAAAC; PAM sequence: AAAAAC
ccacttgacatttcagaatg

SEQ ID NO: 7217 - DNA, 20 bp, Artificial Sequence
  Description of Artificial Sequence: Synthetic oligonucleotide
  Target: ATXN1; (+) strand; PAM type: NAAAAC; PAM sequence: AAAAAC
ttggactccataatgacaac

SEQ ID NO: 7218 - DNA, 20 bp, Artificial Sequence
  Description of Artificial Sequence: Synthetic oligonucleotide
  Target: ATXN1; (+) strand; PAM type: NAAAAC; PAM sequence: TAAAAC
ttctgtttaccaaaccctct

SEQ ID NO: 7219 - DNA, 20 bp, Artificial Sequence
  Description of Artificial Sequence: Synthetic oligonucleotide
  Target: ATXN1; (+) strand; PAM type: NAAAAC; PAM sequence: CAAAAC
ttaccaaccacataaactca

SEQ ID NO: 7220 - DNA, 20 bp, Artificial Sequence
  Description of Artificial Sequence: Synthetic oligonucleotide
  Target: ATXN1; (+) strand; PAM type: NAAAAC; PAM sequence: AAAAAC
acataaactcacaaaacggt

SEQ ID NO: 7221 - DNA, 20 bp, Artificial Sequence
  Description of Artificial Sequence: Synthetic oligonucleotide
  Target: ATXN1; (+) strand; PAM type: NAAAAC; PAM sequence: TAAAAC
ggcagcataaatgctgtgca

SEQ ID NO: 7222 - DNA, 20 bp, Artificial Sequence
  Description of Artificial Sequence: Synthetic oligonucleotide
  Target: ATXN1; (+) strand; PAM type: NAAAAC; PAM sequence: GAAAAC
aggactggagtaagtgcacc

SEQ ID NO: 7223 - DNA, 20 bp, Artificial Sequence
  Description of Artificial Sequence: Synthetic oligonucleotide
  Target: ATXN1; (+) strand; PAM type: NAAAAC; PAM sequence: AAAAAC
ctaggaactgcagcctccta

SEQ ID NO: 7224 - DNA, 20 bp, Artificial Sequence
  Description of Artificial Sequence: Synthetic oligonucleotide
  Target: ATXN1; (+) strand; PAM type: NAAAAC; PAM sequence: AAAAAC
aacaatgatgtttaaatatt

SEQ ID NO: 7225 - DNA, 20 bp, Artificial Sequence
  Description of Artificial Sequence: Synthetic oligonucleotide
  Target: ATXN1; (+) strand; PAM type: NAAAAC; PAM sequence: TAAAAC
attaaaaacagcctgcatta

SEQ ID NO: 7226 - DNA, 20 bp, Artificial Sequence
  Description of Artificial Sequence: Synthetic oligonucleotide
  Target: ATXN1; (+) strand; PAM type: NAAAAC; PAM sequence: CAAAAC
aggattatataccaagaaag

SEQ ID NO: 7227 - DNA, 20 bp, Artificial Sequence
  Description of Artificial Sequence: Synthetic oligonucleotide
  Target: ATXN1; (+) strand; PAM type: NAAAAC; PAM sequence: CAAAAC
tatataccaagaaagcaaaa

SEQ ID NO: 7228 - DNA, 20 bp, Artificial Sequence
  Description of Artificial Sequence: Synthetic oligonucleotide
  Target: ATXN1; (+) strand; PAM type: NAAAAC; PAM sequence: GAAAAC
gttcttgctcaatctcccta

SEQ ID NO: 7229 - DNA, 20 bp, Artificial Sequence
  Description of Artificial Sequence: Synthetic oligonucleotide
  Target: ATXN1; (+) strand; PAM type: NAAAAC; PAM sequence: AAAAAC
cagtttcagacagctttcat

SEQ ID NO: 7230 - DNA, 20 bp, Artificial Sequence
  Description of Artificial Sequence: Synthetic oligonucleotide
  Target: ATXN1; (+) strand; PAM type: NAAAAC; PAM sequence: TAAAAC
tgattttaacaaccttaaat

SEQ ID NO: 7231 - DNA, 20 bp, Artificial Sequence
  Description of Artificial Sequence: Synthetic oligonucleotide
  Target: ATXN1; (+) strand; PAM type: NAAAAC; PAM sequence: AAAAAC
atgtatattacccaaatggt

SEQ ID NO: 7232 - DNA, 20 bp, Artificial Sequence
  Description of Artificial Sequence: Synthetic oligonucleotide
  Target: ATXN1; (+) strand; PAM type: NAAAAC; PAM sequence: AAAAAC
caagactttctcgtgcaaat

SEQ ID NO: 7233 - DNA, 20 bp, Artificial Sequence
  Description of Artificial Sequence: Synthetic oligonucleotide
  Target: ATXN1; (+) strand; PAM type: NAAAAC; PAM sequence: TAAAAC
gggagcacaagagtgcttaa

SEQ ID NO: 7234 - DNA, 20 bp, Artificial Sequence
  Description of Artificial Sequence: Synthetic oligonucleotide
  Target: ATXN1; (+) strand; PAM type: NAAAAC; PAM sequence: AAAAAC
aagatgccttagctttgctc

SEQ ID NO: 7235 - DNA, 20 bp, Artificial Sequence
  Description of Artificial Sequence: Synthetic oligonucleotide
  Target: ATXN1; (+) strand; PAM type: NAAAAC; PAM sequence: AAAAAC
aagatgccttagctttactc

SEQ ID NO: 7236 - DNA, 20 bp, Artificial Sequence
  Description of Artificial Sequence: Synthetic oligonucleotide
  Target: ATXN1; (+) strand; PAM type: NAAAAC; PAM sequence: AAAAAC
atagtagctcctgtttatct

SEQ ID NO: 7237 - DNA, 20 bp, Artificial Sequence
  Description of Artificial Sequence: Synthetic oligonucleotide
  Target: ATXN1; (+) strand; PAM type: NAAAAC; PAM sequence: AAAAAC
ctcttccatattgcatcctc

SEQ ID NO: 7238 - DNA, 20 bp, Artificial Sequence
  Description of Artificial Sequence: Synthetic oligonucleotide
  Target: ATXN1; (+) strand; PAM type: NAAAAC; PAM sequence: GAAAAC
cagaacagatcttacctttg

SEQ ID NO: 7239 - DNA, 20 bp, Artificial Sequence
  Description of Artificial Sequence: Synthetic oligonucleotide
  Target: ATXN1; (+) strand; PAM type: NAAAAC; PAM sequence: CAAAAC
agcaaaccatagtgtgcttg

SEQ ID NO: 7240 - DNA, 20 bp, Artificial Sequence
  Description of Artificial Sequence: Synthetic oligonucleotide
  Target: ATXN1; (+) strand; PAM type: NAAAAC; PAM sequence: TAAAAC
ggctggggagaccacaaaag

SEQ ID NO: 7241 - DNA, 20 bp, Artificial Sequence
  Description of Artificial Sequence: Synthetic oligonucleotide
  Target: ATXN1; (+) strand; PAM type: NAAAAC; PAM sequence: AAAAAC
gtaaaacaaactcaaaagtg

SEQ ID NO: 7242 - DNA, 20 bp, Artificial Sequence
  Description of Artificial Sequence: Synthetic oligonucleotide
  Target: ATXN1; (-) strand; PAM type: NNAGAAW; PAM sequence: TTAGAAA
tcacattttcagaggagtat

SEQ ID NO: 7243 - DNA, 20 bp, Artificial Sequence
  Description of Artificial Sequence: Synthetic oligonucleotide
  Target: ATXN1; (-) strand; PAM type: NNAGAAW; PAM sequence: TCAGAAA
cccgcctgtctggtctaaga

SEQ ID NO: 7244 - DNA, 20 bp, Artificial Sequence
  Description of Artificial Sequence: Synthetic oligonucleotide
  Target: ATXN1; (-) strand; PAM type: NNAGAAW; PAM sequence: CCAGAAT
accaggagcccaaaatgccc

SEQ ID NO: 7245 - DNA, 20 bp, Artificial Sequence
  Description of Artificial Sequence: Synthetic oligonucleotide
  Target: ATXN1; (-) strand; PAM type: NNAGAAW; PAM sequence: ACAGAAA
cgtgctcccctctgctgcta

SEQ ID NO: 7246 - DNA, 20 bp, Artificial Sequence
  Description of Artificial Sequence: Synthetic oligonucleotide
  Target: ATXN1; (-) strand; PAM type: NNAGAAW; PAM sequence: TCAGAAA
ttctgtagcccccaaggcac

SEQ ID NO: 7247 - DNA, 20 bp, Artificial Sequence
  Description of Artificial Sequence: Synthetic oligonucleotide
  Target: ATXN1; (-) strand; PAM type: NNAGAAW; PAM sequence: TTAGAAT
gccccaccttaagagcccaa

SEQ ID NO: 7248 - DNA, 20 bp, Artificial Sequence
  Description of Artificial Sequence: Synthetic oligonucleotide
  Target: ATXN1; (-) strand; PAM type: NNAGAAW; PAM sequence: CGAGAAT
gcacgtggacctcagtcccc

SEQ ID NO: 7249 - DNA, 20 bp, Artificial Sequence
  Description of Artificial Sequence: Synthetic oligonucleotide
  Target: ATXN1; (-) strand; PAM type: NNAGAAW; PAM sequence: AGAGAAA
agggagagagaaagagaaaa

SEQ ID NO: 7250 - DNA, 20 bp, Artificial Sequence
  Description of Artificial Sequence: Synthetic oligonucleotide
  Target: ATXN1; (-) strand; PAM type: NNAGAAW; PAM sequence: AGAGAAA
acaaagaaagggagagagaa

SEQ ID NO: 7251 - DNA, 20 bp, Artificial Sequence
  Description of Artificial Sequence: Synthetic oligonucleotide
  Target: ATXN1; (-) strand; PAM type: NNAGAAW; PAM sequence: AGAGAAA
agaaaaacaaagaaagggag

SEQ ID NO: 7252 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
tttaaaaaagaaagaaaaac

SEQ ID NO: 7253 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
accatcttcttttaaaaaag

SEQ ID NO: 7254 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
tgaaaccatcttcttttaaa

SEQ ID NO: 7255 - DNA, 20 bp, Artificial Sequence
  Description of Artificial Sequence: Synthetic oligonucleotide
  Target: ATXN1; (-) strand; PAM type: NNAGAAW; PAM sequence: CGAGAAA
gtagtgccatgtggtccttc

SEQ ID NO: 7256 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
gggtcattgcttgcctttcc

SEQ ID NO: 7257 - DNA, 20 bp, Artificial Sequence
  Description of Artificial Sequence: Synthetic oligonucleotide
  Target: ATXN1; (-) strand; PAM type: NNAGAAW; PAM sequence: CGAGAAT
ctactctgaaggctgaggca

SEQ ID NO: 7258 - DNA, 20 bp, Artificial Sequence
  Description of Artificial Sequence: Synthetic oligonucleotide
  Target: ATXN1; (-) strand; PAM type: NNAGAAW; PAM sequence: CCAGAAA
gatatggcttagcagttgtg

SEQ ID NO: 7259 - DNA, 20 bp, Artificial Sequence
  Description of Artificial Sequence: Synthetic oligonucleotide
  Target: ATXN1; (-) strand; PAM type: NNAGAAW; PAM sequence: TTAGAAA
cttcctgtaattcaagctca

SEQ ID NO: 7260 - DNA, 20 bp, Artificial Sequence
  Description of Artificial Sequence: Synthetic oligonucleotide
  Target: ATXN1; (-) strand; PAM type: NNAGAAW; PAM sequence: GTAGAAA
ggtgcttgcaggttttctag

SEQ ID NO: 7261 - DNA, 20 bp, Artificial Sequence
  Description of Artificial Sequence: Synthetic oligonucleotide
  Target: ATXN1; (-) strand; PAM type: NNAGAAW; PAM sequence: GAAGAAT
taaacaaatattaaaaaatg

SEQ ID NO: 7262 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
gatgttttgcaccttattga

SEQ ID NO: 7263 - DNA, 20 bp, Artificial Sequence
  Description of Artificial Sequence: Synthetic oligonucleotide
  Target: ATXN1; (-) strand; PAM type: NNAGAAW; PAM sequence: CCAGAAT
ccaagataacatactgtcct

SEQ ID NO: 7264 - DNA, 20 bp, Artificial Sequence
  Description of Artificial Sequence: Synthetic oligonucleotide
  Target: ATXN1; (-) strand; PAM type: NNAGAAW; PAM sequence: TAAGAAT
tatacaataacaacaatctc

SEQ ID NO: 7265 - DNA, 20 bp, Artificial Sequence
  Description of Artificial Sequence: Synthetic oligonucleotide
  Target: ATXN1; (-) strand; PAM type: NNAGAAW; PAM sequence: TCAGAAT
cccacttacaattcttaaat

SEQ ID NO: 7266 - DNA, 20 bp, Artificial Sequence
  Description of Artificial Sequence: Synthetic oligonucleotide
  Target: ATXN1; (-) strand; PAM type: NNAGAAW; PAM sequence: TCAGAAT
aataaatacggagcatcttc

SEQ ID NO: 7267 - DNA, 20 bp, Artificial Sequence
  Description of Artificial Sequence: Synthetic oligonucleotide
  Target: ATXN1; (-) strand; PAM type: NNAGAAW; PAM sequence: CCAGAAT
ttttatttaatataaagagg

SEQ ID NO: 7268 - DNA, 20 bp, Artificial Sequence
  Description of Artificial Sequence: Synthetic oligonucleotide
  Target: ATXN1; (-) strand; PAM type: NNAGAAW; PAM sequence: AAAGAAT
cttcctgttcctataaaccc

SEQ ID NO: 7269 - DNA, 20 bp, Artificial Sequence
  Description of Artificial Sequence: Synthetic oligonucleotide
  Target: ATXN1; (-) strand; PAM type: NNAGAAW; PAM sequence: TGAGAAT
gaactcggtattctgcgatt

SEQ ID NO: 7270 - DNA, 20 bp, Artificial Sequence
  Description of Artificial Sequence: Synthetic oligonucleotide
  Target: ATXN1; (-) strand; PAM type: NNAGAAW; PAM sequence: GAAGAAT
atttgtatggttatggcctg

SEQ ID NO: 7271 - DNA, 20 bp, Artificial Sequence
  Description of Artificial Sequence: Synthetic oligonucleotide
  Target: ATXN1; (-) strand; PAM type: NNAGAAW; PAM sequence: ATAGAAA
agttacatgtttttttgtat

SEQ ID NO: 7272 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
atgttttaaaaaattgcaca

SEQ ID NO: 7273 - DNA, 20 bp, Artificial Sequence
  Description of Artificial Sequence: Synthetic oligonucleotide
  Target: ATXN1; (-) strand; PAM type: NNAGAAW; PAM sequence: GAAGAAA
tacacctgatttgagaagct

SEQ ID NO: 7274 - DNA, 20 bp, Artificial Sequence
  Description of Artificial Sequence: Synthetic oligonucleotide
  Target: ATXN1; (-) strand; PAM type: NNAGAAW; PAM sequence: AGAGAAT
acatcaagtaataaatatac

SEQ ID NO: 7275 - DNA, 20 bp, Artificial Sequence
  Description of Artificial Sequence: Synthetic oligonucleotide
  Target: ATXN1; (-) strand; PAM type: NNAGAAW; PAM sequence: AGAGAAT
taacccagaatttctgaaat

SEQ ID NO: 7276 - DNA, 20 bp, Artificial Sequence
  Description of Artificial Sequence: Synthetic oligonucleotide
  Target: ATXN1; (-) strand; PAM type: NNAGAAW; PAM sequence: CCAGAAT
cttccacatttgtttttaac

SEQ ID NO: 7277 - DNA, 20 bp, Artificial Sequence
  Description of Artificial Sequence: Synthetic oligonucleotide
  Target: ATXN1; (-) strand; PAM type: NNAGAAW; PAM sequence: AGAGAAT
ttcggtggtgatgtgaaagg

SEQ ID NO: 7278 - DNA, 20 bp, Artificial Sequence
  Description of Artificial Sequence: Synthetic oligonucleotide
  Target: ATXN1; (-) strand; PAM type: NNAGAAW; PAM sequence: AGAGAAA
gaaacctatttctttcatag

SEQ ID NO: 7279 - DNA, 20 bp, Artificial Sequence
  Description of Artificial Sequence: Synthetic oligonucleotide
  Target: ATXN1; (-) strand; PAM type: NNAGAAW; PAM sequence: TAAGAAT
gttccttagaatgtttaact

SEQ ID NO: 7280 - DNA, 20 bp, Artificial Sequence
  Description of Artificial Sequence: Synthetic oligonucleotide
  Target: ATXN1; (-) strand; PAM type: NNAGAAW; PAM sequence: TTAGAAT
atatataaaatgactgttcc

SEQ ID NO: 7281 - DNA, 20 bp, Artificial Sequence
  Description of Artificial Sequence: Synthetic oligonucleotide
  Target: ATXN1; (-) strand; PAM type: NNAGAAW; PAM sequence: TAAGAAA
gaaaaaaataatactattaa

SEQ ID NO: 7282 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
caagaaattagtcagggcga

SEQ ID NO: 7283 - DNA, 20 bp, Artificial Sequence
  Description of Artificial Sequence: Synthetic oligonucleotide
  Target: ATXN1; (-) strand; PAM type: NNAGAAW; PAM sequence: CAAGAAA
ttacaatggaacacaatcac

SEQ ID NO: 7284 - DNA, 20 bp, Artificial Sequence
  Description of Artificial Sequence: Synthetic oligonucleotide
  Target: ATXN1; (-) strand; PAM type: NNAGAAW; PAM sequence: GTAGAAA
aaacattaacgatgacaggg

SEQ ID NO: 7285 - DNA, 20 bp, Artificial Sequence
  Description of Artificial Sequence: Synthetic oligonucleotide
  Target: ATXN1; (-) strand; PAM type: NNAGAAW; PAM sequence: GCAGAAA
cgtgcgtctgccgccacgtt

SEQ ID NO: 7286 - DNA, 20 bp, Artificial Sequence
  Description of Artificial Sequence: Synthetic oligonucleotide
  Target: ATXN1; (-) strand; PAM type: NNAGAAW; PAM sequence: TCAGAAA
tatttacaactcatgtggac

SEQ ID NO: 7287 - DNA, 20 bp, Artificial Sequence
  Description of Artificial Sequence: Synthetic oligonucleotide
  Target: ATXN1; (-) strand; PAM type: NNAGAAW; PAM sequence: CTAGAAT
tttgaataggtttagaatag

SEQ ID NO: 7288 - DNA, 20 bp, Artificial Sequence
  Description of Artificial Sequence: Synthetic oligonucleotide
  Target: ATXN1; (-) strand; PAM type: NNAGAAW; PAM sequence: TTAGAAT
ccaaaaacatttgaataggt

SEQ ID NO: 7289 - DNA, 20 bp, Artificial Sequence
  Description of Artificial Sequence: Synthetic oligonucleotide
  Target: ATXN1; (-) strand; PAM type: NNAGAAW; PAM sequence: GGAGAAA
aaaaaaagttttataagtag

SEQ ID NO: 7290 - DNA, 20 bp, Artificial Sequence
  Description of Artificial Sequence: Synthetic oligonucleotide
  Target: ATXN1; (-) strand; PAM type: NNAGAAW; PAM sequence: CCAGAAA
atttaatgtttggtacaaac

SEQ ID NO: 7291 - DNA, 20 bp, Artificial Sequence
  Description of Artificial Sequence: Synthetic oligonucleotide
  Target: ATXN1; (-) strand; PAM type: NNAGAAW; PAM sequence: TCAGAAT
tgttgttattaatgttattt

SEQ ID NO: 7292 - DNA, 20 bp, Artificial Sequence
  Description of Artificial Sequence: Synthetic oligonucleotide
  Target: ATXN1; (-) strand; PAM type: NNAGAAW; PAM sequence: TGAGAAT
tagcgggctcttagaaactc

SEQ ID NO: 7293 - DNA, 20 bp, Artificial Sequence
  Description of Artificial Sequence: Synthetic oligonucleotide
  Target: ATXN1; (-) strand; PAM type: NNAGAAW; PAM sequence: TTAGAAA
agccaggtcttagcgggctc

SEQ ID NO: 7294 - DNA, 20 bp, Artificial Sequence
  Description of Artificial Sequence: Synthetic oligonucleotide
  Target: ATXN1; (-) strand; PAM type: NNAGAAW; PAM sequence: AGAGAAT
tgagagaaaagggatggaga

SEQ ID NO: 7295 - DNA, 20 bp, Artificial Sequence
  Description of Artificial Sequence: Synthetic oligonucleotide
  Target: ATXN1; (-) strand; PAM type: NNAGAAW; PAM sequence: AGAGAAA
cagagttggcagagaaactg

SEQ ID NO: 7296 - DNA, 20 bp, Artificial Sequence
  Description of Artificial Sequence: Synthetic oligonucleotide
  Target: ATXN1; (-) strand; PAM type: NNAGAAW; PAM sequence: AGAGAAA
aaggcatatgcagagttggc

SEQ ID NO: 7297 - DNA, 20 bp, Artificial Sequence
  Description of Artificial Sequence: Synthetic oligonucleotide
  Target: ATXN1; (-) strand; PAM type: NNAGAAW; PAM sequence: TGAGAAT
gcacttttcactttgatgtc

SEQ ID NO: 7298 - DNA, 20 bp, Artificial Sequence
  Description of Artificial Sequence: Synthetic oligonucleotide
  Target: ATXN1; (-) strand; PAM type: NNAGAAW; PAM sequence: GCAGAAT
tgtaactacatttcagctct

SEQ ID NO: 7299 - DNA, 20 bp, Artificial Sequence
  Description of Artificial Sequence: Synthetic oligonucleotide
  Target: ATXN1; (-) strand; PAM type: NNAGAAW; PAM sequence: GGAGAAA
gctgactcccgctagtgtca

SEQ ID NO: 7300 - DNA, 20 bp, Artificial Sequence
  Description of Artificial Sequence: Synthetic oligonucleotide
  Target: ATXN1; (-) strand; PAM type: NNAGAAW; PAM sequence: GAAGAAA
gggctccaggcatccccggg

SEQ ID NO: 7301 - DNA, 20 bp, Artificial Sequence
  Description of Artificial Sequence: Synthetic oligonucleotide
  Target: ATXN1; (-) strand; PAM type: NNAGAAW; PAM sequence: AGAGAAA
aatggcgaactgaagtttcc

SEQ ID NO: 7302 - DNA, 20 bp, Artificial Sequence
  Description of Artificial Sequence: Synthetic oligonucleotide
  Target: ATXN1; (-) strand; PAM type: NNAGAAW; PAM sequence: TGAGAAT
gggagtgcccagatgctctc

SEQ ID NO: 7303 - DNA, 20 bp, Artificial Sequence
  Description of Artificial Sequence: Synthetic oligonucleotide
  Target: ATXN1; (-) strand; PAM type: NNAGAAW; PAM sequence: CAAGAAT
tgtgtgtgcataaaatcaaa

SEQ ID NO: 7304 - DNA, 20 bp, Artificial Sequence
  Description of Artificial Sequence: Synthetic oligonucleotide
  Target: ATXN1; (-) strand; PAM type: NNAGAAW; PAM sequence: CTAGAAA
aattacctagtctactacat

SEQ ID NO: 7305 - DNA, 20 bp, Artificial Sequence
  Description of Artificial Sequence: Synthetic oligonucleotide
  Target: ATXN1; (-) strand; PAM type: NNAGAAW; PAM sequence: TAAGAAA
ttatttgctgtccagtacta

SEQ ID NO: 7306 - DNA, 20 bp, Artificial Sequence
  Description of Artificial Sequence: Synthetic oligonucleotide
  Target: ATXN1; (-) strand; PAM type: NNAGAAW; PAM sequence: GGAGAAA
ggaatgttcaagtgccttca

SEQ ID NO: 7307 - DNA, 20 bp, Artificial Sequence
  Description of Artificial Sequence: Synthetic oligonucleotide
  Target: ATXN1; (-) strand; PAM type: NNAGAAW; PAM sequence: AAAGAAT
tgctttggggtcacaactca

SEQ ID NO: 7308 - DNA, 20 bp, Artificial Sequence
  Description of Artificial Sequence: Synthetic oligonucleotide
  Target: ATXN1; (-) strand; PAM type: NNAGAAW; PAM sequence: GTAGAAA
ctatttttttttaaatttct

SEQ ID NO: 7309 - DNA, 20 bp, Artificial Sequence
  Description of Artificial Sequence: Synthetic oligonucleotide
  Target: ATXN1; (-) strand; PAM type: NNAGAAW; PAM sequence: AGAGAAT
tctcttctaaagctctaatt

SEQ ID NO: 7310 - DNA, 20 bp, Artificial Sequence
  Description of Artificial Sequence: Synthetic oligonucleotide
  Target: ATXN1; (-) strand; PAM type: NNAGAAW; PAM sequence: ATAGAAT
gaaggatctttttgctccat

SEQ ID NO: 7311 - DNA, 20 bp, Artificial Sequence
  Description of Artificial Sequence: Synthetic oligonucleotide
  Target: ATXN1; (-) strand; PAM type: NNAGAAW; PAM sequence: AAAGAAT
gatttgttttttctctacct

SEQ ID NO: 7312 - DNA, 20 bp, Artificial Sequence
  Description of Artificial Sequence: Synthetic oligonucleotide
  Target: ATXN1; (-) strand; PAM type: NNAGAAW; PAM sequence: AAAGAAT
tccctctcacaaaaagaaaa

SEQ ID NO: 7313 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
agcaagactccctctcacaa

SEQ ID NO: 7314 - DNA, 20 bp, Artificial Sequence
  Description of Artificial Sequence: Synthetic oligonucleotide
  Target: ATXN1; (-) strand; PAM type: NNAGAAW; PAM sequence: GTAGAAA
aaggaaacaaagaagatgaa

SEQ ID NO: 7315 - DNA, 20 bp, Artificial Sequence
  Description of Artificial Sequence: Synthetic oligonucleotide
  Target: ATXN1; (-) strand; PAM type: NNAGAAW; PAM sequence: CTAGAAA
atccagtaaagtctgtcatt

SEQ ID NO: 7316 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
gaggtcaggaggcacagaaa

SEQ ID NO: 7317 - DNA, 20 bp, Artificial Sequence
  Description of Artificial Sequence: Synthetic oligonucleotide
  Target: ATXN1; (-) strand; PAM type: NNAGAAW; PAM sequence: ACAGAAA
aagggtagaggtcaggaggc

SEQ ID NO: 7318 - DNA, 20 bp, Artificial Sequence
  Description of Artificial Sequence: Synthetic oligonucleotide
  Target: ATXN1; (-) strand; PAM type: NNAGAAW; PAM sequence: CTAGAAT
cacacacttgtacagggtaa

SEQ ID NO: 7319 - DNA, 20 bp, Artificial Sequence
  Description of Artificial Sequence: Synthetic oligonucleotide
  Target: ATXN1; (-) strand; PAM type: NNAGAAW; PAM sequence: TTAGAAT
ttccagattggtcctcctac

SEQ ID NO: 7320 - DNA, 20 bp, Artificial Sequence
  Description of Artificial Sequence: Synthetic oligonucleotide
  Target: ATXN1; (-) strand; PAM type: NNAGAAW; PAM sequence: CAAGAAT
tacctctgcctggtgttggg

SEQ ID NO: 7321 - DNA, 20 bp, Artificial Sequence
  Description of Artificial Sequence: Synthetic oligonucleotide
  Target: ATXN1; (-) strand; PAM type: NNAGAAW; PAM sequence: CCAGAAA
ttatccgggaacacgcagaa

SEQ ID NO: 7322 - DNA, 20 bp, Artificial Sequence
  Description of Artificial Sequence: Synthetic oligonucleotide
  Target: ATXN1; (-) strand; PAM type: NNAGAAW; PAM sequence: TCAGAAA
gaacacagtagatgttattt

SEQ ID NO: 7323 - DNA, 20 bp, Artificial Sequence
  Description of Artificial Sequence: Synthetic oligonucleotide
  Target: ATXN1; (-) strand; PAM type: NNAGAAW; PAM sequence: CAAGAAA
gggcaacagagaatccatct

SEQ ID NO: 7324 - DNA, 20 bp, Artificial Sequence
  Description of Artificial Sequence: Synthetic oligonucleotide
  Target: ATXN1; (-) strand; PAM type: NNAGAAW; PAM sequence: AGAGAAT
tgcactccagcctgggcaac

SEQ ID NO: 7325 - DNA, 20 bp, Artificial Sequence
  Description of Artificial Sequence: Synthetic oligonucleotide
  Target: ATXN1; (-) strand; PAM type: NNAGAAW; PAM sequence: GGAGAAT
ctactcaggaggctgagaca

SEQ ID NO: 7326 - DNA, 20 bp, Artificial Sequence
  Description of Artificial Sequence: Synthetic oligonucleotide
  Target: ATXN1; (-) strand; PAM type: NNAGAAW; PAM sequence: AGAGAAA
gcaggtttattgggaaagcc

SEQ ID NO: 7327 - DNA, 20 bp, Artificial Sequence
  Description of Artificial Sequence: Synthetic oligonucleotide
  Target: ATXN1; (-) strand; PAM type: NNAGAAW; PAM sequence: GGAGAAT
ctacttgggaggctgaggca

SEQ ID NO: 7328 - DNA, 20 bp, Artificial Sequence
  Description of Artificial Sequence: Synthetic oligonucleotide
  Target: ATXN1; (-) strand; PAM type: NNAGAAW; PAM sequence: GAAGAAT
aagcctttgaagtgattaaa

SEQ ID NO: 7329 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
caaaggcagaatttaggcaa

SEQ ID NO: 7330 - DNA, 20 bp, Artificial Sequence
  Description of Artificial Sequence: Synthetic oligonucleotide
  Target: ATXN1; (-) strand; PAM type: NNAGAAW; PAM sequence: GCAGAAT
tcctttggtaggaagcaaag

SEQ ID NO: 7331 - DNA, 20 bp, Artificial Sequence
  Description of Artificial Sequence: Synthetic oligonucleotide
  Target: ATXN1; (-) strand; PAM type: NNAGAAW; PAM sequence: GGAGAAA
tagttcacactaattagtga

SEQ ID NO: 7332 - DNA, 20 bp, Artificial Sequence
  Description of Artificial Sequence: Synthetic oligonucleotide
  Target: ATXN1; (-) strand; PAM type: NNAGAAW; PAM sequence: TAAGAAT
gttaatgatcagttaacctt

SEQ ID NO: 7333 - DNA, 20 bp, Artificial Sequence
  Description of Artificial Sequence: Synthetic oligonucleotide
  Target: ATXN1; (-) strand; PAM type: NNAGAAW; PAM sequence: TGAGAAA
ttgatgatatatattctcac

SEQ ID NO: 7334 - DNA, 20 bp, Artificial Sequence
  Description of Artificial Sequence: Synthetic oligonucleotide
  Target: ATXN1; (-) strand; PAM type: NNAGAAW; PAM sequence: AGAGAAT
tttgaagctatcagcatcat

SEQ ID NO: 7335 - DNA, 20 bp, Artificial Sequence
  Description of Artificial Sequence: Synthetic oligonucleotide
  Target: ATXN1; (-) strand; PAM type: NNAGAAW; PAM sequence: GGAGAAT
ctactcgggaggctgaggca

SEQ ID NO: 7336 - DNA, 20 bp, Artificial Sequence
  Description of Artificial Sequence: Synthetic oligonucleotide
  Target: ATXN1; (-) strand; PAM type: NNAGAAW; PAM sequence: CAAGAAA
ttctgtctcctggtgggagg

SEQ ID NO: 7337 - DNA, 20 bp, Artificial Sequence
  Description of Artificial Sequence: Synthetic oligonucleotide
  Target: ATXN1; (-) strand; PAM type: NNAGAAW; PAM sequence: GAAGAAT
ggtgcttgattgaacagccg

SEQ ID NO: 7338 - DNA, 20 bp, Artificial Sequence
  Description of Artificial Sequence: Synthetic oligonucleotide
  Target: ATXN1; (-) strand; PAM type: NNAGAAW; PAM sequence: GAAGAAA
gtgatgtaagagaaagagcg

SEQ ID NO: 7339 - DNA, 20 bp, Artificial Sequence
  Description of Artificial Sequence: Synthetic oligonucleotide
  Target: ATXN1; (-) strand; PAM type: NNAGAAW; PAM sequence: AGAGAAA
attgggatgtttgtgatgta

SEQ ID NO: 7340 - DNA, 20 bp, Artificial Sequence
  Description of Artificial Sequence: Synthetic oligonucleotide
  Target: ATXN1; (-) strand; PAM type: NNAGAAW; PAM sequence: TGAGAAT
caatagggttcacgctccta

SEQ ID NO: 7341 - DNA, 20 bp, Artificial Sequence
  Description of Artificial Sequence: Synthetic oligonucleotide
  Target: ATXN1; (-) strand; PAM type: NNAGAAW; PAM sequence: AAAGAAT
caaatatacaagtaaataaa

SEQ ID NO: 7342 - DNA, 20 bp, Artificial Sequence
  Description of Artificial Sequence: Synthetic oligonucleotide
  Target: ATXN1; (-) strand; PAM type: NNAGAAW; PAM sequence: GGAGAAA
aggcggtaaagccacaccct

SEQ ID NO: 7343 - DNA, 20 bp, Artificial Sequence
  Description of Artificial Sequence: Synthetic oligonucleotide
  Target: ATXN1; (-) strand; PAM type: NNAGAAW; PAM sequence: TGAGAAA
tgaggtggctatggctccgc

SEQ ID NO: 7344 - DNA, 20 bp, Artificial Sequence
  Description of Artificial Sequence: Synthetic oligonucleotide
  Target: ATXN1; (-) strand; PAM type: NNAGAAW; PAM sequence: AGAGAAA
agctgcaagaacgagagtgg

SEQ ID NO: 7345 - DNA, 20 bp, Artificial Sequence
  Description of Artificial Sequence: Synthetic oligonucleotide
  Target: ATXN1; (-) strand; PAM type: NNAGAAW; PAM sequence: TCAGAAA
ttattttcattgggatttaa

SEQ ID NO: 7346 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
aaaaaaagaaagaaagaaag

SEQ ID NO: 7347 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
tcaaaaaaaaagaaagaaag

SEQ ID NO: 7348 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
tgtctcaaaaaaaaagaaag

SEQ ID NO: 7349 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
actctgtctcaaaaaaaaag

SEQ ID NO: 7350 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
tgagactctgtctcaaaaaa

SEQ ID NO: 7351 - DNA, 20 bp, Artificial Sequence
  Description of Artificial Sequence: Synthetic oligonucleotide
  Target: ATXN1; (-) strand; PAM type: NNAGAAW; PAM sequence: GGAGAAT
ctacttgggaggctgaggca

SEQ ID NO: 7352 - DNA, 20 bp, Artificial Sequence
  Description of Artificial Sequence: Synthetic oligonucleotide
  Target: ATXN1; (-) strand; PAM type: NNAGAAW; PAM sequence: AGAGAAT
ttactgaaacctagcttatg

SEQ ID NO: 7353 - DNA, 20 bp, Artificial Sequence
  Description of Artificial Sequence: Synthetic oligonucleotide
  Target: ATXN1; (-) strand; PAM type: NNAGAAW; PAM sequence: TAAGAAT
atttcacttgcagacaaagt

SEQ ID NO: 7354 - DNA, 20 bp, Artificial Sequence
  Description of Artificial Sequence: Synthetic oligonucleotide
  Target: ATXN1; (-) strand; PAM type: NNAGAAW; PAM sequence: TGAGAAT
ctctacaggtaaaacaagac

SEQ ID NO: 7355 - DNA, 20 bp, Artificial Sequence
  Description of Artificial Sequence: Synthetic oligonucleotide
  Target: ATXN1; (-) strand; PAM type: NNAGAAW; PAM sequence: TAAGAAA
gtgagccacgctaccatgtg

SEQ ID NO: 7356 - DNA, 20 bp, Artificial Sequence
  Description of Artificial Sequence: Synthetic oligonucleotide
  Target: ATXN1; (-) strand; PAM type: NNAGAAW; PAM sequence: CCAGAAA
aaggcacacattttaaggcc

SEQ ID NO: 7357 - DNA, 20 bp, Artificial Sequence
  Description of Artificial Sequence: Synthetic oligonucleotide
  Target: ATXN1; (-) strand; PAM type: NNAGAAW; PAM sequence: CCAGAAT
tctccatagttttgcctgtt

SEQ ID NO: 7358 - DNA, 20 bp, Artificial Sequence
  Description of Artificial Sequence: Synthetic oligonucleotide
  Target: ATXN1; (-) strand; PAM type: NNAGAAW; PAM sequence: TTAGAAA
actgttgttgtttatagcat

SEQ ID NO: 7359 - DNA, 20 bp, Artificial Sequence
  Description of Artificial Sequence: Synthetic oligonucleotide
  Target: ATXN1; (-) strand; PAM type: NNAGAAW; PAM sequence: GGAGAAA
tctctaaaaaaaaaaaaaaa

SEQ ID NO: 7360 - DNA, 20 bp, Artificial Sequence
  Description of Artificial Sequence: Synthetic oligonucleotide
  Target: ATXN1; (-) strand; PAM type: NNAGAAW; PAM sequence: AGAGAAA
ggtgctggaaaggctccaac

SEQ ID NO: 7361 - DNA, 20 bp, Artificial Sequence
  Description of Artificial Sequence: Synthetic oligonucleotide
  Target: ATXN1; (-) strand; PAM type: NNAGAAW; PAM sequence: GCAGAAA
agatcagtaagacaaccaat

SEQ ID NO: 7362 - DNA, 20 bp, Artificial Sequence
  Description of Artificial Sequence: Synthetic oligonucleotide
  Target: ATXN1; (-) strand; PAM type: NNAGAAW; PAM sequence: CTAGAAA
gagaggcagctgatgaaagt

SEQ ID NO: 7363 - DNA, 20 bp, Artificial Sequence
  Description of Artificial Sequence: Synthetic oligonucleotide
  Target: ATXN1; (-) strand; PAM type: NNAGAAW; PAM sequence: TGAGAAA
aacttagatggctcgggccc

SEQ ID NO: 7364 - DNA, 20 bp, Artificial Sequence
  Description of Artificial Sequence: Synthetic oligonucleotide
  Target: ATXN1; (-) strand; PAM type: NNAGAAW; PAM sequence: ACAGAAT
gttgagagtcccaaaggatg

SEQ ID NO: 7365 - DNA, 20 bp, Artificial Sequence
  Description of Artificial Sequence: Synthetic oligonucleotide
  Target: ATXN1; (-) strand; PAM type: NNAGAAW; PAM sequence: GGAGAAA
gctccagacgaggcaatgta

SEQ ID NO: 7366 - DNA, 20 bp, Artificial Sequence
  Description of Artificial Sequence: Synthetic oligonucleotide
  Target: ATXN1; (-) strand; PAM type: NNAGAAW; PAM sequence: GCAGAAA
agatggcattgtgactctag

SEQ ID NO: 7367 - DNA, 20 bp, Artificial Sequence
  Description of Artificial Sequence: Synthetic oligonucleotide
  Target: ATXN1; (-) strand; PAM type: NNAGAAW; PAM sequence: TCAGAAA
cactgcacccacagagaaat

SEQ ID NO: 7368 - DNA, 20 bp, Artificial Sequence
  Description of Artificial Sequence: Synthetic oligonucleotide
  Target: ATXN1; (-) strand; PAM type: NNAGAAW; PAM sequence: AGAGAAA
actgctgacactgcacccac

SEQ ID NO: 7369 - DNA, 20 bp, Artificial Sequence
  Description of Artificial Sequence: Synthetic oligonucleotide
  Target: ATXN1; (-) strand; PAM type: NNAGAAW; PAM sequence: GAAGAAT
ggggttttctcccctagcct

SEQ ID NO: 7370 - DNA, 20 bp, Artificial Sequence
  Description of Artificial Sequence: Synthetic oligonucleotide
  Target: ATXN1; (-) strand; PAM type: NNAGAAW; PAM sequence: TCAGAAA
tcactttaccgaggagccta

SEQ ID NO: 7371 - DNA, 20 bp, Artificial Sequence
  Description of Artificial Sequence: Synthetic oligonucleotide
  Target: ATXN1; (-) strand; PAM type: NNAGAAW; PAM sequence: GTAGAAA
ggcagctagggcttcacgct

SEQ ID NO: 7372 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
atgccgggaagggcttcctc

SEQ ID NO: 7373 - DNA, 20 bp, Artificial Sequence
  Description of Artificial Sequence: Synthetic oligonucleotide
  Target: ATXN1; (-) strand; PAM type: NNAGAAW; PAM sequence: AGAGAAA
aaaattaatgattaaatgaa

SEQ ID NO: 7374 - DNA, 20 bp, Artificial Sequence
  Description of Artificial Sequence: Synthetic oligonucleotide
  Target: ATXN1; (-) strand; PAM type: NNAGAAW; PAM sequence: GCAGAAA
tcccaggcctggcagcctct

SEQ ID NO: 7375 - DNA, 20 bp, Artificial Sequence
  Description of Artificial Sequence: Synthetic oligonucleotide
  Target: ATXN1; (-) strand; PAM type: NNAGAAW; PAM sequence: TGAGAAT
ggccagcatcaacttcagct

SEQ ID NO: 7376 - DNA, 20 bp, Artificial Sequence
  Description of Artificial Sequence: Synthetic oligonucleotide
  Target: ATXN1; (-) strand; PAM type: NNAGAAW; PAM sequence: TTAGAAA
ggtgtgaaaagaggttttgt

SEQ ID NO: 7377 - DNA, 20 bp, Artificial Sequence
  Description of Artificial Sequence: Synthetic oligonucleotide
  Target: ATXN1; (-) strand; PAM type: NNAGAAW; PAM sequence: TTAGAAT
gtcattgcttttcatggtac

SEQ ID NO: 7378 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
ttaggggtgggtactaggag

SEQ ID NO: 7379 - DNA, 20 bp, Artificial Sequence
  Description of Artificial Sequence: Synthetic oligonucleotide
  Target: ATXN1; (-) strand; PAM type: NNAGAAW; PAM sequence: GGAGAAA
tgaattaggggtgggtacta

SEQ ID NO: 7380 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
aaagatcttatttaaaaaaa

SEQ ID NO: 7381 - DNA, 20 bp, Artificial Sequence
  Description of Artificial Sequence: Synthetic oligonucleotide
  Target: ATXN1; (-) strand; PAM type: NNAGAAW; PAM sequence: CAAGAAA
ttacagtctttggaagggcc

SEQ ID NO: 7382 - DNA, 20 bp, Artificial Sequence
  Description of Artificial Sequence: Synthetic oligonucleotide
  Target: ATXN1; (-) strand; PAM type: NNAGAAW; PAM sequence: CAAGAAA
gacattcagataaaataaaa

SEQ ID NO: 7383 - DNA, 20 bp, Artificial Sequence
  Description of Artificial Sequence: Synthetic oligonucleotide
  Target: ATXN1; (-) strand; PAM type: NNAGAAW; PAM sequence: TCAGAAA
gacactaaaatatcaaagca

SEQ ID NO: 7384 - DNA, 20 bp, Artificial Sequence
  Description of Artificial Sequence: Synthetic oligonucleotide
  Target: ATXN1; (-) strand; PAM type: NNAGAAW; PAM sequence: GGAGAAT
ctactccagaggctgaggta

SEQ ID NO: 7385 - DNA, 20 bp, Artificial Sequence
  Description of Artificial Sequence: Synthetic oligonucleotide
  Target: ATXN1; (-) strand; PAM type: NNAGAAW; PAM sequence: CCAGAAA
tatggagtccttgagacaat

SEQ ID NO: 7386 - DNA, 20 bp, Artificial Sequence
  Description of Artificial Sequence: Synthetic oligonucleotide
  Target: ATXN1; (-) strand; PAM type: NNAGAAW; PAM sequence: CTAGAAA
gcctttcccaactgcgttct

SEQ ID NO: 7387 - DNA, 20 bp, Artificial Sequence
  Description of Artificial Sequence: Synthetic oligonucleotide
  Target: ATXN1; (-) strand; PAM type: NNAGAAW; PAM sequence: CAAGAAA
tttgtccctcgggaggccac

SEQ ID NO: 7388 - DNA, 20 bp, Artificial Sequence
  Description of Artificial Sequence: Synthetic oligonucleotide
  Target: ATXN1; (-) strand; PAM type: NNAGAAW; PAM sequence: ACAGAAA
atgaagagcctggatcccct

SEQ ID NO: 7389 - DNA, 20 bp, Artificial Sequence
  Description of Artificial Sequence: Synthetic oligonucleotide
  Target: ATXN1; (-) strand; PAM type: NNAGAAW; PAM sequence: GGAGAAA
tctgcccttgaagaagaaaa

SEQ ID NO: 7390 - DNA, 20 bp, Artificial Sequence
  Description of Artificial Sequence: Synthetic oligonucleotide
  Target: ATXN1; (-) strand; PAM type: NNAGAAW; PAM sequence: GAAGAAA
ctgcatcatctgcccttgaa

SEQ ID NO: 7391 - DNA, 20 bp, Artificial Sequence
  Description of Artificial Sequence: Synthetic oligonucleotide
  Target: ATXN1; (-) strand; PAM type: NNAGAAW; PAM sequence: TGAGAAA
ccagccaggcaaaggagagg

SEQ ID NO: 7392 - DNA, 20 bp, Artificial Sequence
  Description of Artificial Sequence: Synthetic oligonucleotide
  Target: ATXN1; (-) strand; PAM type: NNAGAAW; PAM sequence: TCAGAAA
tggctctggcagatgaggat

SEQ ID NO: 7393 - DNA, 20 bp, Artificial Sequence
  Description of Artificial Sequence: Synthetic oligonucleotide
  Target: ATXN1; (-) strand; PAM type: NNAGAAW; PAM sequence: TGAGAAA
aaaccaagcatgtaacccac

SEQ ID NO: 7394 - DNA, 20 bp, Artificial Sequence
  Description of Artificial Sequence: Synthetic oligonucleotide
  Target: ATXN1; (-) strand; PAM type: NNAGAAW; PAM sequence: TGAGAAA
ggcgagttgttactttccaa

SEQ ID NO: 7395 - DNA, 20 bp, Artificial Sequence
  Description of Artificial Sequence: Synthetic oligonucleotide
  Target: ATXN1; (-) strand; PAM type: NNAGAAW; PAM sequence: TCAGAAT
aaagcccaatcccacagctc

SEQ ID NO: 7396 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
aaagaaagaaagaaagaaag

SEQ ID NO: 7397 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
ctccaaagaaagaaagaaag

SEQ ID NO: 7398 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
atctctccaaagaaagaaag

SEQ ID NO: 7399 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
ccccatctctccaaagaaag

SEQ ID NO: 7400 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
aagaccccatctctccaaag

SEQ ID NO: 7401 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
tagcaagaccccatctctcc

SEQ ID NO: 7402 - DNA, 20 bp, Artificial Sequence
  Description of Artificial Sequence: Synthetic oligonucleotide
  Target: ATXN1; (-) strand; PAM type: NNAGAAW; PAM sequence: AGAGAAA
tacaaagtagggggcagagt

SEQ ID NO: 7403 - DNA, 20 bp, Artificial Sequence
  Description of Artificial Sequence: Synthetic oligonucleotide
  Target: ATXN1; (-) strand; PAM type: NNAGAAW; PAM sequence: TGAGAAA
taagcgcctctcttgtcata

SEQ ID NO: 7404 - DNA, 20 bp, Artificial Sequence
  Description of Artificial Sequence: Synthetic oligonucleotide
  Target: ATXN1; (-) strand; PAM type: NNAGAAW; PAM sequence: GGAGAAT
ctactcaggaggctgaggca

SEQ ID NO: 7405 - DNA, 20 bp, Artificial Sequence
  Description of Artificial Sequence: Synthetic oligonucleotide
  Target: ATXN1; (-) strand; PAM type: NNAGAAW; PAM sequence: GAAGAAT
tatcaatggataagttttca

SEQ ID NO: 7406 - DNA, 20 bp, Artificial Sequence
  Description of Artificial Sequence: Synthetic oligonucleotide
  Target: ATXN1; (-) strand; PAM type: NNAGAAW; PAM sequence: GCAGAAA
tgcaactagagactctaaga

SEQ ID NO: 7407 - DNA, 20 bp, Artificial Sequence
  Description of Artificial Sequence: Synthetic oligonucleotide
  Target: ATXN1; (-) strand; PAM type: NNAGAAW; PAM sequence: GAAGAAA
tgtgcatggccccatgtttg

SEQ ID NO: 7408 - DNA, 20 bp, Artificial Sequence
  Description of Artificial Sequence: Synthetic oligonucleotide
  Target: ATXN1; (-) strand; PAM type: NNAGAAW; PAM sequence: TTAGAAA
cttataccactgggctaaat

SEQ ID NO: 7409 - DNA, 20 bp, Artificial Sequence
  Description of Artificial Sequence: Synthetic oligonucleotide
  Target: ATXN1; (-) strand; PAM type: NNAGAAW; PAM sequence: ATAGAAT
tttctcaaaccttactgtgc

SEQ ID NO: 7410 - DNA, 20 bp, Artificial Sequence
  Description of Artificial Sequence: Synthetic oligonucleotide
  Target: ATXN1; (-) strand; PAM type: NNAGAAW; PAM sequence: GTAGAAA
atttgcttaagagtttagca

SEQ ID NO: 7411 - DNA, 20 bp, Artificial Sequence
  Description of Artificial Sequence: Synthetic oligonucleotide
  Target: ATXN1; (-) strand; PAM type: NNAGAAW; PAM sequence: GAAGAAA
tgcagttgtgtaaagaacca

SEQ ID NO: 7412 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
tctcgaaatgaaattatagc

SEQ ID NO: 7413 - DNA, 20 bp, Artificial Sequence
  Description of Artificial Sequence: Synthetic oligonucleotide
  Target: ATXN1; (-) strand; PAM type: NNAGAAW; PAM sequence: TGAGAAT
agattggtgagtcagcactt

SEQ ID NO: 7414 - DNA, 20 bp, Artificial Sequence
  Description of Artificial Sequence: Synthetic oligonucleotide
  Target: ATXN1; (-) strand; PAM type: NNAGAAW; PAM sequence: CTAGAAA
tgaggtccccgtcatacata

SEQ ID NO: 7415 - DNA, 20 bp, Artificial Sequence
  Description of Artificial Sequence: Synthetic oligonucleotide
  Target: ATXN1; (-) strand; PAM type: NNAGAAW; PAM sequence: TCAGAAT
cacagagtggaatcacagtc

SEQ ID NO: 7416 - DNA, 20 bp, Artificial Sequence
  Description of Artificial Sequence: Synthetic oligonucleotide
  Target: ATXN1; (-) strand; PAM type: NNAGAAW; PAM sequence: GAAGAAA
ttccactgaggacacagcaa

SEQ ID NO: 7417 - DNA, 20 bp, Artificial Sequence
  Description of Artificial Sequence: Synthetic oligonucleotide
  Target: ATXN1; (-) strand; PAM type: NNAGAAW; PAM sequence: ACAGAAA
acatatcgtggcttaaaaca

SEQ ID NO: 7418 - DNA, 20 bp, Artificial Sequence
  Description of Artificial Sequence: Synthetic oligonucleotide
  Target: ATXN1; (-) strand; PAM type: NNAGAAW; PAM sequence: TAAGAAA
cgcatcatggttgggtagac

SEQ ID NO: 7419 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
ccccaggaaggtcttgcctc

SEQ ID NO: 7420 - DNA, 20 bp, Artificial Sequence
  Description of Artificial Sequence: Synthetic oligonucleotide
  Target: ATXN1; (-) strand; PAM type: NNAGAAW; PAM sequence: GCAGAAT
gtgccaagcagacaagttca

SEQ ID NO: 7421 - DNA, 20 bp, Artificial Sequence
  Description of Artificial Sequence: Synthetic oligonucleotide
  Target: ATXN1; (-) strand; PAM type: NNAGAAW; PAM sequence: TAAGAAT
aatggcagaagccaggaatc

SEQ ID NO: 7422 - DNA, 20 bp, Artificial Sequence
  Description of Artificial Sequence: Synthetic oligonucleotide
  Target: ATXN1; (-) strand; PAM type: NNAGAAW; PAM sequence: ACAGAAA
ttgaatcaggaaaggtcttg

SEQ ID NO: 7423 - DNA, 20 bp, Artificial Sequence
  Description of Artificial Sequence: Synthetic oligonucleotide
  Target: ATXN1; (-) strand; PAM type: NNAGAAW; PAM sequence: ACAGAAA
tcaaccagagtggtggataa

SEQ ID NO: 7424 - DNA, 20 bp, Artificial Sequence
  Description of Artificial Sequence: Synthetic oligonucleotide
  Target: ATXN1; (-) strand; PAM type: NNAGAAW; PAM sequence: TAAGAAA
gagatctatcacagtggtgg

SEQ ID NO: 7425 - DNA, 20 bp, Artificial Sequence
  Description of Artificial Sequence: Synthetic oligonucleotide
  Target: ATXN1; (-) strand; PAM type: NNAGAAW; PAM sequence: TGAGAAT
agataagtgtgggtgatcac

SEQ ID NO: 7426 - DNA, 20 bp, Artificial Sequence
  Description of Artificial Sequence: Synthetic oligonucleotide
  Target: ATXN1; (-) strand; PAM type: NNAGAAW; PAM sequence: AAAGAAT
gaggaaaaaacagatgtttg

SEQ ID NO: 7427 - DNA, 20 bp, Artificial Sequence
  Description of Artificial Sequence: Synthetic oligonucleotide
  Target: ATXN1; (-) strand; PAM type: NNAGAAW; PAM sequence: GAAGAAA
tattatcccacctatcaagt

SEQ ID NO: 7428 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
gagtgagactccgtctcaaa

SEQ ID NO: 7429 - DNA, 20 bp, Artificial Sequence
  Description of Artificial Sequence: Synthetic oligonucleotide
  Target: ATXN1; (-) strand; PAM type: NNAGAAW; PAM sequence: GGAGAAT
cttcttggaaggctgaggca

SEQ ID NO: 7430 - DNA, 20 bp, Artificial Sequence
  Description of Artificial Sequence: Synthetic oligonucleotide
  Target: ATXN1; (-) strand; PAM type: NNAGAAW; PAM sequence: GAAGAAT
cctcctcccagccatgatgt

SEQ ID NO: 7431 - DNA, 20 bp, Artificial Sequence
  Description of Artificial Sequence: Synthetic oligonucleotide
  Target: ATXN1; (-) strand; PAM type: NNAGAAW; PAM sequence: TTAGAAT
ttctcacctctggctgcaaa

SEQ ID NO: 7432 - DNA, 20 bp, Artificial Sequence
  Description of Artificial Sequence: Synthetic oligonucleotide
  Target: ATXN1; (-) strand; PAM type: NNAGAAW; PAM sequence: GGAGAAT
ccactcgggaggctgaggca

SEQ ID NO: 7433 - DNA, 20 bp, Artificial Sequence
  Description of Artificial Sequence: Synthetic oligonucleotide
  Target: ATXN1; (-) strand; PAM type: NNAGAAW; PAM sequence: GGAGAAT
ctacttgggaggctgaggca

SEQ ID NO: 7434 - DNA, 20 bp, Artificial Sequence
  Description of Artificial Sequence: Synthetic oligonucleotide
  Target: ATXN1; (-) strand; PAM type: NNAGAAW; PAM sequence: AAAGAAT
tttgtttttttttttaaaaa

SEQ ID NO: 7435 - DNA, 20 bp, Artificial Sequence
  Description of Artificial Sequence: Synthetic oligonucleotide
  Target: ATXN1; (-) strand; PAM type: NNAGAAW; PAM sequence: ACAGAAT
tatcaatgtcatagcatgta

SEQ ID NO: 7436 - DNA, 20 bp, Artificial Sequence
  Description of Artificial Sequence: Synthetic oligonucleotide
  Target: ATXN1; (-) strand; PAM type: NNAGAAW; PAM sequence: CCAGAAT
accatcaccaccatctgtct

SEQ ID NO: 7437 - DNA, 20 bp, Artificial Sequence
  Description of Artificial Sequence: Synthetic oligonucleotide
  Target: ATXN1; (-) strand; PAM type: NNAGAAW; PAM sequence: ACAGAAA
gggcgctgtgtggtttcaaa

SEQ ID NO: 7438 - DNA, 20 bp, Artificial Sequence
  Description of Artificial Sequence: Synthetic oligonucleotide
  Target: ATXN1; (-) strand; PAM type: NNAGAAW; PAM sequence: TGAGAAA
cacagtcccctttgcggatg

SEQ ID NO: 7439 - DNA, 20 bp, Artificial Sequence
  Description of Artificial Sequence: Synthetic oligonucleotide
  Target: ATXN1; (-) strand; PAM type: NNAGAAW; PAM sequence: ACAGAAT
ggaactgacataacctgatg

SEQ ID NO: 7440 - DNA, 20 bp, Artificial Sequence
  Description of Artificial Sequence: Synthetic oligonucleotide
  Target: ATXN1; (-) strand; PAM type: NNAGAAW; PAM sequence: TTAGAAA
cgagtataagaaccactgca

SEQ ID NO: 7441 - DNA, 20 bp, Artificial Sequence
  Description of Artificial Sequence: Synthetic oligonucleotide
  Target: ATXN1; (-) strand; PAM type: NNAGAAW; PAM sequence: TGAGAAT
gttcctgaacggtgtgtgga

SEQ ID NO: 7442 - DNA, 20 bp, Artificial Sequence
  Description of Artificial Sequence: Synthetic oligonucleotide
  Target: ATXN1; (-) strand; PAM type: NNAGAAW; PAM sequence: CAAGAAT
aacaccctcacagacacaac

SEQ ID NO: 7443 - DNA, 20 bp, Artificial Sequence
  Description of Artificial Sequence: Synthetic oligonucleotide
  Target: ATXN1; (-) strand; PAM type: NNAGAAW; PAM sequence: CGAGAAA
agggcaggaagcatccagca

SEQ ID NO: 7444 - DNA, 20 bp, Artificial Sequence
  Description of Artificial Sequence: Synthetic oligonucleotide
  Target: ATXN1; (-) strand; PAM type: NNAGAAW; PAM sequence: CTAGAAA
aaccaaggacggacagcacc

SEQ ID NO: 7445 - DNA, 20 bp, Artificial Sequence
  Description of Artificial Sequence: Synthetic oligonucleotide
  Target: ATXN1; (-) strand; PAM type: NNAGAAW; PAM sequence: CCAGAAA
tccaaaatctagaaaatgat

SEQ ID NO: 7446 - DNA, 20 bp, Artificial Sequence
  Description of Artificial Sequence: Synthetic oligonucleotide
  Target: ATXN1; (-) strand; PAM type: NNAGAAW; PAM sequence: CTAGAAA
tttatcatcacatccaaaat

SEQ ID NO: 7447 - DNA, 20 bp, Artificial Sequence
  Description of Artificial Sequence: Synthetic oligonucleotide
  Target: ATXN1; (-) strand; PAM type: NNAGAAW; PAM sequence: TGAGAAA
caggagttaataatctcacg

SEQ ID NO: 7448 - DNA, 20 bp, Artificial Sequence
  Description of Artificial Sequence: Synthetic oligonucleotide
  Target: ATXN1; (-) strand; PAM type: NNAGAAW; PAM sequence: AGAGAAT
aaaacaaacatttattgcag

SEQ ID NO: 7449 - DNA, 20 bp, Artificial Sequence
  Description of Artificial Sequence: Synthetic oligonucleotide
  Target: ATXN1; (-) strand; PAM type: NNAGAAW; PAM sequence: GTAGAAA
tcattctgaagtcagtggag

SEQ ID NO: 7450 - DNA, 20 bp, Artificial Sequence
  Description of Artificial Sequence: Synthetic oligonucleotide
  Target: ATXN1; (-) strand; PAM type: NNAGAAW; PAM sequence: AAAGAAT
aataaataaataaataatta

SEQ ID NO: 7451 - DNA, 20 bp, Artificial Sequence
  Description of Artificial Sequence: Synthetic oligonucleotide
  Target: ATXN1; (-) strand; PAM type: NNAGAAW; PAM sequence: TGAGAAT
ctactcaggaggctgaggca

SEQ ID NO: 7452 - DNA, 20 bp, Artificial Sequence
  Description of Artificial Sequence: Synthetic oligonucleotide
  Target: ATXN1; (-) strand; PAM type: NNAGAAW; PAM sequence: AGAGAAA
cccggcgacaaaaaagaggg

SEQ ID NO: 7453 - DNA, 20 bp, Artificial Sequence
  Description of Artificial Sequence: Synthetic oligonucleotide
  Target: ATXN1; (-) strand; PAM type: NNAGAAW; PAM sequence: CCAGAAA
cggctctggccttggccagc

SEQ ID NO: 7454 - DNA, 20 bp, Artificial Sequence
  Description of Artificial Sequence: Synthetic oligonucleotide
  Target: ATXN1; (-) strand; PAM type: NNAGAAW; PAM sequence: CGAGAAA
agaaggcagctaaggcctgg

SEQ ID NO: 7455 - DNA, 20 bp, Artificial Sequence
  Description of Artificial Sequence: Synthetic oligonucleotide
  Target: ATXN1; (-) strand; PAM type: NNAGAAW; PAM sequence: CAAGAAT
gttcttggtctcactgactt

SEQ ID NO: 7456 - DNA, 20 bp, Artificial Sequence
  Description of Artificial Sequence: Synthetic oligonucleotide
  Target: ATXN1; (-) strand; PAM type: NNAGAAW; PAM sequence: CCAGAAT
ctatggttgtgctactgtgt

SEQ ID NO: 7457 - DNA, 20 bp, Artificial Sequence
  Description of Artificial Sequence: Synthetic oligonucleotide
  Target: ATXN1; (-) strand; PAM type: NNAGAAW; PAM sequence: TTAGAAA
cttaaagaggaaatcaaagc

SEQ ID NO: 7458 - DNA, 20 bp, Artificial Sequence
  Description of Artificial Sequence: Synthetic oligonucleotide
  Target: ATXN1; (-) strand; PAM type: NNAGAAW; PAM sequence: AGAGAAA
gcctggttagtacttagatc

SEQ ID NO: 7459 - DNA, 20 bp, Artificial Sequence
  Description of Artificial Sequence: Synthetic oligonucleotide
  Target: ATXN1; (-) strand; PAM type: NNAGAAW; PAM sequence: AGAGAAA
agatgagcaaactgaggcac

SEQ ID NO: 7460 - DNA, 20 bp, Artificial Sequence
  Description of Artificial Sequence: Synthetic oligonucleotide
  Target: ATXN1; (-) strand; PAM type: NNAGAAW; PAM sequence: TTAGAAA
ggtagagaagagggcctttc

SEQ ID NO: 7461 - DNA, 20 bp, Artificial Sequence
  Description of Artificial Sequence: Synthetic oligonucleotide
  Target: ATXN1; (-) strand; PAM type: NNAGAAW; PAM sequence: GTAGAAA
agctaatttttgtattttta

SEQ ID NO: 7462 - DNA, 20 bp, Artificial Sequence
  Description of Artificial Sequence: Synthetic oligonucleotide
  Target: ATXN1; (-) strand; PAM type: NNAGAAW; PAM sequence: AAAGAAT
gatgcaggaagtaacctgag

SEQ ID NO: 7463 - DNA, 20 bp, Artificial Sequence
  Description of Artificial Sequence: Synthetic oligonucleotide
  Target: ATXN1; (-) strand; PAM type: NNAGAAW; PAM sequence: TGAGAAA
ctatgatgcaggaagtaacc

SEQ ID NO: 7464 - DNA, 20 bp, Artificial Sequence
  Description of Artificial Sequence: Synthetic oligonucleotide
  Target: ATXN1; (-) strand; PAM type: NNAGAAW; PAM sequence: CCAGAAA
gtgttctgcgttcaaataag

SEQ ID NO: 7465 - DNA, 20 bp, Artificial Sequence
  Description of Artificial Sequence: Synthetic oligonucleotide
  Target: ATXN1; (-) strand; PAM type: NNAGAAW; PAM sequence: ATAGAAA
tccacgtccacagtgctagt

SEQ ID NO: 7466 - DNA, 20 bp, Artificial Sequence
  Description of Artificial Sequence: Synthetic oligonucleotide
  Target: ATXN1; (-) strand; PAM type: NNAGAAW; PAM sequence: GCAGAAA
gaaatggtgcaaaaccgtta

SEQ ID NO: 7467 - DNA, 20 bp, Artificial Sequence
  Description of Artificial Sequence: Synthetic oligonucleotide
  Target: ATXN1; (-) strand; PAM type: NNAGAAW; PAM sequence: GGAGAAA
tcaggctctggcctatgctt

SEQ ID NO: 7468 - DNA, 20 bp, Artificial Sequence
  Description of Artificial Sequence: Synthetic oligonucleotide
  Target: ATXN1; (-) strand; PAM type: NNAGAAW; PAM sequence: GAAGAAA
cccaagagttgagacatttt

SEQ ID NO: 7469 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
ttctcataattataaaagaa

SEQ ID NO: 7470 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
ttcatgttctcataattata

SEQ ID NO: 7471 - DNA, 20 bp, Artificial Sequence
  Description of Artificial Sequence: Synthetic oligonucleotide
  Target: ATXN1; (-) strand; PAM type: NNAGAAW; PAM sequence: GCAGAAT
ggaaaagactgaaaatcttg

SEQ ID NO: 7472 - DNA, 20 bp, Artificial Sequence
  Description of Artificial Sequence: Synthetic oligonucleotide
  Target: ATXN1; (-) strand; PAM type: NNAGAAW; PAM sequence: GAAGAAT
gaaaaattggtttcttagta

SEQ ID NO: 7473 - DNA, 20 bp, Artificial Sequence
  Description of Artificial Sequence: Synthetic oligonucleotide
  Target: ATXN1; (-) strand; PAM type: NNAGAAW; PAM sequence: CAAGAAT
aaatattgatccagcatact

SEQ ID NO: 7474 - DNA, 20 bp, Artificial Sequence
  Description of Artificial Sequence: Synthetic oligonucleotide
  Target: ATXN1; (-) strand; PAM type: NNAGAAW; PAM sequence: GGAGAAA
ctgttggaattacattacaa

SEQ ID NO: 7475 - DNA, 20 bp, Artificial Sequence
  Description of Artificial Sequence: Synthetic oligonucleotide
  Target: ATXN1; (-) strand; PAM type: NNAGAAW; PAM sequence: TAAGAAA
aaggccaaactaacctgttc

SEQ ID NO: 7476 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
gaagtttcaaatcagctgtg

SEQ ID NO: 7477 - DNA, 20 bp, Artificial Sequence
  Description of Artificial Sequence: Synthetic oligonucleotide
  Target: ATXN1; (-) strand; PAM type: NNAGAAW; PAM sequence: CCAGAAA
aaagtatgaaatggaaaatt

SEQ ID NO: 7478 - DNA, 20 bp, Artificial Sequence
  Description of Artificial Sequence: Synthetic oligonucleotide
  Target: ATXN1; (-) strand; PAM type: NNAGAAW; PAM sequence: AGAGAAT
cctcctgtaattgcttgtta

SEQ ID NO: 7479 - DNA, 20 bp, Artificial Sequence
  Description of Artificial Sequence: Synthetic oligonucleotide
  Target: ATXN1; (-) strand; PAM type: NNAGAAW; PAM sequence: TCAGAAT
ttccccaacctagctgccaa

SEQ ID NO: 7480 - DNA, 20 bp, Artificial Sequence
  Description of Artificial Sequence: Synthetic oligonucleotide
  Target: ATXN1; (-) strand; PAM type: NNAGAAW; PAM sequence: GGAGAAT
ctactagagaggctgaggca

SEQ ID NO: 7481 - DNA, 20 bp, Artificial Sequence
  Description of Artificial Sequence: Synthetic oligonucleotide
  Target: ATXN1; (-) strand; PAM type: NNAGAAW; PAM sequence: TCAGAAA
tctgtagagtttcttgcata

SEQ ID NO: 7482 - DNA, 20 bp, Artificial Sequence
  Description of Artificial Sequence: Synthetic oligonucleotide
  Target: ATXN1; (-) strand; PAM type: NNAGAAW; PAM sequence: GCAGAAA
aaagatgtgcacagtgtgat

SEQ ID NO: 7483 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
tctccaccaagagaggagaa

SEQ ID NO: 7484 - DNA, 20 bp, Artificial Sequence
  Description of Artificial Sequence: Synthetic oligonucleotide
  Target: ATXN1; (-) strand; PAM type: NNAGAAW; PAM sequence: GGAGAAA
aatacctctccaccaagaga

SEQ ID NO: 7485 - DNA, 20 bp, Artificial Sequence
  Description of Artificial Sequence: Synthetic oligonucleotide
  Target: ATXN1; (-) strand; PAM type: NNAGAAW; PAM sequence: AGAGAAA
caggaaggggaagattgagc

SEQ ID NO: 7486 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
gagcgagactccgtctcaaa

SEQ ID NO: 7487 - DNA, 20 bp, Artificial Sequence
  Description of Artificial Sequence: Synthetic oligonucleotide
  Target: ATXN1; (-) strand; PAM type: NNAGAAW; PAM sequence: GGAGAAT
ctactcaggaggctgaggca

SEQ ID NO: 7488 - DNA, 20 bp, Artificial Sequence
  Description of Artificial Sequence: Synthetic oligonucleotide
  Target: ATXN1; (-) strand; PAM type: NNAGAAW; PAM sequence: ATAGAAA
aaaccccgtctctactaaaa

SEQ ID NO: 7489 - DNA, 20 bp, Artificial Sequence
  Description of Artificial Sequence: Synthetic oligonucleotide
  Target: ATXN1; (-) strand; PAM type: NNAGAAW; PAM sequence: GGAGAAT
tgacttcagagctctcagga

SEQ ID NO: 7490 - DNA, 20 bp, Artificial Sequence
  Description of Artificial Sequence: Synthetic oligonucleotide
  Target: ATXN1; (-) strand; PAM type: NNAGAAW; PAM sequence: GAAGAAA
atagaataagcagggaggag

SEQ ID NO: 7491 - DNA, 20 bp, Artificial Sequence
  Description of Artificial Sequence: Synthetic oligonucleotide
  Target: ATXN1; (-) strand; PAM type: NNAGAAW; PAM sequence: ATAGAAT
tgctttgaaccttctgagtc

SEQ ID NO: 7492 - DNA, 20 bp, Artificial Sequence
  Description of Artificial Sequence: Synthetic oligonucleotide
  Target: ATXN1; (-) strand; PAM type: NNAGAAW; PAM sequence: TCAGAAT
caacagcaaagagattatat

SEQ ID NO: 7493 - DNA, 20 bp, Artificial Sequence
  Description of Artificial Sequence: Synthetic oligonucleotide
  Target: ATXN1; (-) strand; PAM type: NNAGAAW; PAM sequence: TGAGAAA
gttcttggcagcttacaaaa

SEQ ID NO: 7494 - DNA, 20 bp, Artificial Sequence
  Description of Artificial Sequence: Synthetic oligonucleotide
  Target: ATXN1; (-) strand; PAM type: NNAGAAW; PAM sequence: AAAGAAT
aagttatatgcttttccccc

SEQ ID NO: 7495 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
gtcttcaagcttctcttagg

SEQ ID NO: 7496 - DNA, 20 bp, Artificial Sequence
  Description of Artificial Sequence: Synthetic oligonucleotide
  Target: ATXN1; (-) strand; PAM type: NNAGAAW; PAM sequence: CCAGAAT
tgctttcccaatctagatct

SEQ ID NO: 7497 - DNA, 20 bp, Artificial Sequence
  Description of Artificial Sequence: Synthetic oligonucleotide
  Target: ATXN1; (-) strand; PAM type: NNAGAAW; PAM sequence: AAAGAAT
gcatttgagactgttggtga

SEQ ID NO: 7498 - DNA, 20 bp, Artificial Sequence
  Description of Artificial Sequence: Synthetic oligonucleotide
  Target: ATXN1; (-) strand; PAM type: NNAGAAW; PAM sequence: TTAGAAA
aaagtgtaatggatgtggag

SEQ ID NO: 7499 - DNA, 20 bp, Artificial Sequence
  Description of Artificial Sequence: Synthetic oligonucleotide
  Target: ATXN1; (-) strand; PAM type: NNAGAAW; PAM sequence: TTAGAAT
ccattcctgagttacttcac

SEQ ID NO: 7500 - DNA, 20 bp, Artificial Sequence
  Description of Artificial Sequence: Synthetic oligonucleotide
  Target: ATXN1; (-) strand; PAM type: NNAGAAW; PAM sequence: AAAGAAT
agtttttgtcctgcgtccag

SEQ ID NO: 7501 - DNA, 20 bp, Artificial Sequence
  Description of Artificial Sequence: Synthetic oligonucleotide
  Target: ATXN1; (-) strand; PAM type: NNAGAAW; PAM sequence: CCAGAAA
cccaagtttttgtcctgcgt

SEQ ID NO: 7502 - DNA, 20 bp, Artificial Sequence
  Description of Artificial Sequence: Synthetic oligonucleotide
  Target: ATXN1; (-) strand; PAM type: NNAGAAW; PAM sequence: TTAGAAT
tgtccttgggagtcatttac

SEQ ID NO: 7503 - DNA, 20 bp, Artificial Sequence
  Description of Artificial Sequence: Synthetic oligonucleotide
  Target: ATXN1; (-) strand; PAM type: NNAGAAW; PAM sequence: ACAGAAT
gcttgaatcctgtttcagaa

SEQ ID NO: 7504 - DNA, 20 bp, Artificial Sequence
  Description of Artificial Sequence: Synthetic oligonucleotide
  Target: ATXN1; (-) strand; PAM type: NNAGAAW; PAM sequence: TCAGAAA
tgtcctgcttgaatcctgtt

SEQ ID NO: 7505 - DNA, 20 bp, Artificial Sequence
  Description of Artificial Sequence: Synthetic oligonucleotide
  Target: ATXN1; (-) strand; PAM type: NNAGAAW; PAM sequence: GTAGAAA
tttaaagagatctgaatgct

SEQ ID NO: 7506 - DNA, 20 bp, Artificial Sequence
  Description of Artificial Sequence: Synthetic oligonucleotide
  Target: ATXN1; (-) strand; PAM type: NNAGAAW; PAM sequence: TTAGAAT
actacagaaacattgaccat

SEQ ID NO: 7507 - DNA, 20 bp, Artificial Sequence
  Description of Artificial Sequence: Synthetic oligonucleotide
  Target: ATXN1; (-) strand; PAM type: NNAGAAW; PAM sequence: ACAGAAA
agagaatgattcctgacact

SEQ ID NO: 7508 - DNA, 20 bp, Artificial Sequence
  Description of Artificial Sequence: Synthetic oligonucleotide
  Target: ATXN1; (-) strand; PAM type: NNAGAAW; PAM sequence: AGAGAAT
caagaaggtgaagcattttc

SEQ ID NO: 7509 - DNA, 20 bp, Artificial Sequence
  Description of Artificial Sequence: Synthetic oligonucleotide
  Target: ATXN1; (-) strand; PAM type: NNAGAAW; PAM sequence: CAAGAAT
tggttaatgtgaggggaagg

SEQ ID NO: 7510 - DNA, 20 bp, Artificial Sequence
  Description of Artificial Sequence: Synthetic oligonucleotide
  Target: ATXN1; (-) strand; PAM type: NNAGAAW; PAM sequence: ATAGAAA
caacatccctatccatttaa

SEQ ID NO: 7511 - DNA, 20 bp, Artificial Sequence
  Description of Artificial Sequence: Synthetic oligonucleotide
  Target: ATXN1; (-) strand; PAM type: NNAGAAW; PAM sequence: AAAGAAT
atgttcacattatattctgc

SEQ ID NO: 7512 - DNA, 20 bp, Artificial Sequence
  Description of Artificial Sequence: Synthetic oligonucleotide
  Target: ATXN1; (-) strand; PAM type: NNAGAAW; PAM sequence: TGAGAAA
aaataacatgataagggatc

SEQ ID NO: 7513 - DNA, 20 bp, Artificial Sequence
  Description of Artificial Sequence: Synthetic oligonucleotide
  Target: ATXN1; (-) strand; PAM type: NNAGAAW; PAM sequence: CCAGAAA
tgtagtaagcaatcattttt

SEQ ID NO: 7514 - DNA, 20 bp, Artificial Sequence
  Description of Artificial Sequence: Synthetic oligonucleotide
  Target: ATXN1; (-) strand; PAM type: NNAGAAW; PAM sequence: GAAGAAA
tgccacggccttaggatgga

SEQ ID NO: 7515 - DNA, 20 bp, Artificial Sequence
  Description of Artificial Sequence: Synthetic oligonucleotide
  Target: ATXN1; (-) strand; PAM type: NNAGAAW; PAM sequence: GGAGAAT
gggggaagataggtgaaatt

SEQ ID NO: 7516 - DNA, 20 bp, Artificial Sequence
  Description of Artificial Sequence: Synthetic oligonucleotide
  Target: ATXN1; (-) strand; PAM type: NNAGAAW; PAM sequence: TGAGAAA
ccagcggaacatggattccc

SEQ ID NO: 7517 - DNA, 20 bp, Artificial Sequence
  Description of Artificial Sequence: Synthetic oligonucleotide
  Target: ATXN1; (-) strand; PAM type: NNAGAAW; PAM sequence: GGAGAAT
atactcgggaggctgaggca

SEQ ID NO: 7518 - DNA, 20 bp, Artificial Sequence
  Description of Artificial Sequence: Synthetic oligonucleotide
  Target: ATXN1; (-) strand; PAM type: NNAGAAW; PAM sequence: TGAGAAA
atgcctgggtccctggcaca

SEQ ID NO: 7519 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
atatatatatgaaaaaagaa

SEQ ID NO: 7520 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
aaatatatatatatatgaaa

SEQ ID NO: 7521 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
ctttgtctcaataagaaaaa

SEQ ID NO: 7522 - DNA, 20 bp, Artificial Sequence
  Description of Artificial Sequence: Synthetic oligonucleotide
  Target: ATXN1; (-) strand; PAM type: NNAGAAW; PAM sequence: TAAGAAA
agagtgagactttgtctcaa

SEQ ID NO: 7523 - DNA, 20 bp, Artificial Sequence
  Description of Artificial Sequence: Synthetic oligonucleotide
  Target: ATXN1; (-) strand; PAM type: NNAGAAW; PAM sequence: GAAGAAT
ctactcaggaggctgaggca

SEQ ID NO: 7524 - DNA, 20 bp, Artificial Sequence
  Description of Artificial Sequence: Synthetic oligonucleotide
  Target: ATXN1; (-) strand; PAM type: NNAGAAW; PAM sequence: GAAGAAA
tacagtatgaagaagaggaa

SEQ ID NO: 7525 - DNA, 20 bp, Artificial Sequence
  Description of Artificial Sequence: Synthetic oligonucleotide
  Target: ATXN1; (-) strand; PAM type: NNAGAAW; PAM sequence: GCAGAAA
acaggggaaaaaagaagtaa

SEQ ID NO: 7526 - DNA, 20 bp, Artificial Sequence
  Description of Artificial Sequence: Synthetic oligonucleotide
  Target: ATXN1; (-) strand; PAM type: NNAGAAW; PAM sequence: TCAGAAT
tctctgatgctgagaagaga

SEQ ID NO: 7527 - DNA, 20 bp, Artificial Sequence
  Description of Artificial Sequence: Synthetic oligonucleotide
  Target: ATXN1; (-) strand; PAM type: NNAGAAW; PAM sequence: TAAGAAA
tatcaccaaagcctcatagg

SEQ ID NO: 7528 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
tgagattgttcttaaaagtc

SEQ ID NO: 7529 - DNA, 20 bp, Artificial Sequence
  Description of Artificial Sequence: Synthetic oligonucleotide
  Target: ATXN1; (-) strand; PAM type: NNAGAAW; PAM sequence: ACAGAAT
agagagagagagagagagaa

SEQ ID NO: 7530 - DNA, 20 bp, Artificial Sequence
  Description of Artificial Sequence: Synthetic oligonucleotide
  Target: ATXN1; (-) strand; PAM type: NNAGAAW; PAM sequence: AGAGAAA
agagagagagagagagagag

SEQ ID NO: 7531 - DNA, 20 bp, Artificial Sequence
  Description of Artificial Sequence: Synthetic oligonucleotide
  Target: ATXN1; (-) strand; PAM type: NNAGAAW; PAM sequence: TCAGAAT
attgtatttccaggcatagg

SEQ ID NO: 7532 - DNA, 20 bp, Artificial Sequence
  Description of Artificial Sequence: Synthetic oligonucleotide
  Target: ATXN1; (-) strand; PAM type: NNAGAAW; PAM sequence: CAAGAAT
ttttgtttacttcatgtcaa

SEQ ID NO: 7533 - DNA, 20 bp, Artificial Sequence
  Description of Artificial Sequence: Synthetic oligonucleotide
  Target: ATXN1; (-) strand; PAM type: NNAGAAW; PAM sequence: GCAGAAA
taacattaccattccagaaa

SEQ ID NO: 7534 - DNA, 20 bp, Artificial Sequence
  Description of Artificial Sequence: Synthetic oligonucleotide
  Target: ATXN1; (-) strand; PAM type: NNAGAAW; PAM sequence: CCAGAAA
tagcctttaacattaccatt

SEQ ID NO: 7535 - DNA, 20 bp, Artificial Sequence
  Description of Artificial Sequence: Synthetic oligonucleotide
  Target: ATXN1; (-) strand; PAM type: NNAGAAW; PAM sequence: TCAGAAA
attatggtcactgcacaggc

SEQ ID NO: 7536 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
aaagaagaagaagtcaagcc

SEQ ID NO: 7537 - DNA, 20 bp, Artificial Sequence
  Description of Artificial Sequence: Synthetic oligonucleotide
  Target: ATXN1; (-) strand; PAM type: NNAGAAW; PAM sequence: TTAGAAA
agaaccttcatcatctatct

SEQ ID NO: 7538 - DNA, 20 bp, Artificial Sequence
  Description of Artificial Sequence: Synthetic oligonucleotide
  Target: ATXN1; (-) strand; PAM type: NNAGAAW; PAM sequence: TCAGAAA
agttggaagacctcagaggt

SEQ ID NO: 7539 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
atctaatgaacatagcagga

SEQ ID NO: 7540 - DNA, 20 bp, Artificial Sequence
  Description of Artificial Sequence: Synthetic oligonucleotide
  Target: ATXN1; (-) strand; PAM type: NNAGAAW; PAM sequence: GAAGAAA
caagttactttaacatagag

SEQ ID NO: 7541 - DNA, 20 bp, Artificial Sequence
  Description of Artificial Sequence: Synthetic oligonucleotide
  Target: ATXN1; (-) strand; PAM type: NNAGAAW; PAM sequence: TTAGAAA
atcattttccatttggatat

SEQ ID NO: 7542 - DNA, 20 bp, Artificial Sequence
  Description of Artificial Sequence: Synthetic oligonucleotide
  Target: ATXN1; (-) strand; PAM type: NNAGAAW; PAM sequence: GTAGAAT
tctgtgtgggttggagacta

SEQ ID NO: 7543 - DNA, 20 bp, Artificial Sequence
  Description of Artificial Sequence: Synthetic oligonucleotide
  Target: ATXN1; (-) strand; PAM type: NNAGAAW; PAM sequence: GGAGAAA
cagccatcctctgcagagct

SEQ ID NO: 7544 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
gatctttgattactattagc

SEQ ID NO: 7545 - DNA, 20 bp, Artificial Sequence
  Description of Artificial Sequence: Synthetic oligonucleotide
  Target: ATXN1; (-) strand; PAM type: NNAGAAW; PAM sequence: TTAGAAA
tcttagttgtgcattgtaca

SEQ ID NO: 7546 - DNA, 20 bp, Artificial Sequence
  Description of Artificial Sequence: Synthetic oligonucleotide
  Target: ATXN1; (-) strand; PAM type: NNAGAAW; PAM sequence: TCAGAAA
gatcacactttatttttata

SEQ ID NO: 7547 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
agatatatgtgagctttaaa

SEQ ID NO: 7548 - DNA, 20 bp, Artificial Sequence
  Description of Artificial Sequence: Synthetic oligonucleotide
  Target: ATXN1; (-) strand; PAM type: NNAGAAW; PAM sequence: TCAGAAT
actgattcaaaattatatat

SEQ ID NO: 7549 - DNA, 20 bp, Artificial Sequence
  Description of Artificial Sequence: Synthetic oligonucleotide
  Target: ATXN1; (-) strand; PAM type: NNAGAAW; PAM sequence: CTAGAAT
cgacatcccaggcatggctc

SEQ ID NO: 7550 - DNA, 20 bp, Artificial Sequence
  Description of Artificial Sequence: Synthetic oligonucleotide
  Target: ATXN1; (-) strand; PAM type: NNAGAAW; PAM sequence: GGAGAAA
cctcactcattcacatgctt

SEQ ID NO: 7551 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
accctgtctcggctcaaaaa

SEQ ID NO: 7552 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
atccagtagagaaagaagtc

SEQ ID NO: 7553 - DNA, 20 bp, Artificial Sequence
  Description of Artificial Sequence: Synthetic oligonucleotide
  Target: ATXN1; (-) strand; PAM type: NNAGAAW; PAM sequence: AGAGAAA
acaataacacatgatccagt

SEQ ID NO: 7554 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
ccctgggtttaatcacacat

SEQ ID NO: 7555 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
atattccttcctgttttata

SEQ ID NO: 7556 - DNA, 20 bp, Artificial Sequence
  Description of Artificial Sequence: Synthetic oligonucleotide
  Target: ATXN1; (-) strand; PAM type: NNAGAAW; PAM sequence: TCAGAAA
atatgtgggcccttggcatt

SEQ ID NO: 7557 - DNA, 20 bp, Artificial Sequence
  Description of Artificial Sequence: Synthetic oligonucleotide
  Target: ATXN1; (-) strand; PAM type: NNAGAAW; PAM sequence: CCAGAAA
caacatggcctgggacatcc

SEQ ID NO: 7558 - DNA, 20 bp, Artificial Sequence
  Description of Artificial Sequence: Synthetic oligonucleotide
  Target: ATXN1; (-) strand; PAM type: NNAGAAW; PAM sequence: ATAGAAT
atggtttcagactttcagga

SEQ ID NO: 7559 - DNA, 20 bp, Artificial Sequence
  Description of Artificial Sequence: Synthetic oligonucleotide
  Target: ATXN1; (-) strand; PAM type: NNAGAAW; PAM sequence: TAAGAAT
ccattgaaccataatcaatg

SEQ ID NO: 7560 - DNA, 20 bp, Artificial Sequence
  Description of Artificial Sequence: Synthetic oligonucleotide
  Target: ATXN1; (-) strand; PAM type: NNAGAAW; PAM sequence: GGAGAAA
ggtggccaggacgtttatac

SEQ ID NO: 7561 - DNA, 20 bp, Artificial Sequence
  Description of Artificial Sequence: Synthetic oligonucleotide
  Target: ATXN1; (-) strand; PAM type: NNAGAAW; PAM sequence: CAAGAAA
tggaaaaactaagacccaaa

SEQ ID NO: 7562 - DNA, 20 bp, Artificial Sequence
  Description of Artificial Sequence: Synthetic oligonucleotide
  Target: ATXN1; (-) strand; PAM type: NNAGAAW; PAM sequence: ATAGAAA
ttaatatgcccgtgaagcag

SEQ ID NO: 7563 - DNA, 20 bp, Artificial Sequence
  Description of Artificial Sequence: Synthetic oligonucleotide
  Target: ATXN1; (-) strand; PAM type: NNAGAAW; PAM sequence: AGAGAAA
gtcttacatggcagcaggca

SEQ ID NO: 7564 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
cccaagcctaggtaatttat

SEQ ID NO: 7565 - DNA, 20 bp, Artificial Sequence
  Description of Artificial Sequence: Synthetic oligonucleotide
  Target: ATXN1; (-) strand; PAM type: NNAGAAW; PAM sequence: GGAGAAA
agagttcatatggaagtaga

SEQ ID NO: 7566 - DNA, 20 bp, Artificial Sequence
  Description of Artificial Sequence: Synthetic oligonucleotide
  Target: ATXN1; (-) strand; PAM type: NNAGAAW; PAM sequence: CAAGAAA
gcaggttatcattatgaatc

SEQ ID NO: 7567 - DNA, 20 bp, Artificial Sequence
  Description of Artificial Sequence: Synthetic oligonucleotide
  Target: ATXN1; (-) strand; PAM type: NNAGAAW; PAM sequence: TCAGAAT
tcagatgtatttctcttctt

SEQ ID NO: 7568 - DNA, 20 bp, Artificial Sequence
  Description of Artificial Sequence: Synthetic oligonucleotide
  Target: ATXN1; (-) strand; PAM type: NNAGAAW; PAM sequence: TAAGAAT
ctcttgtccttggaaaactg

SEQ ID NO: 7569 - DNA, 20 bp, Artificial Sequence
  Description of Artificial Sequence: Synthetic oligonucleotide
  Target: ATXN1; (-) strand; PAM type: NNAGAAW; PAM sequence: ACAGAAT
caattctcatttgcatgcct

SEQ ID NO: 7570 - DNA, 20 bp, Artificial Sequence
  Description of Artificial Sequence: Synthetic oligonucleotide
  Target: ATXN1; (-) strand; PAM type: NNAGAAW; PAM sequence: GCAGAAT
gctgtctttgctgggagagg

SEQ ID NO: 7571 - DNA, 20 bp, Artificial Sequence
  Description of Artificial Sequence: Synthetic oligonucleotide
  Target: ATXN1; (-) strand; PAM type: NNAGAAW; PAM sequence: CCAGAAA
aagggttccatctaggtccc

SEQ ID NO: 7572 - DNA, 20 bp, Artificial Sequence
  Description of Artificial Sequence: Synthetic oligonucleotide
  Target: ATXN1; (-) strand; PAM type: NNAGAAW; PAM sequence: GCAGAAA
ttgtaggcttatgtaaccat

SEQ ID NO: 7573 - DNA, 20 bp, Artificial Sequence
  Description of Artificial Sequence: Synthetic oligonucleotide
  Target: ATXN1; (-) strand; PAM type: NNAGAAW; PAM sequence: GAAGAAT
agatttcatgagaaccgcat

SEQ ID NO: 7574 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
ttcagatatgctgtgggtac

SEQ ID NO: 7575 - DNA, 20 bp, Artificial Sequence
  Description of Artificial Sequence: Synthetic oligonucleotide
  Target: ATXN1; (-) strand; PAM type: NNAGAAW; PAM sequence: GCAGAAA
cataatttgcctctgccttt

SEQ ID NO: 7576 - DNA, 20 bp, Artificial Sequence
  Description of Artificial Sequence: Synthetic oligonucleotide
  Target: ATXN1; (-) strand; PAM type: NNAGAAW; PAM sequence: TCAGAAA
gtttgtcaactattcaagtg

SEQ ID NO: 7577 - DNA, 20 bp, Artificial Sequence
  Description of Artificial Sequence: Synthetic oligonucleotide
  Target: ATXN1; (-) strand; PAM type: NNAGAAW; PAM sequence: GTAGAAT
tgtttttttgagtccaaaaa

SEQ ID NO: 7578 - DNA, 20 bp, Artificial Sequence
  Description of Artificial Sequence: Synthetic oligonucleotide
  Target: ATXN1; (-) strand; PAM type: NNAGAAW; PAM sequence: CAAGAAT
tttgtatactccttaccttt

SEQ ID NO: 7579 - DNA, 20 bp, Artificial Sequence
  Description of Artificial Sequence: Synthetic oligonucleotide
  Target: ATXN1; (-) strand; PAM type: NNAGAAW; PAM sequence: ACAGAAA
ataccgtaaacttataaaca

SEQ ID NO: 7580 - DNA, 20 bp, Artificial Sequence
  Description of Artificial Sequence: Synthetic oligonucleotide
  Target: ATXN1; (-) strand; PAM type: NNAGAAW; PAM sequence: ACAGAAA
aaactctgtacattcttcac

SEQ ID NO: 7581 - DNA, 20 bp, Artificial Sequence
  Description of Artificial Sequence: Synthetic oligonucleotide
  Target: ATXN1; (-) strand; PAM type: NNAGAAW; PAM sequence: GAAGAAT
tagaacttggccagagcttt

SEQ ID NO: 7582 - DNA, 20 bp, Artificial Sequence
  Description of Artificial Sequence: Synthetic oligonucleotide
  Target: ATXN1; (-) strand; PAM type: NNAGAAW; PAM sequence: CAAGAAT
gttagcaagtaaggcacgtg

SEQ ID NO: 7583 - DNA, 20 bp, Artificial Sequence
  Description of Artificial Sequence: Synthetic oligonucleotide
  Target: ATXN1; (-) strand; PAM type: NNAGAAW; PAM sequence: AAAGAAT
gtgggcctaacgcctatctg

SEQ ID NO: 7584 - DNA, 20 bp, Artificial Sequence
  Description of Artificial Sequence: Synthetic oligonucleotide
  Target: ATXN1; (-) strand; PAM type: NNAGAAW; PAM sequence: ATAGAAT
gtaatggaagagcactgttc

SEQ ID NO: 7585 - DNA, 20 bp, Artificial Sequence
  Description of Artificial Sequence: Synthetic oligonucleotide
  Target: ATXN1; (-) strand; PAM type: NNAGAAW; PAM sequence: TTAGAAT
ccattcttgagttacttcac

SEQ ID NO: 7586 - DNA, 20 bp, Artificial Sequence
  Description of Artificial Sequence: Synthetic oligonucleotide
  Target: ATXN1; (-) strand; PAM type: NNAGAAW; PAM sequence: ATAGAAT
gtcatggaggacacaaagga

SEQ ID NO: 7587 - DNA, 20 bp, Artificial Sequence
  Description of Artificial Sequence: Synthetic oligonucleotide
  Target: ATXN1; (-) strand; PAM type: NNAGAAW; PAM sequence: AGAGAAA
accaattcattgcccttggg

SEQ ID NO: 7588 - DNA, 20 bp, Artificial Sequence
  Description of Artificial Sequence: Synthetic oligonucleotide
  Target: ATXN1; (-) strand; PAM type: NNAGAAW; PAM sequence: GAAGAAA
gcatgttgaggacctccttt

SEQ ID NO: 7589 - DNA, 20 bp, Artificial Sequence
  Description of Artificial Sequence: Synthetic oligonucleotide
  Target: ATXN1; (-) strand; PAM type: NNAGAAW; PAM sequence: AGAGAAT
ttctgaagaggcctggaacc

SEQ ID NO: 7590 - DNA, 20 bp, Artificial Sequence
  Description of Artificial Sequence: Synthetic oligonucleotide
  Target: ATXN1; (-) strand; PAM type: NNAGAAW; PAM sequence: CAAGAAT
aatccagacacaggaactca

SEQ ID NO: 7591 - DNA, 20 bp, Artificial Sequence
  Description of Artificial Sequence: Synthetic oligonucleotide
  Target: ATXN1; (-) strand; PAM type: NNAGAAW; PAM sequence: ACAGAAA
ctccctaaaagagcctaaac

SEQ ID NO: 7592 - DNA, 20 bp, Artificial Sequence
  Description of Artificial Sequence: Synthetic oligonucleotide
  Target: ATXN1; (-) strand; PAM type: NNAGAAW; PAM sequence: GCAGAAA
gcacatttgaatgcgcgtgt

SEQ ID NO: 7593 - DNA, 20 bp, Artificial Sequence
  Description of Artificial Sequence: Synthetic oligonucleotide
  Target: ATXN1; (-) strand; PAM type: NNAGAAW; PAM sequence: ACAGAAT
caatatataaatttggaggg

SEQ ID NO: 7594 - DNA, 20 bp, Artificial Sequence
  Description of Artificial Sequence: Synthetic oligonucleotide
  Target: ATXN1; (-) strand; PAM type: NNAGAAW; PAM sequence: CCAGAAA
agggctgccattacaaagtg

SEQ ID NO: 7595 - DNA, 20 bp, Artificial Sequence
  Description of Artificial Sequence: Synthetic oligonucleotide
  Target: ATXN1; (-) strand; PAM type: NNAGAAW; PAM sequence: TGAGAAA
atctaccaaacgtagatacc

SEQ ID NO: 7596 - DNA, 20 bp, Artificial Sequence
  Description of Artificial Sequence: Synthetic oligonucleotide
  Target: ATXN1; (-) strand; PAM type: NNAGAAW; PAM sequence: ATAGAAA
aaatgtagacatacatcagt

SEQ ID NO: 7597 - DNA, 20 bp, Artificial Sequence
  Description of Artificial Sequence: Synthetic oligonucleotide
  Target: ATXN1; (-) strand; PAM type: NNAGAAW; PAM sequence: GTAGAAT
gaattattaatttgttttgg

SEQ ID NO: 7598 - DNA, 20 bp, Artificial Sequence
  Description of Artificial Sequence: Synthetic oligonucleotide
  Target: ATXN1; (-) strand; PAM type: NNAGAAW; PAM sequence: TCAGAAA
gcttgctattccttgtgagg

SEQ ID NO: 7599 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
tataaaatgttccatgaatt

SEQ ID NO: 7600 - DNA, 20 bp, Artificial Sequence
  Description of Artificial Sequence: Synthetic oligonucleotide
  Target: ATXN1; (-) strand; PAM type: NNAGAAW; PAM sequence: TAAGAAT
gggaagggcaacttatattt

SEQ ID NO: 7601 - DNA, 20 bp, Artificial Sequence
  Description of Artificial Sequence: Synthetic oligonucleotide
  Target: ATXN1; (-) strand; PAM type: NNAGAAW; PAM sequence: ACAGAAA
gcatgatctaatgaccacaa

SEQ ID NO: 7602 - DNA, 20 bp, Artificial Sequence
  Description of Artificial Sequence: Synthetic oligonucleotide
  Target: ATXN1; (-) strand; PAM type: NNAGAAW; PAM sequence: GCAGAAA
cattccatcatccctttggg

SEQ ID NO: 7603 - DNA, 20 bp, Artificial Sequence
  Description of Artificial Sequence: Synthetic oligonucleotide
  Target: ATXN1; (-) strand; PAM type: NNAGAAW; PAM sequence: ATAGAAT
ggctttcctggatgtgcaaa

SEQ ID NO: 7604 - DNA, 20 bp, Artificial Sequence
  Description of Artificial Sequence: Synthetic oligonucleotide
  Target: ATXN1; (-) strand; PAM type: NNAGAAW; PAM sequence: AGAGAAA
tgtggatccatggagaagtc

SEQ ID NO: 7605 - DNA, 20 bp, Artificial Sequence
  Description of Artificial Sequence: Synthetic oligonucleotide
  Target: ATXN1; (-) strand; PAM type: NNAGAAW; PAM sequence: GGAGAAA
actatcatgagaacagagag

SEQ ID NO: 7606 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
cctgagactggataatgtgt

SEQ ID NO: 7607 - DNA, 20 bp, Artificial Sequence
  Description of Artificial Sequence: Synthetic oligonucleotide
  Target: ATXN1; (-) strand; PAM type: NNAGAAW; PAM sequence: TTAGAAA
cgagaaattaaggcactgag

SEQ ID NO: 7608 - DNA, 20 bp, Artificial Sequence
  Description of Artificial Sequence: Synthetic oligonucleotide
  Target: ATXN1; (-) strand; PAM type: NNAGAAW; PAM sequence: CGAGAAA
actttatcctagaagtaaaa

SEQ ID NO: 7609 - DNA, 20 bp, Artificial Sequence
  Description of Artificial Sequence: Synthetic oligonucleotide
  Target: ATXN1; (-) strand; PAM type: NNAGAAW; PAM sequence: AGAGAAA
aaaatattgatatgttagat

SEQ ID NO: 7610 - DNA, 20 bp, Artificial Sequence
  Description of Artificial Sequence: Synthetic oligonucleotide
  Target: ATXN1; (-) strand; PAM type: NNAGAAW; PAM sequence: TCAGAAA
gtagtaagccaaacctgtaa

SEQ ID NO: 7611 - DNA, 20 bp, Artificial Sequence
  Description of Artificial Sequence: Synthetic oligonucleotide
  Target: ATXN1; (-) strand; PAM type: NNAGAAW; PAM sequence: TCAGAAA
tgtttgagattagcacgtta

SEQ ID NO: 7612 - DNA, 20 bp, Artificial Sequence
  Description of Artificial Sequence: Synthetic oligonucleotide
  Target: ATXN1; (-) strand; PAM type: NNAGAAW; PAM sequence: AGAGAAA
cactgtagccctgtatcagg

SEQ ID NO: 7613 - DNA, 20 bp, Artificial Sequence
  Description of Artificial Sequence: Synthetic oligonucleotide
  Target: ATXN1; (-) strand; PAM type: NNAGAAW; PAM sequence: CTAGAAA
ccccaagcatctatctctac

SEQ ID NO: 7614 - DNA, 20 bp, Artificial Sequence
  Description of Artificial Sequence: Synthetic oligonucleotide
  Target: ATXN1; (-) strand; PAM type: NNAGAAW; PAM sequence: GCAGAAT
atgttgtcatctcaggaagg

SEQ ID NO: 7615 - DNA, 20 bp, Artificial Sequence
  Description of Artificial Sequence: Synthetic oligonucleotide
  Target: ATXN1; (-) strand; PAM type: NNAGAAW; PAM sequence: TCAGAAT
tggtggccttgtgcagcaga

SEQ ID NO: 7616 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
aagacacagtccttgtcctc

SEQ ID NO: 7617 - DNA, 20 bp, Artificial Sequence
  Description of Artificial Sequence: Synthetic oligonucleotide
  Target: ATXN1; (-) strand; PAM type: NNAGAAW; PAM sequence: TGAGAAT
agggtaacccctgccttgtt

SEQ ID NO: 7618 - DNA, 20 bp, Artificial Sequence
  Description of Artificial Sequence: Synthetic oligonucleotide
  Target: ATXN1; (-) strand; PAM type: NNAGAAW; PAM sequence: TCAGAAT
ttccaagttgttttaaggat

SEQ ID NO: 7619 - DNA, 20 bp, Artificial Sequence
  Description of Artificial Sequence: Synthetic oligonucleotide
  Target: ATXN1; (-) strand; PAM type: NNAGAAW; PAM sequence: GAAGAAT
ttcgatattttatgtggaag

SEQ ID NO: 7620 - DNA, 20 bp, Artificial Sequence
  Description of Artificial Sequence: Synthetic oligonucleotide
  Target: ATXN1; (-) strand; PAM type: NNAGAAW; PAM sequence: GAAGAAT
aatttcatgtgtttttatgt

SEQ ID NO: 7621 - DNA, 20 bp, Artificial Sequence
  Description of Artificial Sequence: Synthetic oligonucleotide
  Target: ATXN1; (-) strand; PAM type: NNAGAAW; PAM sequence: AGAGAAA
cagacaatctagtgctactc

SEQ ID NO: 7622 - DNA, 20 bp, Artificial Sequence
  Description of Artificial Sequence: Synthetic oligonucleotide
  Target: ATXN1; (-) strand; PAM type: NNAGAAW; PAM sequence: GCAGAAT
aatacactttatttgacgta

SEQ ID NO: 7623 - DNA, 20 bp, Artificial Sequence
  Description of Artificial Sequence: Synthetic oligonucleotide
  Target: ATXN1; (-) strand; PAM type: NNAGAAW; PAM sequence: ATAGAAA
atatggtccataaaatgctg

SEQ ID NO: 7624 - DNA, 20 bp, Artificial Sequence
  Description of Artificial Sequence: Synthetic oligonucleotide
  Target: ATXN1; (-) strand; PAM type: NNAGAAW; PAM sequence: TGAGAAT
gtaacccatgagcagaggca

SEQ ID NO: 7625 - DNA, 20 bp, Artificial Sequence
  Description of Artificial Sequence: Synthetic oligonucleotide
  Target: ATXN1; (-) strand; PAM type: NNAGAAW; PAM sequence: TTAGAAA
aggatgcagagacccttgga

SEQ ID NO: 7626 - DNA, 20 bp, Artificial Sequence
  Description of Artificial Sequence: Synthetic oligonucleotide
  Target: ATXN1; (-) strand; PAM type: NNAGAAW; PAM sequence: ATAGAAA
ggcagtataaacaaagtaaa

SEQ ID NO: 7627 - DNA, 20 bp, Artificial Sequence
  Description of Artificial Sequence: Synthetic oligonucleotide
  Target: ATXN1; (-) strand; PAM type: NNAGAAW; PAM sequence: CAAGAAA
gtcttacagcctaaagaaga

SEQ ID NO: 7628 - DNA, 20 bp, Artificial Sequence
  Description of Artificial Sequence: Synthetic oligonucleotide
  Target: ATXN1; (-) strand; PAM type: NNAGAAW; PAM sequence: TCAGAAA
tgaaaggattgtcgataagt

SEQ ID NO: 7629 - DNA, 20 bp, Artificial Sequence
  Description of Artificial Sequence: Synthetic oligonucleotide
  Target: ATXN1; (-) strand; PAM type: NNAGAAW; PAM sequence: TGAGAAT
aaaacatcagcattcagagg

SEQ ID NO: 7630 - DNA, 20 bp, Artificial Sequence
  Description of Artificial Sequence: Synthetic oligonucleotide
  Target: ATXN1; (-) strand; PAM type: NNAGAAW; PAM sequence: AGAGAAA
caaaggcagtgcagtgtatg

SEQ ID NO: 7631 - DNA, 20 bp, Artificial Sequence
  Description of Artificial Sequence: Synthetic oligonucleotide
  Target: ATXN1; (-) strand; PAM type: NNAGAAW; PAM sequence: GTAGAAA
gatagataagccaaatggag

SEQ ID NO: 7632 - DNA, 20 bp, Artificial Sequence
  Description of Artificial Sequence: Synthetic oligonucleotide
  Target: ATXN1; (-) strand; PAM type: NNAGAAW; PAM sequence: TGAGAAT
cattagagactgcaaatgtc

SEQ ID NO: 7633 - DNA, 20 bp, Artificial Sequence
  Description of Artificial Sequence: Synthetic oligonucleotide
  Target: ATXN1; (-) strand; PAM type: NNAGAAW; PAM sequence: CCAGAAA
accattacctgtgcactggc

SEQ ID NO: 7634 - DNA, 20 bp, Artificial Sequence
  Description of Artificial Sequence: Synthetic oligonucleotide
  Target: ATXN1; (-) strand; PAM type: NNAGAAW; PAM sequence: TCAGAAT
tggatcccaaacctaactga

SEQ ID NO: 7635 - DNA, 20 bp, Artificial Sequence
  Description of Artificial Sequence: Synthetic oligonucleotide
  Target: ATXN1; (-) strand; PAM type: NNAGAAW; PAM sequence: TTAGAAA
cacagagaaacatgttattt

SEQ ID NO: 7636 - DNA, 20 bp, Artificial Sequence
  Description of Artificial Sequence: Synthetic oligonucleotide
  Target: ATXN1; (-) strand; PAM type: NNAGAAW; PAM sequence: AGAGAAA
acttaaatttcctccgtcac

SEQ ID NO: 7637 - DNA, 20 bp, Artificial Sequence
  Description of Artificial Sequence: Synthetic oligonucleotide
  Target: ATXN1; (-) strand; PAM type: NNAGAAW; PAM sequence: GAAGAAA
cacttaaactgatatcctct

SEQ ID NO: 7638 - DNA, 20 bp, Artificial Sequence
  Description of Artificial Sequence: Synthetic oligonucleotide
  Target: ATXN1; (-) strand; PAM type: NNAGAAW; PAM sequence: AGAGAAA
ggctgctgggctttgagggc

SEQ ID NO: 7639 - DNA, 20 bp, Artificial Sequence
  Description of Artificial Sequence: Synthetic oligonucleotide
  Target: ATXN1; (-) strand; PAM type: NNAGAAW; PAM sequence: CCAGAAA
ctgactgctggatttttgct

SEQ ID NO: 7640 - DNA, 20 bp, Artificial Sequence
  Description of Artificial Sequence: Synthetic oligonucleotide
  Target: ATXN1; (-) strand; PAM type: NNAGAAW; PAM sequence: TTAGAAA
ggggagaaaatcaggccact

SEQ ID NO: 7641 - DNA, 20 bp, Artificial Sequence
  Description of Artificial Sequence: Synthetic oligonucleotide
  Target: ATXN1; (-) strand; PAM type: NNAGAAW; PAM sequence: GGAGAAA
tccaggatcctaacaggagg

SEQ ID NO: 7642 - DNA, 20 bp, Artificial Sequence
  Description of Artificial Sequence: Synthetic oligonucleotide
  Target: ATXN1; (-) strand; PAM type: NNAGAAW; PAM sequence: AAAGAAT
aactccatctcaaaaaaaaa

SEQ ID NO: 7643 - DNA, 20 bp, Artificial Sequence
  Description of Artificial Sequence: Synthetic oligonucleotide
  Target: ATXN1; (-) strand; PAM type: NNAGAAW; PAM sequence: GGAGAAT
ctactcaggaggctgaggca

SEQ ID NO: 7644 - DNA, 20 bp, Artificial Sequence
  Description of Artificial Sequence: Synthetic oligonucleotide
  Target: ATXN1; (-) strand; PAM type: NNAGAAW; PAM sequence: AAAGAAT
tgtcttgtgagtttagagat

SEQ ID NO: 7645 - DNA, 20 bp, Artificial Sequence
  Description of Artificial Sequence: Synthetic oligonucleotide
  Target: ATXN1; (-) strand; PAM type: NNAGAAW; PAM sequence: CAAGAAT
acacagattgctggaaagcc

SEQ ID NO: 7646 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
gaaggtcttgaaacttctta

SEQ ID NO: 7647 - DNA, 20 bp, Artificial Sequence
  Description of Artificial Sequence: Synthetic oligonucleotide
  Target: ATXN1; (-) strand; PAM type: NNAGAAW; PAM sequence: TGAGAAA
atgtgatctgttagtgggtc

SEQ ID NO: 7648 - DNA, 20 bp, Artificial Sequence
  Description of Artificial Sequence: Synthetic oligonucleotide
  Target: ATXN1; (-) strand; PAM type: NNAGAAW; PAM sequence: CCAGAAA
cagtgagctatggatgtaac

SEQ ID NO: 7649 - DNA, 20 bp, Artificial Sequence
  Description of Artificial Sequence: Synthetic oligonucleotide
  Target: ATXN1; (-) strand; PAM type: NNAGAAW; PAM sequence: TTAGAAT
aaaaaaaaggtgattccatg

SEQ ID NO: 7650 - DNA, 20 bp, Artificial Sequence
  Description of Artificial Sequence: Synthetic oligonucleotide
  Target: ATXN1; (-) strand; PAM type: NNAGAAW; PAM sequence: ACAGAAA
ttaaagaagtgtcttagacc

SEQ ID NO: 7651 - DNA, 20 bp, Artificial Sequence
  Description of Artificial Sequence: Synthetic oligonucleotide
  Target: ATXN1; (-) strand; PAM type: NNAGAAW; PAM sequence: TCAGAAT
aagccaaagaaaccagtatt

SEQ ID NO: 7652 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
aatcaacaggtctaaaagcc

SEQ ID NO: 7653 - DNA, 20 bp, Artificial Sequence
  Description of Artificial Sequence: Synthetic oligonucleotide
  Target: ATXN1; (-) strand; PAM type: NNAGAAW; PAM sequence: CTAGAAA
aattttaaaatgaaaacatt

SEQ ID NO: 7654 - DNA, 20 bp, Artificial Sequence
  Description of Artificial Sequence: Synthetic oligonucleotide
  Target: ATXN1; (-) strand; PAM type: NNAGAAW; PAM sequence: TAAGAAA
catactctagcccataaata

SEQ ID NO: 7655 - DNA, 20 bp, Artificial Sequence
  Description of Artificial Sequence: Synthetic oligonucleotide
  Target: ATXN1; (-) strand; PAM type: NNAGAAW; PAM sequence: GCAGAAA
ttggtccttaagagaagact

SEQ ID NO: 7656 - DNA, 20 bp, Artificial Sequence
  Description of Artificial Sequence: Synthetic oligonucleotide
  Target: ATXN1; (-) strand; PAM type: NNAGAAW; PAM sequence: TAAGAAA
ctactgcatatctctttggc

SEQ ID NO: 7657 - DNA, 20 bp, Artificial Sequence
  Description of Artificial Sequence: Synthetic oligonucleotide
  Target: ATXN1; (-) strand; PAM type: NNAGAAW; PAM sequence: GTAGAAA
agctacagcatcagtaggca

SEQ ID NO: 7658 - DNA, 20 bp, Artificial Sequence
  Description of Artificial Sequence: Synthetic oligonucleotide
  Target: ATXN1; (-) strand; PAM type: NNAGAAW; PAM sequence: GTAGAAA
ctacagttaatttcttatag

SEQ ID NO: 7659 - DNA, 20 bp, Artificial Sequence
  Description of Artificial Sequence: Synthetic oligonucleotide
  Target: ATXN1; (-) strand; PAM type: NNAGAAW; PAM sequence: GTAGAAA
tattctataagcttgttttt

SEQ ID NO: 7660 - DNA, 20 bp, Artificial Sequence
  Description of Artificial Sequence: Synthetic oligonucleotide
  Target: ATXN1; (-) strand; PAM type: NNAGAAW; PAM sequence: CAAGAAT
aaacacattttacagctgta

SEQ ID NO: 7661 - DNA, 20 bp, Artificial Sequence
  Description of Artificial Sequence: Synthetic oligonucleotide
  Target: ATXN1; (-) strand; PAM type: NNAGAAW; PAM sequence: GTAGAAA
ataggtacagtaaaaatgaa

SEQ ID NO: 7662 - DNA, 20 bp, Artificial Sequence
  Description of Artificial Sequence: Synthetic oligonucleotide
  Target: ATXN1; (-) strand; PAM type: NNAGAAW; PAM sequence: ATAGAAT
tagtttttgtgcatctagac

SEQ ID NO: 7663 - DNA, 20 bp, Artificial Sequence
  Description of Artificial Sequence: Synthetic oligonucleotide
  Target: ATXN1; (-) strand; PAM type: NNAGAAW; PAM sequence: TGAGAAA
ttaataatgggaatgcattc

SEQ ID NO: 7664 - DNA, 20 bp, Artificial Sequence
  Description of Artificial Sequence: Synthetic oligonucleotide
  Target: ATXN1; (-) strand; PAM type: NNAGAAW; PAM sequence: GGAGAAT
ctactcgggaggctgaagca

SEQ ID NO: 7665 - DNA, 20 bp, Artificial Sequence
  Description of Artificial Sequence: Synthetic oligonucleotide
  Target: ATXN1; (-) strand; PAM type: NNAGAAW; PAM sequence: TAAGAAA
tcccctagttctatttcact

SEQ ID NO: 7666 - DNA, 20 bp, Artificial Sequence
  Description of Artificial Sequence: Synthetic oligonucleotide
  Target: ATXN1; (-) strand; PAM type: NNAGAAW; PAM sequence: AAAGAAT
aataacctgtggtaaagtct

SEQ ID NO: 7667 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
ttcaactttttctgaaagcc

SEQ ID NO: 7668 - DNA, 20 bp, Artificial Sequence
  Description of Artificial Sequence: Synthetic oligonucleotide
  Target: ATXN1; (-) strand; PAM type: NNAGAAW; PAM sequence: TGAGAAA
gttagttctgcttaatgtgt

SEQ ID NO: 7669 - DNA, 20 bp, Artificial Sequence
  Description of Artificial Sequence: Synthetic oligonucleotide
  Target: ATXN1; (-) strand; PAM type: NNAGAAW; PAM sequence: TAAGAAT
agtaattcactagtgacctc

SEQ ID NO: 7670 - DNA, 20 bp, Artificial Sequence
  Description of Artificial Sequence: Synthetic oligonucleotide
  Target: ATXN1; (-) strand; PAM type: NNAGAAW; PAM sequence: CAAGAAA
acagcagggaaagtcctttc

SEQ ID NO: 7671 - DNA, 20 bp, Artificial Sequence
  Description of Artificial Sequence: Synthetic oligonucleotide
  Target: ATXN1; (-) strand; PAM type: NNAGAAW; PAM sequence: TGAGAAA
atttctgtctttagaaatgt

SEQ ID NO: 7672 - DNA, 20 bp, Artificial Sequence
  Description of Artificial Sequence: Synthetic oligonucleotide
  Target: ATXN1; (-) strand; PAM type: NNAGAAW; PAM sequence: TTAGAAA
tcttttcgctatttctgtct

SEQ ID NO: 7673 - DNA, 20 bp, Artificial Sequence
  Description of Artificial Sequence: Synthetic oligonucleotide
  Target: ATXN1; (-) strand; PAM type: NNAGAAW; PAM sequence: GCAGAAA
ttgtcttctagaaccatgag

SEQ ID NO: 7674 - DNA, 20 bp, Artificial Sequence
  Description of Artificial Sequence: Synthetic oligonucleotide
  Target: ATXN1; (-) strand; PAM type: NNAGAAW; PAM sequence: GGAGAAT
tgagagccagagggttagaa

SEQ ID NO: 7675 - DNA, 20 bp, Artificial Sequence
  Description of Artificial Sequence: Synthetic oligonucleotide
  Target: ATXN1; (-) strand; PAM type: NNAGAAW; PAM sequence: GGAGAAA
tggaggtgtcccgtgcattg

SEQ ID NO: 7676 - DNA, 20 bp, Artificial Sequence
  Description of Artificial Sequence: Synthetic oligonucleotide
  Target: ATXN1; (-) strand; PAM type: NNAGAAW; PAM sequence: AGAGAAT
aaggttacagtctgggttgg

SEQ ID NO: 7677 - DNA, 20 bp, Artificial Sequence
  Description of Artificial Sequence: Synthetic oligonucleotide
  Target: ATXN1; (-) strand; PAM type: NNAGAAW; PAM sequence: GGAGAAA
ctccacctcagagggctgta

SEQ ID NO: 7678 - DNA, 20 bp, Artificial Sequence
  Description of Artificial Sequence: Synthetic oligonucleotide
  Target: ATXN1; (-) strand; PAM type: NNAGAAW; PAM sequence: GGAGAAT
atgtcatccacatagtcact

SEQ ID NO: 7679 - DNA, 20 bp, Artificial Sequence
  Description of Artificial Sequence: Synthetic oligonucleotide
  Target: ATXN1; (-) strand; PAM type: NNAGAAW; PAM sequence: GTAGAAA
ggaatgtggttgttgccact

SEQ ID NO: 7680 - DNA, 20 bp, Artificial Sequence
  Description of Artificial Sequence: Synthetic oligonucleotide
  Target: ATXN1; (-) strand; PAM type: NNAGAAW; PAM sequence: CTAGAAA
atataatatcagagtaagtc

SEQ ID NO: 7681 - DNA, 20 bp, Artificial Sequence
  Description of Artificial Sequence: Synthetic oligonucleotide
  Target: ATXN1; (-) strand; PAM type: NNAGAAW; PAM sequence: TTAGAAA
ccaggtttcaaggatgagtt

SEQ ID NO: 7682 - DNA, 20 bp, Artificial Sequence
  Description of Artificial Sequence: Synthetic oligonucleotide
  Target: ATXN1; (-) strand; PAM type: NNAGAAW; PAM sequence: TAAGAAA
aaatgtagcagcctgagatt

SEQ ID NO: 7683 - DNA, 20 bp, Artificial Sequence
  Description of Artificial Sequence: Synthetic oligonucleotide
  Target: ATXN1; (-) strand; PAM type: NNAGAAW; PAM sequence: TGAGAAA
ggactaatacgactggtggt

SEQ ID NO: 7684 - DNA, 20 bp, Artificial Sequence
  Description of Artificial Sequence: Synthetic oligonucleotide
  Target: ATXN1; (-) strand; PAM type: NNAGAAW; PAM sequence: AGAGAAA
tcaaatatattctgagttct

SEQ ID NO: 7685 - DNA, 20 bp, Artificial Sequence
  Description of Artificial Sequence: Synthetic oligonucleotide
  Target: ATXN1; (-) strand; PAM type: NNAGAAW; PAM sequence: TTAGAAA
tcgtaagttttaaaaacgaa

SEQ ID NO: 7686 - DNA, 20 bp, Artificial Sequence
  Description of Artificial Sequence: Synthetic oligonucleotide
  Target: ATXN1; (-) strand; PAM type: NNAGAAW; PAM sequence: GCAGAAT
tctgctaggtttgggatgtg

SEQ ID NO: 7687 - DNA, 20 bp, Artificial Sequence
  Description of Artificial Sequence: Synthetic oligonucleotide
  Target: ATXN1; (-) strand; PAM type: NNAGAAW; PAM sequence: TTAGAAA
gcttgaataacttcctcttc

SEQ ID NO: 7688 - DNA, 20 bp, Artificial Sequence
  Description of Artificial Sequence: Synthetic oligonucleotide
  Target: ATXN1; (-) strand; PAM type: NNAGAAW; PAM sequence: GGAGAAT
ctacttaaggggctgaagca

SEQ ID NO: 7689 - DNA, 20 bp, Artificial Sequence
  Description of Artificial Sequence: Synthetic oligonucleotide
  Target: ATXN1; (-) strand; PAM type: NNAGAAW; PAM sequence: CCAGAAA
tcaagaacagaacgtgaaag

SEQ ID NO: 7690 - DNA, 20 bp, Artificial Sequence
  Description of Artificial Sequence: Synthetic oligonucleotide
  Target: ATXN1; (-) strand; PAM type: NNAGAAW; PAM sequence: TAAGAAT
tttttttttcccaaagatcc

SEQ ID NO: 7691 - DNA, 20 bp, Artificial Sequence
  Description of Artificial Sequence: Synthetic oligonucleotide
  Target: ATXN1; (-) strand; PAM type: NNAGAAW; PAM sequence: CCAGAAT
ggcacagagatgactaaaag

SEQ ID NO: 7692 - DNA, 20 bp, Artificial Sequence
  Description of Artificial Sequence: Synthetic oligonucleotide
  Target: ATXN1; (-) strand; PAM type: NNAGAAW; PAM sequence: TAAGAAT
cttctgctctgaatcagtat

SEQ ID NO: 7693 - DNA, 20 bp, Artificial Sequence
  Description of Artificial Sequence: Synthetic oligonucleotide
  Target: ATXN1; (-) strand; PAM type: NNAGAAW; PAM sequence: CAAGAAT
ttcagaggccctgtggaagc

SEQ ID NO: 7694 - DNA, 20 bp, Artificial Sequence
  Description of Artificial Sequence: Synthetic oligonucleotide
  Target: ATXN1; (-) strand; PAM type: NNAGAAW; PAM sequence: CAAGAAA
ttctgctttaaagaactctc

SEQ ID NO: 7695 - DNA, 20 bp, Artificial Sequence
  Description of Artificial Sequence: Synthetic oligonucleotide
  Target: ATXN1; (-) strand; PAM type: NNAGAAW; PAM sequence: CCAGAAA
gacatttcacaggaaatgac

SEQ ID NO: 7696 - DNA, 20 bp, Artificial Sequence
  Description of Artificial Sequence: Synthetic oligonucleotide
  Target: ATXN1; (-) strand; PAM type: NNAGAAW; PAM sequence: CTAGAAA
aaggaagaaagtttcccagg

SEQ ID NO: 7697 - DNA, 20 bp, Artificial Sequence
  Description of Artificial Sequence: Synthetic oligonucleotide
  Target: ATXN1; (-) strand; PAM type: NNAGAAW; PAM sequence: GAAGAAA
ataaatagtgctgaatgaag

SEQ ID NO: 7698 - DNA, 20 bp, Artificial Sequence
  Description of Artificial Sequence: Synthetic oligonucleotide
  Target: ATXN1; (-) strand; PAM type: NNAGAAW; PAM sequence: TGAGAAA
aaatgagaaagtcttgcttc

SEQ ID NO: 7699 - DNA, 20 bp, Artificial Sequence
  Description of Artificial Sequence: Synthetic oligonucleotide
  Target: ATXN1; (-) strand; PAM type: NNAGAAW; PAM sequence: TGAGAAA
ttgatattcagagacccaaa

SEQ ID NO: 7700 - DNA, 20 bp, Artificial Sequence
  Description of Artificial Sequence: Synthetic oligonucleotide
  Target: ATXN1; (-) strand; PAM type: NNAGAAW; PAM sequence: CCAGAAT
tttaggataaaatacagaat

SEQ ID NO: 7701 - DNA, 20 bp, Artificial Sequence
  Description of Artificial Sequence: Synthetic oligonucleotide
  Target: ATXN1; (-) strand; PAM type: NNAGAAW; PAM sequence: ACAGAAT
aaaggtctttaggataaaat

SEQ ID NO: 7702 - DNA, 20 bp, Artificial Sequence
  Description of Artificial Sequence: Synthetic oligonucleotide
  Target: ATXN1; (-) strand; PAM type: NNAGAAW; PAM sequence: AGAGAAA
ctaaatctgcattgaaagca

SEQ ID NO: 7703 - DNA, 20 bp, Artificial Sequence
  Description of Artificial Sequence: Synthetic oligonucleotide
  Target: ATXN1; (-) strand; PAM type: NNAGAAW; PAM sequence: AGAGAAA
gtcatagggagaaaaaagag

SEQ ID NO: 7704 - DNA, 20 bp, Artificial Sequence
  Description of Artificial Sequence: Synthetic oligonucleotide
  Target: ATXN1; (-) strand; PAM type: NNAGAAW; PAM sequence: GGAGAAA
ttaatgaaggaaagtcatag

SEQ ID NO: 7705 - DNA, 20 bp, Artificial Sequence
  Description of Artificial Sequence: Synthetic oligonucleotide
  Target: ATXN1; (-) strand; PAM type: NNAGAAW; PAM sequence: TGAGAAT
aatttagagagaaaggaatc

SEQ ID NO: 7706 - DNA, 20 bp, Artificial Sequence
  Description of Artificial Sequence: Synthetic oligonucleotide
  Target: ATXN1; (-) strand; PAM type: NNAGAAW; PAM sequence: AGAGAAA
ccttggtatgattaatttag

SEQ ID NO: 7707 - DNA, 20 bp, Artificial Sequence
  Description of Artificial Sequence: Synthetic oligonucleotide
  Target: ATXN1; (-) strand; PAM type: NNAGAAW; PAM sequence: AGAGAAA
ttgaataaattttgcttcta

SEQ ID NO: 7708 - DNA, 20 bp, Artificial Sequence
  Description of Artificial Sequence: Synthetic oligonucleotide
  Target: ATXN1; (-) strand; PAM type: NNAGAAW; PAM sequence: TAAGAAT
tattacagctagcagatatt

SEQ ID NO: 7709 - DNA, 20 bp, Artificial Sequence
  Description of Artificial Sequence: Synthetic oligonucleotide
  Target: ATXN1; (-) strand; PAM type: NNAGAAW; PAM sequence: TGAGAAA
ggaagtaacttgtgaaatgc

SEQ ID NO: 7710 - DNA, 20 bp, Artificial Sequence
  Description of Artificial Sequence: Synthetic oligonucleotide
  Target: ATXN1; (-) strand; PAM type: NNAGAAW; PAM sequence: GCAGAAA
caagaccatttttactttct

SEQ ID NO: 7711 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
tgcttgttctttggtgctgt

SEQ ID NO: 7712 - DNA, 20 bp, Artificial Sequence
  Description of Artificial Sequence: Synthetic oligonucleotide
  Target: ATXN1; (-) strand; PAM type: NNAGAAW; PAM sequence: TTAGAAA
catagtacacatcttaagtg

SEQ ID NO: 7713 - DNA, 20 bp, Artificial Sequence
  Description of Artificial Sequence: Synthetic oligonucleotide
  Target: ATXN1; (-) strand; PAM type: NNAGAAW; PAM sequence: GAAGAAT
agcaagctgctaagaaggtt

SEQ ID NO: 7714 - DNA, 20 bp, Artificial Sequence
  Description of Artificial Sequence: Synthetic oligonucleotide
  Target: ATXN1; (-) strand; PAM type: NNAGAAW; PAM sequence: GGAGAAA
atggaatggatatagaaatg

SEQ ID NO: 7715 - DNA, 20 bp, Artificial Sequence
  Description of Artificial Sequence: Synthetic oligonucleotide
  Target: ATXN1; (-) strand; PAM type: NNAGAAW; PAM sequence: ATAGAAA
tacttaataatggaatggat

SEQ ID NO: 7716 - DNA, 20 bp, Artificial Sequence
  Description of Artificial Sequence: Synthetic oligonucleotide
  Target: ATXN1; (-) strand; PAM type: NNAGAAW; PAM sequence: TGAGAAA
cttcagctacttattagttg

SEQ ID NO: 7717 - DNA, 20 bp, Artificial Sequence
  Description of Artificial Sequence: Synthetic oligonucleotide
  Target: ATXN1; (-) strand; PAM type: NNAGAAW; PAM sequence: TAAGAAT
caccctcttgggtgccaagg

SEQ ID NO: 7718 - DNA, 20 bp, Artificial Sequence
  Description of Artificial Sequence: Synthetic oligonucleotide
  Target: ATXN1; (-) strand; PAM type: NNAGAAW; PAM sequence: GAAGAAT
tatacttaaccagtttaggt

SEQ ID NO: 7719 - DNA, 20 bp, Artificial Sequence
  Description of Artificial Sequence: Synthetic oligonucleotide
  Target: ATXN1; (-) strand; PAM type: NNAGAAW; PAM sequence: TTAGAAA
ggggcaaaactgagtaagtt

SEQ ID NO: 7720 - DNA, 20 bp, Artificial Sequence
  Description of Artificial Sequence: Synthetic oligonucleotide
  Target: ATXN1; (-) strand; PAM type: NNAGAAW; PAM sequence: TCAGAAA
caactggattgtaaattcct

SEQ ID NO: 7721 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
atcccagtgcaagcattagg

SEQ ID NO: 7722 - DNA, 20 bp, Artificial Sequence
  Description of Artificial Sequence: Synthetic oligonucleotide
  Target: ATXN1; (-) strand; PAM type: NNAGAAW; PAM sequence: TCAGAAA
catagcctctgaggtattcg

SEQ ID NO: 7723 - DNA, 20 bp, Artificial Sequence
  Description of Artificial Sequence: Synthetic oligonucleotide
  Target: ATXN1; (-) strand; PAM type: NNAGAAW; PAM sequence: TCAGAAA
atctccaaaatatcgctaca

SEQ ID NO: 7724 - DNA, 20 bp, Artificial Sequence
  Description of Artificial Sequence: Synthetic oligonucleotide
  Target: ATXN1; (-) strand; PAM type: NNAGAAW; PAM sequence: AAAGAAT
ggaagggaatgatatgttag

SEQ ID NO: 7725 - DNA, 20 bp, Artificial Sequence
  Description of Artificial Sequence: Synthetic oligonucleotide
  Target: ATXN1; (-) strand; PAM type: NNAGAAW; PAM sequence: TTAGAAA
gtagggaagggaatgatatg

SEQ ID NO: 7726 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
cattggaggctcacaatttg

SEQ ID NO: 7727 - DNA, 20 bp, Artificial Sequence
  Description of Artificial Sequence: Synthetic oligonucleotide
  Target: ATXN1; (-) strand; PAM type: NNAGAAW; PAM sequence: TCAGAAT
taatttcatccgttacaacc

SEQ ID NO: 7728 - DNA, 20 bp, Artificial Sequence
  Description of Artificial Sequence: Synthetic oligonucleotide
  Target: ATXN1; (-) strand; PAM type: NNAGAAW; PAM sequence: TTAGAAA
cacaacaaagaagaaggctt

SEQ ID NO: 7729 - DNA, 20 bp, Artificial Sequence
  Description of Artificial Sequence: Synthetic oligonucleotide
  Target: ATXN1; (-) strand; PAM type: NNAGAAW; PAM sequence: GCAGAAA
taatgggcctctgagataaa

SEQ ID NO: 7730 - DNA, 20 bp, Artificial Sequence
  Description of Artificial Sequence: Synthetic oligonucleotide
  Target: ATXN1; (-) strand; PAM type: NNAGAAW; PAM sequence: AGAGAAA
ttgtttggtttcttttggaa

SEQ ID NO: 7731 - DNA, 20 bp, Artificial Sequence
  Description of Artificial Sequence: Synthetic oligonucleotide
  Target: ATXN1; (-) strand; PAM type: NNAGAAW; PAM sequence: ATAGAAT
aactgacgctgttgccgtgg

SEQ ID NO: 7732 - DNA, 20 bp, Artificial Sequence
  Description of Artificial Sequence: Synthetic oligonucleotide
  Target: ATXN1; (-) strand; PAM type: NNAGAAW; PAM sequence: TGAGAAA
gagcctggcaatgaaatttc

SEQ ID NO: 7733 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
ctttgtggggagaaaaggac

SEQ ID NO: 7734 - DNA, 20 bp, Artificial Sequence
  Description of Artificial Sequence: Synthetic oligonucleotide
  Target: ATXN1; (-) strand; PAM type: NNAGAAW; PAM sequence: GGAGAAA
ggaaatctactactttgtgg

SEQ ID NO: 7735 - DNA, 20 bp, Artificial Sequence
  Description of Artificial Sequence: Synthetic oligonucleotide
  Target: ATXN1; (-) strand; PAM type: NNAGAAW; PAM sequence: CTAGAAA
gagacctcatcaccctaaca

SEQ ID NO: 7736 - DNA, 20 bp, Artificial Sequence
  Description of Artificial Sequence: Synthetic oligonucleotide
  Target: ATXN1; (-) strand; PAM type: NNAGAAW; PAM sequence: AAAGAAT
atagcacaagcctataacaa

SEQ ID NO: 7737 - DNA, 20 bp, Artificial Sequence
  Description of Artificial Sequence: Synthetic oligonucleotide
  Target: ATXN1; (-) strand; PAM type: NNAGAAW; PAM sequence: TCAGAAA
tatcactgttagacagactt

SEQ ID NO: 7738 - DNA, 20 bp, Artificial Sequence
  Description of Artificial Sequence: Synthetic oligonucleotide
  Target: ATXN1; (-) strand; PAM type: NNAGAAW; PAM sequence: TTAGAAA
gctttgagaatgtttcattt

SEQ ID NO: 7739 - DNA, 20 bp, Artificial Sequence
  Description of Artificial Sequence: Synthetic oligonucleotide
  Target: ATXN1; (-) strand; PAM type: NNAGAAW; PAM sequence: TGAGAAT
ttttccttactttccagctt

SEQ ID NO: 7740 - DNA, 20 bp, Artificial Sequence
  Description of Artificial Sequence: Synthetic oligonucleotide
  Target: ATXN1; (-) strand; PAM type: NNAGAAW; PAM sequence: ATAGAAA
ttaattagctccttgaggct

SEQ ID NO: 7741 - DNA, 20 bp, Artificial Sequence
  Description of Artificial Sequence: Synthetic oligonucleotide
  Target: ATXN1; (-) strand; PAM type: NNAGAAW; PAM sequence: GCAGAAA
acagtgagagatagggaaga

SEQ ID NO: 7742 - DNA, 20 bp, Artificial Sequence
  Description of Artificial Sequence: Synthetic oligonucleotide
  Target: ATXN1; (-) strand; PAM type: NNAGAAW; PAM sequence: CAAGAAT
aggccaggccttagtaactg

SEQ ID NO: 7743 - DNA, 20 bp, Artificial Sequence
  Description of Artificial Sequence: Synthetic oligonucleotide
  Target: ATXN1; (-) strand; PAM type: NNAGAAW; PAM sequence: AGAGAAT
aaagtgaattctgagtggag

SEQ ID NO: 7744 - DNA, 20 bp, Artificial Sequence
  Description of Artificial Sequence: Synthetic oligonucleotide
  Target: ATXN1; (-) strand; PAM type: NNAGAAW; PAM sequence: GTAGAAA
ccagtccaccaacatattga

SEQ ID NO: 7745 - DNA, 20 bp, Artificial Sequence
  Description of Artificial Sequence: Synthetic oligonucleotide
  Target: ATXN1; (-) strand; PAM type: NNAGAAW; PAM sequence: CCAGAAA
attaatttaattttaaagag

SEQ ID NO: 7746 - DNA, 20 bp, Artificial Sequence
  Description of Artificial Sequence: Synthetic oligonucleotide
  Target: ATXN1; (-) strand; PAM type: NNAGAAW; PAM sequence: CTAGAAT
attataagtgacattttgtt

SEQ ID NO: 7747 - DNA, 20 bp, Artificial Sequence
  Description of Artificial Sequence: Synthetic oligonucleotide
  Target: ATXN1; (-) strand; PAM type: NNAGAAW; PAM sequence: GGAGAAT
ctactcgggaggctgaggca

SEQ ID NO: 7748 - DNA, 20 bp, Artificial Sequence
  Description of Artificial Sequence: Synthetic oligonucleotide
  Target: ATXN1; (-) strand; PAM type: NNAGAAW; PAM sequence: GCAGAAT
catgaaggatccagataacc

SEQ ID NO: 7749 - DNA, 20 bp, Artificial Sequence
  Description of Artificial Sequence: Synthetic oligonucleotide
  Target: ATXN1; (-) strand; PAM type: NNAGAAW; PAM sequence: GAAGAAA
ctgactgcaaaatggatgat

SEQ ID NO: 7750 - DNA, 20 bp, Artificial Sequence
  Description of Artificial Sequence: Synthetic oligonucleotide
  Target: ATXN1; (-) strand; PAM type: NNAGAAW; PAM sequence: CCAGAAA
caattcatagacattacttt

SEQ ID NO: 7751 - DNA, 20 bp, Artificial Sequence
  Description of Artificial Sequence: Synthetic oligonucleotide
  Target: ATXN1; (-) strand; PAM type: NNAGAAW; PAM sequence: TAAGAAA
tctatattgagagatccttc

SEQ ID NO: 7752 - DNA, 20 bp, Artificial Sequence
  Description of Artificial Sequence: Synthetic oligonucleotide
  Target: ATXN1; (-) strand; PAM type: NNAGAAW; PAM sequence: TTAGAAA
taggggaagttgacaaaaca

SEQ ID NO: 7753 - DNA, 20 bp, Artificial Sequence
  Description of Artificial Sequence: Synthetic oligonucleotide
  Target: ATXN1; (-) strand; PAM type: NNAGAAW; PAM sequence: GGAGAAT
gtactggggaagctgaggtg

SEQ ID NO: 7754 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
catagtgagaccctgtctca

SEQ ID NO: 7755 - DNA, 20 bp, Artificial Sequence
  Description of Artificial Sequence: Synthetic oligonucleotide
  Target: ATXN1; (-) strand; PAM type: NNAGAAW; PAM sequence: TAAGAAA
gtctcaagaaaaaaaaaaaa

SEQ ID NO: 7756 - DNA, 20 bp, Artificial Sequence
  Description of Artificial Sequence: Synthetic oligonucleotide
  Target: ATXN1; (-) strand; PAM type: NNAGAAW; PAM sequence: CAAGAAA
gacagagcaagactccgtct

SEQ ID NO: 7757 - DNA, 20 bp, Artificial Sequence
  Description of Artificial Sequence: Synthetic oligonucleotide
  Target: ATXN1; (-) strand; PAM type: NNAGAAW; PAM sequence: TGAGAAA
gagatacagtgttcgtatgc

SEQ ID NO: 7758 - DNA, 20 bp, Artificial Sequence
  Description of Artificial Sequence: Synthetic oligonucleotide
  Target: ATXN1; (-) strand; PAM type: NNAGAAW; PAM sequence: GTAGAAA
atgaactagggtagtggcag

SEQ ID NO: 7759 - DNA, 20 bp, Artificial Sequence
  Description of Artificial Sequence: Synthetic oligonucleotide
  Target: ATXN1; (-) strand; PAM type: NNAGAAW; PAM sequence: ATAGAAA
gcttgaaagctaaggaacaa

SEQ ID NO: 7760 - DNA, 20 bp, Artificial Sequence
  Description of Artificial Sequence: Synthetic oligonucleotide
  Target: ATXN1; (-) strand; PAM type: NNAGAAW; PAM sequence: ACAGAAA
accatcattacccttattca

SEQ ID NO: 7761 - DNA, 20 bp, Artificial Sequence
  Description of Artificial Sequence: Synthetic oligonucleotide
  Target: ATXN1; (-) strand; PAM type: NNAGAAW; PAM sequence: GAAGAAA
tagcaagaacccatctcaaa

SEQ ID NO: 7762 - DNA, 20 bp, Artificial Sequence
  Description of Artificial Sequence: Synthetic oligonucleotide
  Target: ATXN1; (-) strand; PAM type: NNAGAAW; PAM sequence: TAAGAAT
agacagtgatagaactatca

SEQ ID NO: 7763 - DNA, 20 bp, Artificial Sequence
  Description of Artificial Sequence: Synthetic oligonucleotide
  Target: ATXN1; (-) strand; PAM type: NNAGAAW; PAM sequence: CAAGAAA
agtactccatggttgtatca

SEQ ID NO: 7764 - DNA, 20 bp, Artificial Sequence
  Description of Artificial Sequence: Synthetic oligonucleotide
  Target: ATXN1; (-) strand; PAM type: NNAGAAW; PAM sequence: AGAGAAT
ggatcatggccacccaggcc

SEQ ID NO: 7765 - DNA, 20 bp, Artificial Sequence
  Description of Artificial Sequence: Synthetic oligonucleotide
  Target: ATXN1; (-) strand; PAM type: NNAGAAW; PAM sequence: TTAGAAA
aaatgcattttgatgtttat

SEQ ID NO: 7766 - DNA, 20 bp, Artificial Sequence
  Description of Artificial Sequence: Synthetic oligonucleotide
  Target: ATXN1; (-) strand; PAM type: NNAGAAW; PAM sequence: AGAGAAT
agagagacagagagagagag

SEQ ID NO: 7767 - DNA, 20 bp, Artificial Sequence
  Description of Artificial Sequence: Synthetic oligonucleotide
  Target: ATXN1; (-) strand; PAM type: NNAGAAW; PAM sequence: CCAGAAA
aaaagcctaaaacaggaagg

SEQ ID NO: 7768 - DNA, 20 bp, Artificial Sequence
  Description of Artificial Sequence: Synthetic oligonucleotide
  Target: ATXN1; (-) strand; PAM type: NNAGAAW; PAM sequence: GCAGAAT
agtgtctgatatttctcaag

SEQ ID NO: 7769 - DNA, 20 bp, Artificial Sequence
  Description of Artificial Sequence: Synthetic oligonucleotide
  Target: ATXN1; (-) strand; PAM type: NNAGAAW; PAM sequence: AGAGAAA
ggcaccaggatgtctggaga

SEQ ID NO: 7770 - DNA, 20 bp, Artificial Sequence
  Description of Artificial Sequence: Synthetic oligonucleotide
  Target: ATXN1; (-) strand; PAM type: NNAGAAW; PAM sequence: AGAGAAT
tagaagttacagaagaggag

SEQ ID NO: 7771 - DNA, 20 bp, Artificial Sequence
  Description of Artificial Sequence: Synthetic oligonucleotide
  Target: ATXN1; (-) strand; PAM type: NNAGAAW; PAM sequence: CAAGAAA
cttttccaagtctctctctc

SEQ ID NO: 7772 - DNA, 20 bp, Artificial Sequence
  Description of Artificial Sequence: Synthetic oligonucleotide
  Target: ATXN1; (-) strand; PAM type: NNAGAAW; PAM sequence: GCAGAAT
tagaagtcggattcactgag

SEQ ID NO: 7773 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
tggcagagataaggcagatc

SEQ ID NO: 7774 - DNA, 20 bp, Artificial Sequence
  Description of Artificial Sequence: Synthetic oligonucleotide
  Target: ATXN1; (-) strand; PAM type: NNAGAAW; PAM sequence: GAAGAAT
gcctgatgcaaaatgacaaa

SEQ ID NO: 7775 - DNA, 20 bp, Artificial Sequence
  Description of Artificial Sequence: Synthetic oligonucleotide
  Target: ATXN1; (-) strand; PAM type: NNAGAAW; PAM sequence: TCAGAAT
aaaaacaccattgtttgtga

SEQ ID NO: 7776 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
atgttgtagcaaccatgaca

SEQ ID NO: 7777 - DNA, 20 bp, Artificial Sequence
  Description of Artificial Sequence: Synthetic oligonucleotide
  Target: ATXN1; (-) strand; PAM type: NNAGAAW; PAM sequence: GGAGAAT
gggcagacagagacagcaat

SEQ ID NO: 7778 - DNA, 20 bp, Artificial Sequence
  Description of Artificial Sequence: Synthetic oligonucleotide
  Target: ATXN1; (-) strand; PAM type: NNAGAAW; PAM sequence: CCAGAAA
gggaatagtctgcaaaggta

SEQ ID NO: 7779 - DNA, 20 bp, Artificial Sequence
  Description of Artificial Sequence: Synthetic oligonucleotide
  Target: ATXN1; (-) strand; PAM type: NNAGAAW; PAM sequence: ACAGAAT
attaatttgtgctctgtttc

SEQ ID NO: 7780 - DNA, 20 bp, Artificial Sequence
  Description of Artificial Sequence: Synthetic oligonucleotide
  Target: ATXN1; (-) strand; PAM type: NNAGAAW; PAM sequence: ACAGAAA
agctacagaggggtcctgag

SEQ ID NO: 7781 - DNA, 20 bp, Artificial Sequence
  Description of Artificial Sequence: Synthetic oligonucleotide
  Target: ATXN1; (-) strand; PAM type: NNAGAAW; PAM sequence: AGAGAAT
aagaatgattaagaaggctt

SEQ ID NO: 7782 - DNA, 20 bp, Artificial Sequence
  Description of Artificial Sequence: Synthetic oligonucleotide
  Target: ATXN1; (-) strand; PAM type: NNAGAAW; PAM sequence: GAAGAAT
tgaaggacaaagtaatacct

SEQ ID NO: 7783 - DNA, 20 bp, Artificial Sequence
  Description of Artificial Sequence: Synthetic oligonucleotide
  Target: ATXN1; (-) strand; PAM type: NNAGAAW; PAM sequence: ACAGAAT
aagccctgtcaaaatgaatg

SEQ ID NO: 7784 - DNA, 20 bp, Artificial Sequence
  Description of Artificial Sequence: Synthetic oligonucleotide
  Target: ATXN1; (-) strand; PAM type: NNAGAAW; PAM sequence: CAAGAAA
tggatagagggggagggaaa

SEQ ID NO: 7785 - DNA, 20 bp, Artificial Sequence
  Description of Artificial Sequence: Synthetic oligonucleotide
  Target: ATXN1; (-) strand; PAM type: NNAGAAW; PAM sequence: TGAGAAT
ccgacatacaatctggtcca

SEQ ID NO: 7786 - DNA, 20 bp, Artificial Sequence
  Description of Artificial Sequence: Synthetic oligonucleotide
  Target: ATXN1; (-) strand; PAM type: NNAGAAW; PAM sequence: TGAGAAA
gatgtcaacagtgccaaggc

SEQ ID NO: 7787 - DNA, 20 bp, Artificial Sequence
  Description of Artificial Sequence: Synthetic oligonucleotide
  Target: ATXN1; (-) strand; PAM type: NNAGAAW; PAM sequence: AAAGAAT
cacaggacagcccccaccac

SEQ ID NO: 7788 - DNA, 20 bp, Artificial Sequence
  Description of Artificial Sequence: Synthetic oligonucleotide
  Target: ATXN1; (-) strand; PAM type: NNAGAAW; PAM sequence: TCAGAAA
caaatgaaagtgtggaaaaa

SEQ ID NO: 7789 - DNA, 20 bp, Artificial Sequence
  Description of Artificial Sequence: Synthetic oligonucleotide
  Target: ATXN1; (-) strand; PAM type: NNAGAAW; PAM sequence: ATAGAAA
cttgcaaccatattttacag

SEQ ID NO: 7790 - DNA, 20 bp, Artificial Sequence
  Description of Artificial Sequence: Synthetic oligonucleotide
  Target: ATXN1; (-) strand; PAM type: NNAGAAW; PAM sequence: TCAGAAA
gacaagagcaaaactacatc

SEQ ID NO: 7791 - DNA, 20 bp, Artificial Sequence
  Description of Artificial Sequence: Synthetic oligonucleotide
  Target: ATXN1; (-) strand; PAM type: NNAGAAW; PAM sequence: GGAGAAT
ctactccagaggctgaggca

SEQ ID NO: 7792 - DNA, 20 bp, Artificial Sequence
  Description of Artificial Sequence: Synthetic oligonucleotide
  Target: ATXN1; (-) strand; PAM type: NNAGAAW; PAM sequence: TAAGAAA
cttggaacagtgcaagcgct

SEQ ID NO: 7793 - DNA, 20 bp, Artificial Sequence
  Description of Artificial Sequence: Synthetic oligonucleotide
  Target: ATXN1; (-) strand; PAM type: NNAGAAW; PAM sequence: GGAGAAA
ccctttattatttatggtta

SEQ ID NO: 7794 - DNA, 20 bp, Artificial Sequence
  Description of Artificial Sequence: Synthetic oligonucleotide
  Target: ATXN1; (-) strand; PAM type: NNAGAAW; PAM sequence: AGAGAAT
tggggaagaaatagtagggc

SEQ ID NO: 7795 - DNA, 20 bp, Artificial Sequence
  Description of Artificial Sequence: Synthetic oligonucleotide
  Target: ATXN1; (-) strand; PAM type: NNAGAAW; PAM sequence: GAAGAAA
aagggatctctgtctatggg

SEQ ID NO: 7796 - DNA, 20 bp, Artificial Sequence
  Description of Artificial Sequence: Synthetic oligonucleotide
  Target: ATXN1; (-) strand; PAM type: NNAGAAW; PAM sequence: TGAGAAA
catatattttgcagtgccag

SEQ ID NO: 7797 - DNA, 20 bp, Artificial Sequence
  Description of Artificial Sequence: Synthetic oligonucleotide
  Target: ATXN1; (-) strand; PAM type: NNAGAAW; PAM sequence: TGAGAAT
ctacttgggaggctaaggca

SEQ ID NO: 7798 - DNA, 20 bp, Artificial Sequence
  Description of Artificial Sequence: Synthetic oligonucleotide
  Target: ATXN1; (-) strand; PAM type: NNAGAAW; PAM sequence: AGAGAAA
cacagaatgcttctatgata

SEQ ID NO: 7799 - DNA, 20 bp, Artificial Sequence
  Description of Artificial Sequence: Synthetic oligonucleotide
  Target: ATXN1; (-) strand; PAM type: NNAGAAW; PAM sequence: ACAGAAT
ggcctaaaactcatagaaac

SEQ ID NO: 7800 - DNA, 20 bp, Artificial Sequence
  Description of Artificial Sequence: Synthetic oligonucleotide
  Target: ATXN1; (-) strand; PAM type: NNAGAAW; PAM sequence: ATAGAAA
atcgaatgggcctaaaactc

SEQ ID NO: 7801 - DNA, 20 bp, Artificial Sequence
  Description of Artificial Sequence: Synthetic oligonucleotide
  Target: ATXN1; (-) strand; PAM type: NNAGAAW; PAM sequence: AAAGAAT
gtcaccacgtgatcttcaga

SEQ ID NO: 7802 - DNA, 20 bp, Artificial Sequence
  Description of Artificial Sequence: Synthetic oligonucleotide
  Target: ATXN1; (-) strand; PAM type: NNAGAAW; PAM sequence: TCAGAAA
ccacagtcaccacgtgatct

SEQ ID NO: 7803 - DNA, 20 bp, Artificial Sequence
  Description of Artificial Sequence: Synthetic oligonucleotide
  Target: ATXN1; (-) strand; PAM type: NNAGAAW; PAM sequence: GTAGAAT
gtacttaaaaatgtgatgtg

SEQ ID NO: 7804 - DNA, 20 bp, Artificial Sequence
  Description of Artificial Sequence: Synthetic oligonucleotide
  Target: ATXN1; (-) strand; PAM type: NNAGAAW; PAM sequence: TCAGAAT
aagcaatgtatcagtaaact

SEQ ID NO: 7805 - DNA, 20 bp, Artificial Sequence
  Description of Artificial Sequence: Synthetic oligonucleotide
  Target: ATXN1; (-) strand; PAM type: NNAGAAW; PAM sequence: CAAGAAA
ttgtcagttgtaaagactgc

SEQ ID NO: 7806 - DNA, 20 bp, Artificial Sequence
  Description of Artificial Sequence: Synthetic oligonucleotide
  Target: ATXN1; (-) strand; PAM type: NNAGAAW; PAM sequence: ATAGAAA
ggactgtgctgaggaaggtc

SEQ ID NO: 7807 - DNA, 20 bp, Artificial Sequence
  Description of Artificial Sequence: Synthetic oligonucleotide
  Target: ATXN1; (-) strand; PAM type: NNAGAAW; PAM sequence: CAAGAAA
tctgcacagaccctccttcc

SEQ ID NO: 7808 - DNA, 20 bp, Artificial Sequence
  Description of Artificial Sequence: Synthetic oligonucleotide
  Target: ATXN1; (-) strand; PAM type: NNAGAAW; PAM sequence: GCAGAAT
cttggcagacatccccccca

SEQ ID NO: 7809 - DNA, 20 bp, Artificial Sequence
  Description of Artificial Sequence: Synthetic oligonucleotide
  Target: ATXN1; (-) strand; PAM type: NNAGAAW; PAM sequence: GGAGAAT
ttcacccctaaaatgtactt

SEQ ID NO: 7810 - DNA, 20 bp, Artificial Sequence
  Description of Artificial Sequence: Synthetic oligonucleotide
  Target: ATXN1; (-) strand; PAM type: NNAGAAW; PAM sequence: AGAGAAA
ggcagctttcttcagaaaag

SEQ ID NO: 7811 - DNA, 20 bp, Artificial Sequence
  Description of Artificial Sequence: Synthetic oligonucleotide
  Target: ATXN1; (-) strand; PAM type: NNAGAAW; PAM sequence: TCAGAAA
caaaatcaaggcagctttct

SEQ ID NO: 7812 - DNA, 20 bp, Artificial Sequence
  Description of Artificial Sequence: Synthetic oligonucleotide
  Target: ATXN1; (-) strand; PAM type: NNAGAAW; PAM sequence: TGAGAAT
tgggggtgatgaggtagttg

SEQ ID NO: 7813 - DNA, 20 bp, Artificial Sequence
  Description of Artificial Sequence: Synthetic oligonucleotide
  Target: ATXN1; (-) strand; PAM type: NNAGAAW; PAM sequence: TTAGAAT
ctgcttttgcccccatcctg

SEQ ID NO: 7814 - DNA, 20 bp, Artificial Sequence
  Description of Artificial Sequence: Synthetic oligonucleotide
  Target: ATXN1; (-) strand; PAM type: NNAGAAW; PAM sequence: TCAGAAA
ggctcccccgcgatctctca

SEQ ID NO: 7815 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
cacagctaataagctttagg

SEQ ID NO: 7816 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
gaagaagagaagaaaagaaa

SEQ ID NO: 7817 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
agaagaagaagaagagaaga

SEQ ID NO: 7818 - DNA, 20 bp, Artificial Sequence
  Description of Artificial Sequence: Synthetic oligonucleotide
  Target: ATXN1; (-) strand; PAM type: NNAGAAW; PAM sequence: GAAGAAA
aaaaaagaagaagaagaaga

SEQ ID NO: 7819 - DNA, 20 bp, Artificial Sequence
  Description of Artificial Sequence: Synthetic oligonucleotide
  Target: ATXN1; (-) strand; PAM type: NNAGAAW; PAM sequence: ATAGAAA
gttttgagagattgaaatac

SEQ ID NO: 7820 - DNA, 20 bp, Artificial Sequence
  Description of Artificial Sequence: Synthetic oligonucleotide
  Target: ATXN1; (-) strand; PAM type: NNAGAAW; PAM sequence: TCAGAAA
ggattgaactgtgtagtgcc

SEQ ID NO: 7821 - DNA, 20 bp, Artificial Sequence
  Description of Artificial Sequence: Synthetic oligonucleotide
  Target: ATXN1; (-) strand; PAM type: NNAGAAW; PAM sequence: GCAGAAT
cttctttgcacttctttcaa

SEQ ID NO: 7822 - DNA, 20 bp, Artificial Sequence
  Description of Artificial Sequence: Synthetic oligonucleotide
  Target: ATXN1; (-) strand; PAM type: NNAGAAW; PAM sequence: ACAGAAT
cacagttaaaggaatttaaa

SEQ ID NO: 7823 - DNA, 20 bp, Artificial Sequence
  Description of Artificial Sequence: Synthetic oligonucleotide
  Target: ATXN1; (-) strand; PAM type: NNAGAAW; PAM sequence: TAAGAAT
acaggaaaagggagaaacag

SEQ ID NO: 7824 - DNA, 20 bp, Artificial Sequence
  Description of Artificial Sequence: Synthetic oligonucleotide
  Target: ATXN1; (-) strand; PAM type: NNAGAAW; PAM sequence: GGAGAAA
aaaatgggcaacaggaaaag

SEQ ID NO: 7825 - DNA, 20 bp, Artificial Sequence
  Description of Artificial Sequence: Synthetic oligonucleotide
  Target: ATXN1; (-) strand; PAM type: NNAGAAW; PAM sequence: AGAGAAA
agcaaagttttagaagggaa

SEQ ID NO: 7826 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
ataatacacactgagtcatc

SEQ ID NO: 7827 - DNA, 20 bp, Artificial Sequence
  Description of Artificial Sequence: Synthetic oligonucleotide
  Target: ATXN1; (-) strand; PAM type: NNAGAAW; PAM sequence: ATAGAAA
gaagaatcaatcagaagcag

SEQ ID NO: 7828 - DNA, 20 bp, Artificial Sequence
  Description of Artificial Sequence: Synthetic oligonucleotide
  Target: ATXN1; (-) strand; PAM type: NNAGAAW; PAM sequence: GAAGAAT
aactgagatcaagggagaat

SEQ ID NO: 7829 - DNA, 20 bp, Artificial Sequence
  Description of Artificial Sequence: Synthetic oligonucleotide
  Target: ATXN1; (-) strand; PAM type: NNAGAAW; PAM sequence: GGAGAAT
aatgacaaactgagatcaag

SEQ ID NO: 7830 - DNA, 20 bp, Artificial Sequence
  Description of Artificial Sequence: Synthetic oligonucleotide
  Target: ATXN1; (-) strand; PAM type: NNAGAAW; PAM sequence: CAAGAAT
cccaccaaacctcatctacc

SEQ ID NO: 7831 - DNA, 20 bp, Artificial Sequence
  Description of Artificial Sequence: Synthetic oligonucleotide
  Target: ATXN1; (-) strand; PAM type: NNAGAAW; PAM sequence: AGAGAAA
aggtgagaaaattgagccct

SEQ ID NO: 7832 - DNA, 20 bp, Artificial Sequence
  Description of Artificial Sequence: Synthetic oligonucleotide
  Target: ATXN1; (-) strand; PAM type: NNAGAAW; PAM sequence: TGAGAAA
tgttactcttgttttacagg

SEQ ID NO: 7833 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
tgtctccaaaaaaaaaagaa

SEQ ID NO: 7834 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
agactctgtctccaaaaaaa

SEQ ID NO: 7835 - DNA, 20 bp, Artificial Sequence
  Description of Artificial Sequence: Synthetic oligonucleotide
  Target: ATXN1; (-) strand; PAM type: NNAGAAW; PAM sequence: GGAGAAT
ccactcaggaggctaaggca

SEQ ID NO: 7836 - DNA, 20 bp, Artificial Sequence
  Description of Artificial Sequence: Synthetic oligonucleotide
  Target: ATXN1; (-) strand; PAM type: NNAGAAW; PAM sequence: TCAGAAT
agtagtctctctgcttcttc

SEQ ID NO: 7837 - DNA, 20 bp, Artificial Sequence
  Description of Artificial Sequence: Synthetic oligonucleotide
  Target: ATXN1; (-) strand; PAM type: NNAGAAW; PAM sequence: GCAGAAA
ctccttagtgcatgggaaga

SEQ ID NO: 7838 - DNA, 20 bp, Artificial Sequence
  Description of Artificial Sequence: Synthetic oligonucleotide
  Target: ATXN1; (-) strand; PAM type: NNAGAAW; PAM sequence: TTAGAAA
tggattatctatgttttctg

SEQ ID NO: 7839 - DNA, 20 bp, Artificial Sequence
  Description of Artificial Sequence: Synthetic oligonucleotide
  Target: ATXN1; (-) strand; PAM type: NNAGAAW; PAM sequence: AGAGAAA
atgcatttaggaagagatga

SEQ ID NO: 7840 - DNA, 20 bp, Artificial Sequence
  Description of Artificial Sequence: Synthetic oligonucleotide
  Target: ATXN1; (-) strand; PAM type: NNAGAAW; PAM sequence: CCAGAAT
aacacccatagtagccaagg

SEQ ID NO: 7841 - DNA, 20 bp, Artificial Sequence
  Description of Artificial Sequence: Synthetic oligonucleotide
  Target: ATXN1; (-) strand; PAM type: NNAGAAW; PAM sequence: TGAGAAT
tctaggttgtaccttcctta

SEQ ID NO: 7842 - DNA, 20 bp, Artificial Sequence
  Description of Artificial Sequence: Synthetic oligonucleotide
  Target: ATXN1; (-) strand; PAM type: NNAGAAW; PAM sequence: GCAGAAA
ctttctttgcttttcagatg

SEQ ID NO: 7843 - DNA, 20 bp, Artificial Sequence
  Description of Artificial Sequence: Synthetic oligonucleotide
  Target: ATXN1; (-) strand; PAM type: NNAGAAW; PAM sequence: CAAGAAA
aaaaatggagaaaaaataaa

SEQ ID NO: 7844 - DNA, 20 bp, Artificial Sequence
  Description of Artificial Sequence: Synthetic oligonucleotide
  Target: ATXN1; (-) strand; PAM type: NNAGAAW; PAM sequence: GGAGAAA
aatattttggattaaaaaat

SEQ ID NO: 7845 - DNA, 20 bp, Artificial Sequence
  Description of Artificial Sequence: Synthetic oligonucleotide
  Target: ATXN1; (-) strand; PAM type: NNAGAAW; PAM sequence: ACAGAAA
attatacgtgctctgagtct

SEQ ID NO: 7846 - DNA, 20 bp, Artificial Sequence
  Description of Artificial Sequence: Synthetic oligonucleotide
  Target: ATXN1; (-) strand; PAM type: NNAGAAW; PAM sequence: CCAGAAT
cccatcttacacaagagatt

SEQ ID NO: 7847 - DNA, 20 bp, Artificial Sequence
  Description of Artificial Sequence: Synthetic oligonucleotide
  Target: ATXN1; (-) strand; PAM type: NNAGAAW; PAM sequence: TGAGAAA
atttagatccactgagaatc

SEQ ID NO: 7848 - DNA, 20 bp, Artificial Sequence
  Description of Artificial Sequence: Synthetic oligonucleotide
  Target: ATXN1; (-) strand; PAM type: NNAGAAW; PAM sequence: TGAGAAT
cagtttaaatttagatccac

SEQ ID NO: 7849 - DNA, 20 bp, Artificial Sequence
  Description of Artificial Sequence: Synthetic oligonucleotide
  Target: ATXN1; (-) strand; PAM type: NNAGAAW; PAM sequence: GTAGAAA
tttttatttgtttaacatat

SEQ ID NO: 7850 - DNA, 20 bp, Artificial Sequence
  Description of Artificial Sequence: Synthetic oligonucleotide
  Target: ATXN1; (-) strand; PAM type: NNAGAAW; PAM sequence: CAAGAAA
tagtaaatactttttaggga

SEQ ID NO: 7851 - DNA, 20 bp, Artificial Sequence
  Description of Artificial Sequence: Synthetic oligonucleotide
  Target: ATXN1; (-) strand; PAM type: NNAGAAW; PAM sequence: TAAGAAT
ttgggggcatgtctctgtgg

SEQ ID NO: 7852 - DNA, 20 bp, Artificial Sequence
  Description of Artificial Sequence: Synthetic oligonucleotide
  Target: ATXN1; (-) strand; PAM type: NNAGAAW; PAM sequence: CTAGAAA
ccttcttatttggtcttcat

SEQ ID NO: 7853 - DNA, 20 bp, Artificial Sequence
  Description of Artificial Sequence: Synthetic oligonucleotide
  Target: ATXN1; (-) strand; PAM type: NNAGAAW; PAM sequence: CCAGAAA
ttttagggataagggatggg

SEQ ID NO: 7854 - DNA, 20 bp, Artificial Sequence
  Description of Artificial Sequence: Synthetic oligonucleotide
  Target: ATXN1; (-) strand; PAM type: NNAGAAW; PAM sequence: TAAGAAT
ttgggggcatgtctctgtgg

SEQ ID NO: 7855 - DNA, 20 bp, Artificial Sequence
  Description of Artificial Sequence: Synthetic oligonucleotide
  Target: ATXN1; (-) strand; PAM type: NNAGAAW; PAM sequence: CTAGAAA
ccttcttatttggtcttcat

SEQ ID NO: 7856 - DNA, 20 bp, Artificial Sequence
  Description of Artificial Sequence: Synthetic oligonucleotide
  Target: ATXN1; (-) strand; PAM type: NNAGAAW; PAM sequence: CTAGAAT
tttcaaatctttttctactt

SEQ ID NO: 7857 - DNA, 20 bp, Artificial Sequence
  Description of Artificial Sequence: Synthetic oligonucleotide
  Target: ATXN1; (-) strand; PAM type: NNAGAAW; PAM sequence: AAAGAAT
gtcattttacctgagtgtcc

SEQ ID NO: 7858 - DNA, 20 bp, Artificial Sequence
  Description of Artificial Sequence: Synthetic oligonucleotide
  Target: ATXN1; (-) strand; PAM type: NNAGAAW; PAM sequence: TTAGAAT
cagccttccagtaaaaatgt

SEQ ID NO: 7859 - DNA, 20 bp, Artificial Sequence
  Description of Artificial Sequence: Synthetic oligonucleotide
  Target: ATXN1; (-) strand; PAM type: NNAGAAW; PAM sequence: TGAGAAA
ggagacctggtttctttcag

SEQ ID NO: 7860 - DNA, 20 bp, Artificial Sequence
  Description of Artificial Sequence: Synthetic oligonucleotide
  Target: ATXN1; (-) strand; PAM type: NNAGAAW; PAM sequence: AGAGAAA
gcaggaattattgttcatga

SEQ ID NO: 7861 - DNA, 20 bp, Artificial Sequence
  Description of Artificial Sequence: Synthetic oligonucleotide
  Target: ATXN1; (-) strand; PAM type: NNAGAAW; PAM sequence: GTAGAAT
gaaaccagaccatttgtctg

SEQ ID NO: 7862 - DNA, 20 bp, Artificial Sequence
  Description of Artificial Sequence: Synthetic oligonucleotide
  Target: ATXN1; (-) strand; PAM type: NNAGAAW; PAM sequence: TGAGAAA
tattttgcagttttttctgt

SEQ ID NO: 7863 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
aatataaaaacttaaaaaaa

SEQ ID NO: 7864 - DNA, 20 bp, Artificial Sequence
  Description of Artificial Sequence: Synthetic oligonucleotide
  Target: ATXN1; (-) strand; PAM type: NNAGAAW; PAM sequence: TAAGAAA
ccaacaatgatagactggat

SEQ ID NO: 7865 - DNA, 20 bp, Artificial Sequence
  Description of Artificial Sequence: Synthetic oligonucleotide
  Target: ATXN1; (-) strand; PAM type: NNAGAAW; PAM sequence: CTAGAAA
gattcctcagggatctagaa

SEQ ID NO: 7866 - DNA, 20 bp, Artificial Sequence
  Description of Artificial Sequence: Synthetic oligonucleotide
  Target: ATXN1; (-) strand; PAM type: NNAGAAW; PAM sequence: GGAGAAA
acaggtgctggagaggatgt

SEQ ID NO: 7867 - DNA, 20 bp, Artificial Sequence
  Description of Artificial Sequence: Synthetic oligonucleotide
  Target: ATXN1; (-) strand; PAM type: NNAGAAW; PAM sequence: TTAGAAT
gagataccatctcacaccag

SEQ ID NO: 7868 - DNA, 20 bp, Artificial Sequence
  Description of Artificial Sequence: Synthetic oligonucleotide
  Target: ATXN1; (-) strand; PAM type: NNAGAAW; PAM sequence: AGAGAAA
gctcatcatcactggccatc

SEQ ID NO: 7869 - DNA, 20 bp, Artificial Sequence
  Description of Artificial Sequence: Synthetic oligonucleotide
  Target: ATXN1; (-) strand; PAM type: NNAGAAW; PAM sequence: ATAGAAA
aggaactttaactttgtgtt

SEQ ID NO: 7870 - DNA, 20 bp, Artificial Sequence
  Description of Artificial Sequence: Synthetic oligonucleotide
  Target: ATXN1; (-) strand; PAM type: NNAGAAW; PAM sequence: TGAGAAA
aggctgtgggaaaccacatt

SEQ ID NO: 7871 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
taactgttaaaccctttgaa

SEQ ID NO: 7872 - DNA, 20 bp, Artificial Sequence
  Description of Artificial Sequence: Synthetic oligonucleotide
  Target: ATXN1; (-) strand; PAM type: NNAGAAW; PAM sequence: ATAGAAA
gtcactgtaaagttccttta

SEQ ID NO: 7873 - DNA, 20 bp, Artificial Sequence
  Description of Artificial Sequence: Synthetic oligonucleotide
  Target: ATXN1; (-) strand; PAM type: NNAGAAW; PAM sequence: GAAGAAT
gaaatgaaacaacaacatgt

SEQ ID NO: 7874 - DNA, 20 bp, Artificial Sequence
  Description of Artificial Sequence: Synthetic oligonucleotide
  Target: ATXN1; (-) strand; PAM type: NNAGAAW; PAM sequence: ACAGAAA
acaccaacaggatatatttt

SEQ ID NO: 7875 - DNA, 20 bp, Artificial Sequence
  Description of Artificial Sequence: Synthetic oligonucleotide
  Target: ATXN1; (-) strand; PAM type: NNAGAAW; PAM sequence: AAAGAAT
gtgataagcactatcattag

SEQ ID NO: 7876 - DNA, 20 bp, Artificial Sequence
  Description of Artificial Sequence: Synthetic oligonucleotide
  Target: ATXN1; (-) strand; PAM type: NNAGAAW; PAM sequence: TTAGAAA
tctagtgataagcactatca

SEQ ID NO: 7877 - DNA, 20 bp, Artificial Sequence
  Description of Artificial Sequence: Synthetic oligonucleotide
  Target: ATXN1; (-) strand; PAM type: NNAGAAW; PAM sequence: GGAGAAT
ctactcaggaggctgaggca

SEQ ID NO: 7878 - DNA, 20 bp, Artificial Sequence
  Description of Artificial Sequence: Synthetic oligonucleotide
  Target: ATXN1; (-) strand; PAM type: NNAGAAW; PAM sequence: TTAGAAA
aagcttcaataaagattaaa

SEQ ID NO: 7879 - DNA, 20 bp, Artificial Sequence
  Description of Artificial Sequence: Synthetic oligonucleotide
  Target: ATXN1; (-) strand; PAM type: NNAGAAW; PAM sequence: GTAGAAT
agatgctctgaagcccgttg

SEQ ID NO: 7880 - DNA, 20 bp, Artificial Sequence
  Description of Artificial Sequence: Synthetic oligonucleotide
  Target: ATXN1; (-) strand; PAM type: NNAGAAW; PAM sequence: TGAGAAA
aaactacagttacttaataa

SEQ ID NO: 7881 - DNA, 20 bp, Artificial Sequence
  Description of Artificial Sequence: Synthetic oligonucleotide
  Target: ATXN1; (-) strand; PAM type: NNAGAAW; PAM sequence: GAAGAAT
tcagctgtgatgaatgaaga

SEQ ID NO: 7882 - DNA, 20 bp, Artificial Sequence
  Description of Artificial Sequence: Synthetic oligonucleotide
  Target: ATXN1; (-) strand; PAM type: NNAGAAW; PAM sequence: TAAGAAA
ccttactaacaaaatggagt

SEQ ID NO: 7883 - DNA, 20 bp, Artificial Sequence
  Description of Artificial Sequence: Synthetic oligonucleotide
  Target: ATXN1; (-) strand; PAM type: NNAGAAW; PAM sequence: TAAGAAT
catttgattaacggggtaac

SEQ ID NO: 7884 - DNA, 20 bp, Artificial Sequence
  Description of Artificial Sequence: Synthetic oligonucleotide
  Target: ATXN1; (-) strand; PAM type: NNAGAAW; PAM sequence: TGAGAAA
agcgctacaacctttctacc

SEQ ID NO: 7885 - DNA, 20 bp, Artificial Sequence
  Description of Artificial Sequence: Synthetic oligonucleotide
  Target: ATXN1; (-) strand; PAM type: NNAGAAW; PAM sequence: GAAGAAA
atctctttcaattttagaag

SEQ ID NO: 7886 - DNA, 20 bp, Artificial Sequence
  Description of Artificial Sequence: Synthetic oligonucleotide
  Target: ATXN1; (-) strand; PAM type: NNAGAAW; PAM sequence: GAAGAAA
tacttaaaaaacaagaagaa

SEQ ID NO: 7887 - DNA, 20 bp, Artificial Sequence
  Description of Artificial Sequence: Synthetic oligonucleotide
  Target: ATXN1; (-) strand; PAM type: NNAGAAW; PAM sequence: GGAGAAA
gcctaaatcttccattagag

SEQ ID NO: 7888 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
cacttaaaacaaaaggaaga

SEQ ID NO: 7889 - DNA, 20 bp, Artificial Sequence
  Description of Artificial Sequence: Synthetic oligonucleotide
  Target: ATXN1; (-) strand; PAM type: NNAGAAW; PAM sequence: GAAGAAA
gtgttcacttaaaacaaaag

SEQ ID NO: 7890 - DNA, 20 bp, Artificial Sequence
  Description of Artificial Sequence: Synthetic oligonucleotide
  Target: ATXN1; (-) strand; PAM type: NNAGAAW; PAM sequence: TGAGAAA
tttatgttgttgtgcagtat

SEQ ID NO: 7891 - DNA, 20 bp, Artificial Sequence
  Description of Artificial Sequence: Synthetic oligonucleotide
  Target: ATXN1; (-) strand; PAM type: NNAGAAW; PAM sequence: ACAGAAA
aatgaagctttgtgatgaac

SEQ ID NO: 7892 - DNA, 20 bp, Artificial Sequence
  Description of Artificial Sequence: Synthetic oligonucleotide
  Target: ATXN1; (-) strand; PAM type: NNAGAAW; PAM sequence: GAAGAAA
atgctgacttataaaatcaa

SEQ ID NO: 7893 - DNA, 20 bp, Artificial Sequence
  Description of Artificial Sequence: Synthetic oligonucleotide
  Target: ATXN1; (-) strand; PAM type: NNAGAAW; PAM sequence: TCAGAAA
tatgagatattaaggaatct

SEQ ID NO: 7894 - DNA, 20 bp, Artificial Sequence
  Description of Artificial Sequence: Synthetic oligonucleotide
  Target: ATXN1; (-) strand; PAM type: NNAGAAW; PAM sequence: TTAGAAA
aagatgtccccatttaatgc

SEQ ID NO: 7895 - DNA, 20 bp, Artificial Sequence
  Description of Artificial Sequence: Synthetic oligonucleotide
  Target: ATXN1; (-) strand; PAM type: NNAGAAW; PAM sequence: TGAGAAT
aaatttgtttctgtttgctt

SEQ ID NO: 7896 - DNA, 20 bp, Artificial Sequence
  Description of Artificial Sequence: Synthetic oligonucleotide
  Target: ATXN1; (-) strand; PAM type: NNAGAAW; PAM sequence: ATAGAAA
caaagacagcaagactgaag

SEQ ID NO: 7897 - DNA, 20 bp, Artificial Sequence
  Description of Artificial Sequence: Synthetic oligonucleotide
  Target: ATXN1; (-) strand; PAM type: NNAGAAW; PAM sequence: TTAGAAA
gaggaaacttctctggcatc

SEQ ID NO: 7898 - DNA, 20 bp, Artificial Sequence
  Description of Artificial Sequence: Synthetic oligonucleotide
  Target: ATXN1; (-) strand; PAM type: NNAGAAW; PAM sequence: CCAGAAT
gggcacaagacagacaaatc

SEQ ID NO: 7899 - DNA, 20 bp, Artificial Sequence
  Description of Artificial Sequence: Synthetic oligonucleotide
  Target: ATXN1; (-) strand; PAM type: NNAGAAW; PAM sequence: GCAGAAT
gatgtcattgaatgtcgttt

SEQ ID NO: 7900 - DNA, 20 bp, Artificial Sequence
  Description of Artificial Sequence: Synthetic oligonucleotide
  Target: ATXN1; (-) strand; PAM type: NNAGAAW; PAM sequence: GGAGAAA
cagcaatacaccctgaactc

SEQ ID NO: 7901 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
actgtcccactggcttttta

SEQ ID NO: 7902 - DNA, 20 bp, Artificial Sequence
  Description of Artificial Sequence: Synthetic oligonucleotide
  Target: ATXN1; (-) strand; PAM type: NNAGAAW; PAM sequence: TCAGAAA
tttgattcacaaatgagttt

SEQ ID NO: 7903 - DNA, 20 bp, Artificial Sequence
  Description of Artificial Sequence: Synthetic oligonucleotide
  Target: ATXN1; (-) strand; PAM type: NNAGAAW; PAM sequence: CAAGAAT
cttgttgtggtggaatgaga

SEQ ID NO: 7904 - DNA, 20 bp, Artificial Sequence
  Description of Artificial Sequence: Synthetic oligonucleotide
  Target: ATXN1; (-) strand; PAM type: NNAGAAW; PAM sequence: TCAGAAT
aggtttacgctaaactttca

SEQ ID NO: 7905 - DNA, 20 bp, Artificial Sequence
  Description of Artificial Sequence: Synthetic oligonucleotide
  Target: ATXN1; (-) strand; PAM type: NNAGAAW; PAM sequence: AAAGAAT
caaatctaataaaattttat

SEQ ID NO: 7906 - DNA, 20 bp, Artificial Sequence
  Description of Artificial Sequence: Synthetic oligonucleotide
  Target: ATXN1; (-) strand; PAM type: NNAGAAW; PAM sequence: TGAGAAA
atcaatgatgagactgatgc

SEQ ID NO: 7907 - DNA, 20 bp, Artificial Sequence
  Description of Artificial Sequence: Synthetic oligonucleotide
  Target: ATXN1; (-) strand; PAM type: NNAGAAW; PAM sequence: TTAGAAA
ctgcacctcattttccagaa

SEQ ID NO: 7908 - DNA, 20 bp, Artificial Sequence
  Description of Artificial Sequence: Synthetic oligonucleotide
  Target: ATXN1; (-) strand; PAM type: NNAGAAW; PAM sequence: CCAGAAT
tcctctctgcacctcatttt

SEQ ID NO: 7909 - DNA, 20 bp, Artificial Sequence
  Description of Artificial Sequence: Synthetic oligonucleotide
  Target: ATXN1; (-) strand; PAM type: NNAGAAW; PAM sequence: GAAGAAT
aaacaatgattttgaattca

SEQ ID NO: 7910 - DNA, 20 bp, Artificial Sequence
  Description of Artificial Sequence: Synthetic oligonucleotide
  Target: ATXN1; (-) strand; PAM type: NNAGAAW; PAM sequence: TAAGAAA
atctgaactggtgataagat

SEQ ID NO: 7911 - DNA, 20 bp, Artificial Sequence
  Description of Artificial Sequence: Synthetic oligonucleotide
  Target: ATXN1; (-) strand; PAM type: NNAGAAW; PAM sequence: CAAGAAT
attcatggtctcgctgactt

SEQ ID NO: 7912 - DNA, 20 bp, Artificial Sequence
  Description of Artificial Sequence: Synthetic oligonucleotide
  Target: ATXN1; (-) strand; PAM type: NNAGAAW; PAM sequence: ACAGAAT
gaattctaaggaaaaatagg

SEQ ID NO: 7913 - DNA, 20 bp, Artificial Sequence
  Description of Artificial Sequence: Synthetic oligonucleotide
  Target: ATXN1; (-) strand; PAM type: NNAGAAW; PAM sequence: GGAGAAA
aaccttggagaagagaggcg

SEQ ID NO: 7914 - DNA, 20 bp, Artificial Sequence
  Description of Artificial Sequence: Synthetic oligonucleotide
  Target: ATXN1; (-) strand; PAM type: NNAGAAW; PAM sequence: GGAGAAA
tattagaaatcatccttata

SEQ ID NO: 7915 - DNA, 20 bp, Artificial Sequence
  Description of Artificial Sequence: Synthetic oligonucleotide
  Target: ATXN1; (-) strand; PAM type: NNAGAAW; PAM sequence: TTAGAAA
gcagagtcctgaaatttata

SEQ ID NO: 7916 - DNA, 20 bp, Artificial Sequence
  Description of Artificial Sequence: Synthetic oligonucleotide
  Target: ATXN1; (-) strand; PAM type: NNAGAAW; PAM sequence: TGAGAAA
ctttagaccacaaagaggac

SEQ ID NO: 7917 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
gcctgggtgtttcccatctg

SEQ ID NO: 7918 - DNA, 20 bp, Artificial Sequence
  Description of Artificial Sequence: Synthetic oligonucleotide
  Target: ATXN1; (-) strand; PAM type: NNAGAAW; PAM sequence: GCAGAAA
tattaaggccagaccgtagt

SEQ ID NO: 7919 - DNA, 20 bp, Artificial Sequence
  Description of Artificial Sequence: Synthetic oligonucleotide
  Target: ATXN1; (-) strand; PAM type: NNAGAAW; PAM sequence: GCAGAAT
cttacagaaaaggtcaacct

SEQ ID NO: 7920 - DNA, 20 bp, Artificial Sequence
  Description of Artificial Sequence: Synthetic oligonucleotide
  Target: ATXN1; (-) strand; PAM type: NNAGAAW; PAM sequence: ACAGAAA
ctccatttcccttccctctt

SEQ ID NO: 7921 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
tgtggattatccttcagtaa

SEQ ID NO: 7922 - DNA, 20 bp, Artificial Sequence
  Description of Artificial Sequence: Synthetic oligonucleotide
  Target: ATXN1; (-) strand; PAM type: NNAGAAW; PAM sequence: GGAGAAA
caattacaactgaggaggtg

SEQ ID NO: 7923 - DNA, 20 bp, Artificial Sequence
  Description of Artificial Sequence: Synthetic oligonucleotide
  Target: ATXN1; (-) strand; PAM type: NNAGAAW; PAM sequence: TAAGAAA
gggtgtggggctttcaggca

SEQ ID NO: 7924 - DNA, 20 bp, Artificial Sequence
  Description of Artificial Sequence: Synthetic oligonucleotide
  Target: ATXN1; (-) strand; PAM type: NNAGAAW; PAM sequence: CTAGAAT
acgattcagtttttgtactc

SEQ ID NO: 7925 - DNA, 20 bp, Artificial Sequence
  Description of Artificial Sequence: Synthetic oligonucleotide
  Target: ATXN1; (-) strand; PAM type: NNAGAAW; PAM sequence: AGAGAAA
tgtgggatcctcaaaggcaa

SEQ ID NO: 7926 - DNA, 20 bp, Artificial Sequence
  Description of Artificial Sequence: Synthetic oligonucleotide
  Target: ATXN1; (-) strand; PAM type: NNAGAAW; PAM sequence: CTAGAAA
tgccttgtacccttgattag

SEQ ID NO: 7927 - DNA, 20 bp, Artificial Sequence
  Description of Artificial Sequence: Synthetic oligonucleotide
  Target: ATXN1; (-) strand; PAM type: NNAGAAW; PAM sequence: GGAGAAA
gattggttctccatcctctg

SEQ ID NO: 7928 - DNA, 20 bp, Artificial Sequence
  Description of Artificial Sequence: Synthetic oligonucleotide
  Target: ATXN1; (-) strand; PAM type: NNAGAAW; PAM sequence: GGAGAAA
tgccgttaaccaccccaagg

SEQ ID NO: 7929 - DNA, 20 bp, Artificial Sequence
  Description of Artificial Sequence: Synthetic oligonucleotide
  Target: ATXN1; (-) strand; PAM type: NNAGAAW; PAM sequence: GGAGAAT
gactgagccccattttgtga

SEQ ID NO: 7930 - DNA, 20 bp, Artificial Sequence
  Description of Artificial Sequence: Synthetic oligonucleotide
  Target: ATXN1; (-) strand; PAM type: NNAGAAW; PAM sequence: TGAGAAA
atcaagtaggaggtcatttg

SEQ ID NO: 7931 - DNA, 20 bp, Artificial Sequence
  Description of Artificial Sequence: Synthetic oligonucleotide
  Target: ATXN1; (-) strand; PAM type: NNAGAAW; PAM sequence: AGAGAAT
agtatatagtcctgctgcaa

SEQ ID NO: 7932 - DNA, 20 bp, Artificial Sequence
  Description of Artificial Sequence: Synthetic oligonucleotide
  Target: ATXN1; (-) strand; PAM type: NNAGAAW; PAM sequence: GGAGAAA
ctgtgctctattttcccatt

SEQ ID NO: 7933 - DNA, 20 bp, Artificial Sequence
  Description of Artificial Sequence: Synthetic oligonucleotide
  Target: ATXN1; (-) strand; PAM type: NNAGAAW; PAM sequence: TAAGAAT
atgtaagttgaagttccaca

SEQ ID NO: 7934 - DNA, 20 bp, Artificial Sequence
  Description of Artificial Sequence: Synthetic oligonucleotide
  Target: ATXN1; (-) strand; PAM type: NNAGAAW; PAM sequence: TGAGAAA
ttatttcttgcaaactgtct

SEQ ID NO: 7935 - DNA, 20 bp, Artificial Sequence
  Description of Artificial Sequence: Synthetic oligonucleotide
  Target: ATXN1; (-) strand; PAM type: NNAGAAW; PAM sequence: GGAGAAA
tgtcatgggacgtagaaagg

SEQ ID NO: 7936 - DNA, 20 bp, Artificial Sequence
  Description of Artificial Sequence: Synthetic oligonucleotide
  Target: ATXN1; (-) strand; PAM type: NNAGAAW; PAM sequence: GTAGAAA
caagatggctgtcatgggac

SEQ ID NO: 7937 - DNA, 20 bp, Artificial Sequence
  Description of Artificial Sequence: Synthetic oligonucleotide
  Target: ATXN1; (-) strand; PAM type: NNAGAAW; PAM sequence: TTAGAAT
ctccctgcgattggctacct

SEQ ID NO: 7938 - DNA, 20 bp, Artificial Sequence
  Description of Artificial Sequence: Synthetic oligonucleotide
  Target: ATXN1; (-) strand; PAM type: NNAGAAW; PAM sequence: CAAGAAT
gtttatggtctcgctgactt

SEQ ID NO: 7939 - DNA, 20 bp, Artificial Sequence
  Description of Artificial Sequence: Synthetic oligonucleotide
  Target: ATXN1; (-) strand; PAM type: NNAGAAW; PAM sequence: ACAGAAA
tatagaacagttttaggttt

SEQ ID NO: 7940 - DNA, 20 bp, Artificial Sequence
  Description of Artificial Sequence: Synthetic oligonucleotide
  Target: ATXN1; (-) strand; PAM type: NNAGAAW; PAM sequence: TTAGAAT
cttggaaattatgcattccc

SEQ ID NO: 7941 - DNA, 20 bp, Artificial Sequence
  Description of Artificial Sequence: Synthetic oligonucleotide
  Target: ATXN1; (-) strand; PAM type: NNAGAAW; PAM sequence: GAAGAAA
cagatgagaattctgaaaga

SEQ ID NO: 7942 - DNA, 20 bp, Artificial Sequence
  Description of Artificial Sequence: Synthetic oligonucleotide
  Target: ATXN1; (-) strand; PAM type: NNAGAAW; PAM sequence: TGAGAAT
ctatcctaaatatgatcaga

SEQ ID NO: 7943 - DNA, 20 bp, Artificial Sequence
  Description of Artificial Sequence: Synthetic oligonucleotide
  Target: ATXN1; (-) strand; PAM type: NNAGAAW; PAM sequence: ATAGAAT
atacatgtagctttacagaa

SEQ ID NO: 7944 - DNA, 20 bp, Artificial Sequence
  Description of Artificial Sequence: Synthetic oligonucleotide
  Target: ATXN1; (-) strand; PAM type: NNAGAAW; PAM sequence: ACAGAAA
aaataaatacatgtagcttt

SEQ ID NO: 7945 - DNA, 20 bp, Artificial Sequence
  Description of Artificial Sequence: Synthetic oligonucleotide
  Target: ATXN1; (-) strand; PAM type: NNAGAAW; PAM sequence: AGAGAAA
gattctctgtaatagcttga

SEQ ID NO: 7946 - DNA, 20 bp, Artificial Sequence
  Description of Artificial Sequence: Synthetic oligonucleotide
  Target: ATXN1; (-) strand; PAM type: NNAGAAW; PAM sequence: CAAGAAA
caagaaagcgcctccagagt

SEQ ID NO: 7947 - DNA, 20 bp, Artificial Sequence
  Description of Artificial Sequence: Synthetic oligonucleotide
  Target: ATXN1; (-) strand; PAM type: NNAGAAW; PAM sequence: CAAGAAA
atttttttaaatagactaat

SEQ ID NO: 7948 - DNA, 20 bp, Artificial Sequence
  Description of Artificial Sequence: Synthetic oligonucleotide
  Target: ATXN1; (-) strand; PAM type: NNAGAAW; PAM sequence: ATAGAAT
atgaggagcatatctccgtg

SEQ ID NO: 7949 - DNA, 20 bp, Artificial Sequence
  Description of Artificial Sequence: Synthetic oligonucleotide
  Target: ATXN1; (-) strand; PAM type: NNAGAAW; PAM sequence: GAAGAAA
gctccctccatcccccaccc

SEQ ID NO: 7950 - DNA, 20 bp, Artificial Sequence
  Description of Artificial Sequence: Synthetic oligonucleotide
  Target: ATXN1; (-) strand; PAM type: NNAGAAW; PAM sequence: TCAGAAA
ttcaaggtgaaattgttagt

SEQ ID NO: 7951 - DNA, 20 bp, Artificial Sequence
  Description of Artificial Sequence: Synthetic oligonucleotide
  Target: ATXN1; (-) strand; PAM type: NNAGAAW; PAM sequence: AAAGAAT
agtgaatgtatgcccataga

SEQ ID NO: 7952 - DNA, 20 bp, Artificial Sequence
  Description of Artificial Sequence: Synthetic oligonucleotide
  Target: ATXN1; (-) strand; PAM type: NNAGAAW; PAM sequence: ATAGAAA
gctatagtgaatgtatgccc

SEQ ID NO: 7953 - DNA, 20 bp, Artificial Sequence
  Description of Artificial Sequence: Synthetic oligonucleotide
  Target: ATXN1; (-) strand; PAM type: NNAGAAW; PAM sequence: AGAGAAT
gaaatggaatgtctttacca

SEQ ID NO: 7954 - DNA, 20 bp, Artificial Sequence
  Description of Artificial Sequence: Synthetic oligonucleotide
  Target: ATXN1; (-) strand; PAM type: NNAGAAW; PAM sequence: ATAGAAA
tcgatggtcactagatagaa

SEQ ID NO: 7955 - DNA, 20 bp, Artificial Sequence
  Description of Artificial Sequence: Synthetic oligonucleotide
  Target: ATXN1; (-) strand; PAM type: NNAGAAW; PAM sequence: ATAGAAA
acatattcgatggtcactag

SEQ ID NO: 7956 - DNA, 20 bp, Artificial Sequence
  Description of Artificial Sequence: Synthetic oligonucleotide
  Target: ATXN1; (-) strand; PAM type: NNAGAAW; PAM sequence: GGAGAAT
ctactcaggaggctgaggcg

SEQ ID NO: 7957 - DNA, 20 bp, Artificial Sequence
  Description of Artificial Sequence: Synthetic oligonucleotide
  Target: ATXN1; (-) strand; PAM type: NNAGAAW; PAM sequence: TTAGAAA
ggacattgttaacaatctgc

SEQ ID NO: 7958 - DNA, 20 bp, Artificial Sequence
  Description of Artificial Sequence: Synthetic oligonucleotide
  Target: ATXN1; (-) strand; PAM type: NNAGAAW; PAM sequence: TTAGAAA
ttgcacagttttggcagatt

SEQ ID NO: 7959 - DNA, 20 bp, Artificial Sequence
  Description of Artificial Sequence: Synthetic oligonucleotide
  Target: ATXN1; (-) strand; PAM type: NNAGAAW; PAM sequence: ATAGAAT
tgttggtttttcaggcccta

SEQ ID NO: 7960 - DNA, 20 bp, Artificial Sequence
  Description of Artificial Sequence: Synthetic oligonucleotide
  Target: ATXN1; (-) strand; PAM type: NNAGAAW; PAM sequence: ATAGAAT
ttatatttttgcttctcctg

SEQ ID NO: 7961 - DNA, 20 bp, Artificial Sequence
  Description of Artificial Sequence: Synthetic oligonucleotide
  Target: ATXN1; (-) strand; PAM type: NNAGAAW; PAM sequence: TCAGAAT
tctgtctgtgctatagcatg

SEQ ID NO: 7962 - DNA, 20 bp, Artificial Sequence
  Description of Artificial Sequence: Synthetic oligonucleotide
  Target: ATXN1; (-) strand; PAM type: NNAGAAW; PAM sequence: GGAGAAA
aggtaccttggttggcctgt

SEQ ID NO: 7963 - DNA, 20 bp, Artificial Sequence
  Description of Artificial Sequence: Synthetic oligonucleotide
  Target: ATXN1; (-) strand; PAM type: NNAGAAW; PAM sequence: TGAGAAA
tagcagggagattattggaa

SEQ ID NO: 7964 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
aggtattccgagtgtcttat

SEQ ID NO: 7965 - DNA, 20 bp, Artificial Sequence
  Description of Artificial Sequence: Synthetic oligonucleotide
  Target: ATXN1; (-) strand; PAM type: NNAGAAW; PAM sequence: TTAGAAA
acctcctgttgtttaccttt

SEQ ID NO: 7966 - DNA, 20 bp, Artificial Sequence
  Description of Artificial Sequence: Synthetic oligonucleotide
  Target: ATXN1; (-) strand; PAM type: NNAGAAW; PAM sequence: ATAGAAT
ggagtagacagtaaaaaaaa

SEQ ID NO: 7967 - DNA, 20 bp, Artificial Sequence
  Description of Artificial Sequence: Synthetic oligonucleotide
  Target: ATXN1; (-) strand; PAM type: NNAGAAW; PAM sequence: ATAGAAA
aactctttcaaaaggcaaaa

SEQ ID NO: 7968 - DNA, 20 bp, Artificial Sequence
  Description of Artificial Sequence: Synthetic oligonucleotide
  Target: ATXN1; (-) strand; PAM type: NNAGAAW; PAM sequence: GCAGAAA
tggaggcccttcaaggtaga

SEQ ID NO: 7969 - DNA, 20 bp, Artificial Sequence
  Description of Artificial Sequence: Synthetic oligonucleotide
  Target: ATXN1; (-) strand; PAM type: NNAGAAW; PAM sequence: CCAGAAA
gtactttcagaacaatgtga

SEQ ID NO: 7970 - DNA, 20 bp, Artificial Sequence
  Description of Artificial Sequence: Synthetic oligonucleotide
  Target: ATXN1; (-) strand; PAM type: NNAGAAW; PAM sequence: GAAGAAA
aggcatatgtgaagtctcat

SEQ ID NO: 7971 - DNA, 20 bp, Artificial Sequence
  Description of Artificial Sequence: Synthetic oligonucleotide
  Target: ATXN1; (-) strand; PAM type: NNAGAAW; PAM sequence: CAAGAAA
ctaagggttcccaaaagcag

SEQ ID NO: 7972 - DNA, 20 bp, Artificial Sequence
  Description of Artificial Sequence: Synthetic oligonucleotide
  Target: ATXN1; (-) strand; PAM type: NNAGAAW; PAM sequence: CCAGAAA
gaatgaggagtagatgttaa

SEQ ID NO: 7973 - DNA, 20 bp, Artificial Sequence
  Description of Artificial Sequence: Synthetic oligonucleotide
  Target: ATXN1; (-) strand; PAM type: NNAGAAW; PAM sequence: TGAGAAA
tcagtcactggggaaagaaa

SEQ ID NO: 7974 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
ggagctttcagtcactgggg

SEQ ID NO: 7975 - DNA, 20 bp, Artificial Sequence
  Description of Artificial Sequence: Synthetic oligonucleotide
  Target: ATXN1; (-) strand; PAM type: NNAGAAW; PAM sequence: ACAGAAA
tcttctttcagcaaatattt

SEQ ID NO: 7976 - DNA, 20 bp, Artificial Sequence
  Description of Artificial Sequence: Synthetic oligonucleotide
  Target: ATXN1; (-) strand; PAM type: NNAGAAW; PAM sequence: GAAGAAA
attctttgaaatttaggata

SEQ ID NO: 7977 - DNA, 20 bp, Artificial Sequence
  Description of Artificial Sequence: Synthetic oligonucleotide
  Target: ATXN1; (-) strand; PAM type: NNAGAAW; PAM sequence: TCAGAAT
cagtgaaggtgacacatttg

SEQ ID NO: 7978 - DNA, 20 bp, Artificial Sequence
  Description of Artificial Sequence: Synthetic oligonucleotide
  Target: ATXN1; (-) strand; PAM type: NNAGAAW; PAM sequence: GTAGAAT
gcttccttgacatgtatata

SEQ ID NO: 7979 - DNA, 20 bp, Artificial Sequence
  Description of Artificial Sequence: Synthetic oligonucleotide
  Target: ATXN1; (-) strand; PAM type: NNAGAAW; PAM sequence: GGAGAAT
ctactcgggaggctgaggca

SEQ ID NO: 7980 - DNA, 20 bp, Artificial Sequence
  Description of Artificial Sequence: Synthetic oligonucleotide
  Target: ATXN1; (-) strand; PAM type: NNAGAAW; PAM sequence: GTAGAAA
ataactggaagcatactaga

SEQ ID NO: 7981 - DNA, 20 bp, Artificial Sequence
  Description of Artificial Sequence: Synthetic oligonucleotide
  Target: ATXN1; (-) strand; PAM type: NNAGAAW; PAM sequence: GAAGAAA
gtttgatggttgctttttta

SEQ ID NO: 7982 - DNA, 20 bp, Artificial Sequence
  Description of Artificial Sequence: Synthetic oligonucleotide
  Target: ATXN1; (-) strand; PAM type: NNAGAAW; PAM sequence: TAAGAAA
agatagttctctcatatgaa

SEQ ID NO: 7983 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
gaaagaaataatttttggaa

SEQ ID NO: 7984 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
aagatctgggactggaattg

SEQ ID NO: 7985 - DNA, 20 bp, Artificial Sequence
  Description of Artificial Sequence: Synthetic oligonucleotide
  Target: ATXN1; (-) strand; PAM type: NNAGAAW; PAM sequence: GAAGAAA
gatgccaagacatttttcac

SEQ ID NO: 7986 - DNA, 20 bp, Artificial Sequence
  Description of Artificial Sequence: Synthetic oligonucleotide
  Target: ATXN1; (-) strand; PAM type: NNAGAAW; PAM sequence: ATAGAAA
ccgatttggatccaaagaac

SEQ ID NO: 7987 - DNA, 20 bp, Artificial Sequence
  Description of Artificial Sequence: Synthetic oligonucleotide
  Target: ATXN1; (-) strand; PAM type: NNAGAAW; PAM sequence: GCAGAAT
tgaattaatgggtagtccag

SEQ ID NO: 7988 - DNA, 20 bp, Artificial Sequence
  Description of Artificial Sequence: Synthetic oligonucleotide
  Target: ATXN1; (-) strand; PAM type: NNAGAAW; PAM sequence: GGAGAAT
tggtacagatagaatcccac

SEQ ID NO: 7989 - DNA, 20 bp, Artificial Sequence
  Description of Artificial Sequence: Synthetic oligonucleotide
  Target: ATXN1; (-) strand; PAM type: NNAGAAW; PAM sequence: ATAGAAT
acatggtctttctggtacag

SEQ ID NO: 7990 - DNA, 20 bp, Artificial Sequence
  Description of Artificial Sequence: Synthetic oligonucleotide
  Target: ATXN1; (-) strand; PAM type: NNAGAAW; PAM sequence: GGAGAAA
agaacgctattgttcagaaa

SEQ ID NO: 7991 - DNA, 20 bp, Artificial Sequence
  Description of Artificial Sequence: Synthetic oligonucleotide
  Target: ATXN1; (-) strand; PAM type: NNAGAAW; PAM sequence: TCAGAAA
gaagagtagaacgctattgt

SEQ ID NO: 7992 - DNA, 20 bp, Artificial Sequence
  Description of Artificial Sequence: Synthetic oligonucleotide
  Target: ATXN1; (-) strand; PAM type: NNAGAAW; PAM sequence: ATAGAAT
cccaagcctttgtggcttgc

SEQ ID NO: 7993 - DNA, 20 bp, Artificial Sequence
  Description of Artificial Sequence: Synthetic oligonucleotide
  Target: ATXN1; (-) strand; PAM type: NNAGAAW; PAM sequence: TCAGAAT
gtgacctgcccacattgctg

SEQ ID NO: 7994 - DNA, 20 bp, Artificial Sequence
  Description of Artificial Sequence: Synthetic oligonucleotide
  Target: ATXN1; (-) strand; PAM type: NNAGAAW; PAM sequence: AGAGAAA
agctgtttcaaacctatgtt

SEQ ID NO: 7995 - DNA, 20 bp, Artificial Sequence
  Description of Artificial Sequence: Synthetic oligonucleotide
  Target: ATXN1; (-) strand; PAM type: NNAGAAW; PAM sequence: TCAGAAA
aaacaagtatgttacatgat

SEQ ID NO: 7996 - DNA, 20 bp, Artificial Sequence
  Description of Artificial Sequence: Synthetic oligonucleotide
  Target: ATXN1; (-) strand; PAM type: NNAGAAW; PAM sequence: AAAGAAT
ctaagtagaattgtagactg

SEQ ID NO: 7997 - DNA, 20 bp, Artificial Sequence
  Description of Artificial Sequence: Synthetic oligonucleotide
  Target: ATXN1; (-) strand; PAM type: NNAGAAW; PAM sequence: GTAGAAT
atgtaataaattattgctaa

SEQ ID NO: 7998 - DNA, 20 bp, Artificial Sequence
  Description of Artificial Sequence: Synthetic oligonucleotide
  Target: ATXN1; (-) strand; PAM type: NNAGAAW; PAM sequence: AAAGAAT
ctaaatttttcacttttgta

SEQ ID NO: 7999 - DNA, 20 bp, Artificial Sequence
  Description of Artificial Sequence: Synthetic oligonucleotide
  Target: ATXN1; (-) strand; PAM type: NNAGAAW; PAM sequence: ATAGAAA
ggactaatgtaaacagacaa

SEQ ID NO: 8000 - DNA, 20 bp, Artificial Sequence
  Description of Artificial Sequence: Synthetic oligonucleotide
  Target: ATXN1; (-) strand; PAM type: NNAGAAW; PAM sequence: CAAGAAT
aattcgaagtgctcaatgtt

SEQ ID NO: 8001 - DNA, 20 bp, Artificial Sequence
  Description of Artificial Sequence: Synthetic oligonucleotide
  Target: ATXN1; (-) strand; PAM type: NNAGAAW; PAM sequence: ACAGAAA
tgtttccaactgaactttgt

SEQ ID NO: 8002 - DNA, 20 bp, Artificial Sequence
  Description of Artificial Sequence: Synthetic oligonucleotide
  Target: ATXN1; (-) strand; PAM type: NNAGAAW; PAM sequence: AAAGAAT
agcaagaacttgggatgcct

SEQ ID NO: 8003 - DNA, 20 bp, Artificial Sequence
  Description of Artificial Sequence: Synthetic oligonucleotide
  Target: ATXN1; (-) strand; PAM type: NNAGAAW; PAM sequence: TCAGAAA
gagccagagctttccttcca

SEQ ID NO: 8004 - DNA, 20 bp, Artificial Sequence
  Description of Artificial Sequence: Synthetic oligonucleotide
  Target: ATXN1; (-) strand; PAM type: NNAGAAW; PAM sequence: AGAGAAT
tactctgaatctccagacta

SEQ ID NO: 8005 - DNA, 20 bp, Artificial Sequence
  Description of Artificial Sequence: Synthetic oligonucleotide
  Target: ATXN1; (-) strand; PAM type: NNAGAAW; PAM sequence: GAAGAAA
aggcattactttattcctag

SEQ ID NO: 8006 - DNA, 20 bp, Artificial Sequence
  Description of Artificial Sequence: Synthetic oligonucleotide
  Target: ATXN1; (-) strand; PAM type: NNAGAAW; PAM sequence: TCAGAAT
tgtgtctatggactcccttt

SEQ ID NO: 8007 - DNA, 20 bp, Artificial Sequence
  Description of Artificial Sequence: Synthetic oligonucleotide
  Target: ATXN1; (-) strand; PAM type: NNAGAAW; PAM sequence: TTAGAAT
acttcattctagtgcacacc

SEQ ID NO: 8008 - DNA, 20 bp, Artificial Sequence
  Description of Artificial Sequence: Synthetic oligonucleotide
  Target: ATXN1; (-) strand; PAM type: NNAGAAW; PAM sequence: CTAGAAA
gcctgaagtgctgtatctcc

SEQ ID NO: 8009 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
agtggatacttgatgtgtat

SEQ ID NO: 8010 - DNA, 20 bp, Artificial Sequence
  Description of Artificial Sequence: Synthetic oligonucleotide
  Target: ATXN1; (-) strand; PAM type: NNAGAAW; PAM sequence: TGAGAAT
gaacatacatgctgttctga

SEQ ID NO: 8011 - DNA, 20 bp, Artificial Sequence
  Description of Artificial Sequence: Synthetic oligonucleotide
  Target: ATXN1; (-) strand; PAM type: NNAGAAW; PAM sequence: GGAGAAA
attggttagagtctaagcaa

SEQ ID NO: 8012 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
tgagcacagtcttagggtta

SEQ ID NO: 8013 - DNA, 20 bp, Artificial Sequence
  Description of Artificial Sequence: Synthetic oligonucleotide
  Target: ATXN1; (-) strand; PAM type: NNAGAAW; PAM sequence: TGAGAAA
tcattttatgatggacaact

SEQ ID NO: 8014 - DNA, 20 bp, Artificial Sequence
  Description of Artificial Sequence: Synthetic oligonucleotide
  Target: ATXN1; (-) strand; PAM type: NNAGAAW; PAM sequence: AGAGAAT
aggggggatcttgtacaaga

SEQ ID NO: 8015 - DNA, 20 bp, Artificial Sequence
  Description of Artificial Sequence: Synthetic oligonucleotide
  Target: ATXN1; (-) strand; PAM type: NNAGAAW; PAM sequence: AAAGAAT
agagaaggcaggcaattttc

SEQ ID NO: 8016 - DNA, 20 bp, Artificial Sequence
  Description of Artificial Sequence: Synthetic oligonucleotide
  Target: ATXN1; (-) strand; PAM type: NNAGAAW; PAM sequence: TTAGAAT
ttttcccaatcaggtaactg

SEQ ID NO: 8017 - DNA, 20 bp, Artificial Sequence
  Description of Artificial Sequence: Synthetic oligonucleotide
  Target: ATXN1; (-) strand; PAM type: NNAGAAW; PAM sequence: CTAGAAA
tccagttacagtgtgtttta

SEQ ID NO: 8018 - DNA, 20 bp, Artificial Sequence
  Description of Artificial Sequence: Synthetic oligonucleotide
  Target: ATXN1; (-) strand; PAM type: NNAGAAW; PAM sequence: GGAGAAA
caaagtgtagcatatatcag

SEQ ID NO: 8019 - DNA, 20 bp, Artificial Sequence
  Description of Artificial Sequence: Synthetic oligonucleotide
  Target: ATXN1; (-) strand; PAM type: NNAGAAW; PAM sequence: CCAGAAA
tttccagcttcttaactcag

SEQ ID NO: 8020 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
gttaggagattttgaccagg

SEQ ID NO: 8021 - DNA, 20 bp, Artificial Sequence
  Description of Artificial Sequence: Synthetic oligonucleotide
  Target: ATXN1; (-) strand; PAM type: NNAGAAW; PAM sequence: AGAGAAT
gctcagccctcctactttct

SEQ ID NO: 8022 - DNA, 20 bp, Artificial Sequence
  Description of Artificial Sequence: Synthetic oligonucleotide
  Target: ATXN1; (-) strand; PAM type: NNAGAAW; PAM sequence: GAAGAAA
ttctcacttctctgtgaaag

SEQ ID NO: 8023 - DNA, 20 bp, Artificial Sequence
  Description of Artificial Sequence: Synthetic oligonucleotide
  Target: ATXN1; (-) strand; PAM type: NNAGAAW; PAM sequence: TAAGAAA
agaacattgaacttcttttt

SEQ ID NO: 8024 - DNA, 20 bp, Artificial Sequence
  Description of Artificial Sequence: Synthetic oligonucleotide
  Target: ATXN1; (-) strand; PAM type: NNAGAAW; PAM sequence: CCAGAAA
aagattgtgtctgaagtctc

SEQ ID NO: 8025 - DNA, 20 bp, Artificial Sequence
  Description of Artificial Sequence: Synthetic oligonucleotide
  Target: ATXN1; (-) strand; PAM type: NNAGAAW; PAM sequence: CAAGAAT
cgggaactgtgtgtgctttg

SEQ ID NO: 8026 - DNA, 20 bp, Artificial Sequence
  Description of Artificial Sequence: Synthetic oligonucleotide
  Target: ATXN1; (-) strand; PAM type: NNAGAAW; PAM sequence: CAAGAAA
cttgaaagggggaaaaaaat

SEQ ID NO: 8027 - DNA, 20 bp, Artificial Sequence
  Description of Artificial Sequence: Synthetic oligonucleotide
  Target: ATXN1; (-) strand; PAM type: NNAGAAW; PAM sequence: TCAGAAA
ctcttttttgttttttttcc

SEQ ID NO: 8028 - DNA, 20 bp, Artificial Sequence
  Description of Artificial Sequence: Synthetic oligonucleotide
  Target: ATXN1; (-) strand; PAM type: NNAGAAW; PAM sequence: TGAGAAA
caagcgaatgatttaattaa

SEQ ID NO: 8029 - DNA, 20 bp, Artificial Sequence
  Description of Artificial Sequence: Synthetic oligonucleotide
  Target: ATXN1; (-) strand; PAM type: NNAGAAW; PAM sequence: AGAGAAA
gaaatggcaaaataaaaaag

SEQ ID NO: 8030 - DNA, 20 bp, Artificial Sequence
  Description of Artificial Sequence: Synthetic oligonucleotide
  Target: ATXN1; (-) strand; PAM type: NNAGAAW; PAM sequence: TCAGAAA
ttgctctgatggcctagcag

SEQ ID NO: 8031 - DNA, 20 bp, Artificial Sequence
  Description of Artificial Sequence: Synthetic oligonucleotide
  Target: ATXN1; (-) strand; PAM type: NNAGAAW; PAM sequence: CAAGAAT
gtcattatttgctgtcacat

SEQ ID NO: 8032 - DNA, 20 bp, Artificial Sequence
  Description of Artificial Sequence: Synthetic oligonucleotide
  Target: ATXN1; (-) strand; PAM type: NNAGAAW; PAM sequence: CCAGAAA
ccgtaatcatcaaggggaag

SEQ ID NO: 8033 - DNA, 20 bp, Artificial Sequence
  Description of Artificial Sequence: Synthetic oligonucleotide
  Target: ATXN1; (-) strand; PAM type: NNAGAAW; PAM sequence: AGAGAAA
aaaagctgtttaagtccaag

SEQ ID NO: 8034 - DNA, 20 bp, Artificial Sequence
  Description of Artificial Sequence: Synthetic oligonucleotide
  Target: ATXN1; (-) strand; PAM type: NNAGAAW; PAM sequence: GAAGAAA
agatgtgggatgatagggaa

SEQ ID NO: 8035 - DNA, 20 bp, Artificial Sequence
  Description of Artificial Sequence: Synthetic oligonucleotide
  Target: ATXN1; (-) strand; PAM type: NNAGAAW; PAM sequence: GAAGAAT
actactgattttccttagtg

SEQ ID NO: 8036 - DNA, 20 bp, Artificial Sequence
  Description of Artificial Sequence: Synthetic oligonucleotide
  Target: ATXN1; (-) strand; PAM type: NNAGAAW; PAM sequence: GAAGAAA
atgctttaatgttgtaggat

SEQ ID NO: 8037 - DNA, 20 bp, Artificial Sequence
  Description of Artificial Sequence: Synthetic oligonucleotide
  Target: ATXN1; (-) strand; PAM type: NNAGAAW; PAM sequence: GGAGAAA
gctgtgggcagtcaggggaa

SEQ ID NO: 8038 - DNA, 20 bp, Artificial Sequence
  Description of Artificial Sequence: Synthetic oligonucleotide
  Target: ATXN1; (-) strand; PAM type: NNAGAAW; PAM sequence: TCAGAAT
gaactgaaaaggaccttggg

SEQ ID NO: 8039 - DNA, 20 bp, Artificial Sequence
  Description of Artificial Sequence: Synthetic oligonucleotide
  Target: ATXN1; (-) strand; PAM type: NNAGAAW; PAM sequence: TTAGAAA
ggtttctttcatcagagagc

SEQ ID NO: 8040 - DNA, 20 bp, Artificial Sequence
  Description of Artificial Sequence: Synthetic oligonucleotide
  Target: ATXN1; (-) strand; PAM type: NNAGAAW; PAM sequence: AGAGAAA
ctttcaagtccctggaagac

SEQ ID NO: 8041 - DNA, 20 bp, Artificial Sequence
  Description of Artificial Sequence: Synthetic oligonucleotide
  Target: ATXN1; (-) strand; PAM type: NNAGAAW; PAM sequence: ATAGAAA
taatggattggaagaacaga

SEQ ID NO: 8042 - DNA, 20 bp, Artificial Sequence
  Description of Artificial Sequence: Synthetic oligonucleotide
  Target: ATXN1; (-) strand; PAM type: NNAGAAW; PAM sequence: ACAGAAT
agatgtaatggattggaaga

SEQ ID NO: 8043 - DNA, 20 bp, Artificial Sequence
  Description of Artificial Sequence: Synthetic oligonucleotide
  Target: ATXN1; (-) strand; PAM type: NNAGAAW; PAM sequence: TCAGAAA
cccaccccaagcctactgaa

SEQ ID NO: 8044 - DNA, 20 bp, Artificial Sequence
  Description of Artificial Sequence: Synthetic oligonucleotide
  Target: ATXN1; (-) strand; PAM type: NNAGAAW; PAM sequence: TCAGAAA
cagcatcacctgggaacttg

SEQ ID NO: 8045 - DNA, 20 bp, Artificial Sequence
  Description of Artificial Sequence: Synthetic oligonucleotide
  Target: ATXN1; (-) strand; PAM type: NNAGAAW; PAM sequence: ACAGAAA
tctctctggccctgtaattg

SEQ ID NO: 8046 - DNA, 20 bp, Artificial Sequence
  Description of Artificial Sequence: Synthetic oligonucleotide
  Target: ATXN1; (-) strand; PAM type: NNAGAAW; PAM sequence: GGAGAAT
aggatctggaaccagtagga

SEQ ID NO: 8047 - DNA, 20 bp, Artificial Sequence
  Description of Artificial Sequence: Synthetic oligonucleotide
  Target: ATXN1; (-) strand; PAM type: NNAGAAW; PAM sequence: TGAGAAA
gactgagtatgcttggagtg

SEQ ID NO: 8048 - DNA, 20 bp, Artificial Sequence
  Description of Artificial Sequence: Synthetic oligonucleotide
  Target: ATXN1; (-) strand; PAM type: NNAGAAW; PAM sequence: AGAGAAA
agaaggaaggttactaacac

SEQ ID NO: 8049 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
tagtctactaaataaaagga

SEQ ID NO: 8050 - DNA, 20 bp, Artificial Sequence
  Description of Artificial Sequence: Synthetic oligonucleotide
  Target: ATXN1; (-) strand; PAM type: NNAGAAW; PAM sequence: CCAGAAA
agccaaggggagagatcatt

SEQ ID NO: 8051 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
gctttctgtaagaggtggct

SEQ ID NO: 8052 - DNA, 20 bp, Artificial Sequence
  Description of Artificial Sequence: Synthetic oligonucleotide
  Target: ATXN1; (-) strand; PAM type: NNAGAAW; PAM sequence: GGAGAAT
ctactcaggaggctgagaca

SEQ ID NO: 8053 - DNA, 20 bp, Artificial Sequence
  Description of Artificial Sequence: Synthetic oligonucleotide
  Target: ATXN1; (-) strand; PAM type: NNAGAAW; PAM sequence: TTAGAAT
tggcaatcttgtgggctacg

SEQ ID NO: 8054 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
agtgattcaagcaaaaaaaa

SEQ ID NO: 8055 - DNA, 20 bp, Artificial Sequence
  Description of Artificial Sequence: Synthetic oligonucleotide
  Target: ATXN1; (-) strand; PAM type: NNAGAAW; PAM sequence: TAAGAAT
aagtaccatctcagagaaat

SEQ ID NO: 8056 - DNA, 20 bp, Artificial Sequence
  Description of Artificial Sequence: Synthetic oligonucleotide
  Target: ATXN1; (-) strand; PAM type: NNAGAAW; PAM sequence: AGAGAAA
acccaagaaagtaccatctc

SEQ ID NO: 8057 - DNA, 20 bp, Artificial Sequence
  Description of Artificial Sequence: Synthetic oligonucleotide
  Target: ATXN1; (-) strand; PAM type: NNAGAAW; PAM sequence: CAAGAAA
aaggagtaatataaggaacc

SEQ ID NO: 8058 - DNA, 20 bp, Artificial Sequence
  Description of Artificial Sequence: Synthetic oligonucleotide
  Target: ATXN1; (-) strand; PAM type: NNAGAAW; PAM sequence: TTAGAAA
aggaaatctgtcccctagag

SEQ ID NO: 8059 - DNA, 20 bp, Artificial Sequence
  Description of Artificial Sequence: Synthetic oligonucleotide
  Target: ATXN1; (-) strand; PAM type: NNAGAAW; PAM sequence: ATAGAAA
aacagtagaaggaaatcatt

SEQ ID NO: 8060 - DNA, 20 bp, Artificial Sequence
  Description of Artificial Sequence: Synthetic oligonucleotide
  Target: ATXN1; (-) strand; PAM type: NNAGAAW; PAM sequence: TCAGAAA
gatgatgctgtcagcttcca

SEQ ID NO: 8061 - DNA, 20 bp, Artificial Sequence
  Description of Artificial Sequence: Synthetic oligonucleotide
  Target: ATXN1; (-) strand; PAM type: NNAGAAW; PAM sequence: GGAGAAA
ttggaaaccgatggaatgtg

SEQ ID NO: 8062 - DNA, 20 bp, Artificial Sequence
  Description of Artificial Sequence: Synthetic oligonucleotide
  Target: ATXN1; (-) strand; PAM type: NNAGAAW; PAM sequence: GCAGAAT
gcggtgaagatagaaagggt

SEQ ID NO: 8063 - DNA, 20 bp, Artificial Sequence
  Description of Artificial Sequence: Synthetic oligonucleotide
  Target: ATXN1; (-) strand; PAM type: NNAGAAW; PAM sequence: ATAGAAA
gctagcatggggcggtgaag

SEQ ID NO: 8064 - DNA, 20 bp, Artificial Sequence
  Description of Artificial Sequence: Synthetic oligonucleotide
  Target: ATXN1; (-) strand; PAM type: NNAGAAW; PAM sequence: AGAGAAA
atgactcaaatggtttagag

SEQ ID NO: 8065 - DNA, 20 bp, Artificial Sequence
  Description of Artificial Sequence: Synthetic oligonucleotide
  Target: ATXN1; (-) strand; PAM type: NNAGAAW; PAM sequence: AAAGAAT
gaagatcttcagcatcaaat

SEQ ID NO: 8066 - DNA, 20 bp, Artificial Sequence
  Description of Artificial Sequence: Synthetic oligonucleotide
  Target: ATXN1; (-) strand; PAM type: NNAGAAW; PAM sequence: GTAGAAA
cagtgtgcatgaggggagaa

SEQ ID NO: 8067 - DNA, 20 bp, Artificial Sequence
  Description of Artificial Sequence: Synthetic oligonucleotide
  Target: ATXN1; (-) strand; PAM type: NNAGAAW; PAM sequence: GTAGAAA
cttacattttgacacgtgga

SEQ ID NO: 8068 - DNA, 20 bp, Artificial Sequence
  Description of Artificial Sequence: Synthetic oligonucleotide
  Target: ATXN1; (-) strand; PAM type: NNAGAAW; PAM sequence: GTAGAAA
aataagaggataaaagagtt

SEQ ID NO: 8069 - DNA, 20 bp, Artificial Sequence
  Description of Artificial Sequence: Synthetic oligonucleotide
  Target: ATXN1; (-) strand; PAM type: NNAGAAW; PAM sequence: GTAGAAT
aacttctgattgagaaagtt

SEQ ID NO: 8070 - DNA, 20 bp, Artificial Sequence
  Description of Artificial Sequence: Synthetic oligonucleotide
  Target: ATXN1; (-) strand; PAM type: NNAGAAW; PAM sequence: TGAGAAA
aaaaaaaaaaaacttctgat

SEQ ID NO: 8071 - DNA, 20 bp, Artificial Sequence
  Description of Artificial Sequence: Synthetic oligonucleotide
  Target: ATXN1; (-) strand; PAM type: NNAGAAW; PAM sequence: TCAGAAA
tggcagcttctctttattcc

SEQ ID NO: 8072 - DNA, 20 bp, Artificial Sequence
  Description of Artificial Sequence: Synthetic oligonucleotide
  Target: ATXN1; (-) strand; PAM type: NNAGAAW; PAM sequence: TCAGAAT
ttgtgaataaatcatattct

SEQ ID NO: 8073 - DNA, 20 bp, Artificial Sequence
  Description of Artificial Sequence: Synthetic oligonucleotide
  Target: ATXN1; (-) strand; PAM type: NNAGAAW; PAM sequence: TAAGAAA
atccaaggactgccagtttg

SEQ ID NO: 8074 - DNA, 20 bp, Artificial Sequence
  Description of Artificial Sequence: Synthetic oligonucleotide
  Target: ATXN1; (-) strand; PAM type: NNAGAAW; PAM sequence: AGAGAAT
acaaaccagttaatatacac

SEQ ID NO: 8075 - DNA, 20 bp, Artificial Sequence
  Description of Artificial Sequence: Synthetic oligonucleotide
  Target: ATXN1; (-) strand; PAM type: NNAGAAW; PAM sequence: CCAGAAA
tgcgtgatgactcatggcaa

SEQ ID NO: 8076 - DNA, 20 bp, Artificial Sequence
  Description of Artificial Sequence: Synthetic oligonucleotide
  Target: ATXN1; (-) strand; PAM type: NNAGAAW; PAM sequence: TCAGAAA
gctcatgatttataaatgct

SEQ ID NO: 8077 - DNA, 20 bp, Artificial Sequence
  Description of Artificial Sequence: Synthetic oligonucleotide
  Target: ATXN1; (-) strand; PAM type: NNAGAAW; PAM sequence: AGAGAAT
ctctcaatattatggcaaaa

SEQ ID NO: 8078 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
tgcatggtagtagttcataa

SEQ ID NO: 8079 - DNA, 20 bp, Artificial Sequence
  Description of Artificial Sequence: Synthetic oligonucleotide
  Target: ATXN1; (-) strand; PAM type: NNAGAAW; PAM sequence: TCAGAAA
tctggcactgattttgaatt

SEQ ID NO: 8080 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
tagtaaaacaagtagaccaa

SEQ ID NO: 8081 - DNA, 20 bp, Artificial Sequence
  Description of Artificial Sequence: Synthetic oligonucleotide
  Target: ATXN1; (-) strand; PAM type: NNAGAAW; PAM sequence: TCAGAAA
aatactttgttctgattgag

SEQ ID NO: 8082 - DNA, 20 bp, Artificial Sequence
  Description of Artificial Sequence: Synthetic oligonucleotide
  Target: ATXN1; (-) strand; PAM type: NNAGAAW; PAM sequence: CTAGAAT
attgaaatcccagttttaag

SEQ ID NO: 8083 - DNA, 20 bp, Artificial Sequence
  Description of Artificial Sequence: Synthetic oligonucleotide
  Target: ATXN1; (-) strand; PAM type: NNAGAAW; PAM sequence: AAAGAAT
agcgccacattcatagaaag

SEQ ID NO: 8084 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
cttcagcgccacattcatag

SEQ ID NO: 8085 - DNA, 20 bp, Artificial Sequence
  Description of Artificial Sequence: Synthetic oligonucleotide
  Target: ATXN1; (-) strand; PAM type: NNAGAAW; PAM sequence: ATAGAAA
aaatcttcagcgccacattc

SEQ ID NO: 8086 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
ttgtagaatgctcatggtgt

SEQ ID NO: 8087 - DNA, 20 bp, Artificial Sequence
  Description of Artificial Sequence: Synthetic oligonucleotide
  Target: ATXN1; (-) strand; PAM type: NNAGAAW; PAM sequence: GTAGAAT
taaagagaggtaggaaactt

SEQ ID NO: 8088 - DNA, 20 bp, Artificial Sequence
  Description of Artificial Sequence: Synthetic oligonucleotide
  Target: ATXN1; (-) strand; PAM type: NNAGAAW; PAM sequence: CGAGAAT
aatggggatatgctcttccc

SEQ ID NO: 8089 - DNA, 20 bp, Artificial Sequence
  Description of Artificial Sequence: Synthetic oligonucleotide
  Target: ATXN1; (-) strand; PAM type: NNAGAAW; PAM sequence: ATAGAAA
tcctgttattctttctccta

SEQ ID NO: 8090 - DNA, 20 bp, Artificial Sequence
  Description of Artificial Sequence: Synthetic oligonucleotide
  Target: ATXN1; (-) strand; PAM type: NNAGAAW; PAM sequence: GGAGAAA
ctgcaagatgaaggaggagg

SEQ ID NO: 8091 - DNA, 20 bp, Artificial Sequence
  Description of Artificial Sequence: Synthetic oligonucleotide
  Target: ATXN1; (-) strand; PAM type: NNAGAAW; PAM sequence: TGAGAAT
tatattaggagttgtaagtg

SEQ ID NO: 8092 - DNA, 20 bp, Artificial Sequence
  Description of Artificial Sequence: Synthetic oligonucleotide
  Target: ATXN1; (-) strand; PAM type: NNAGAAW; PAM sequence: ATAGAAT
agaattccattgttttagca

SEQ ID NO: 8093 - DNA, 20 bp, Artificial Sequence
  Description of Artificial Sequence: Synthetic oligonucleotide
  Target: ATXN1; (-) strand; PAM type: NNAGAAW; PAM sequence: GGAGAAT
ccataacgaagtcattcccg

SEQ ID NO: 8094 - DNA, 20 bp, Artificial Sequence
  Description of Artificial Sequence: Synthetic oligonucleotide
  Target: ATXN1; (-) strand; PAM type: NNAGAAW; PAM sequence: CAAGAAT
gagagtgaaagtcacacgaa

SEQ ID NO: 8095 - DNA, 20 bp, Artificial Sequence
  Description of Artificial Sequence: Synthetic oligonucleotide
  Target: ATXN1; (-) strand; PAM type: NNAGAAW; PAM sequence: TTAGAAA
gggcattccagtgattgaca

SEQ ID NO: 8096 - DNA, 20 bp, Artificial Sequence
  Description of Artificial Sequence: Synthetic oligonucleotide
  Target: ATXN1; (-) strand; PAM type: NNAGAAW; PAM sequence: TCAGAAA
gaatagacaactccttagag

SEQ ID NO: 8097 - DNA, 20 bp, Artificial Sequence
  Description of Artificial Sequence: Synthetic oligonucleotide
  Target: ATXN1; (-) strand; PAM type: NNAGAAW; PAM sequence: CCAGAAT
attcagtttatacacaacat

SEQ ID NO: 8098 - DNA, 20 bp, Artificial Sequence
  Description of Artificial Sequence: Synthetic oligonucleotide
  Target: ATXN1; (-) strand; PAM type: NNAGAAW; PAM sequence: AGAGAAA
gccttgaaaacattatgcca

SEQ ID NO: 8099 - DNA, 20 bp, Artificial Sequence
  Description of Artificial Sequence: Synthetic oligonucleotide
  Target: ATXN1; (-) strand; PAM type: NNAGAAW; PAM sequence: CAAGAAT
agagtattattgaaccaaaa

SEQ ID NO: 8100 - DNA, 20 bp, Artificial Sequence
  Description of Artificial Sequence: Synthetic oligonucleotide
  Target: ATXN1; (-) strand; PAM type: NNAGAAW; PAM sequence: ACAGAAT
aagtcctcaaatagctaaat

SEQ ID NO: 8101 - DNA, 20 bp, Artificial Sequence
  Description of Artificial Sequence: Synthetic oligonucleotide
  Target: ATXN1; (-) strand; PAM type: NNAGAAW; PAM sequence: ATAGAAA
tgtagtatggtgcaatcact

SEQ ID NO: 8102 - DNA, 20 bp, Artificial Sequence
  Description of Artificial Sequence: Synthetic oligonucleotide
  Target: ATXN1; (-) strand; PAM type: NNAGAAW; PAM sequence: AGAGAAA
aaagaactcttacaattcaa

SEQ ID NO: 8103 - DNA, 20 bp, Artificial Sequence
  Description of Artificial Sequence: Synthetic oligonucleotide
  Target: ATXN1; (-) strand; PAM type: NNAGAAW; PAM sequence: GGAGAAA
aaaagacagcccacagaatg

SEQ ID NO: 8104 - DNA, 20 bp, Artificial Sequence
  Description of Artificial Sequence: Synthetic oligonucleotide
  Target: ATXN1; (-) strand; PAM type: NNAGAAW; PAM sequence: ACAGAAT
agaaagtcaaaagacagccc

SEQ ID NO: 8105 - DNA, 20 bp, Artificial Sequence
  Description of Artificial Sequence: Synthetic oligonucleotide
  Target: ATXN1; (-) strand; PAM type: NNAGAAW; PAM sequence: CAAGAAA
tgtgaaccaaagggcactgt

SEQ ID NO: 8106 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
caccaaaagcacaaacaaca

SEQ ID NO: 8107 - DNA, 20 bp, Artificial Sequence
  Description of Artificial Sequence: Synthetic oligonucleotide
  Target: ATXN1; (-) strand; PAM type: NNAGAAW; PAM sequence: AGAGAAA
agtcacctgggacacatgcc

SEQ ID NO: 8108 - DNA, 20 bp, Artificial Sequence
  Description of Artificial Sequence: Synthetic oligonucleotide
  Target: ATXN1; (-) strand; PAM type: NNAGAAW; PAM sequence: AGAGAAA
tttaaagttttgttttttca

SEQ ID NO: 8109 - DNA, 20 bp, Artificial Sequence
  Description of Artificial Sequence: Synthetic oligonucleotide
  Target: ATXN1; (-) strand; PAM type: NNAGAAW; PAM sequence: CCAGAAA
agtcatagtgtaaccaaaag

SEQ ID NO: 8110 - DNA, 20 bp, Artificial Sequence
  Description of Artificial Sequence: Synthetic oligonucleotide
  Target: ATXN1; (-) strand; PAM type: NNAGAAW; PAM sequence: CCAGAAT
attggctgaattgatgatag

SEQ ID NO: 8111 - DNA, 20 bp, Artificial Sequence
  Description of Artificial Sequence: Synthetic oligonucleotide
  Target: ATXN1; (-) strand; PAM type: NNAGAAW; PAM sequence: GTAGAAT
ctctccaccttggctgcata

SEQ ID NO: 8112 - DNA, 20 bp, Artificial Sequence
  Description of Artificial Sequence: Synthetic oligonucleotide
  Target: ATXN1; (-) strand; PAM type: NNAGAAW; PAM sequence: CAAGAAA
agagtgaatgataactgata

SEQ ID NO: 8113 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
cacatgcatacaatatagag

SEQ ID NO: 8114 - DNA, 20 bp, Artificial Sequence
  Description of Artificial Sequence: Synthetic oligonucleotide
  Target: ATXN1; (-) strand; PAM type: NNAGAAW; PAM sequence: AGAGAAA
cacccacatgcatacaatat

SEQ ID NO: 8115 - DNA, 20 bp, Artificial Sequence
  Description of Artificial Sequence: Synthetic oligonucleotide
  Target: ATXN1; (-) strand; PAM type: NNAGAAW; PAM sequence: AAAGAAT
ccagtcttatcacatcttgg

SEQ ID NO: 8116 - DNA, 20 bp, Artificial Sequence
  Description of Artificial Sequence: Synthetic oligonucleotide
  Target: ATXN1; (-) strand; PAM type: NNAGAAW; PAM sequence: AGAGAAA
gagtgcaccagtttaaaata

SEQ ID NO: 8117 - DNA, 20 bp, Artificial Sequence
  Description of Artificial Sequence: Synthetic oligonucleotide
  Target: ATXN1; (-) strand; PAM type: NNAGAAW; PAM sequence: ACAGAAT
cttatggcataataatggaa

SEQ ID NO: 8118 - DNA, 20 bp, Artificial Sequence
  Description of Artificial Sequence: Synthetic oligonucleotide
  Target: ATXN1; (-) strand; PAM type: NNAGAAW; PAM sequence: AAAGAAT
tttaaaaatattttaaaaat

SEQ ID NO: 8119 - DNA, 20 bp, Artificial Sequence
  Description of Artificial Sequence: Synthetic oligonucleotide
  Target: ATXN1; (-) strand; PAM type: NNAGAAW; PAM sequence: AGAGAAT
agtggggggcaaggggaggg

SEQ ID NO: 8120 - DNA, 20 bp, Artificial Sequence
  Description of Artificial Sequence: Synthetic oligonucleotide
  Target: ATXN1; (-) strand; PAM type: NNAGAAW; PAM sequence: ACAGAAA
ctcagcaaactaacacagga

SEQ ID NO: 8121 - DNA, 20 bp, Artificial Sequence
  Description of Artificial Sequence: Synthetic oligonucleotide
  Target: ATXN1; (-) strand; PAM type: NNAGAAW; PAM sequence: AAAGAAT
gaatactatgcagccataaa

SEQ ID NO: 8122 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
ccatcaatgatagactggat

SEQ ID NO: 8123 - DNA, 20 bp, Artificial Sequence
  Description of Artificial Sequence: Synthetic oligonucleotide
  Target: ATXN1; (-) strand; PAM type: NNAGAAW; PAM sequence: CCAGAAA
gattcctcaaggatctagaa

SEQ ID NO: 8124 - DNA, 20 bp, Artificial Sequence
  Description of Artificial Sequence: Synthetic oligonucleotide
  Target: ATXN1; (-) strand; PAM type: NNAGAAW; PAM sequence: GGAGAAA
atagatgctggcgaggctgt

SEQ ID NO: 8125 - DNA, 20 bp, Artificial Sequence
  Description of Artificial Sequence: Synthetic oligonucleotide
  Target: ATXN1; (-) strand; PAM type: NNAGAAW; PAM sequence: ATAGAAT
gcagctcctaaatctattgt

SEQ ID NO: 8126 - DNA, 20 bp, Artificial Sequence
  Description of Artificial Sequence: Synthetic oligonucleotide
  Target: ATXN1; (-) strand; PAM type: NNAGAAW; PAM sequence: TAAGAAA
accaacttctaatacttgcc

SEQ ID NO: 8127 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
gtaaagtcttgatacactga

SEQ ID NO: 8128 - DNA, 20 bp, Artificial Sequence
  Description of Artificial Sequence: Synthetic oligonucleotide
  Target: ATXN1; (-) strand; PAM type: NNAGAAW; PAM sequence: TGAGAAT
tatagcaattcagagcatac

SEQ ID NO: 8129 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
cattatttttagcctattac

SEQ ID NO: 8130 - DNA, 20 bp, Artificial Sequence
  Description of Artificial Sequence: Synthetic oligonucleotide
  Target: ATXN1; (-) strand; PAM type: NNAGAAW; PAM sequence: CCAGAAT
tgtttctttacggtctatag

SEQ ID NO: 8131 - DNA, 20 bp, Artificial Sequence
  Description of Artificial Sequence: Synthetic oligonucleotide
  Target: ATXN1; (-) strand; PAM type: NNAGAAW; PAM sequence: GTAGAAA
cagtaactcaaaaggaattt

SEQ ID NO: 8132 - DNA, 20 bp, Artificial Sequence
  Description of Artificial Sequence: Synthetic oligonucleotide
  Target: ATXN1; (-) strand; PAM type: NNAGAAW; PAM sequence: ATAGAAT
tgtcataagggtccacttaa

SEQ ID NO: 8133 - DNA, 20 bp, Artificial Sequence
  Description of Artificial Sequence: Synthetic oligonucleotide
  Target: ATXN1; (-) strand; PAM type: NNAGAAW; PAM sequence: TAAGAAT
agatcattcaattacatttt

SEQ ID NO: 8134 - DNA, 20 bp, Artificial Sequence
  Description of Artificial Sequence: Synthetic oligonucleotide
  Target: ATXN1; (-) strand; PAM type: NNAGAAW; PAM sequence: TCAGAAA
atataaaataagtcctgagt

SEQ ID NO: 8135 - DNA, 20 bp, Artificial Sequence
  Description of Artificial Sequence: Synthetic oligonucleotide
  Target: ATXN1; (-) strand; PAM type: NNAGAAW; PAM sequence: GTAGAAT
gcctgaaccaaccatgcaaa

SEQ ID NO: 8136 - DNA, 20 bp, Artificial Sequence
  Description of Artificial Sequence: Synthetic oligonucleotide
  Target: ATXN1; (-) strand; PAM type: NNAGAAW; PAM sequence: ACAGAAA
tgtttacttatttctgagta

SEQ ID NO: 8137 - DNA, 20 bp, Artificial Sequence
  Description of Artificial Sequence: Synthetic oligonucleotide
  Target: ATXN1; (-) strand; PAM type: NNAGAAW; PAM sequence: ATAGAAT
gatgtcagcctgacctaatg

SEQ ID NO: 8138 - DNA, 20 bp, Artificial Sequence
  Description of Artificial Sequence: Synthetic oligonucleotide
  Target: ATXN1; (-) strand; PAM type: NNAGAAW; PAM sequence: TGAGAAA
tgggtatatggaggctttta

SEQ ID NO: 8139 - DNA, 20 bp, Artificial Sequence
  Description of Artificial Sequence: Synthetic oligonucleotide
  Target: ATXN1; (-) strand; PAM type: NNAGAAW; PAM sequence: GGAGAAT
ccctccagatgaagtgaaaa

SEQ ID NO: 8140 - DNA, 20 bp, Artificial Sequence
  Description of Artificial Sequence: Synthetic oligonucleotide
  Target: ATXN1; (-) strand; PAM type: NNAGAAW; PAM sequence: CTAGAAA
ggccaaacttctgtgctacc

SEQ ID NO: 8141 - DNA, 20 bp, Artificial Sequence
  Description of Artificial Sequence: Synthetic oligonucleotide
  Target: ATXN1; (-) strand; PAM type: NNAGAAW; PAM sequence: TTAGAAA
atcatactagagaaaaatca

SEQ ID NO: 8142 - DNA, 20 bp, Artificial Sequence
  Description of Artificial Sequence: Synthetic oligonucleotide
  Target: ATXN1; (-) strand; PAM type: NNAGAAW; PAM sequence: AGAGAAA
ctattaaataaaatcatact

SEQ ID NO: 8143 - DNA, 20 bp, Artificial Sequence
  Description of Artificial Sequence: Synthetic oligonucleotide
  Target: ATXN1; (-) strand; PAM type: NNAGAAW; PAM sequence: TCAGAAT
gtcttgtggcctgatctcca

SEQ ID NO: 8144 - DNA, 20 bp, Artificial Sequence
  Description of Artificial Sequence: Synthetic oligonucleotide
  Target: ATXN1; (-) strand; PAM type: NNAGAAW; PAM sequence: GGAGAAA
accaattacatagggagtga

SEQ ID NO: 8145 - DNA, 20 bp, Artificial Sequence
  Description of Artificial Sequence: Synthetic oligonucleotide
  Target: ATXN1; (-) strand; PAM type: NNAGAAW; PAM sequence: AGAGAAT
aaatggattctgtgttttcc

SEQ ID NO: 8146 - DNA, 20 bp, Artificial Sequence
  Description of Artificial Sequence: Synthetic oligonucleotide
  Target: ATXN1; (-) strand; PAM type: NNAGAAW; PAM sequence: AGAGAAT
ctttactcccttagggtaga

SEQ ID NO: 8147 - DNA, 20 bp, Artificial Sequence
  Description of Artificial Sequence: Synthetic oligonucleotide
  Target: ATXN1; (-) strand; PAM type: NNAGAAW; PAM sequence: TTAGAAA
gaatttctaaataccatata

SEQ ID NO: 8148 - DNA, 20 bp, Artificial Sequence
  Description of Artificial Sequence: Synthetic oligonucleotide
  Target: ATXN1; (-) strand; PAM type: NNAGAAW; PAM sequence: AGAGAAT
tcaaacaccttctatagtgc

SEQ ID NO: 8149 - DNA, 20 bp, Artificial Sequence
  Description of Artificial Sequence: Synthetic oligonucleotide
  Target: ATXN1; (-) strand; PAM type: NNAGAAW; PAM sequence: TAAGAAA
cattgctcataaatgtttgc

SEQ ID NO: 8150 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
tggctttggagacttcagtc

SEQ ID NO: 8151 - DNA, 20 bp, Artificial Sequence
  Description of Artificial Sequence: Synthetic oligonucleotide
  Target: ATXN1; (-) strand; PAM type: NNAGAAW; PAM sequence: GGAGAAA
cttttctgagggctttcttt

SEQ ID NO: 8152 - DNA, 20 bp, Artificial Sequence
  Description of Artificial Sequence: Synthetic oligonucleotide
  Target: ATXN1; (-) strand; PAM type: NNAGAAW; PAM sequence: CAAGAAT
aactaggaaagtcatacttc

SEQ ID NO: 8153 - DNA, 20 bp, Artificial Sequence
  Description of Artificial Sequence: Synthetic oligonucleotide
  Target: ATXN1; (-) strand; PAM type: NNAGAAW; PAM sequence: CCAGAAA
ctctgtgtttgatgctatta

SEQ ID NO: 8154 - DNA, 20 bp, Artificial Sequence
  Description of Artificial Sequence: Synthetic oligonucleotide
  Target: ATXN1; (-) strand; PAM type: NNAGAAW; PAM sequence: TCAGAAT
catccatgttgtaacatgtg

SEQ ID NO: 8155 - DNA, 20 bp, Artificial Sequence
  Description of Artificial Sequence: Synthetic oligonucleotide
  Target: ATXN1; (-) strand; PAM type: NNAGAAW; PAM sequence: GTAGAAT
gctctagggacctcctatga

SEQ ID NO: 8156 - DNA, 20 bp, Artificial Sequence
  Description of Artificial Sequence: Synthetic oligonucleotide
  Target: ATXN1; (-) strand; PAM type: NNAGAAW; PAM sequence: ATAGAAA
agaaacctgtagttgacagg

SEQ ID NO: 8157 - DNA, 20 bp, Artificial Sequence
  Description of Artificial Sequence: Synthetic oligonucleotide
  Target: ATXN1; (-) strand; PAM type: NNAGAAW; PAM sequence: TAAGAAA
agaaaaacagggaggccagg

SEQ ID NO: 8158 - DNA, 20 bp, Artificial Sequence
  Description of Artificial Sequence: Synthetic oligonucleotide
  Target: ATXN1; (-) strand; PAM type: NNAGAAW; PAM sequence: CAAGAAA
ctgtgacattaaaaggatgg

SEQ ID NO: 8159 - DNA, 20 bp, Artificial Sequence
  Description of Artificial Sequence: Synthetic oligonucleotide
  Target: ATXN1; (-) strand; PAM type: NNAGAAW; PAM sequence: TCAGAAT
aattaccataaataggacag

SEQ ID NO: 8160 - DNA, 20 bp, Artificial Sequence
  Description of Artificial Sequence: Synthetic oligonucleotide
  Target: ATXN1; (-) strand; PAM type: NNAGAAW; PAM sequence: ACAGAAT
agtttcagtcctgaatggct

SEQ ID NO: 8161 - DNA, 20 bp, Artificial Sequence
  Description of Artificial Sequence: Synthetic oligonucleotide
  Target: ATXN1; (-) strand; PAM type: NNAGAAW; PAM sequence: TTAGAAA
aagaagattgaaactgcagt

SEQ ID NO: 8162 - DNA, 20 bp, Artificial Sequence
  Description of Artificial Sequence: Synthetic oligonucleotide
  Target: ATXN1; (-) strand; PAM type: NNAGAAW; PAM sequence: CGAGAAA
agcaacaagagattttgaaa

SEQ ID NO: 8163 - DNA, 20 bp, Artificial Sequence
  Description of Artificial Sequence: Synthetic oligonucleotide
  Target: ATXN1; (-) strand; PAM type: NNAGAAW; PAM sequence: ACAGAAA
ttataagtctactggatgtg

SEQ ID NO: 8164 - DNA, 20 bp, Artificial Sequence
  Description of Artificial Sequence: Synthetic oligonucleotide
  Target: ATXN1; (-) strand; PAM type: NNAGAAW; PAM sequence: GAAGAAT
tcagaaggttgtggacttct

SEQ ID NO: 8165 - DNA, 20 bp, Artificial Sequence
  Description of Artificial Sequence: Synthetic oligonucleotide
  Target: ATXN1; (-) strand; PAM type: NNAGAAW; PAM sequence: GGAGAAA
gttgctaggttgattctgag

SEQ ID NO: 8166 - DNA, 20 bp, Artificial Sequence
  Description of Artificial Sequence: Synthetic oligonucleotide
  Target: ATXN1; (-) strand; PAM type: NNAGAAW; PAM sequence: GGAGAAA
agattagagggaccgtttga

SEQ ID NO: 8167 - DNA, 20 bp, Artificial Sequence
  Description of Artificial Sequence: Synthetic oligonucleotide
  Target: ATXN1; (-) strand; PAM type: NNAGAAW; PAM sequence: AGAGAAT
aacttgtctttatctttaaa

SEQ ID NO: 8168 - DNA, 20 bp, Artificial Sequence
  Description of Artificial Sequence: Synthetic oligonucleotide
  Target: ATXN1; (-) strand; PAM type: NNAGAAW; PAM sequence: TTAGAAA
aaaatctgtgggcagaactt

SEQ ID NO: 8169 - DNA, 20 bp, Artificial Sequence
  Description of Artificial Sequence: Synthetic oligonucleotide
  Target: ATXN1; (-) strand; PAM type: NNAGAAW; PAM sequence: CTAGAAA
tcacagccactaacaaattc

SEQ ID NO: 8170 - DNA, 20 bp, Artificial Sequence
  Description of Artificial Sequence: Synthetic oligonucleotide
  Target: ATXN1; (-) strand; PAM type: NNAGAAW; PAM sequence: AGAGAAA
ctaaataatatttggtcaaa

SEQ ID NO: 8171 - DNA, 20 bp, Artificial Sequence
  Description of Artificial Sequence: Synthetic oligonucleotide
  Target: ATXN1; (-) strand; PAM type: NNAGAAW; PAM sequence: TTAGAAA
atactgaacagatattttac

SEQ ID NO: 8172 - DNA, 20 bp, Artificial Sequence
  Description of Artificial Sequence: Synthetic oligonucleotide
  Target: ATXN1; (-) strand; PAM type: NNAGAAW; PAM sequence: AAAGAAT
ggcttcagagtcagctaacc

SEQ ID NO: 8173 - DNA, 20 bp, Artificial Sequence
  Description of Artificial Sequence: Synthetic oligonucleotide
  Target: ATXN1; (-) strand; PAM type: NNAGAAW; PAM sequence: GTAGAAA
attcttttgatgtactttgt

SEQ ID NO: 8174 - DNA, 20 bp, Artificial Sequence
  Description of Artificial Sequence: Synthetic oligonucleotide
  Target: ATXN1; (-) strand; PAM type: NNAGAAW; PAM sequence: TTAGAAT
gtcctagagactttaaacat

SEQ ID NO: 8175 - DNA, 20 bp, Artificial Sequence
  Description of Artificial Sequence: Synthetic oligonucleotide
  Target: ATXN1; (-) strand; PAM type: NNAGAAW; PAM sequence: AGAGAAT
aaagatgctactgggagaga

SEQ ID NO: 8176 - DNA, 20 bp, Artificial Sequence
  Description of Artificial Sequence: Synthetic oligonucleotide
  Target: ATXN1; (-) strand; PAM type: NNAGAAW; PAM sequence: GAAGAAA
tttgatttgggagaaaggag

SEQ ID NO: 8177 - DNA, 20 bp, Artificial Sequence
  Description of Artificial Sequence: Synthetic oligonucleotide
  Target: ATXN1; (-) strand; PAM type: NNAGAAW; PAM sequence: GGAGAAA
agggagtcagttttgatttg

SEQ ID NO: 8178 - DNA, 20 bp, Artificial Sequence
  Description of Artificial Sequence: Synthetic oligonucleotide
  Target: ATXN1; (-) strand; PAM type: NNAGAAW; PAM sequence: CGAGAAA
taaaatggtttgaatgtggg

SEQ ID NO: 8179 - DNA, 20 bp, Artificial Sequence
  Description of Artificial Sequence: Synthetic oligonucleotide
  Target: ATXN1; (-) strand; PAM type: NNAGAAW; PAM sequence: TTAGAAA
acaaactgagcaactgggta

SEQ ID NO: 8180 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
accgatgtggaggacactac

SEQ ID NO: 8181 - DNA, 20 bp, Artificial Sequence
  Description of Artificial Sequence: Synthetic oligonucleotide
  Target: ATXN1; (-) strand; PAM type: NNAGAAW; PAM sequence: GGAGAAA
tccatatcccgtgagatggt

SEQ ID NO: 8182 - DNA, 20 bp, Artificial Sequence
  Description of Artificial Sequence: Synthetic oligonucleotide
  Target: ATXN1; (-) strand; PAM type: NNAGAAW; PAM sequence: AGAGAAA
acgtgtgtattatgtggtga

SEQ ID NO: 8183 - DNA, 20 bp, Artificial Sequence
  Description of Artificial Sequence: Synthetic oligonucleotide
  Target: ATXN1; (-) strand; PAM type: NNAGAAW; PAM sequence: AAAGAAT
cacaccacatgtgtcagacc

SEQ ID NO: 8184 - DNA, 20 bp, Artificial Sequence
  Description of Artificial Sequence: Synthetic oligonucleotide
  Target: ATXN1; (-) strand; PAM type: NNAGAAW; PAM sequence: AGAGAAA
ggagaatggacagctcatag

SEQ ID NO: 8185 - DNA, 20 bp, Artificial Sequence
  Description of Artificial Sequence: Synthetic oligonucleotide
  Target: ATXN1; (-) strand; PAM type: NNAGAAW; PAM sequence: GGAGAAT
ctccgtgtaggactcaacac

SEQ ID NO: 8186 - DNA, 20 bp, Artificial Sequence
  Description of Artificial Sequence: Synthetic oligonucleotide
  Target: ATXN1; (-) strand; PAM type: NNAGAAW; PAM sequence: TAAGAAT
ggtaaaagaatgaatgaact

SEQ ID NO: 8187 - DNA, 20 bp, Artificial Sequence
  Description of Artificial Sequence: Synthetic oligonucleotide
  Target: ATXN1; (-) strand; PAM type: NNAGAAW; PAM sequence: AAAGAAT
gctcgataacgtgtagggta

SEQ ID NO: 8188 - DNA, 20 bp, Artificial Sequence
  Description of Artificial Sequence: Synthetic oligonucleotide
  Target: ATXN1; (-) strand; PAM type: NNAGAAW; PAM sequence: AGAGAAA
tctttcatgatcactggaag

SEQ ID NO: 8189 - DNA, 20 bp, Artificial Sequence
  Description of Artificial Sequence: Synthetic oligonucleotide
  Target: ATXN1; (-) strand; PAM type: NNAGAAW; PAM sequence: GCAGAAA
ggataggataagcttttgtt

SEQ ID NO: 8190 - DNA, 20 bp, Artificial Sequence
  Description of Artificial Sequence: Synthetic oligonucleotide
  Target: ATXN1; (-) strand; PAM type: NNAGAAW; PAM sequence: AGAGAAA
cattaccaaatggtaataat

SEQ ID NO: 8191 - DNA, 20 bp, Artificial Sequence
  Description of Artificial Sequence: Synthetic oligonucleotide
  Target: ATXN1; (-) strand; PAM type: NNAGAAW; PAM sequence: ACAGAAT
aatgatgagccatggttgac

SEQ ID NO: 8192 - DNA, 20 bp, Artificial Sequence
  Description of Artificial Sequence: Synthetic oligonucleotide
  Target: ATXN1; (-) strand; PAM type: NNAGAAW; PAM sequence: TGAGAAT
tgaatgaacaaatgactgaa

SEQ ID NO: 8193 - DNA, 20 bp, Artificial Sequence
  Description of Artificial Sequence: Synthetic oligonucleotide
  Target: ATXN1; (-) strand; PAM type: NNAGAAW; PAM sequence: TCAGAAA
ctttttttctctgctacctc

SEQ ID NO: 8194 - DNA, 20 bp, Artificial Sequence
  Description of Artificial Sequence: Synthetic oligonucleotide
  Target: ATXN1; (-) strand; PAM type: NNAGAAW; PAM sequence: TTAGAAT
tttattgttagtctcctcta

SEQ ID NO: 8195 - DNA, 20 bp, Artificial Sequence
  Description of Artificial Sequence: Synthetic oligonucleotide
  Target: ATXN1; (-) strand; PAM type: NNAGAAW; PAM sequence: ATAGAAA
cataagggaaatcctccccc

SEQ ID NO: 8196 - DNA, 20 bp, Artificial Sequence
  Description of Artificial Sequence: Synthetic oligonucleotide
  Target: ATXN1; (-) strand; PAM type: NNAGAAW; PAM sequence: GAAGAAA
actcattccacacccttggg

SEQ ID NO: 8197 - DNA, 20 bp, Artificial Sequence
  Description of Artificial Sequence: Synthetic oligonucleotide
  Target: ATXN1; (-) strand; PAM type: NNAGAAW; PAM sequence: GGAGAAA
ctgtctgtgtgaagagggaa

SEQ ID NO: 8198 - DNA, 20 bp, Artificial Sequence
  Description of Artificial Sequence: Synthetic oligonucleotide
  Target: ATXN1; (-) strand; PAM type: NNAGAAW; PAM sequence: CCAGAAT
agtattgaggcagacggggg

SEQ ID NO: 8199 - DNA, 20 bp, Artificial Sequence
  Description of Artificial Sequence: Synthetic oligonucleotide
  Target: ATXN1; (-) strand; PAM type: NNAGAAW; PAM sequence: TGAGAAA
gtcccaagttctgagcccac

SEQ ID NO: 8200 - DNA, 20 bp, Artificial Sequence
  Description of Artificial Sequence: Synthetic oligonucleotide
  Target: ATXN1; (-) strand; PAM type: NNAGAAW; PAM sequence: TAAGAAT
gcagatataaagtcacaagg

SEQ ID NO: 8201 - DNA, 20 bp, Artificial Sequence
  Description of Artificial Sequence: Synthetic oligonucleotide
  Target: ATXN1; (-) strand; PAM type: NNAGAAW; PAM sequence: CAAGAAA
cttcaaagaaaagataaact

SEQ ID NO: 8202 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
aaaatgttgttcagttcttc

SEQ ID NO: 8203 - DNA, 20 bp, Artificial Sequence
  Description of Artificial Sequence: Synthetic oligonucleotide
  Target: ATXN1; (-) strand; PAM type: NNAGAAW; PAM sequence: AAAGAAT
catctatataatccttgatg

SEQ ID NO: 8204 - DNA, 20 bp, Artificial Sequence
  Description of Artificial Sequence: Synthetic oligonucleotide
  Target: ATXN1; (-) strand; PAM type: NNAGAAW; PAM sequence: AGAGAAA
caggcccagtaggactgcac

SEQ ID NO: 8205 - DNA, 20 bp, Artificial Sequence
  Description of Artificial Sequence: Synthetic oligonucleotide
  Target: ATXN1; (-) strand; PAM type: NNAGAAW; PAM sequence: TCAGAAT
tgtgtggcacagcggctctg

SEQ ID NO: 8206 - DNA, 20 bp, Artificial Sequence
  Description of Artificial Sequence: Synthetic oligonucleotide
  Target: ATXN1; (-) strand; PAM type: NNAGAAW; PAM sequence: GGAGAAT
tcctggggcctgtgatatgc

SEQ ID NO: 8207 - DNA, 20 bp, Artificial Sequence
  Description of Artificial Sequence: Synthetic oligonucleotide
  Target: ATXN1; (-) strand; PAM type: NNAGAAW; PAM sequence: CCAGAAA
atagcaacgtgactgtgctg

SEQ ID NO: 8208 - DNA, 20 bp, Artificial Sequence
  Description of Artificial Sequence: Synthetic oligonucleotide
  Target: ATXN1; (-) strand; PAM type: NNAGAAW; PAM sequence: TGAGAAA
aatttttttattttaccaaa

SEQ ID NO: 8209 - DNA, 20 bp, Artificial Sequence
  Description of Artificial Sequence: Synthetic oligonucleotide
  Target: ATXN1; (-) strand; PAM type: NNAGAAW; PAM sequence: CAAGAAA
tggtagagaagggtctgagg

SEQ ID NO: 8210 - DNA, 20 bp, Artificial Sequence
  Description of Artificial Sequence: Synthetic oligonucleotide
  Target: ATXN1; (-) strand; PAM type: NNAGAAW; PAM sequence: AAAGAAT
catcataggattctttgggt

SEQ ID NO: 8211 - DNA, 20 bp, Artificial Sequence
  Description of Artificial Sequence: Synthetic oligonucleotide
  Target: ATXN1; (-) strand; PAM type: NNAGAAW; PAM sequence: GAAGAAA
attaagggccttgagaaagt

SEQ ID NO: 8212 - DNA, 20 bp, Artificial Sequence
  Description of Artificial Sequence: Synthetic oligonucleotide
  Target: ATXN1; (-) strand; PAM type: NNAGAAW; PAM sequence: TGAGAAA
aagggggcaattaagggcct

SEQ ID NO: 8213 - DNA, 20 bp, Artificial Sequence
  Description of Artificial Sequence: Synthetic oligonucleotide
  Target: ATXN1; (-) strand; PAM type: NNAGAAW; PAM sequence: TGAGAAA
ttccattttcctgtcttatc

SEQ ID NO: 8214 - DNA, 20 bp, Artificial Sequence
  Description of Artificial Sequence: Synthetic oligonucleotide
  Target: ATXN1; (-) strand; PAM type: NNAGAAW; PAM sequence: TTAGAAT
gttaagaatatgattctcag

SEQ ID NO: 8215 - DNA, 20 bp, Artificial Sequence
  Description of Artificial Sequence: Synthetic oligonucleotide
  Target: ATXN1; (-) strand; PAM type: NNAGAAW; PAM sequence: TAAGAAT
gcaataagatggagagaagt

SEQ ID NO: 8216 - DNA, 20 bp, Artificial Sequence
  Description of Artificial Sequence: Synthetic oligonucleotide
  Target: ATXN1; (-) strand; PAM type: NNAGAAW; PAM sequence: TGAGAAA
ctgaccttcatagagacttt

SEQ ID NO: 8217 - DNA, 20 bp, Artificial Sequence
  Description of Artificial Sequence: Synthetic oligonucleotide
  Target: ATXN1; (-) strand; PAM type: NNAGAAW; PAM sequence: GAAGAAT
cgcggttgtctgcacctgca

SEQ ID NO: 8218 - DNA, 20 bp, Artificial Sequence
  Description of Artificial Sequence: Synthetic oligonucleotide
  Target: ATXN1; (-) strand; PAM type: NNAGAAW; PAM sequence: TGAGAAA
cttctgttatggatgtcatc

SEQ ID NO: 8219 - DNA, 20 bp, Artificial Sequence
  Description of Artificial Sequence: Synthetic oligonucleotide
  Target: ATXN1; (-) strand; PAM type: NNAGAAW; PAM sequence: CAAGAAT
tgtcttttgaattccatgac

SEQ ID NO: 8220 - DNA, 20 bp, Artificial Sequence
  Description of Artificial Sequence: Synthetic oligonucleotide
  Target: ATXN1; (-) strand; PAM type: NNAGAAW; PAM sequence: ACAGAAA
gctattaccttgtccagctc

SEQ ID NO: 8221 - DNA, 20 bp, Artificial Sequence
  Description of Artificial Sequence: Synthetic oligonucleotide
  Target: ATXN1; (-) strand; PAM type: NNAGAAW; PAM sequence: CAAGAAA
atccaattactatgatgcac

SEQ ID NO: 8222 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
tagaccattttcttcgtgag

SEQ ID NO: 8223 - DNA, 20 bp, Artificial Sequence
  Description of Artificial Sequence: Synthetic oligonucleotide
  Target: ATXN1; (-) strand; PAM type: NNAGAAW; PAM sequence: TGAGAAA
aaattagaccattttcttcg

SEQ ID NO: 8224 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
tttttctattccagttttcc

SEQ ID NO: 8225 - DNA, 20 bp, Artificial Sequence
  Description of Artificial Sequence: Synthetic oligonucleotide
  Target: ATXN1; (-) strand; PAM type: NNAGAAW; PAM sequence: AGAGAAT
ctgctcatttggactgattt

SEQ ID NO: 8226 - DNA, 20 bp, Artificial Sequence
  Description of Artificial Sequence: Synthetic oligonucleotide
  Target: ATXN1; (-) strand; PAM type: NNAGAAW; PAM sequence: TAAGAAA
gcatggaggacatgacattt

SEQ ID NO: 8227 - DNA, 20 bp, Artificial Sequence
  Description of Artificial Sequence: Synthetic oligonucleotide
  Target: ATXN1; (-) strand; PAM type: NNAGAAW; PAM sequence: ACAGAAA
catagtgagaccccatctct

SEQ ID NO: 8228 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
aaaactccatctccgcaaat

SEQ ID NO: 8229 - DNA, 20 bp, Artificial Sequence
  Description of Artificial Sequence: Synthetic oligonucleotide
  Target: ATXN1; (-) strand; PAM type: NNAGAAW; PAM sequence: ATAGAAT
gctgtggccttccacagctc

SEQ ID NO: 8230 - DNA, 20 bp, Artificial Sequence
  Description of Artificial Sequence: Synthetic oligonucleotide
  Target: ATXN1; (-) strand; PAM type: NNAGAAW; PAM sequence: CAAGAAT
gaaatcagttttcgtggtct

SEQ ID NO: 8231 - DNA, 20 bp, Artificial Sequence
  Description of Artificial Sequence: Synthetic oligonucleotide
  Target: ATXN1; (-) strand; PAM type: NNAGAAW; PAM sequence: CTAGAAA
accaagcgccacactaaaaa

SEQ ID NO: 8232 - DNA, 20 bp, Artificial Sequence
  Description of Artificial Sequence: Synthetic oligonucleotide
  Target: ATXN1; (-) strand; PAM type: NNAGAAW; PAM sequence: GAAGAAT
atgtaaaataaacacatcat

SEQ ID NO: 8233 - DNA, 20 bp, Artificial Sequence
  Description of Artificial Sequence: Synthetic oligonucleotide
  Target: ATXN1; (-) strand; PAM type: NNAGAAW; PAM sequence: GAAGAAA
tctcaatcttgaaaaatgta

SEQ ID NO: 8234 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
tttaatttttgataccttct

SEQ ID NO: 8235 - DNA, 20 bp, Artificial Sequence
  Description of Artificial Sequence: Synthetic oligonucleotide
  Target: ATXN1; (-) strand; PAM type: NNAGAAW; PAM sequence: TTAGAAA
tctttgagaaggaacttaga

SEQ ID NO: 8236 - DNA, 20 bp, Artificial Sequence
  Description of Artificial Sequence: Synthetic oligonucleotide
  Target: ATXN1; (-) strand; PAM type: NNAGAAW; PAM sequence: TTAGAAA
catggagcagtgttggatac

SEQ ID NO: 8237 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
aatgcctagagtgaattgtc

SEQ ID NO: 8238 - DNA, 20 bp, Artificial Sequence
  Description of Artificial Sequence: Synthetic oligonucleotide
  Target: ATXN1; (-) strand; PAM type: NNAGAAW; PAM sequence: TCAGAAT
aagtgcttattttttgtttg

SEQ ID NO: 8239 - DNA, 20 bp, Artificial Sequence
  Description of Artificial Sequence: Synthetic oligonucleotide
  Target: ATXN1; (-) strand; PAM type: NNAGAAW; PAM sequence: TCAGAAT
tgcatgcttgtggctcataa

SEQ ID NO: 8240 - DNA, 20 bp, Artificial Sequence
  Description of Artificial Sequence: Synthetic oligonucleotide
  Target: ATXN1; (-) strand; PAM type: NNAGAAW; PAM sequence: CGAGAAA
ctgtggataaatttatccga

SEQ ID NO: 8241 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
ataagcattgagataatggg

SEQ ID NO: 8242 - DNA, 20 bp, Artificial Sequence
  Description of Artificial Sequence: Synthetic oligonucleotide
  Target: ATXN1; (-) strand; PAM type: NNAGAAW; PAM sequence: ACAGAAT
gggttgcactttttaaagtc

SEQ ID NO: 8243 - DNA, 20 bp, Artificial Sequence
  Description of Artificial Sequence: Synthetic oligonucleotide
  Target: ATXN1; (-) strand; PAM type: NNAGAAW; PAM sequence: TAAGAAA
ctttggctgttctaggtgtt

SEQ ID NO: 8244 - DNA, 20 bp, Artificial Sequence
  Description of Artificial Sequence: Synthetic oligonucleotide
  Target: ATXN1; (-) strand; PAM type: NNAGAAW; PAM sequence: ATAGAAA
catttgctccctggtccttt

SEQ ID NO: 8245 - DNA, 20 bp, Artificial Sequence
  Description of Artificial Sequence: Synthetic oligonucleotide
  Target: ATXN1; (-) strand; PAM type: NNAGAAW; PAM sequence: TAAGAAA
attgtcatctaacttttcac

SEQ ID NO: 8246 - DNA, 20 bp, Artificial Sequence
  Description of Artificial Sequence: Synthetic oligonucleotide
  Target: ATXN1; (-) strand; PAM type: NNAGAAW; PAM sequence: GCAGAAT
gaggttcagtggtggatgct

SEQ ID NO: 8247 - DNA, 20 bp, Artificial Sequence
  Description of Artificial Sequence: Synthetic oligonucleotide
  Target: ATXN1; (-) strand; PAM type: NNAGAAW; PAM sequence: GAAGAAA
gtcatttgcatattttcttt

SEQ ID NO: 8248 - DNA, 20 bp, Artificial Sequence
  Description of Artificial Sequence: Synthetic oligonucleotide
  Target: ATXN1; (-) strand; PAM type: NNAGAAW; PAM sequence: TCAGAAT
tatccatgttgtagcatgtg

SEQ ID NO: 8249 - DNA, 20 bp, Artificial Sequence
  Description of Artificial Sequence: Synthetic oligonucleotide
  Target: ATXN1; (-) strand; PAM type: NNAGAAW; PAM sequence: TCAGAAA
ggtctctgaggttgtaaaac

SEQ ID NO: 8250 - DNA, 20 bp, Artificial Sequence
  Description of Artificial Sequence: Synthetic oligonucleotide
  Target: ATXN1; (-) strand; PAM type: NNAGAAW; PAM sequence: GGAGAAT
gcagttatatgcgtgacgaa

SEQ ID NO: 8251 - DNA, 20 bp, Artificial Sequence
  Description of Artificial Sequence: Synthetic oligonucleotide
  Target: ATXN1; (-) strand; PAM type: NNAGAAW; PAM sequence: TGAGAAA
cgatatcattttctttcagc

SEQ ID NO: 8252 - DNA, 20 bp, Artificial Sequence
  Description of Artificial Sequence: Synthetic oligonucleotide
  Target: ATXN1; (-) strand; PAM type: NNAGAAW; PAM sequence: CAAGAAT
aggtatcttctgattcttac

SEQ ID NO: 8253 - DNA, 20 bp, Artificial Sequence
  Description of Artificial Sequence: Synthetic oligonucleotide
  Target: ATXN1; (-) strand; PAM type: NNAGAAW; PAM sequence: TCAGAAA
ttggttaaaactcttaacgg

SEQ ID NO: 8254 - DNA, 20 bp, Artificial Sequence
  Description of Artificial Sequence: Synthetic oligonucleotide
  Target: ATXN1; (-) strand; PAM type: NNAGAAW; PAM sequence: TCAGAAA
atgagccaagtgttaaatgt

SEQ ID NO: 8255 - DNA, 20 bp, Artificial Sequence
  Description of Artificial Sequence: Synthetic oligonucleotide
  Target: ATXN1; (-) strand; PAM type: NNAGAAW; PAM sequence: GAAGAAA
tcttaaatatctatggataa

SEQ ID NO: 8256 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
gacctagcctaagagcattc

SEQ ID NO: 8257 - DNA, 20 bp, Artificial Sequence
  Description of Artificial Sequence: Synthetic oligonucleotide
  Target: ATXN1; (-) strand; PAM type: NNAGAAW; PAM sequence: TCAGAAT
cagagaagtgctgtagaaaa

SEQ ID NO: 8258 - DNA, 20 bp, Artificial Sequence
  Description of Artificial Sequence: Synthetic oligonucleotide
  Target: ATXN1; (-) strand; PAM type: NNAGAAW; PAM sequence: GTAGAAA
gacagtaacagagaagtgct

SEQ ID NO: 8259 - DNA, 20 bp, Artificial Sequence
  Description of Artificial Sequence: Synthetic oligonucleotide
  Target: ATXN1; (-) strand; PAM type: NNAGAAW; PAM sequence: CTAGAAT
ccctcacagacccctgccct

SEQ ID NO: 8260 - DNA, 20 bp, Artificial Sequence
  Description of Artificial Sequence: Synthetic oligonucleotide
  Target: ATXN1; (-) strand; PAM type: NNAGAAW; PAM sequence: GCAGAAA
agttctgggtgctggggctt

SEQ ID NO: 8261 - DNA, 20 bp, Artificial Sequence
  Description of Artificial Sequence: Synthetic oligonucleotide
  Target: ATXN1; (-) strand; PAM type: NNAGAAW; PAM sequence: GGAGAAT
gacccctggtttgttttatt

SEQ ID NO: 8262 - DNA, 20 bp, Artificial Sequence
  Description of Artificial Sequence: Synthetic oligonucleotide
  Target: ATXN1; (-) strand; PAM type: NNAGAAW; PAM sequence: CTAGAAT
ggatattccctgtcacagta

SEQ ID NO: 8263 - DNA, 20 bp, Artificial Sequence
  Description of Artificial Sequence: Synthetic oligonucleotide
  Target: ATXN1; (-) strand; PAM type: NNAGAAW; PAM sequence: TGAGAAA
tctggccattggcagctctt

SEQ ID NO: 8264 - DNA, 20 bp, Artificial Sequence
  Description of Artificial Sequence: Synthetic oligonucleotide
  Target: ATXN1; (-) strand; PAM type: NNAGAAW; PAM sequence: CCAGAAA
cgtgagccaaccatgcctgg

SEQ ID NO: 8265 - DNA, 20 bp, Artificial Sequence
  Description of Artificial Sequence: Synthetic oligonucleotide
  Target: ATXN1; (-) strand; PAM type: NNAGAAW; PAM sequence: TAAGAAT
gcaaacatacaagtaaattg

SEQ ID NO: 8266 - DNA, 20 bp, Artificial Sequence
  Description of Artificial Sequence: Synthetic oligonucleotide
  Target: ATXN1; (-) strand; PAM type: NNAGAAW; PAM sequence: GGAGAAA
ttctgtaaaagaggttaaaa

SEQ ID NO: 8267 - DNA, 20 bp, Artificial Sequence
  Description of Artificial Sequence: Synthetic oligonucleotide
  Target: ATXN1; (-) strand; PAM type: NNAGAAW; PAM sequence: GTAGAAT
aggccaagtaagagttgaag

SEQ ID NO: 8268 - DNA, 20 bp, Artificial Sequence
  Description of Artificial Sequence: Synthetic oligonucleotide
  Target: ATXN1; (-) strand; PAM type: NNAGAAW; PAM sequence: CAAGAAA
cttttaattaactcctattt

SEQ ID NO: 8269 - DNA, 20 bp, Artificial Sequence
  Description of Artificial Sequence: Synthetic oligonucleotide
  Target: ATXN1; (-) strand; PAM type: NNAGAAW; PAM sequence: GTAGAAT
cgaggccattgatttgctgc

SEQ ID NO: 8270 - DNA, 20 bp, Artificial Sequence
  Description of Artificial Sequence: Synthetic oligonucleotide
  Target: ATXN1; (-) strand; PAM type: NNAGAAW; PAM sequence: GCAGAAT
ctgtcggtggcatcacgttg

SEQ ID NO: 8271 - DNA, 20 bp, Artificial Sequence
  Description of Artificial Sequence: Synthetic oligonucleotide
  Target: ATXN1; (-) strand; PAM type: NNAGAAW; PAM sequence: AGAGAAA
tgaaggtcttgagggcaaag

SEQ ID NO: 8272 - DNA, 20 bp, Artificial Sequence
  Description of Artificial Sequence: Synthetic oligonucleotide
  Target: ATXN1; (-) strand; PAM type: NNAGAAW; PAM sequence: CAAGAAT
ccctgtctctactgaaaaaa

SEQ ID NO: 8273 - DNA, 20 bp, Artificial Sequence
  Description of Artificial Sequence: Synthetic oligonucleotide
  Target: ATXN1; (-) strand; PAM type: NNAGAAW; PAM sequence: TTAGAAT
agtagtgaggagaggatagg

SEQ ID NO: 8274 - DNA, 20 bp, Artificial Sequence
  Description of Artificial Sequence: Synthetic oligonucleotide
  Target: ATXN1; (-) strand; PAM type: NNAGAAW; PAM sequence: AGAGAAA
gatgcttgatacaagagaag

SEQ ID NO: 8275 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
tgagagtgactaatagtttt

SEQ ID NO: 8276 - DNA, 20 bp, Artificial Sequence
  Description of Artificial Sequence: Synthetic oligonucleotide
  Target: ATXN1; (-) strand; PAM type: NNAGAAW; PAM sequence: ATAGAAT
acagaggtggatccctggtt

SEQ ID NO: 8277 - DNA, 20 bp, Artificial Sequence
  Description of Artificial Sequence: Synthetic oligonucleotide
  Target: ATXN1; (-) strand; PAM type: NNAGAAW; PAM sequence: CAAGAAA
aggcaagggaaacatcatgt

SEQ ID NO: 8278 - DNA, 20 bp, Artificial Sequence
  Description of Artificial Sequence: Synthetic oligonucleotide
  Target: ATXN1; (-) strand; PAM type: NNAGAAW; PAM sequence: TTAGAAA
ggctatgtaaaatagttttc

SEQ ID NO: 8279 - DNA, 20 bp, Artificial Sequence
  Description of Artificial Sequence: Synthetic oligonucleotide
  Target: ATXN1; (-) strand; PAM type: NNAGAAW; PAM sequence: AAAGAAT
ctctgctggggtggaaggag

SEQ ID NO: 8280 - DNA, 20 bp, Artificial Sequence
  Description of Artificial Sequence: Synthetic oligonucleotide
  Target: ATXN1; (-) strand; PAM type: NNAGAAW; PAM sequence: GGAGAAA
gtccctctgctggggtggaa

SEQ ID NO: 8281 - DNA, 20 bp, Artificial Sequence
  Description of Artificial Sequence: Synthetic oligonucleotide
  Target: ATXN1; (-) strand; PAM type: NNAGAAW; PAM sequence: ACAGAAA
gaagagctccaaagaaagaa

SEQ ID NO: 8282 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
aatacagaagagctccaaag

SEQ ID NO: 8283 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
aacaaatacagaagagctcc

SEQ ID NO: 8284 - DNA, 20 bp, Artificial Sequence
  Description of Artificial Sequence: Synthetic oligonucleotide
  Target: ATXN1; (-) strand; PAM type: NNAGAAW; PAM sequence: GAAGAAT
ggaatgaagtctgccgcctg

SEQ ID NO: 8285 - DNA, 20 bp, Artificial Sequence
  Description of Artificial Sequence: Synthetic oligonucleotide
  Target: ATXN1; (-) strand; PAM type: NNAGAAW; PAM sequence: TCAGAAA
gggtgctcaggggcaagatg

SEQ ID NO: 8286 - DNA, 20 bp, Artificial Sequence
  Description of Artificial Sequence: Synthetic oligonucleotide
  Target: ATXN1; (-) strand; PAM type: NNAGAAW; PAM sequence: CCAGAAA
tcttgcatcatttgacatca

SEQ ID NO: 8287 - DNA, 20 bp, Artificial Sequence
  Description of Artificial Sequence: Synthetic oligonucleotide
  Target: ATXN1; (-) strand; PAM type: NNAGAAW; PAM sequence: AAAGAAT
ttttatgcatcaccttctgg

SEQ ID NO: 8288 - DNA, 20 bp, Artificial Sequence
  Description of Artificial Sequence: Synthetic oligonucleotide
  Target: ATXN1; (-) strand; PAM type: NNAGAAW; PAM sequence: ACAGAAT
ggccacatgtcccctcccgc

SEQ ID NO: 8289 - DNA, 20 bp, Artificial Sequence
  Description of Artificial Sequence: Synthetic oligonucleotide
  Target: ATXN1; (-) strand; PAM type: NNAGAAW; PAM sequence: TTAGAAA
ttatccccaaatgaaaagaa

SEQ ID NO: 8290 - DNA, 20 bp, Artificial Sequence
  Description of Artificial Sequence: Synthetic oligonucleotide
  Target: ATXN1; (-) strand; PAM type: NNAGAAW; PAM sequence: AAAGAAT
cttgtcttatccccaaatga

SEQ ID NO: 8291 - DNA, 20 bp, Artificial Sequence
  Description of Artificial Sequence: Synthetic oligonucleotide
  Target: ATXN1; (-) strand; PAM type: NNAGAAW; PAM sequence: ACAGAAT
agtggttagaacacatgcaa

SEQ ID NO: 8292 - DNA, 20 bp, Artificial Sequence
  Description of Artificial Sequence: Synthetic oligonucleotide
  Target: ATXN1; (-) strand; PAM type: NNAGAAW; PAM sequence: TGAGAAA
cctggagcatgcgagggact

SEQ ID NO: 8293 - DNA, 20 bp, Artificial Sequence
  Description of Artificial Sequence: Synthetic oligonucleotide
  Target: ATXN1; (-) strand; PAM type: NNAGAAW; PAM sequence: AGAGAAA
cactcagtccctgctggcaa

SEQ ID NO: 8294 - DNA, 20 bp, Artificial Sequence
  Description of Artificial Sequence: Synthetic oligonucleotide
  Target: ATXN1; (-) strand; PAM type: NNAGAAW; PAM sequence: AGAGAAT
agatgtagggtcatagactc

SEQ ID NO: 8295 - DNA, 20 bp, Artificial Sequence
  Description of Artificial Sequence: Synthetic oligonucleotide
  Target: ATXN1; (-) strand; PAM type: NNAGAAW; PAM sequence: TTAGAAA
ttcgaaaactcctccctccc

SEQ ID NO: 8296 - DNA, 20 bp, Artificial Sequence
  Description of Artificial Sequence: Synthetic oligonucleotide
  Target: ATXN1; (-) strand; PAM type: NNAGAAW; PAM sequence: TTAGAAA
aatgcgtatttgccatgctc

SEQ ID NO: 8297 - DNA, 20 bp, Artificial Sequence
  Description of Artificial Sequence: Synthetic oligonucleotide
  Target: ATXN1; (-) strand; PAM type: NNAGAAW; PAM sequence: CAAGAAA
tggcctcatcagctatgttt

SEQ ID NO: 8298 - DNA, 20 bp, Artificial Sequence
  Description of Artificial Sequence: Synthetic oligonucleotide
  Target: ATXN1; (-) strand; PAM type: NNAGAAW; PAM sequence: TAAGAAA
gaggacattttggggggtaa

SEQ ID NO: 8299 - DNA, 20 bp, Artificial Sequence
  Description of Artificial Sequence: Synthetic oligonucleotide
  Target: ATXN1; (-) strand; PAM type: NNAGAAW; PAM sequence: GGAGAAT
aacatattaaggtcatttaa

SEQ ID NO: 8300 - DNA, 20 bp, Artificial Sequence
  Description of Artificial Sequence: Synthetic oligonucleotide
  Target: ATXN1; (-) strand; PAM type: NNAGAAW; PAM sequence: CAAGAAA
attgccaaaaaaaaaaaaga

SEQ ID NO: 8301 - DNA, 20 bp, Artificial Sequence
  Description of Artificial Sequence: Synthetic oligonucleotide
  Target: ATXN1; (-) strand; PAM type: NNAGAAW; PAM sequence: GAAGAAT
gattaccaggaccctgaatt

SEQ ID NO: 8302 - DNA, 20 bp, Artificial Sequence
  Description of Artificial Sequence: Synthetic oligonucleotide
  Target: ATXN1; (-) strand; PAM type: NNAGAAW; PAM sequence: GTAGAAA
atttctcaccagtttgaatt

SEQ ID NO: 8303 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
cagactcactactctgaagg

SEQ ID NO: 8304 - DNA, 20 bp, Artificial Sequence
  Description of Artificial Sequence: Synthetic oligonucleotide
  Target: ATXN1; (-) strand; PAM type: NNAGAAW; PAM sequence: TCAGAAA
atagttgggacaattaaggc

SEQ ID NO: 8305 - DNA, 20 bp, Artificial Sequence
  Description of Artificial Sequence: Synthetic oligonucleotide
  Target: ATXN1; (-) strand; PAM type: NNAGAAW; PAM sequence: ATAGAAA
atatgaaacatttgtttttc

SEQ ID NO: 8306 - DNA, 20 bp, Artificial Sequence
  Description of Artificial Sequence: Synthetic oligonucleotide
  Target: ATXN1; (-) strand; PAM type: NNAGAAW; PAM sequence: TGAGAAT
tccaggcttggacactttcg

SEQ ID NO: 8307 - DNA, 20 bp, Artificial Sequence
  Description of Artificial Sequence: Synthetic oligonucleotide
  Target: ATXN1; (-) strand; PAM type: NNAGAAW; PAM sequence: TTAGAAT
tctcagggtttggggttggt

SEQ ID NO: 8308 - DNA, 20 bp, Artificial Sequence
  Description of Artificial Sequence: Synthetic oligonucleotide
  Target: ATXN1; (-) strand; PAM type: NNAGAAW; PAM sequence: CAAGAAA
ggagttatgctgcccaaagc

SEQ ID NO: 8309 - DNA, 20 bp, Artificial Sequence
  Description of Artificial Sequence: Synthetic oligonucleotide
  Target: ATXN1; (-) strand; PAM type: NNAGAAW; PAM sequence: ACAGAAT
gactctacgatgttcacaca

SEQ ID NO: 8310 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
agtttaatttattattgaag

SEQ ID NO: 8311 - DNA, 20 bp, Artificial Sequence
  Description of Artificial Sequence: Synthetic oligonucleotide
  Target: ATXN1; (-) strand; PAM type: NNAGAAW; PAM sequence: GAAGAAA
gctaagtttaatttattatt

SEQ ID NO: 8312 - DNA, 20 bp, Artificial Sequence
  Description of Artificial Sequence: Synthetic oligonucleotide
  Target: ATXN1; (-) strand; PAM type: NNAGAAW; PAM sequence: GAAGAAA
tattgaataaagatataaaa

SEQ ID NO: 8313 - DNA, 20 bp, Artificial Sequence
  Description of Artificial Sequence: Synthetic oligonucleotide
  Target: ATXN1; (-) strand; PAM type: NNAGAAW; PAM sequence: ATAGAAA
aaaattttttaaaaatgaaa

SEQ ID NO: 8314 - DNA, 20 bp, Artificial Sequence
  Description of Artificial Sequence: Synthetic oligonucleotide
  Target: ATXN1; (-) strand; PAM type: NNAGAAW; PAM sequence: GAAGAAT
cataagattataatgaagct

SEQ ID NO: 8315 - DNA, 20 bp, Artificial Sequence
  Description of Artificial Sequence: Synthetic oligonucleotide
  Target: ATXN1; (-) strand; PAM type: NNAGAAW; PAM sequence: TGAGAAT
tttcaactcccacttatgag

SEQ ID NO: 8316 - DNA, 20 bp, Artificial Sequence
  Description of Artificial Sequence: Synthetic oligonucleotide
  Target: ATXN1; (-) strand; PAM type: NNAGAAW; PAM sequence: GTAGAAA
gcctaataattatgcctact

SEQ ID NO: 8317 - DNA, 20 bp, Artificial Sequence
  Description of Artificial Sequence: Synthetic oligonucleotide
  Target: ATXN1; (-) strand; PAM type: NNAGAAW; PAM sequence: CAAGAAA
gctaccatattgcttatagt

SEQ ID NO: 8318 - DNA, 20 bp, Artificial Sequence
  Description of Artificial Sequence: Synthetic oligonucleotide
  Target: ATXN1; (-) strand; PAM type: NNAGAAW; PAM sequence: ACAGAAA
atccgttctgcaaacccatc

SEQ ID NO: 8319 - DNA, 20 bp, Artificial Sequence
  Description of Artificial Sequence: Synthetic oligonucleotide
  Target: ATXN1; (-) strand; PAM type: NNAGAAW; PAM sequence: CTAGAAT
acaagtcttgtatgacttgc

SEQ ID NO: 8320 - DNA, 20 bp, Artificial Sequence
  Description of Artificial Sequence: Synthetic oligonucleotide
  Target: ATXN1; (-) strand; PAM type: NNAGAAW; PAM sequence: TTAGAAA
atgttggggcctgtcatgaa

SEQ ID NO: 8321 - DNA, 20 bp, Artificial Sequence
  Description of Artificial Sequence: Synthetic oligonucleotide
  Target: ATXN1; (-) strand; PAM type: NNAGAAW; PAM sequence: ACAGAAT
tcagaagtccctcagatttt

SEQ ID NO: 8322 - DNA, 20 bp, Artificial Sequence
  Description of Artificial Sequence: Synthetic oligonucleotide
  Target: ATXN1; (-) strand; PAM type: NNAGAAW; PAM sequence: TCAGAAA
tagagacgtgcagcaggcat

SEQ ID NO: 8323 - DNA, 20 bp, Artificial Sequence
  Description of Artificial Sequence: Synthetic oligonucleotide
  Target: ATXN1; (-) strand; PAM type: NNAGAAW; PAM sequence: CTAGAAT
tttcagacccgtaacttctg

SEQ ID NO: 8324 - DNA, 20 bp, Artificial Sequence
  Description of Artificial Sequence: Synthetic oligonucleotide
  Target: ATXN1; (-) strand; PAM type: NNAGAAW; PAM sequence: AGAGAAA
cacagcccgagcacagccag

SEQ ID NO: 8325 - DNA, 20 bp, Artificial Sequence
  Description of Artificial Sequence: Synthetic oligonucleotide
  Target: ATXN1; (-) strand; PAM type: NNAGAAW; PAM sequence: CAAGAAA
tgagtagcatctttgagtgg

SEQ ID NO: 8326 - DNA, 20 bp, Artificial Sequence
  Description of Artificial Sequence: Synthetic oligonucleotide
  Target: ATXN1; (-) strand; PAM type: NNAGAAW; PAM sequence: ATAGAAT
gtgagttggggtacagtggc

SEQ ID NO: 8327 - DNA, 20 bp, Artificial Sequence
  Description of Artificial Sequence: Synthetic oligonucleotide
  Target: ATXN1; (-) strand; PAM type: NNAGAAW; PAM sequence: TTAGAAA
ttagacatagagtgagctgg

SEQ ID NO: 8328 - DNA, 20 bp, Artificial Sequence
  Description of Artificial Sequence: Synthetic oligonucleotide
  Target: ATXN1; (-) strand; PAM type: NNAGAAW; PAM sequence: ATAGAAA
agcagcagaaggacatttta

SEQ ID NO: 8329 - DNA, 20 bp, Artificial Sequence
  Description of Artificial Sequence: Synthetic oligonucleotide
  Target: ATXN1; (-) strand; PAM type: NNAGAAW; PAM sequence: AGAGAAA
agctatgtccagaaaagaga

SEQ ID NO: 8330 - DNA, 20 bp, Artificial Sequence
  Description of Artificial Sequence: Synthetic oligonucleotide
  Target: ATXN1; (-) strand; PAM type: NNAGAAW; PAM sequence: CCAGAAA
tttgctgttggaagctatgt

SEQ ID NO: 8331 - DNA, 20 bp, Artificial Sequence
  Description of Artificial Sequence: Synthetic oligonucleotide
  Target: ATXN1; (-) strand; PAM type: NNAGAAW; PAM sequence: GTAGAAT
cccagccacgttgctctgga

SEQ ID NO: 8332 - DNA, 20 bp, Artificial Sequence
  Description of Artificial Sequence: Synthetic oligonucleotide
  Target: ATXN1; (-) strand; PAM type: NNAGAAW; PAM sequence: TGAGAAA
tctagtcaattaccgtgcac

SEQ ID NO: 8333 - DNA, 20 bp, Artificial Sequence
  Description of Artificial Sequence: Synthetic oligonucleotide
  Target: ATXN1; (-) strand; PAM type: NNAGAAW; PAM sequence: AGAGAAA
gtttctgattgtctttaagc

SEQ ID NO: 8334 - DNA, 20 bp, Artificial Sequence
  Description of Artificial Sequence: Synthetic oligonucleotide
  Target: ATXN1; (-) strand; PAM type: NNAGAAW; PAM sequence: GGAGAAA
ggccccttggatctctggaa

SEQ ID NO: 8335 - DNA, 20 bp, Artificial Sequence
  Description of Artificial Sequence: Synthetic oligonucleotide
  Target: ATXN1; (-) strand; PAM type: NNAGAAW; PAM sequence: GGAGAAT
ctactcaggaggctgaggca

SEQ ID NO: 8336 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
ttatctgcatgacaggcagg

SEQ ID NO: 8337 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
agaatgttttgatctcttgc

SEQ ID NO: 8338 - DNA, 20 bp, Artificial Sequence
  Description of Artificial Sequence: Synthetic oligonucleotide
  Target: ATXN1; (-) strand; PAM type: NNAGAAW; PAM sequence: AAAGAAT
tgatggtgccattaaagaaa

SEQ ID NO: 8339 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
ttctttttgatggtgccatt

SEQ ID NO: 8340 - DNA, 20 bp, Artificial Sequence
  Description of Artificial Sequence: Synthetic oligonucleotide
  Target: ATXN1; (-) strand; PAM type: NNAGAAW; PAM sequence: AAAGAAT
ctgagaaaccacaagaggaa

SEQ ID NO: 8341 - DNA, 20 bp, Artificial Sequence
  Description of Artificial Sequence: Synthetic oligonucleotide
  Target: ATXN1; (-) strand; PAM type: NNAGAAW; PAM sequence: TGAGAAA
taatacagagttccaaatac

SEQ ID NO: 8342 - DNA, 20 bp, Artificial Sequence
  Description of Artificial Sequence: Synthetic oligonucleotide
  Target: ATXN1; (-) strand; PAM type: NNAGAAW; PAM sequence: CAAGAAA
agagtctccgaaaaggcttg

SEQ ID NO: 8343 - DNA, 20 bp, Artificial Sequence
  Description of Artificial Sequence: Synthetic oligonucleotide
  Target: ATXN1; (-) strand; PAM type: NNAGAAW; PAM sequence: GAAGAAA
aaaggtggaagaatgggatg

SEQ ID NO: 8344 - DNA, 20 bp, Artificial Sequence
  Description of Artificial Sequence: Synthetic oligonucleotide
  Target: ATXN1; (-) strand; PAM type: NNAGAAW; PAM sequence: GAAGAAT
agagaaaaggaagaaaggtg

SEQ ID NO: 8345 - DNA, 20 bp, Artificial Sequence
  Description of Artificial Sequence: Synthetic oligonucleotide
  Target: ATXN1; (-) strand; PAM type: NNAGAAW; PAM sequence: GAAGAAA
cttttgctaagagagaaaag

SEQ ID NO: 8346 - DNA, 20 bp, Artificial Sequence
  Description of Artificial Sequence: Synthetic oligonucleotide
  Target: ATXN1; (-) strand; PAM type: NNAGAAW; PAM sequence: AGAGAAA
tagtaaaggcttttgctaag

SEQ ID NO: 8347 - DNA, 20 bp, Artificial Sequence
  Description of Artificial Sequence: Synthetic oligonucleotide
  Target: ATXN1; (-) strand; PAM type: NNAGAAW; PAM sequence: GCAGAAA
tgaatctgacggaattattt

SEQ ID NO: 8348 - DNA, 20 bp, Artificial Sequence
  Description of Artificial Sequence: Synthetic oligonucleotide
  Target: ATXN1; (-) strand; PAM type: NNAGAAW; PAM sequence: GTAGAAA
ttgtagggcttttataatga

SEQ ID NO: 8349 - DNA, 20 bp, Artificial Sequence
  Description of Artificial Sequence: Synthetic oligonucleotide
  Target: ATXN1; (-) strand; PAM type: NNAGAAW; PAM sequence: ACAGAAT
tcttttgtttcagttaccct

SEQ ID NO: 8350 - DNA, 20 bp, Artificial Sequence
  Description of Artificial Sequence: Synthetic oligonucleotide
  Target: ATXN1; (-) strand; PAM type: NNAGAAW; PAM sequence: TTAGAAA
acctttttactggttgtcct

SEQ ID NO: 8351 - DNA, 20 bp, Artificial Sequence
  Description of Artificial Sequence: Synthetic oligonucleotide
  Target: ATXN1; (-) strand; PAM type: NNAGAAW; PAM sequence: AAAGAAT
aagtttatagataaatatag

SEQ ID NO: 8352 - DNA, 20 bp, Artificial Sequence
  Description of Artificial Sequence: Synthetic oligonucleotide
  Target: ATXN1; (-) strand; PAM type: NNAGAAW; PAM sequence: ATAGAAA
atataagtttatagataaat

SEQ ID NO: 8353 - DNA, 20 bp, Artificial Sequence
  Description of Artificial Sequence: Synthetic oligonucleotide
  Target: ATXN1; (-) strand; PAM type: NNAGAAW; PAM sequence: TCAGAAT
tttatttttccataggaact

SEQ ID NO: 8354 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
ttacattttcattactccaa

SEQ ID NO: 8355 - DNA, 20 bp, Artificial Sequence
  Description of Artificial Sequence: Synthetic oligonucleotide
  Target: ATXN1; (-) strand; PAM type: NNAGAAW; PAM sequence: ATAGAAT
aatgggtttttaatctattc

SEQ ID NO: 8356 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
agagtgagaccctgtctcta

SEQ ID NO: 8357 - DNA, 20 bp, Artificial Sequence
  Description of Artificial Sequence: Synthetic oligonucleotide
  Target: ATXN1; (-) strand; PAM type: NNAGAAW; PAM sequence: GGAGAAA
tgtcagcaaggatctctgga

SEQ ID NO: 8358 - DNA, 20 bp, Artificial Sequence
  Description of Artificial Sequence: Synthetic oligonucleotide
  Target: ATXN1; (-) strand; PAM type: NNAGAAW; PAM sequence: GCAGAAT
agacctaaaaattcagctac

SEQ ID NO: 8359 - DNA, 20 bp, Artificial Sequence
  Description of Artificial Sequence: Synthetic oligonucleotide
  Target: ATXN1; (-) strand; PAM type: NNAGAAW; PAM sequence: GTAGAAT
caagaatctctgcaggagtg

SEQ ID NO: 8360 - DNA, 20 bp, Artificial Sequence
  Description of Artificial Sequence: Synthetic oligonucleotide
  Target: ATXN1; (-) strand; PAM type: NNAGAAW; PAM sequence: CAAGAAT
aaaaacccagggatttgcta

SEQ ID NO: 8361 - DNA, 20 bp, Artificial Sequence
  Description of Artificial Sequence: Synthetic oligonucleotide
  Target: ATXN1; (-) strand; PAM type: NNAGAAW; PAM sequence: GAAGAAA
tttgttctcctatgaacaaa

SEQ ID NO: 8362 - DNA, 20 bp, Artificial Sequence
  Description of Artificial Sequence: Synthetic oligonucleotide
  Target: ATXN1; (-) strand; PAM type: NNAGAAW; PAM sequence: ATAGAAT
gggtaggaagcctgactttt

SEQ ID NO: 8363 - DNA, 20 bp, Artificial Sequence
  Description of Artificial Sequence: Synthetic oligonucleotide
  Target: ATXN1; (-) strand; PAM type: NNAGAAW; PAM sequence: AGAGAAA
acccaaggcatcagggattc

SEQ ID NO: 8364 - DNA, 20 bp, Artificial Sequence
  Description of Artificial Sequence: Synthetic oligonucleotide
  Target: ATXN1; (-) strand; PAM type: NNAGAAW; PAM sequence: CCAGAAT
ttatggcatcactatacagc

SEQ ID NO: 8365 - DNA, 20 bp, Artificial Sequence
  Description of Artificial Sequence: Synthetic oligonucleotide
  Target: ATXN1; (-) strand; PAM type: NNAGAAW; PAM sequence: GAAGAAA
tcccatttttatttaccaat

SEQ ID NO: 8366 - DNA, 20 bp, Artificial Sequence
  Description of Artificial Sequence: Synthetic oligonucleotide
  Target: ATXN1; (-) strand; PAM type: NNAGAAW; PAM sequence: TGAGAAT
gtactcatgagacagtatat

SEQ ID NO: 8367 - DNA, 20 bp, Artificial Sequence
  Description of Artificial Sequence: Synthetic oligonucleotide
  Target: ATXN1; (-) strand; PAM type: NNAGAAW; PAM sequence: GAAGAAT
tcttgcttttttaaaatctt

SEQ ID NO: 8368 - DNA, 20 bp, Artificial Sequence
  Description of Artificial Sequence: Synthetic oligonucleotide
  Target: ATXN1; (-) strand; PAM type: NNAGAAW; PAM sequence: AGAGAAT
catacacctgttgaaatctt

SEQ ID NO: 8369 - DNA, 20 bp, Artificial Sequence
  Description of Artificial Sequence: Synthetic oligonucleotide
  Target: ATXN1; (-) strand; PAM type: NNAGAAW; PAM sequence: TAAGAAT
agaacatagttgtagaaggg

SEQ ID NO: 8370 - DNA, 20 bp, Artificial Sequence
  Description of Artificial Sequence: Synthetic oligonucleotide
  Target: ATXN1; (-) strand; PAM type: NNAGAAW; PAM sequence: ATAGAAT
gttctagacattccatataa

SEQ ID NO: 8371 - DNA, 20 bp, Artificial Sequence
  Description of Artificial Sequence: Synthetic oligonucleotide
  Target: ATXN1; (-) strand; PAM type: NNAGAAW; PAM sequence: GAAGAAA
tatcaagaccctcacccagg

SEQ ID NO: 8372 - DNA, 20 bp, Artificial Sequence
  Description of Artificial Sequence: Synthetic oligonucleotide
  Target: ATXN1; (-) strand; PAM type: NNAGAAW; PAM sequence: TGAGAAA
atccacctggaaatgtctcc

SEQ ID NO: 8373 - DNA, 20 bp, Artificial Sequence
  Description of Artificial Sequence: Synthetic oligonucleotide
  Target: ATXN1; (-) strand; PAM type: NNAGAAW; PAM sequence: AGAGAAA
taaagaagcagatgggaaga

SEQ ID NO: 8374 - DNA, 20 bp, Artificial Sequence
  Description of Artificial Sequence: Synthetic oligonucleotide
  Target: ATXN1; (-) strand; PAM type: NNAGAAW; PAM sequence: ACAGAAT
cactatgctcatatggggaa

SEQ ID NO: 8375 - DNA, 20 bp, Artificial Sequence
  Description of Artificial Sequence: Synthetic oligonucleotide
  Target: ATXN1; (-) strand; PAM type: NNAGAAW; PAM sequence: GCAGAAA
tgtccttatggtgtggagaa

SEQ ID NO: 8376 - DNA, 20 bp, Artificial Sequence
  Description of Artificial Sequence: Synthetic oligonucleotide
  Target: ATXN1; (-) strand; PAM type: NNAGAAW; PAM sequence: ACAGAAT
ttagcctcacccaagcaaaa

SEQ ID NO: 8377 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
aggaaggctacatcagtgtg

SEQ ID NO: 8378 - DNA, 20 bp, Artificial Sequence
  Description of Artificial Sequence: Synthetic oligonucleotide
  Target: ATXN1; (-) strand; PAM type: NNAGAAW; PAM sequence: TGAGAAT
tttctctactgtcaaaactg

SEQ ID NO: 8379 - DNA, 20 bp, Artificial Sequence
  Description of Artificial Sequence: Synthetic oligonucleotide
  Target: ATXN1; (-) strand; PAM type: NNAGAAW; PAM sequence: CAAGAAA
aaacagtactgcagcccatg

SEQ ID NO: 8380 - DNA, 20 bp, Artificial Sequence
  Description of Artificial Sequence: Synthetic oligonucleotide
  Target: ATXN1; (-) strand; PAM type: NNAGAAW; PAM sequence: TCAGAAT
agtggaaagaaacatttatt

SEQ ID NO: 8381 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
cacatgcacccttgcagtgg

SEQ ID NO: 8382 - DNA, 20 bp, Artificial Sequence
  Description of Artificial Sequence: Synthetic oligonucleotide
  Target: ATXN1; (-) strand; PAM type: NNAGAAW; PAM sequence: AAAGAAT
gtgatgtgcttccatattaa

SEQ ID NO: 8383 - DNA, 20 bp, Artificial Sequence
  Description of Artificial Sequence: Synthetic oligonucleotide
  Target: ATXN1; (-) strand; PAM type: NNAGAAW; PAM sequence: ATAGAAT
tgttctgttaggaggtagaa

SEQ ID NO: 8384 - DNA, 20 bp, Artificial Sequence
  Description of Artificial Sequence: Synthetic oligonucleotide
  Target: ATXN1; (-) strand; PAM type: NNAGAAW; PAM sequence: GTAGAAA
tgatgctgttctgttaggag

SEQ ID NO: 8385 - DNA, 20 bp, Artificial Sequence
  Description of Artificial Sequence: Synthetic oligonucleotide
  Target: ATXN1; (-) strand; PAM type: NNAGAAW; PAM sequence: ACAGAAT
cattgttagcagagcagctg

SEQ ID NO: 8386 - DNA, 20 bp, Artificial Sequence
  Description of Artificial Sequence: Synthetic oligonucleotide
  Target: ATXN1; (-) strand; PAM type: NNAGAAW; PAM sequence: GCAGAAA
actatttaaaagaagggggc

SEQ ID NO: 8387 - DNA, 20 bp, Artificial Sequence
  Description of Artificial Sequence: Synthetic oligonucleotide
  Target: ATXN1; (-) strand; PAM type: NNAGAAW; PAM sequence: GTAGAAA
gcacagtccgcctataaatt

SEQ ID NO: 8388 - DNA, 20 bp, Artificial Sequence
  Description of Artificial Sequence: Synthetic oligonucleotide
  Target: ATXN1; (-) strand; PAM type: NNAGAAW; PAM sequence: GGAGAAA
ttaatactctctttatgttt

SEQ ID NO: 8389 - DNA, 20 bp, Artificial Sequence
  Description of Artificial Sequence: Synthetic oligonucleotide
  Target: ATXN1; (-) strand; PAM type: NNAGAAW; PAM sequence: TGAGAAA
tatttataacactgtttctc

SEQ ID NO: 8390 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
ggttgtttccaggtaccgaa

SEQ ID NO: 8391 - DNA, 20 bp, Artificial Sequence
  Description of Artificial Sequence: Synthetic oligonucleotide
  Target: ATXN1; (-) strand; PAM type: NNAGAAW; PAM sequence: CCAGAAA
ataggagaggcagacagatg

SEQ ID NO: 8392 - DNA, 20 bp, Artificial Sequence
  Description of Artificial Sequence: Synthetic oligonucleotide
  Target: ATXN1; (-) strand; PAM type: NNAGAAW; PAM sequence: CTAGAAA
attagatctgctgtcaaaac

SEQ ID NO: 8393 - DNA, 20 bp, Artificial Sequence
  Description of Artificial Sequence: Synthetic oligonucleotide
  Target: ATXN1; (-) strand; PAM type: NNAGAAW; PAM sequence: CTAGAAA
gaaccttctagatactgccg

SEQ ID NO: 8394 - DNA, 20 bp, Artificial Sequence
  Description of Artificial Sequence: Synthetic oligonucleotide
  Target: ATXN1; (-) strand; PAM type: NNAGAAW; PAM sequence: GGAGAAT
tagtcaactgcaggtaaagt

SEQ ID NO: 8395 - DNA, 20 bp, Artificial Sequence
  Description of Artificial Sequence: Synthetic oligonucleotide
  Target: ATXN1; (-) strand; PAM type: NNAGAAW; PAM sequence: CCAGAAT
ttccttccatgttcccttga

SEQ ID NO: 8396 - DNA, 20 bp, Artificial Sequence
  Description of Artificial Sequence: Synthetic oligonucleotide
  Target: ATXN1; (-) strand; PAM type: NNAGAAW; PAM sequence: GGAGAAA
tactaaccacagtgaaggaa

SEQ ID NO: 8397 - DNA, 20 bp, Artificial Sequence
  Description of Artificial Sequence: Synthetic oligonucleotide
  Target: ATXN1; (-) strand; PAM type: NNAGAAW; PAM sequence: GGAGAAA
aggaaaaaccttcttgggaa

SEQ ID NO: 8398 - DNA, 20 bp, Artificial Sequence
  Description of Artificial Sequence: Synthetic oligonucleotide
  Target: ATXN1; (-) strand; PAM type: NNAGAAW; PAM sequence: GCAGAAT
tatgatcctagttatcttag

SEQ ID NO: 8399 - DNA, 20 bp, Artificial Sequence
  Description of Artificial Sequence: Synthetic oligonucleotide
  Target: ATXN1; (-) strand; PAM type: NNAGAAW; PAM sequence: GTAGAAA
tcgctgtgcaaggagcaagg

SEQ ID NO: 8400 - DNA, 20 bp, Artificial Sequence
  Description of Artificial Sequence: Synthetic oligonucleotide
  Target: ATXN1; (-) strand; PAM type: NNAGAAW; PAM sequence: CCAGAAA
agtgatgagggtggacagct

SEQ ID NO: 8401 - DNA, 20 bp, Artificial Sequence
  Description of Artificial Sequence: Synthetic oligonucleotide
  Target: ATXN1; (-) strand; PAM type: NNAGAAW; PAM sequence: GCAGAAT
caattgcaaggtaaaggcag

SEQ ID NO: 8402 - DNA, 20 bp, Artificial Sequence
  Description of Artificial Sequence: Synthetic oligonucleotide
  Target: ATXN1; (-) strand; PAM type: NNAGAAW; PAM sequence: GCAGAAT
aagcacatatgttcacattg

SEQ ID NO: 8403 - DNA, 20 bp, Artificial Sequence
  Description of Artificial Sequence: Synthetic oligonucleotide
  Target: ATXN1; (-) strand; PAM type: NNAGAAW; PAM sequence: GCAGAAT
tagagcggacattggaaatg

SEQ ID NO: 8404 - DNA, 20 bp, Artificial Sequence
  Description of Artificial Sequence: Synthetic oligonucleotide
  Target: ATXN1; (-) strand; PAM type: NNAGAAW; PAM sequence: AAAGAAT
ataaaagaaaataatgtata

SEQ ID NO: 8405 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
gtctctagaaaaataaaata

SEQ ID NO: 8406 - DNA, 20 bp, Artificial Sequence
  Description of Artificial Sequence: Synthetic oligonucleotide
  Target: ATXN1; (-) strand; PAM type: NNAGAAW; PAM sequence: CTAGAAA
ggcaaagtgagaccctgtct

SEQ ID NO: 8407 - DNA, 20 bp, Artificial Sequence
  Description of Artificial Sequence: Synthetic oligonucleotide
  Target: ATXN1; (-) strand; PAM type: NNAGAAW; PAM sequence: TTAGAAA
tgcatgtttttttgtagaat

SEQ ID NO: 8408 - DNA, 20 bp, Artificial Sequence
  Description of Artificial Sequence: Synthetic oligonucleotide
  Target: ATXN1; (-) strand; PAM type: NNAGAAW; PAM sequence: GTAGAAT
atatgaatgcatgttttttt

SEQ ID NO: 8409 - DNA, 20 bp, Artificial Sequence
  Description of Artificial Sequence: Synthetic oligonucleotide
  Target: ATXN1; (-) strand; PAM type: NNAGAAW; PAM sequence: TGAGAAT
tggaagttctggttctagtc

SEQ ID NO: 8410 - DNA, 20 bp, Artificial Sequence
  Description of Artificial Sequence: Synthetic oligonucleotide
  Target: ATXN1; (-) strand; PAM type: NNAGAAW; PAM sequence: GGAGAAA
tattgacaataggcaactga

SEQ ID NO: 8411 - DNA, 20 bp, Artificial Sequence
  Description of Artificial Sequence: Synthetic oligonucleotide
  Target: ATXN1; (-) strand; PAM type: NNAGAAW; PAM sequence: CAAGAAT
acgaatttccacttattact

SEQ ID NO: 8412 - DNA, 20 bp, Artificial Sequence
  Description of Artificial Sequence: Synthetic oligonucleotide
  Target: ATXN1; (-) strand; PAM type: NNAGAAW; PAM sequence: ACAGAAA
tgaactttatagaagaaaaa

SEQ ID NO: 8413 - DNA, 20 bp, Artificial Sequence
  Description of Artificial Sequence: Synthetic oligonucleotide
  Target: ATXN1; (-) strand; PAM type: NNAGAAW; PAM sequence: GAAGAAA
aaagtatactgaactttata

SEQ ID NO: 8414 - DNA, 20 bp, Artificial Sequence
  Description of Artificial Sequence: Synthetic oligonucleotide
  Target: ATXN1; (-) strand; PAM type: NNAGAAW; PAM sequence: CCAGAAA
tgcttacgctggaatgtggg

SEQ ID NO: 8415 - DNA, 20 bp, Artificial Sequence
  Description of Artificial Sequence: Synthetic oligonucleotide
  Target: ATXN1; (-) strand; PAM type: NNAGAAW; PAM sequence: AAAGAAT
aggtgaggaaggaggattaa

SEQ ID NO: 8416 - DNA, 20 bp, Artificial Sequence
  Description of Artificial Sequence: Synthetic oligonucleotide
  Target: ATXN1; (-) strand; PAM type: NNAGAAW; PAM sequence: GGAGAAT
acttagtaattgttggattt

SEQ ID NO: 8417 - DNA, 20 bp, Artificial Sequence
  Description of Artificial Sequence: Synthetic oligonucleotide
  Target: ATXN1; (-) strand; PAM type: NNAGAAW; PAM sequence: GGAGAAA
atgtagggtggccagagttg

SEQ ID NO: 8418 - DNA, 20 bp, Artificial Sequence
  Description of Artificial Sequence: Synthetic oligonucleotide
  Target: ATXN1; (-) strand; PAM type: NNAGAAW; PAM sequence: AGAGAAT
ttgctggagattggtatgaa

SEQ ID NO: 8419 - DNA, 20 bp, Artificial Sequence
  Description of Artificial Sequence: Synthetic oligonucleotide
  Target: ATXN1; (-) strand; PAM type: NNAGAAW; PAM sequence: TGAGAAA
tgtcaggttcagaagaggaa

SEQ ID NO: 8420 - DNA, 20 bp, Artificial Sequence
  Description of Artificial Sequence: Synthetic oligonucleotide
  Target: ATXN1; (-) strand; PAM type: NNAGAAW; PAM sequence: TGAGAAT
aatccatgacaacagacaac

SEQ ID NO: 8421 - DNA, 20 bp, Artificial Sequence
  Description of Artificial Sequence: Synthetic oligonucleotide
  Target: ATXN1; (-) strand; PAM type: NNAGAAW; PAM sequence: AGAGAAT
ctacttgggaggctgaggca

SEQ ID NO: 8422 - DNA, 20 bp, Artificial Sequence
  Description of Artificial Sequence: Synthetic oligonucleotide
  Target: ATXN1; (-) strand; PAM type: NNAGAAW; PAM sequence: GGAGAAA
gagaccaccctgagcaacat

SEQ ID NO: 8423 - DNA, 20 bp, Artificial Sequence
  Description of Artificial Sequence: Synthetic oligonucleotide
  Target: ATXN1; (-) strand; PAM type: NNAGAAW; PAM sequence: TAAGAAA
tgtcacagattagcagaaac

SEQ ID NO: 8424 - DNA, 20 bp, Artificial Sequence
  Description of Artificial Sequence: Synthetic oligonucleotide
  Target: ATXN1; (-) strand; PAM type: NNAGAAW; PAM sequence: GCAGAAA
tcaggaactgtcacagatta

SEQ ID NO: 8425 - DNA, 20 bp, Artificial Sequence
  Description of Artificial Sequence: Synthetic oligonucleotide
  Target: ATXN1; (-) strand; PAM type: NNAGAAW; PAM sequence: CAAGAAA
aggcataatctcactctaat

SEQ ID NO: 8426 - DNA, 20 bp, Artificial Sequence
  Description of Artificial Sequence: Synthetic oligonucleotide
  Target: ATXN1; (-) strand; PAM type: NNAGAAW; PAM sequence: GAAGAAT
gaaaaataaaagtttacggt

SEQ ID NO: 8427 - DNA, 20 bp, Artificial Sequence
  Description of Artificial Sequence: Synthetic oligonucleotide
  Target: ATXN1; (-) strand; PAM type: NNAGAAW; PAM sequence: GGAGAAA
caaacatttagtaattacaa

SEQ ID NO: 8428 - DNA, 20 bp, Artificial Sequence
  Description of Artificial Sequence: Synthetic oligonucleotide
  Target: ATXN1; (-) strand; PAM type: NNAGAAW; PAM sequence: GTAGAAT
tatgcagaaacaggaaattc

SEQ ID NO: 8429 - DNA, 20 bp, Artificial Sequence
  Description of Artificial Sequence: Synthetic oligonucleotide
  Target: ATXN1; (-) strand; PAM type: NNAGAAW; PAM sequence: GCAGAAA
atgagcgggcaaaagtatat

SEQ ID NO: 8430 - DNA, 20 bp, Artificial Sequence
  Description of Artificial Sequence: Synthetic oligonucleotide
  Target: ATXN1; (-) strand; PAM type: NNAGAAW; PAM sequence: TTAGAAT
gcagatgtggattagatgga

SEQ ID NO: 8431 - DNA, 20 bp, Artificial Sequence
  Description of Artificial Sequence: Synthetic oligonucleotide
  Target: ATXN1; (-) strand; PAM type: NNAGAAW; PAM sequence: CGAGAAA
actcatagtaagaattgcca

SEQ ID NO: 8432 - DNA, 20 bp, Artificial Sequence
  Description of Artificial Sequence: Synthetic oligonucleotide
  Target: ATXN1; (-) strand; PAM type: NNAGAAW; PAM sequence: TAAGAAT
aacatcattagaactcatag

SEQ ID NO: 8433 - DNA, 20 bp, Artificial Sequence
  Description of Artificial Sequence: Synthetic oligonucleotide
  Target: ATXN1; (-) strand; PAM type: NNAGAAW; PAM sequence: GCAGAAT
aggaatgactcttccctgca

SEQ ID NO: 8434 - DNA, 20 bp, Artificial Sequence
  Description of Artificial Sequence: Synthetic oligonucleotide
  Target: ATXN1; (-) strand; PAM type: NNAGAAW; PAM sequence: AAAGAAT
taaatgctggattataaccc

SEQ ID NO: 8435 - DNA, 20 bp, Artificial Sequence
  Description of Artificial Sequence: Synthetic oligonucleotide
  Target: ATXN1; (-) strand; PAM type: NNAGAAW; PAM sequence: TTAGAAT
gtagaatatctagctacagc

SEQ ID NO: 8436 - DNA, 20 bp, Artificial Sequence
  Description of Artificial Sequence: Synthetic oligonucleotide
  Target: ATXN1; (-) strand; PAM type: NNAGAAW; PAM sequence: GTAGAAT
gctgtgtctgctctgaaatg

SEQ ID NO: 8437 - DNA, 20 bp, Artificial Sequence
  Description of Artificial Sequence: Synthetic oligonucleotide
  Target: ATXN1; (-) strand; PAM type: NNAGAAW; PAM sequence: CTAGAAA
ctgtgtgatggcgtgtgtct

SEQ ID NO: 8438 - DNA, 20 bp, Artificial Sequence
  Description of Artificial Sequence: Synthetic oligonucleotide
  Target: ATXN1; (-) strand; PAM type: NNAGAAW; PAM sequence: CTAGAAA
cttagctgtttccaattttc

SEQ ID NO: 8439 - DNA, 20 bp, Artificial Sequence
  Description of Artificial Sequence: Synthetic oligonucleotide
  Target: ATXN1; (-) strand; PAM type: NNAGAAW; PAM sequence: CAAGAAA
aaaatactgtaagagcagta

SEQ ID NO: 8440 - DNA, 20 bp, Artificial Sequence
  Description of Artificial Sequence: Synthetic oligonucleotide
  Target: ATXN1; (-) strand; PAM type: NNAGAAW; PAM sequence: GTAGAAA
gctgggctgaactatcatat

SEQ ID NO: 8441 - DNA, 20 bp, Artificial Sequence
  Description of Artificial Sequence: Synthetic oligonucleotide
  Target: ATXN1; (-) strand; PAM type: NNAGAAW; PAM sequence: GCAGAAA
gttgcagagtgtaatttgtg

SEQ ID NO: 8442 - DNA, 20 bp, Artificial Sequence
  Description of Artificial Sequence: Synthetic oligonucleotide
  Target: ATXN1; (-) strand; PAM type: NNAGAAW; PAM sequence: GAAGAAT
gaattgaaaatgctttggat

SEQ ID NO: 8443 - DNA, 20 bp, Artificial Sequence
  Description of Artificial Sequence: Synthetic oligonucleotide
  Target: ATXN1; (-) strand; PAM type: NNAGAAW; PAM sequence: GGAGAAT
gatgtaacattatatgtgca

SEQ ID NO: 8444 - DNA, 20 bp, Artificial Sequence
  Description of Artificial Sequence: Synthetic oligonucleotide
  Target: ATXN1; (-) strand; PAM type: NNAGAAW; PAM sequence: TTAGAAA
aaaagacacattgacattaa

SEQ ID NO: 8445 - DNA, 20 bp, Artificial Sequence
  Description of Artificial Sequence: Synthetic oligonucleotide
  Target: ATXN1; (-) strand; PAM type: NNAGAAW; PAM sequence: AGAGAAA
taatttagggaggtctgggc

SEQ ID NO: 8446 - DNA, 20 bp, Artificial Sequence
  Description of Artificial Sequence: Synthetic oligonucleotide
  Target: ATXN1; (-) strand; PAM type: NNAGAAW; PAM sequence: ACAGAAT
atattctggtaagccctgta

SEQ ID NO: 8447 - DNA, 20 bp, Artificial Sequence
  Description of Artificial Sequence: Synthetic oligonucleotide
  Target: ATXN1; (-) strand; PAM type: NNAGAAW; PAM sequence: ACAGAAT
tcagaaattcttctatgttt

SEQ ID NO: 8448 - DNA, 20 bp, Artificial Sequence
  Description of Artificial Sequence: Synthetic oligonucleotide
  Target: ATXN1; (-) strand; PAM type: NNAGAAW; PAM sequence: TCAGAAA
ctgcttctcatttttctggc

SEQ ID NO: 8449 - DNA, 20 bp, Artificial Sequence
  Description of Artificial Sequence: Synthetic oligonucleotide
  Target: ATXN1; (-) strand; PAM type: NNAGAAW; PAM sequence: ATAGAAA
tttttccgcatctctataaa

SEQ ID NO: 8450 - DNA, 20 bp, Artificial Sequence
  Description of Artificial Sequence: Synthetic oligonucleotide
  Target: ATXN1; (-) strand; PAM type: NNAGAAW; PAM sequence: TCAGAAA
ggagaaaatgaaatacaata

SEQ ID NO: 8451 - DNA, 20 bp, Artificial Sequence
  Description of Artificial Sequence: Synthetic oligonucleotide
  Target: ATXN1; (-) strand; PAM type: NNAGAAW; PAM sequence: GGAGAAA
gtaataaaattaatgtagtg

SEQ ID NO: 8452 - DNA, 20 bp, Artificial Sequence
  Description of Artificial Sequence: Synthetic oligonucleotide
  Target: ATXN1; (-) strand; PAM type: NNAGAAW; PAM sequence: CAAGAAA
aatagaaccaaaaatgaatt

SEQ ID NO: 8453 - DNA, 20 bp, Artificial Sequence
  Description of Artificial Sequence: Synthetic oligonucleotide
  Target: ATXN1; (-) strand; PAM type: NNAGAAW; PAM sequence: GCAGAAT
ataaaatgtttatgtaatga

SEQ ID NO: 8454 - DNA, 20 bp, Artificial Sequence
  Description of Artificial Sequence: Synthetic oligonucleotide
  Target: ATXN1; (-) strand; PAM type: NNAGAAW; PAM sequence: CCAGAAA
acctgggcattttagtttaa

SEQ ID NO: 8455 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
aaaggaagattccagggaat

SEQ ID NO: 8456 - DNA, 20 bp, Artificial Sequence
  Description of Artificial Sequence: Synthetic oligonucleotide
  Target: ATXN1; (-) strand; PAM type: NNAGAAW; PAM sequence: TTAGAAA
aggaagatttgtcaacatag

SEQ ID NO: 8457 - DNA, 20 bp, Artificial Sequence
  Description of Artificial Sequence: Synthetic oligonucleotide
  Target: ATXN1; (-) strand; PAM type: NNAGAAW; PAM sequence: AGAGAAA
atcttgggaataacagtgac

SEQ ID NO: 8458 - DNA, 20 bp, Artificial Sequence
  Description of Artificial Sequence: Synthetic oligonucleotide
  Target: ATXN1; (-) strand; PAM type: NNAGAAW; PAM sequence: CCAGAAA
tggaaggatgaactgactga

SEQ ID NO: 8459 - DNA, 20 bp, Artificial Sequence
  Description of Artificial Sequence: Synthetic oligonucleotide
  Target: ATXN1; (-) strand; PAM type: NNAGAAW; PAM sequence: TCAGAAA
taggtaagcatgttataaca

SEQ ID NO: 8460 - DNA, 20 bp, Artificial Sequence
  Description of Artificial Sequence: Synthetic oligonucleotide
  Target: ATXN1; (-) strand; PAM type: NNAGAAW; PAM sequence: CAAGAAT
tggaatatagtgaccacagt

SEQ ID NO: 8461 - DNA, 20 bp, Artificial Sequence
  Description of Artificial Sequence: Synthetic oligonucleotide
  Target: ATXN1; (-) strand; PAM type: NNAGAAW; PAM sequence: ACAGAAA
gtttggggaaaaggagtgag

SEQ ID NO: 8462 - DNA, 20 bp, Artificial Sequence
  Description of Artificial Sequence: Synthetic oligonucleotide
  Target: ATXN1; (-) strand; PAM type: NNAGAAW; PAM sequence: CAAGAAT
ataaacatagccaaacaaaa

SEQ ID NO: 8463 - DNA, 20 bp, Artificial Sequence
  Description of Artificial Sequence: Synthetic oligonucleotide
  Target: ATXN1; (-) strand; PAM type: NNAGAAW; PAM sequence: TCAGAAT
tgggagccacagagccactg

SEQ ID NO: 8464 - DNA, 20 bp, Artificial Sequence
  Description of Artificial Sequence: Synthetic oligonucleotide
  Target: ATXN1; (-) strand; PAM type: NNAGAAW; PAM sequence: TCAGAAT
tattaagaaggatcatctct

SEQ ID NO: 8465 - DNA, 20 bp, Artificial Sequence
  Description of Artificial Sequence: Synthetic oligonucleotide
  Target: ATXN1; (-) strand; PAM type: NNAGAAW; PAM sequence: AGAGAAA
ttataggattcagcggtgga

SEQ ID NO: 8466 - DNA, 20 bp, Artificial Sequence
  Description of Artificial Sequence: Synthetic oligonucleotide
  Target: ATXN1; (-) strand; PAM type: NNAGAAW; PAM sequence: GTAGAAA
aagtgcgggcaaaactcgag

SEQ ID NO: 8467 - DNA, 20 bp, Artificial Sequence
  Description of Artificial Sequence: Synthetic oligonucleotide
  Target: ATXN1; (-) strand; PAM type: NNAGAAW; PAM sequence: TTAGAAA
gtgtttactcttaaaacaca

SEQ ID NO: 8468 - DNA, 20 bp, Artificial Sequence
  Description of Artificial Sequence: Synthetic oligonucleotide
  Target: ATXN1; (-) strand; PAM type: NNAGAAW; PAM sequence: TAAGAAA
gaaatgtacatttctaaggt

SEQ ID NO: 8469 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
tttatcctacagaaacacaa

SEQ ID NO: 8470 - DNA, 20 bp, Artificial Sequence
  Description of Artificial Sequence: Synthetic oligonucleotide
  Target: ATXN1; (-) strand; PAM type: NNAGAAW; PAM sequence: ACAGAAA
ggaaatgtttcctttatcct

SEQ ID NO: 8471 - DNA, 20 bp, Artificial Sequence
  Description of Artificial Sequence: Synthetic oligonucleotide
  Target: ATXN1; (-) strand; PAM type: NNAGAAW; PAM sequence: GAAGAAT
tttttcttaaccacccaaag

SEQ ID NO: 8472 - DNA, 20 bp, Artificial Sequence
  Description of Artificial Sequence: Synthetic oligonucleotide
  Target: ATXN1; (-) strand; PAM type: NNAGAAW; PAM sequence: TTAGAAA
tttataactctacaaacatg

SEQ ID NO: 8473 - DNA, 20 bp, Artificial Sequence
  Description of Artificial Sequence: Synthetic oligonucleotide
  Target: ATXN1; (-) strand; PAM type: NNAGAAW; PAM sequence: TAAGAAA
ttattgacaatccatatcct

SEQ ID NO: 8474 - DNA, 20 bp, Artificial Sequence
  Description of Artificial Sequence: Synthetic oligonucleotide
  Target: ATXN1; (-) strand; PAM type: NNAGAAW; PAM sequence: AGAGAAT
ggcatagaacagaaagaacc

SEQ ID NO: 8475 - DNA, 20 bp, Artificial Sequence
  Description of Artificial Sequence: Synthetic oligonucleotide
  Target: ATXN1; (-) strand; PAM type: NNAGAAW; PAM sequence: ACAGAAA
gttgatctggaaggcataga

SEQ ID NO: 8476 - DNA, 20 bp, Artificial Sequence
  Description of Artificial Sequence: Synthetic oligonucleotide
  Target: ATXN1; (-) strand; PAM type: NNAGAAW; PAM sequence: GGAGAAA
tgcatctgaaattggaaact

SEQ ID NO: 8477 - DNA, 20 bp, Artificial Sequence
  Description of Artificial Sequence: Synthetic oligonucleotide
  Target: ATXN1; (-) strand; PAM type: NNAGAAW; PAM sequence: TGAGAAA
aaagcacaacttttgaattg

SEQ ID NO: 8478 - DNA, 20 bp, Artificial Sequence
  Description of Artificial Sequence: Synthetic oligonucleotide
  Target: ATXN1; (-) strand; PAM type: NNAGAAW; PAM sequence: GCAGAAT
agacctatctgcaagaccag

SEQ ID NO: 8479 - DNA, 20 bp, Artificial Sequence
  Description of Artificial Sequence: Synthetic oligonucleotide
  Target: ATXN1; (-) strand; PAM type: NNAGAAW; PAM sequence: CCAGAAT
tgttggttgtcaagggctta

SEQ ID NO: 8480 - DNA, 20 bp, Artificial Sequence
  Description of Artificial Sequence: Synthetic oligonucleotide
  Target: ATXN1; (-) strand; PAM type: NNAGAAW; PAM sequence: GCAGAAA
tgtggatcactggctggtgt

SEQ ID NO: 8481 - DNA, 20 bp, Artificial Sequence
  Description of Artificial Sequence: Synthetic oligonucleotide
  Target: ATXN1; (-) strand; PAM type: NNAGAAW; PAM sequence: GAAGAAA
atcaataaagactcagagag

SEQ ID NO: 8482 - DNA, 20 bp, Artificial Sequence
  Description of Artificial Sequence: Synthetic oligonucleotide
  Target: ATXN1; (-) strand; PAM type: NNAGAAW; PAM sequence: TAAGAAA
cctgtgactatgaggatgaa

SEQ ID NO: 8483 - DNA, 20 bp, Artificial Sequence
  Description of Artificial Sequence: Synthetic oligonucleotide
  Target: ATXN1; (-) strand; PAM type: NNAGAAW; PAM sequence: TAAGAAT
ctaattaagacatgttagct

SEQ ID NO: 8484 - DNA, 20 bp, Artificial Sequence
  Description of Artificial Sequence: Synthetic oligonucleotide
  Target: ATXN1; (-) strand; PAM type: NNAGAAW; PAM sequence: AAAGAAT
aagtgaaaggaaaagtggtc

SEQ ID NO: 8485 - DNA, 20 bp, Artificial Sequence
  Description of Artificial Sequence: Synthetic oligonucleotide
  Target: ATXN1; (-) strand; PAM type: NNAGAAW; PAM sequence: TGAGAAA
ttcaggagtatttaatcatt

SEQ ID NO: 8486 - DNA, 20 bp, Artificial Sequence
  Description of Artificial Sequence: Synthetic oligonucleotide
  Target: ATXN1; (-) strand; PAM type: NNAGAAW; PAM sequence: TCAGAAA
acttaccagatttcgacatt

SEQ ID NO: 8487 - DNA, 20 bp, Artificial Sequence
  Description of Artificial Sequence: Synthetic oligonucleotide
  Target: ATXN1; (-) strand; PAM type: NNAGAAW; PAM sequence: TGAGAAT
ttaatacagttttccaatgc

SEQ ID NO: 8488 - DNA, 20 bp, Artificial Sequence
  Description of Artificial Sequence: Synthetic oligonucleotide
  Target: ATXN1; (-) strand; PAM type: NNAGAAW; PAM sequence: TGAGAAT
acagaagcagcctaactcag

SEQ ID NO: 8489 - DNA, 20 bp, Artificial Sequence
  Description of Artificial Sequence: Synthetic oligonucleotide
  Target: ATXN1; (-) strand; PAM type: NNAGAAW; PAM sequence: TTAGAAT
cttgttatttcttagaaatc

SEQ ID NO: 8490 - DNA, 20 bp, Artificial Sequence
  Description of Artificial Sequence: Synthetic oligonucleotide
  Target: ATXN1; (-) strand; PAM type: NNAGAAW; PAM sequence: TTAGAAA
aactgactgcttgttatttc

SEQ ID NO: 8491 - DNA, 20 bp, Artificial Sequence
  Description of Artificial Sequence: Synthetic oligonucleotide
  Target: ATXN1; (-) strand; PAM type: NNAGAAW; PAM sequence: AGAGAAA
ttgtggctagaaggagtctt

SEQ ID NO: 8492 - DNA, 20 bp, Artificial Sequence
  Description of Artificial Sequence: Synthetic oligonucleotide
  Target: ATXN1; (-) strand; PAM type: NNAGAAW; PAM sequence: CTAGAAT
cttgaagagatggtatagta

SEQ ID NO: 8493 - DNA, 20 bp, Artificial Sequence
  Description of Artificial Sequence: Synthetic oligonucleotide
  Target: ATXN1; (-) strand; PAM type: NNAGAAW; PAM sequence: GTAGAAA
tactaactacagaagtgttg

SEQ ID NO: 8494 - DNA, 20 bp, Artificial Sequence
  Description of Artificial Sequence: Synthetic oligonucleotide
  Target: ATXN1; (-) strand; PAM type: NNAGAAW; PAM sequence: TAAGAAT
tgtgaacaggtaaacatgtt

SEQ ID NO: 8495 - DNA, 20 bp, Artificial Sequence
  Description of Artificial Sequence: Synthetic oligonucleotide
  Target: ATXN1; (-) strand; PAM type: NNAGAAW; PAM sequence: CCAGAAA
aatctattctgcttagattt

SEQ ID NO: 8496 - DNA, 20 bp, Artificial Sequence
  Description of Artificial Sequence: Synthetic oligonucleotide
  Target: ATXN1; (-) strand; PAM type: NNAGAAW; PAM sequence: GCAGAAT
agctaggaaacgtaggtgag

SEQ ID NO: 8497 - DNA, 20 bp, Artificial Sequence
  Description of Artificial Sequence: Synthetic oligonucleotide
  Target: ATXN1; (-) strand; PAM type: NNAGAAW; PAM sequence: TTAGAAA
gcaggttttgggggccatgt

SEQ ID NO: 8498 - DNA, 20 bp, Artificial Sequence
  Description of Artificial Sequence: Synthetic oligonucleotide
  Target: ATXN1; (-) strand; PAM type: NNAGAAW; PAM sequence: AGAGAAT
atgctgtagtgcaagttgga

SEQ ID NO: 8499 - DNA, 20 bp, Artificial Sequence
  Description of Artificial Sequence: Synthetic oligonucleotide
  Target: ATXN1; (-) strand; PAM type: NNAGAAW; PAM sequence: AAAGAAT
gagctgagagctgaaggaga

SEQ ID NO: 8500 - DNA, 20 bp, Artificial Sequence
  Description of Artificial Sequence: Synthetic oligonucleotide
  Target: ATXN1; (-) strand; PAM type: NNAGAAW; PAM sequence: GGAGAAA
ggactgagctgagagctgaa

SEQ ID NO: 8501 - DNA, 20 bp, Artificial Sequence
  Description of Artificial Sequence: Synthetic oligonucleotide
  Target: ATXN1; (-) strand; PAM type: NNAGAAW; PAM sequence: AGAGAAA
acaggggttgtagaaaaatg

SEQ ID NO: 8502 - DNA, 20 bp, Artificial Sequence
  Description of Artificial Sequence: Synthetic oligonucleotide
  Target: ATXN1; (-) strand; PAM type: NNAGAAW; PAM sequence: GTAGAAA
tagggataggtacaggggtt

SEQ ID NO: 8503 - DNA, 20 bp, Artificial Sequence
  Description of Artificial Sequence: Synthetic oligonucleotide
  Target: ATXN1; (-) strand; PAM type: NNAGAAW; PAM sequence: ACAGAAA
acttcatagataatttttgt

SEQ ID NO: 8504 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
ctctaattttttttttagca

SEQ ID NO: 8505 - DNA, 20 bp, Artificial Sequence
  Description of Artificial Sequence: Synthetic oligonucleotide
  Target: ATXN1; (-) strand; PAM type: NNAGAAW; PAM sequence: TTAGAAT
taaatttctgcaattctaaa

SEQ ID NO: 8506 - DNA, 20 bp, Artificial Sequence
  Description of Artificial Sequence: Synthetic oligonucleotide
  Target: ATXN1; (-) strand; PAM type: NNAGAAW; PAM sequence: GCAGAAT
caagagaaaagcaacatagg

SEQ ID NO: 8507 - DNA, 20 bp, Artificial Sequence
  Description of Artificial Sequence: Synthetic oligonucleotide
  Target: ATXN1; (-) strand; PAM type: NNAGAAW; PAM sequence: AGAGAAA
ttaaatttggccaatatgca

SEQ ID NO: 8508 - DNA, 20 bp, Artificial Sequence
  Description of Artificial Sequence: Synthetic oligonucleotide
  Target: ATXN1; (-) strand; PAM type: NNAGAAW; PAM sequence: ATAGAAA
gtgataaatgtgaattgaga

SEQ ID NO: 8509 - DNA, 20 bp, Artificial Sequence
  Description of Artificial Sequence: Synthetic oligonucleotide
  Target: ATXN1; (-) strand; PAM type: NNAGAAW; PAM sequence: TGAGAAT
tatcagtgataaatgtgaat

SEQ ID NO: 8510 - DNA, 20 bp, Artificial Sequence
  Description of Artificial Sequence: Synthetic oligonucleotide
  Target: ATXN1; (-) strand; PAM type: NNAGAAW; PAM sequence: TCAGAAA
tctctgaggaaaagcctcaa

SEQ ID NO: 8511 - DNA, 20 bp, Artificial Sequence
  Description of Artificial Sequence: Synthetic oligonucleotide
  Target: ATXN1; (-) strand; PAM type: NNAGAAW; PAM sequence: AAAGAAT
ttgtctcaaagaaaaaaaaa

SEQ ID NO: 8512 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
acagagtgagaacttgtctc

SEQ ID NO: 8513 - DNA, 20 bp, Artificial Sequence
  Description of Artificial Sequence: Synthetic oligonucleotide
  Target: ATXN1; (-) strand; PAM type: NNAGAAW; PAM sequence: GGAGAAA
gagaccatcctggccaacat

SEQ ID NO: 8514 - DNA, 20 bp, Artificial Sequence
  Description of Artificial Sequence: Synthetic oligonucleotide
  Target: ATXN1; (-) strand; PAM type: NNAGAAW; PAM sequence: ATAGAAT
tcaatagctgtggccatgga

SEQ ID NO: 8515 - DNA, 20 bp, Artificial Sequence
  Description of Artificial Sequence: Synthetic oligonucleotide
  Target: ATXN1; (-) strand; PAM type: NNAGAAW; PAM sequence: AAAGAAT
gaaggaccagcataatgaac

SEQ ID NO: 8516 - DNA, 20 bp, Artificial Sequence
  Description of Artificial Sequence: Synthetic oligonucleotide
  Target: ATXN1; (-) strand; PAM type: NNAGAAW; PAM sequence: CTAGAAA
gcccctaaggagctcatagt

SEQ ID NO: 8517 - DNA, 20 bp, Artificial Sequence
  Description of Artificial Sequence: Synthetic oligonucleotide
  Target: ATXN1; (-) strand; PAM type: NNAGAAW; PAM sequence: AAAGAAT
actgagagtatattctgtgc

SEQ ID NO: 8518 - DNA, 20 bp, Artificial Sequence
  Description of Artificial Sequence: Synthetic oligonucleotide
  Target: ATXN1; (-) strand; PAM type: NNAGAAW; PAM sequence: GCAGAAT
gcttattctgaaacagctga

SEQ ID NO: 8519 - DNA, 20 bp, Artificial Sequence
  Description of Artificial Sequence: Synthetic oligonucleotide
  Target: ATXN1; (-) strand; PAM type: NNAGAAW; PAM sequence: TAAGAAT
gaaataagcccatataggaa

SEQ ID NO: 8520 - DNA, 20 bp, Artificial Sequence
  Description of Artificial Sequence: Synthetic oligonucleotide
  Target: ATXN1; (-) strand; PAM type: NNAGAAW; PAM sequence: TGAGAAA
aaaaatcaaaggtggatatg

SEQ ID NO: 8521 - DNA, 20 bp, Artificial Sequence
  Description of Artificial Sequence: Synthetic oligonucleotide
  Target: ATXN1; (-) strand; PAM type: NNAGAAW; PAM sequence: TGAGAAA
tgggcctgggtaggatatta

SEQ ID NO: 8522 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
aaaatcttggggcgtggaga

SEQ ID NO: 8523 - DNA, 20 bp, Artificial Sequence
  Description of Artificial Sequence: Synthetic oligonucleotide
  Target: ATXN1; (-) strand; PAM type: NNAGAAW; PAM sequence: GGAGAAA
cctagaaaatcttggggcgt

SEQ ID NO: 8524 - DNA, 20 bp, Artificial Sequence
  Description of Artificial Sequence: Synthetic oligonucleotide
  Target: ATXN1; (-) strand; PAM type: NNAGAAW; PAM sequence: CTAGAAA
tagtgcttcctaccaaaagc

SEQ ID NO: 8525 - DNA, 20 bp, Artificial Sequence
  Description of Artificial Sequence: Synthetic oligonucleotide
  Target: ATXN1; (-) strand; PAM type: NNAGAAW; PAM sequence: ACAGAAT
agaaggaaccaactccagac

SEQ ID NO: 8526 - DNA, 20 bp, Artificial Sequence
  Description of Artificial Sequence: Synthetic oligonucleotide
  Target: ATXN1; (-) strand; PAM type: NNAGAAW; PAM sequence: ACAGAAA
gaaaagggcgttctgatagg

SEQ ID NO: 8527 - DNA, 20 bp, Artificial Sequence
  Description of Artificial Sequence: Synthetic oligonucleotide
  Target: ATXN1; (-) strand; PAM type: NNAGAAW; PAM sequence: TGAGAAA
taaccaatcatggggaggat

SEQ ID NO: 8528 - DNA, 20 bp, Artificial Sequence
  Description of Artificial Sequence: Synthetic oligonucleotide
  Target: ATXN1; (-) strand; PAM type: NNAGAAW; PAM sequence: TCAGAAT
atttttaaagtgatagcatg

SEQ ID NO: 8529 - DNA, 20 bp, Artificial Sequence
  Description of Artificial Sequence: Synthetic oligonucleotide
  Target: ATXN1; (-) strand; PAM type: NNAGAAW; PAM sequence: ATAGAAA
tgggttacaaacattgcatg

SEQ ID NO: 8530 - DNA, 20 bp, Artificial Sequence
  Description of Artificial Sequence: Synthetic oligonucleotide
  Target: ATXN1; (-) strand; PAM type: NNAGAAW; PAM sequence: ATAGAAA
tgtattttagagagtgatag

SEQ ID NO: 8531 - DNA, 20 bp, Artificial Sequence
  Description of Artificial Sequence: Synthetic oligonucleotide
  Target: ATXN1; (-) strand; PAM type: NNAGAAW; PAM sequence: TTAGAAA
tgtaacaacatggctaaatc

SEQ ID NO: 8532 - DNA, 20 bp, Artificial Sequence
  Description of Artificial Sequence: Synthetic oligonucleotide
  Target: ATXN1; (-) strand; PAM type: NNAGAAW; PAM sequence: ACAGAAT
tatatataattttttgcttc

SEQ ID NO: 8533 - DNA, 20 bp, Artificial Sequence
  Description of Artificial Sequence: Synthetic oligonucleotide
  Target: ATXN1; (-) strand; PAM type: NNAGAAW; PAM sequence: ATAGAAA
tggacacagcattgtttcta

SEQ ID NO: 8534 - DNA, 20 bp, Artificial Sequence
  Description of Artificial Sequence: Synthetic oligonucleotide
  Target: ATXN1; (-) strand; PAM type: NNAGAAW; PAM sequence: ACAGAAT
cactgcactccagcctggcg

SEQ ID NO: 8535 - DNA, 20 bp, Artificial Sequence
  Description of Artificial Sequence: Synthetic oligonucleotide
  Target: ATXN1; (-) strand; PAM type: NNAGAAW; PAM sequence: GGAGAAT
atactcgggaggctgaggca

SEQ ID NO: 8536 - DNA, 20 bp, Artificial Sequence
  Description of Artificial Sequence: Synthetic oligonucleotide
  Target: ATXN1; (-) strand; PAM type: NNAGAAW; PAM sequence: TTAGAAT
gcttatttctttatggatat

SEQ ID NO: 8537 - DNA, 20 bp, Artificial Sequence
  Description of Artificial Sequence: Synthetic oligonucleotide
  Target: ATXN1; (-) strand; PAM type: NNAGAAW; PAM sequence: TAAGAAT
cttttggtatccaccttgct

SEQ ID NO: 8538 - DNA, 20 bp, Artificial Sequence
  Description of Artificial Sequence: Synthetic oligonucleotide
  Target: ATXN1; (-) strand; PAM type: NNAGAAW; PAM sequence: AAAGAAT
accttattcttttggagagg

SEQ ID NO: 8539 - DNA, 20 bp, Artificial Sequence
  Description of Artificial Sequence: Synthetic oligonucleotide
  Target: ATXN1; (-) strand; PAM type: NNAGAAW; PAM sequence: GGAGAAA
agtaagaaagagaccataat

SEQ ID NO: 8540 - DNA, 20 bp, Artificial Sequence
  Description of Artificial Sequence: Synthetic oligonucleotide
  Target: ATXN1; (-) strand; PAM type: NNAGAAW; PAM sequence: TAAGAAA
tgctttttgtagttaaccag

SEQ ID NO: 8541 - DNA, 20 bp, Artificial Sequence
  Description of Artificial Sequence: Synthetic oligonucleotide
  Target: ATXN1; (-) strand; PAM type: NNAGAAW; PAM sequence: TGAGAAT
cctacttaattaaaacagtg

SEQ ID NO: 8542 - DNA, 20 bp, Artificial Sequence
  Description of Artificial Sequence: Synthetic oligonucleotide
  Target: ATXN1; (-) strand; PAM type: NNAGAAW; PAM sequence: GGAGAAA
tttaccaggctttggatagg

SEQ ID NO: 8543 - DNA, 20 bp, Artificial Sequence
  Description of Artificial Sequence: Synthetic oligonucleotide
  Target: ATXN1; (-) strand; PAM type: NNAGAAW; PAM sequence: GGAGAAT
tcaaagatttttgtagttgt

SEQ ID NO: 8544 - DNA, 20 bp, Artificial Sequence
  Description of Artificial Sequence: Synthetic oligonucleotide
  Target: ATXN1; (-) strand; PAM type: NNAGAAW; PAM sequence: GCAGAAA
catttctgccataattgtgg

SEQ ID NO: 8545 - DNA, 20 bp, Artificial Sequence
  Description of Artificial Sequence: Synthetic oligonucleotide
  Target: ATXN1; (-) strand; PAM type: NNAGAAW; PAM sequence: CTAGAAT
aggcagaggcaggagaatcg

SEQ ID NO: 8546 - DNA, 20 bp, Artificial Sequence
  Description of Artificial Sequence: Synthetic oligonucleotide
  Target: ATXN1; (-) strand; PAM type: NNAGAAW; PAM sequence: GGAGAAT
ctactggggaggcagaggca

SEQ ID NO: 8547 - DNA, 20 bp, Artificial Sequence
  Description of Artificial Sequence: Synthetic oligonucleotide
  Target: ATXN1; (-) strand; PAM type: NNAGAAW; PAM sequence: CAAGAAT
gaatatgtttctccttacat

SEQ ID NO: 8548 - DNA, 20 bp, Artificial Sequence
  Description of Artificial Sequence: Synthetic oligonucleotide
  Target: ATXN1; (-) strand; PAM type: NNAGAAW; PAM sequence: AGAGAAA
tattatactgaaatttcaaa

SEQ ID NO: 8549 - DNA, 20 bp, Artificial Sequence
  Description of Artificial Sequence: Synthetic oligonucleotide
  Target: ATXN1; (-) strand; PAM type: NNAGAAW; PAM sequence: GTAGAAA
tacttcttatgacctgctgt

SEQ ID NO: 8550 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
ggaggtactgatgcatagga

SEQ ID NO: 8551 - DNA, 20 bp, Artificial Sequence
  Description of Artificial Sequence: Synthetic oligonucleotide
  Target: ATXN1; (-) strand; PAM type: NNAGAAW; PAM sequence: TAAGAAA
attatataatggcagctgtg

SEQ ID NO: 8552 - DNA, 20 bp, Artificial Sequence
  Description of Artificial Sequence: Synthetic oligonucleotide
  Target: ATXN1; (-) strand; PAM type: NNAGAAW; PAM sequence: CAAGAAT
attaaataaaaaacaatggc

SEQ ID NO: 8553 - DNA, 20 bp, Artificial Sequence
  Description of Artificial Sequence: Synthetic oligonucleotide
  Target: ATXN1; (-) strand; PAM type: NNAGAAW; PAM sequence: GGAGAAA
ttttgcatagctaatatcac

SEQ ID NO: 8554 - DNA, 20 bp, Artificial Sequence
  Description of Artificial Sequence: Synthetic oligonucleotide
  Target: ATXN1; (-) strand; PAM type: NNAGAAW; PAM sequence: TTAGAAT
cctttgttggagttttaaat

SEQ ID NO: 8555 - DNA, 20 bp, Artificial Sequence
  Description of Artificial Sequence: Synthetic oligonucleotide
  Target: ATXN1; (-) strand; PAM type: NNAGAAW; PAM sequence: GAAGAAT
ctcacgaatcttgaacctta

SEQ ID NO: 8556 - DNA, 20 bp, Artificial Sequence
  Description of Artificial Sequence: Synthetic oligonucleotide
  Target: ATXN1; (-) strand; PAM type: NNAGAAW; PAM sequence: TAAGAAT
ctaacaactgcgtcattttc

SEQ ID NO: 8557 - DNA, 20 bp, Artificial Sequence
  Description of Artificial Sequence: Synthetic oligonucleotide
  Target: ATXN1; (-) strand; PAM type: NNAGAAW; PAM sequence: TAAGAAT
aagatagcaacatacttaaa

SEQ ID NO: 8558 - DNA, 20 bp, Artificial Sequence
  Description of Artificial Sequence: Synthetic oligonucleotide
  Target: ATXN1; (-) strand; PAM type: NNAGAAW; PAM sequence: GAAGAAT
gatgcattttagcagtgttg

SEQ ID NO: 8559 - DNA, 20 bp, Artificial Sequence
  Description of Artificial Sequence: Synthetic oligonucleotide
  Target: ATXN1; (-) strand; PAM type: NNAGAAW; PAM sequence: ATAGAAA
catcctgttagaaagtcaga

SEQ ID NO: 8560 - DNA, 20 bp, Artificial Sequence
  Description of Artificial Sequence: Synthetic oligonucleotide
  Target: ATXN1; (-) strand; PAM type: NNAGAAW; PAM sequence: TCAGAAT
gattgcatcctgttagaaag

SEQ ID NO: 8561 - DNA, 20 bp, Artificial Sequence
  Description of Artificial Sequence: Synthetic oligonucleotide
  Target: ATXN1; (-) strand; PAM type: NNAGAAW; PAM sequence: TTAGAAA
ggctctcagattgcatcctg

SEQ ID NO: 8562 - DNA, 20 bp, Artificial Sequence
  Description of Artificial Sequence: Synthetic oligonucleotide
  Target: ATXN1; (-) strand; PAM type: NNAGAAW; PAM sequence: TGAGAAT
aaccctgactctaaaatacg

SEQ ID NO: 8563 - DNA, 20 bp, Artificial Sequence
  Description of Artificial Sequence: Synthetic oligonucleotide
  Target: ATXN1; (-) strand; PAM type: NNAGAAW; PAM sequence: GTAGAAA
gggtgggaaagaattacgga

SEQ ID NO: 8564 - DNA, 20 bp, Artificial Sequence
  Description of Artificial Sequence: Synthetic oligonucleotide
  Target: ATXN1; (-) strand; PAM type: NNAGAAW; PAM sequence: AAAGAAT
gttgacagggcaggggtggg

SEQ ID NO: 8565 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
ctcactgatgttagaattta

SEQ ID NO: 8566 - DNA, 20 bp, Artificial Sequence
  Description of Artificial Sequence: Synthetic oligonucleotide
  Target: ATXN1; (-) strand; PAM type: NNAGAAW; PAM sequence: TTAGAAT
attttggctgctcactgatg

SEQ ID NO: 8567 - DNA, 20 bp, Artificial Sequence
  Description of Artificial Sequence: Synthetic oligonucleotide
  Target: ATXN1; (-) strand; PAM type: NNAGAAW; PAM sequence: AAAGAAT
ctccatctaaaaaaaaaaaa

SEQ ID NO: 8568 - DNA, 20 bp, Artificial Sequence
  Description of Artificial Sequence: Synthetic oligonucleotide
  Target: ATXN1; (-) strand; PAM type: NNAGAAW; PAM sequence: TCAGAAT
accttatcctctttccccgt

SEQ ID NO: 8569 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
tttattttatcggcacttag

SEQ ID NO: 8570 - DNA, 20 bp, Artificial Sequence
  Description of Artificial Sequence: Synthetic oligonucleotide
  Target: ATXN1; (-) strand; PAM type: NNAGAAW; PAM sequence: TTAGAAA
atcttttattttatcggcac

SEQ ID NO: 8571 - DNA, 20 bp, Artificial Sequence
  Description of Artificial Sequence: Synthetic oligonucleotide
  Target: ATXN1; (-) strand; PAM type: NNAGAAW; PAM sequence: TAAGAAT
ctcaagctctcagaaactgg

SEQ ID NO: 8572 - DNA, 20 bp, Artificial Sequence
  Description of Artificial Sequence: Synthetic oligonucleotide
  Target: ATXN1; (-) strand; PAM type: NNAGAAW; PAM sequence: TCAGAAA
gggcccaagacctcaagctc

SEQ ID NO: 8573 - DNA, 20 bp, Artificial Sequence
  Description of Artificial Sequence: Synthetic oligonucleotide
  Target: ATXN1; (-) strand; PAM type: NNAGAAW; PAM sequence: GGAGAAT
aggagaaaagccaggggaaa

SEQ ID NO: 8574 - DNA, 20 bp, Artificial Sequence
  Description of Artificial Sequence: Synthetic oligonucleotide
  Target: ATXN1; (-) strand; PAM type: NNAGAAW; PAM sequence: GGAGAAA
aggcttaaagcctcttggaa

SEQ ID NO: 8575 - DNA, 20 bp, Artificial Sequence
  Description of Artificial Sequence: Synthetic oligonucleotide
  Target: ATXN1; (-) strand; PAM type: NNAGAAW; PAM sequence: ACAGAAT
ctccccatgagaactttatt

SEQ ID NO: 8576 - DNA, 20 bp, Artificial Sequence
  Description of Artificial Sequence: Synthetic oligonucleotide
  Target: ATXN1; (-) strand; PAM type: NNAGAAW; PAM sequence: AGAGAAA
aaaaaaaaaaaaaaaaaaga

SEQ ID NO: 8577 - DNA, 20 bp, Artificial Sequence
  Description of Artificial Sequence: Synthetic oligonucleotide
  Target: ATXN1; (-) strand; PAM type: NNAGAAW; PAM sequence: GGAGAAT
agggagcctgaacatataaa

SEQ ID NO: 8578 - DNA, 20 bp, Artificial Sequence
  Description of Artificial Sequence: Synthetic oligonucleotide
  Target: ATXN1; (-) strand; PAM type: NNAGAAW; PAM sequence: TAAGAAT
tgtctaagtgcagaggatct

SEQ ID NO: 8579 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
actatgtaaggagacatagt

SEQ ID NO: 8580 - DNA, 20 bp, Artificial Sequence
  Description of Artificial Sequence: Synthetic oligonucleotide
  Target: ATXN1; (-) strand; PAM type: NNAGAAW; PAM sequence: GGAGAAT
ctacttgggaggctgaggca

SEQ ID NO: 8581 - DNA, 20 bp, Artificial Sequence
  Description of Artificial Sequence: Synthetic oligonucleotide
  Target: ATXN1; (-) strand; PAM type: NNAGAAW; PAM sequence: GGAGAAT
ctacttgggaggctgaggca

SEQ ID NO: 8582 - DNA, 20 bp, Artificial Sequence
  Description of Artificial Sequence: Synthetic oligonucleotide
  Target: ATXN1; (-) strand; PAM type: NNAGAAW; PAM sequence: GTAGAAA
aaccctttcacttcacagat

SEQ ID NO: 8583 - DNA, 20 bp, Artificial Sequence
  Description of Artificial Sequence: Synthetic oligonucleotide
  Target: ATXN1; (-) strand; PAM type: NNAGAAW; PAM sequence: CTAGAAT
ataattgcagaacttgggag

SEQ ID NO: 8584 - DNA, 20 bp, Artificial Sequence
  Description of Artificial Sequence: Synthetic oligonucleotide
  Target: ATXN1; (-) strand; PAM type: NNAGAAW; PAM sequence: GTAGAAT
gtggatgtcataagaagact

SEQ ID NO: 8585 - DNA, 20 bp, Artificial Sequence
  Description of Artificial Sequence: Synthetic oligonucleotide
  Target: ATXN1; (-) strand; PAM type: NNAGAAW; PAM sequence: ACAGAAA
aagagagaccttggagagag

SEQ ID NO: 8586 - DNA, 20 bp, Artificial Sequence
  Description of Artificial Sequence: Synthetic oligonucleotide
  Target: ATXN1; (-) strand; PAM type: NNAGAAW; PAM sequence: TTAGAAA
tgattgtcaacaaaggtgac

SEQ ID NO: 8587 - DNA, 20 bp, Artificial Sequence
  Description of Artificial Sequence: Synthetic oligonucleotide
  Target: ATXN1; (-) strand; PAM type: NNAGAAW; PAM sequence: ATAGAAA
gtgtagtcaaaattaagaag

SEQ ID NO: 8588 - DNA, 20 bp, Artificial Sequence
  Description of Artificial Sequence: Synthetic oligonucleotide
  Target: ATXN1; (-) strand; PAM type: NNAGAAW; PAM sequence: AAAGAAT
ccaacatattttaaggaaac

SEQ ID NO: 8589 - DNA, 20 bp, Artificial Sequence
  Description of Artificial Sequence: Synthetic oligonucleotide
  Target: ATXN1; (-) strand; PAM type: NNAGAAW; PAM sequence: GAAGAAT
gcgctctcctactagggaga

SEQ ID NO: 8590 - DNA, 20 bp, Artificial Sequence
  Description of Artificial Sequence: Synthetic oligonucleotide
  Target: ATXN1; (-) strand; PAM type: NNAGAAW; PAM sequence: AGAGAAT
ctgtgccaccttttcaagaa

SEQ ID NO: 8591 - DNA, 20 bp, Artificial Sequence
  Description of Artificial Sequence: Synthetic oligonucleotide
  Target: ATXN1; (-) strand; PAM type: NNAGAAW; PAM sequence: CAAGAAA
acagtgctgtgccacctttt

SEQ ID NO: 8592 - DNA, 20 bp, Artificial Sequence
  Description of Artificial Sequence: Synthetic oligonucleotide
  Target: ATXN1; (-) strand; PAM type: NNAGAAW; PAM sequence: TCAGAAT
gatttctaaccagtgctctg

SEQ ID NO: 8593 - DNA, 20 bp, Artificial Sequence
  Description of Artificial Sequence: Synthetic oligonucleotide
  Target: ATXN1; (-) strand; PAM type: NNAGAAW; PAM sequence: TTAGAAA
ttactctgtatttcttcagt

SEQ ID NO: 8594 - DNA, 20 bp, Artificial Sequence
  Description of Artificial Sequence: Synthetic oligonucleotide
  Target: ATXN1; (-) strand; PAM type: NNAGAAW; PAM sequence: TCAGAAA
ttgttttatttcttctattg

SEQ ID NO: 8595 - DNA, 20 bp, Artificial Sequence
  Description of Artificial Sequence: Synthetic oligonucleotide
  Target: ATXN1; (-) strand; PAM type: NNAGAAW; PAM sequence: CAAGAAT
ttttgttgctccttgggatc

SEQ ID NO: 8596 - DNA, 20 bp, Artificial Sequence
  Description of Artificial Sequence: Synthetic oligonucleotide
  Target: ATXN1; (-) strand; PAM type: NNAGAAW; PAM sequence: CCAGAAT
cgagatggagccactgcact

SEQ ID NO: 8597 - DNA, 20 bp, Artificial Sequence
  Description of Artificial Sequence: Synthetic oligonucleotide
  Target: ATXN1; (-) strand; PAM type: NNAGAAW; PAM sequence: GGAGAAT
ctactcgaaaggctgaggca

SEQ ID NO: 8598 - DNA, 20 bp, Artificial Sequence
  Description of Artificial Sequence: Synthetic oligonucleotide
  Target: ATXN1; (-) strand; PAM type: NNAGAAW; PAM sequence: ACAGAAT
agttttgttgcattgtggtc

SEQ ID NO: 8599 - DNA, 20 bp, Artificial Sequence
  Description of Artificial Sequence: Synthetic oligonucleotide
  Target: ATXN1; (-) strand; PAM type: NNAGAAW; PAM sequence: GAAGAAT
ttatactctacacctattta

SEQ ID NO: 8600 - DNA, 20 bp, Artificial Sequence
  Description of Artificial Sequence: Synthetic oligonucleotide
  Target: ATXN1; (-) strand; PAM type: NNAGAAW; PAM sequence: CTAGAAA
attaaagcattttaatgttt

SEQ ID NO: 8601 - DNA, 20 bp, Artificial Sequence
  Description of Artificial Sequence: Synthetic oligonucleotide
  Target: ATXN1; (-) strand; PAM type: NNAGAAW; PAM sequence: TTAGAAT
attacctgtccccaaagtta

SEQ ID NO: 8602 - DNA, 20 bp, Artificial Sequence
  Description of Artificial Sequence: Synthetic oligonucleotide
  Target: ATXN1; (-) strand; PAM type: NNAGAAW; PAM sequence: AGAGAAA
cctcaaggagaagaaaagtg

SEQ ID NO: 8603 - DNA, 20 bp, Artificial Sequence
  Description of Artificial Sequence: Synthetic oligonucleotide
  Target: ATXN1; (-) strand; PAM type: NNAGAAW; PAM sequence: GAAGAAA
cctctgagttgcctcaagga

SEQ ID NO: 8604 - DNA, 20 bp, Artificial Sequence
  Description of Artificial Sequence: Synthetic oligonucleotide
  Target: ATXN1; (-) strand; PAM type: NNAGAAW; PAM sequence: TAAGAAA
ccataaaagagaaccattct

SEQ ID NO: 8605 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
tatcatggaaactggtagag

SEQ ID NO: 8606 - DNA, 20 bp, Artificial Sequence
  Description of Artificial Sequence: Synthetic oligonucleotide
  Target: ATXN1; (-) strand; PAM type: NNAGAAW; PAM sequence: AGAGAAA
tatgtatcatggaaactggt

SEQ ID NO: 8607 - DNA, 20 bp, Artificial Sequence
  Description of Artificial Sequence: Synthetic oligonucleotide
  Target: ATXN1; (-) strand; PAM type: NNAGAAW; PAM sequence: AGAGAAA
tctttcccacagaatattta

SEQ ID NO: 8608 - DNA, 20 bp, Artificial Sequence
  Description of Artificial Sequence: Synthetic oligonucleotide
  Target: ATXN1; (-) strand; PAM type: NNAGAAW; PAM sequence: ACAGAAT
aattttcaaccctctttccc

SEQ ID NO: 8609 - DNA, 20 bp, Artificial Sequence
  Description of Artificial Sequence: Synthetic oligonucleotide
  Target: ATXN1; (-) strand; PAM type: NNAGAAW; PAM sequence: CTAGAAA
attaaagcattttaatgttt

SEQ ID NO: 8610 - DNA, 20 bp, Artificial Sequence
  Description of Artificial Sequence: Synthetic oligonucleotide
  Target: ATXN1; (-) strand; PAM type: NNAGAAW; PAM sequence: TTAGAAT
attacctgtccccaaagtta

SEQ ID NO: 8611 - DNA, 20 bp, Artificial Sequence
  Description of Artificial Sequence: Synthetic oligonucleotide
  Target: ATXN1; (-) strand; PAM type: NNAGAAW; PAM sequence: AGAGAAA
cctcaaggagaagaaaagtg

SEQ ID NO: 8612 - DNA, 20 bp, Artificial Sequence
  Description of Artificial Sequence: Synthetic oligonucleotide
  Target: ATXN1; (-) strand; PAM type: NNAGAAW; PAM sequence: GAAGAAA
cctctgagttgcctcaagga

SEQ ID NO: 8613 - DNA, 20 bp, Artificial Sequence
  Description of Artificial Sequence: Synthetic oligonucleotide
  Target: ATXN1; (-) strand; PAM type: NNAGAAW; PAM sequence: TAAGAAA
ccgtaaaagagaaccattct

SEQ ID NO: 8614 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
tatcatggaaactggtagag

SEQ ID NO: 8615 - DNA, 20 bp, Artificial Sequence
  Description of Artificial Sequence: Synthetic oligonucleotide
  Target: ATXN1; (-) strand; PAM type: NNAGAAW; PAM sequence: AGAGAAA
tatgtatcatggaaactggt

SEQ ID NO: 8616 - DNA, 20 bp, Artificial Sequence
  Description of Artificial Sequence: Synthetic oligonucleotide
  Target: ATXN1; (-) strand; PAM type: NNAGAAW; PAM sequence: AGAGAAA
tctttcccacagaatattta

SEQ ID NO: 8617 - DNA, 20 bp, Artificial Sequence
  Description of Artificial Sequence: Synthetic oligonucleotide
  Target: ATXN1; (-) strand; PAM type: NNAGAAW; PAM sequence: ACAGAAT
aattttcaaccctctttccc

SEQ ID NO: 8618 - DNA, 20 bp, Artificial Sequence
  Description of Artificial Sequence: Synthetic oligonucleotide
  Target: ATXN1; (-) strand; PAM type: NNAGAAW; PAM sequence: ATAGAAT
gtaatgcattttctgttttt

SEQ ID NO: 8619 - DNA, 20 bp, Artificial Sequence
  Description of Artificial Sequence: Synthetic oligonucleotide
  Target: ATXN1; (-) strand; PAM type: NNAGAAW; PAM sequence: AGAGAAT
tagattagatatcaattcag

SEQ ID NO: 8620 - DNA, 20 bp, Artificial Sequence
  Description of Artificial Sequence: Synthetic oligonucleotide
  Target: ATXN1; (-) strand; PAM type: NNAGAAW; PAM sequence: TTAGAAA
ctaataaaaactaaatgttt

SEQ ID NO: 8621 - DNA, 20 bp, Artificial Sequence
  Description of Artificial Sequence: Synthetic oligonucleotide
  Target: ATXN1; (-) strand; PAM type: NNAGAAW; PAM sequence: CTAGAAA
ttttttttttgcttttatac

SEQ ID NO: 8622 - DNA, 20 bp, Artificial Sequence
  Description of Artificial Sequence: Synthetic oligonucleotide
  Target: ATXN1; (-) strand; PAM type: NNAGAAW; PAM sequence: TGAGAAT
ctgttcctgggttagtttgc

SEQ ID NO: 8623 - DNA, 20 bp, Artificial Sequence
  Description of Artificial Sequence: Synthetic oligonucleotide
  Target: ATXN1; (-) strand; PAM type: NNAGAAW; PAM sequence: TTAGAAA
gttcattgcttatttttgtc

SEQ ID NO: 8624 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
aagtactgtaattaaaaaaa

SEQ ID NO: 8625 - DNA, 20 bp, Artificial Sequence
  Description of Artificial Sequence: Synthetic oligonucleotide
  Target: ATXN1; (-) strand; PAM type: NNAGAAW; PAM sequence: AAAGAAT
agaaaaactggaaatacaga

SEQ ID NO: 8626 - DNA, 20 bp, Artificial Sequence
  Description of Artificial Sequence: Synthetic oligonucleotide
  Target: ATXN1; (-) strand; PAM type: NNAGAAW; PAM sequence: ACAGAAA
catttagaaaaactggaaat

SEQ ID NO: 8627 - DNA, 20 bp, Artificial Sequence
  Description of Artificial Sequence: Synthetic oligonucleotide
  Target: ATXN1; (-) strand; PAM type: NNAGAAW; PAM sequence: TTAGAAA
gaagggatgtatatattcat

SEQ ID NO: 8628 - DNA, 20 bp, Artificial Sequence
  Description of Artificial Sequence: Synthetic oligonucleotide
  Target: ATXN1; (-) strand; PAM type: NNAGAAW; PAM sequence: CCAGAAA
gtctgactccagggcatgcc

SEQ ID NO: 8629 - DNA, 20 bp, Artificial Sequence
  Description of Artificial Sequence: Synthetic oligonucleotide
  Target: ATXN1; (-) strand; PAM type: NNAGAAW; PAM sequence: ATAGAAA
actactgcttttcctctagc

SEQ ID NO: 8630 - DNA, 20 bp, Artificial Sequence
  Description of Artificial Sequence: Synthetic oligonucleotide
  Target: ATXN1; (-) strand; PAM type: NNAGAAW; PAM sequence: AGAGAAT
tgagagacagagagagagag

SEQ ID NO: 8631 - DNA, 20 bp, Artificial Sequence
  Description of Artificial Sequence: Synthetic oligonucleotide
  Target: ATXN1; (-) strand; PAM type: NNAGAAW; PAM sequence: GGAGAAT
taaacgatagcacaatatct

SEQ ID NO: 8632 - DNA, 20 bp, Artificial Sequence
  Description of Artificial Sequence: Synthetic oligonucleotide
  Target: ATXN1; (-) strand; PAM type: NNAGAAW; PAM sequence: AGAGAAA
tgtgtgagagagagagagac

SEQ ID NO: 8633 - DNA, 20 bp, Artificial Sequence
  Description of Artificial Sequence: Synthetic oligonucleotide
  Target: ATXN1; (-) strand; PAM type: NNAGAAW; PAM sequence: TGAGAAT
tttcttaggatcctaggata

SEQ ID NO: 8634 - DNA, 20 bp, Artificial Sequence
  Description of Artificial Sequence: Synthetic oligonucleotide
  Target: ATXN1; (-) strand; PAM type: NNAGAAW; PAM sequence: CTAGAAA
tttttagtaggacctcagat

SEQ ID NO: 8635 - DNA, 20 bp, Artificial Sequence
  Description of Artificial Sequence: Synthetic oligonucleotide
  Target: ATXN1; (-) strand; PAM type: NNAGAAW; PAM sequence: CTAGAAT
cagcttgtgggtggtggagg

SEQ ID NO: 8636 - DNA, 20 bp, Artificial Sequence
  Description of Artificial Sequence: Synthetic oligonucleotide
  Target: ATXN1; (-) strand; PAM type: NNAGAAW; PAM sequence: ATAGAAT
taaaaatttacattcctgaa

SEQ ID NO: 8637 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
acagaaagatggctgggtaa

SEQ ID NO: 8638 - DNA, 20 bp, Artificial Sequence
  Description of Artificial Sequence: Synthetic oligonucleotide
  Target: ATXN1; (-) strand; PAM type: NNAGAAW; PAM sequence: ACAGAAA
tactggcaggctaaaaacca

SEQ ID NO: 8639 - DNA, 20 bp, Artificial Sequence
  Description of Artificial Sequence: Synthetic oligonucleotide
  Target: ATXN1; (-) strand; PAM type: NNAGAAW; PAM sequence: TTAGAAA
aaaaaaaaaaggctagaagc

SEQ ID NO: 8640 - DNA, 20 bp, Artificial Sequence
  Description of Artificial Sequence: Synthetic oligonucleotide
  Target: ATXN1; (-) strand; PAM type: NNAGAAW; PAM sequence: GCAGAAA
gaagccaaaaaagttacgtt

SEQ ID NO: 8641 - DNA, 20 bp, Artificial Sequence
  Description of Artificial Sequence: Synthetic oligonucleotide
  Target: ATXN1; (-) strand; PAM type: NNAGAAW; PAM sequence: TTAGAAA
atattcattggtacaaccat

SEQ ID NO: 8642 - DNA, 20 bp, Artificial Sequence
  Description of Artificial Sequence: Synthetic oligonucleotide
  Target: ATXN1; (-) strand; PAM type: NNAGAAW; PAM sequence: ACAGAAT
atgagttggctagaaattta

SEQ ID NO: 8643 - DNA, 20 bp, Artificial Sequence
  Description of Artificial Sequence: Synthetic oligonucleotide
  Target: ATXN1; (-) strand; PAM type: NNAGAAW; PAM sequence: CTAGAAA
agttgattgtgatgagttgg

SEQ ID NO: 8644 - DNA, 20 bp, Artificial Sequence
  Description of Artificial Sequence: Synthetic oligonucleotide
  Target: ATXN1; (-) strand; PAM type: NNAGAAW; PAM sequence: CCAGAAT
gttcagattaattgagatag

SEQ ID NO: 8645 - DNA, 20 bp, Artificial Sequence
  Description of Artificial Sequence: Synthetic oligonucleotide
  Target: ATXN1; (-) strand; PAM type: NNAGAAW; PAM sequence: GCAGAAT
ggggatataattcacaaact

SEQ ID NO: 8646 - DNA, 20 bp, Artificial Sequence
  Description of Artificial Sequence: Synthetic oligonucleotide
  Target: ATXN1; (-) strand; PAM type: NNAGAAW; PAM sequence: GCAGAAT
tgcaatgctcaatctatggt

SEQ ID NO: 8647 - DNA, 20 bp, Artificial Sequence
  Description of Artificial Sequence: Synthetic oligonucleotide
  Target: ATXN1; (-) strand; PAM type: NNAGAAW; PAM sequence: TGAGAAT
aggttgaagctgcagtttga

SEQ ID NO: 8648 - DNA, 20 bp, Artificial Sequence
  Description of Artificial Sequence: Synthetic oligonucleotide
  Target: ATXN1; (-) strand; PAM type: NNAGAAW; PAM sequence: GCAGAAA
gatgcattctgcgatcagtg

SEQ ID NO: 8649 - DNA, 20 bp, Artificial Sequence
  Description of Artificial Sequence: Synthetic oligonucleotide
  Target: ATXN1; (-) strand; PAM type: NNAGAAW; PAM sequence: ATAGAAT
taatcacagctgccttcatt

SEQ ID NO: 8650 - DNA, 20 bp, Artificial Sequence
  Description of Artificial Sequence: Synthetic oligonucleotide
  Target: ATXN1; (-) strand; PAM type: NNAGAAW; PAM sequence: CCAGAAT
ccaaatatgttttttcattg

SEQ ID NO: 8651 - DNA, 20 bp, Artificial Sequence
  Description of Artificial Sequence: Synthetic oligonucleotide
  Target: ATXN1; (-) strand; PAM type: NNAGAAW; PAM sequence: CAAGAAA
ggaagaccctgactcaaaaa

SEQ ID NO: 8652 - DNA, 20 bp, Artificial Sequence
  Description of Artificial Sequence: Synthetic oligonucleotide
  Target: ATXN1; (-) strand; PAM type: NNAGAAW; PAM sequence: GGAGAAT
ctgcttgggaggctgaggca

SEQ ID NO: 8653 - DNA, 20 bp, Artificial Sequence
  Description of Artificial Sequence: Synthetic oligonucleotide
  Target: ATXN1; (-) strand; PAM type: NNAGAAW; PAM sequence: TGAGAAA
ttccaaatacagttatattc

SEQ ID NO: 8654 - DNA, 20 bp, Artificial Sequence
  Description of Artificial Sequence: Synthetic oligonucleotide
  Target: ATXN1; (-) strand; PAM type: NNAGAAW; PAM sequence: TCAGAAT
gggctcattaacatctttga

SEQ ID NO: 8655 - DNA, 20 bp, Artificial Sequence
  Description of Artificial Sequence: Synthetic oligonucleotide
  Target: ATXN1; (-) strand; PAM type: NNAGAAW; PAM sequence: GGAGAAA
tcattagtgctaatattgca

SEQ ID NO: 8656 - DNA, 20 bp, Artificial Sequence
  Description of Artificial Sequence: Synthetic oligonucleotide
  Target: ATXN1; (-) strand; PAM type: NNAGAAW; PAM sequence: CCAGAAT
cctgcattaataggcaaatt

SEQ ID NO: 8657 - DNA, 20 bp, Artificial Sequence
  Description of Artificial Sequence: Synthetic oligonucleotide
  Target: ATXN1; (-) strand; PAM type: NNAGAAW; PAM sequence: TAAGAAA
aactcactagagggagcttc

SEQ ID NO: 8658 - DNA, 20 bp, Artificial Sequence
  Description of Artificial Sequence: Synthetic oligonucleotide
  Target: ATXN1; (-) strand; PAM type: NNAGAAW; PAM sequence: TAAGAAA
ctgaacctaaaataaaagct

SEQ ID NO: 8659 - DNA, 20 bp, Artificial Sequence
  Description of Artificial Sequence: Synthetic oligonucleotide
  Target: ATXN1; (-) strand; PAM type: NNAGAAW; PAM sequence: GCAGAAA
agggtggaggaggaagagga

SEQ ID NO: 8660 - DNA, 20 bp, Artificial Sequence
  Description of Artificial Sequence: Synthetic oligonucleotide
  Target: ATXN1; (-) strand; PAM type: NNAGAAW; PAM sequence: ACAGAAT
ctattcacagtagcaaagac

SEQ ID NO: 8661 - DNA, 20 bp, Artificial Sequence
  Description of Artificial Sequence: Synthetic oligonucleotide
  Target: ATXN1; (-) strand; PAM type: NNAGAAW; PAM sequence: GGAGAAA
ttggatgctgatgaggttgc

SEQ ID NO: 8662 - DNA, 20 bp, Artificial Sequence
  Description of Artificial Sequence: Synthetic oligonucleotide
  Target: ATXN1; (-) strand; PAM type: NNAGAAW; PAM sequence: TCAGAAT
gagatactatctcataccag

SEQ ID NO: 8663 - DNA, 20 bp, Artificial Sequence
  Description of Artificial Sequence: Synthetic oligonucleotide
  Target: ATXN1; (-) strand; PAM type: NNAGAAW; PAM sequence: TAAGAAT
aaaagaagacatatggccaa

SEQ ID NO: 8664 - DNA, 20 bp, Artificial Sequence
  Description of Artificial Sequence: Synthetic oligonucleotide
  Target: ATXN1; (-) strand; PAM type: NNAGAAW; PAM sequence: GGAGAAT
ctacgcgggaggctgaggca

SEQ ID NO: 8665 - DNA, 20 bp, Artificial Sequence
  Description of Artificial Sequence: Synthetic oligonucleotide
  Target: ATXN1; (-) strand; PAM type: NNAGAAW; PAM sequence: TAAGAAA
agactctaagaaggcaacat

SEQ ID NO: 8666 - DNA, 20 bp, Artificial Sequence
  Description of Artificial Sequence: Synthetic oligonucleotide
  Target: ATXN1; (-) strand; PAM type: NNAGAAW; PAM sequence: TTAGAAT
tcaatctgaccattttgtat

SEQ ID NO: 8667 - DNA, 20 bp, Artificial Sequence
  Description of Artificial Sequence: Synthetic oligonucleotide
  Target: ATXN1; (-) strand; PAM type: NNAGAAW; PAM sequence: GCAGAAA
tccctgaaattttcactata

SEQ ID NO: 8668 - DNA, 20 bp, Artificial Sequence
  Description of Artificial Sequence: Synthetic oligonucleotide
  Target: ATXN1; (-) strand; PAM type: NNAGAAW; PAM sequence: TCAGAAA
gaaggagagtgggcatggag

SEQ ID NO: 8669 - DNA, 20 bp, Artificial Sequence
  Description of Artificial Sequence: Synthetic oligonucleotide
  Target: ATXN1; (-) strand; PAM type: NNAGAAW; PAM sequence: ACAGAAT
caagtcagctttggaatgat

SEQ ID NO: 8670 - DNA, 20 bp, Artificial Sequence
  Description of Artificial Sequence: Synthetic oligonucleotide
  Target: ATXN1; (-) strand; PAM type: NNAGAAW; PAM sequence: TAAGAAT
ggaatgagactaattaataa

SEQ ID NO: 8671 - DNA, 20 bp, Artificial Sequence
  Description of Artificial Sequence: Synthetic oligonucleotide
  Target: ATXN1; (-) strand; PAM type: NNAGAAW; PAM sequence: CAAGAAT
aagtgattctgggtcattga

SEQ ID NO: 8672 - DNA, 20 bp, Artificial Sequence
  Description of Artificial Sequence: Synthetic oligonucleotide
  Target: ATXN1; (-) strand; PAM type: NNAGAAW; PAM sequence: AGAGAAT
atctgtaaatctacccaaca

SEQ ID NO: 8673 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
ctttcccttccaaaactgga

SEQ ID NO: 8674 - DNA, 20 bp, Artificial Sequence
  Description of Artificial Sequence: Synthetic oligonucleotide
  Target: ATXN1; (-) strand; PAM type: NNAGAAW; PAM sequence: ACAGAAA
agtgtaaagacatatttcta

SEQ ID NO: 8675 - DNA, 20 bp, Artificial Sequence
  Description of Artificial Sequence: Synthetic oligonucleotide
  Target: ATXN1; (-) strand; PAM type: NNAGAAW; PAM sequence: GAAGAAT
taggtttgttcaactggagt

SEQ ID NO: 8676 - DNA, 20 bp, Artificial Sequence
  Description of Artificial Sequence: Synthetic oligonucleotide
  Target: ATXN1; (-) strand; PAM type: NNAGAAW; PAM sequence: CAAGAAA
tgcttgtgagagttaaacat

SEQ ID NO: 8677 - DNA, 20 bp, Artificial Sequence
  Description of Artificial Sequence: Synthetic oligonucleotide
  Target: ATXN1; (-) strand; PAM type: NNAGAAW; PAM sequence: GAAGAAA
gtttaaactgtgttttctaa

SEQ ID NO: 8678 - DNA, 20 bp, Artificial Sequence
  Description of Artificial Sequence: Synthetic oligonucleotide
  Target: ATXN1; (-) strand; PAM type: NNAGAAW; PAM sequence: AGAGAAA
aggattaactttttcattac

SEQ ID NO: 8679 - DNA, 20 bp, Artificial Sequence
  Description of Artificial Sequence: Synthetic oligonucleotide
  Target: ATXN1; (-) strand; PAM type: NNAGAAW; PAM sequence: CCAGAAA
acagatgagaaaaccgaggc

SEQ ID NO: 8680 - DNA, 20 bp, Artificial Sequence
  Description of Artificial Sequence: Synthetic oligonucleotide
  Target: ATXN1; (-) strand; PAM type: NNAGAAW; PAM sequence: TGAGAAA
gagtattatcctcctacaga

SEQ ID NO: 8681 - DNA, 20 bp, Artificial Sequence
  Description of Artificial Sequence: Synthetic oligonucleotide
  Target: ATXN1; (-) strand; PAM type: NNAGAAW; PAM sequence: TCAGAAA
taaaaataaatgtttaattc

SEQ ID NO: 8682 - DNA, 20 bp, Artificial Sequence
  Description of Artificial Sequence: Synthetic oligonucleotide
  Target: ATXN1; (-) strand; PAM type: NNAGAAW; PAM sequence: GAAGAAA
cacagggtttcttttttgga

SEQ ID NO: 8683 - DNA, 20 bp, Artificial Sequence
  Description of Artificial Sequence: Synthetic oligonucleotide
  Target: ATXN1; (-) strand; PAM type: NNAGAAW; PAM sequence: CCAGAAT
atttcatttatatgaaaggt

SEQ ID NO: 8684 - DNA, 20 bp, Artificial Sequence
  Description of Artificial Sequence: Synthetic oligonucleotide
  Target: ATXN1; (-) strand; PAM type: NNAGAAW; PAM sequence: TGAGAAT
caatagggttcacgctccta

SEQ ID NO: 8685 - DNA, 20 bp, Artificial Sequence
  Description of Artificial Sequence: Synthetic oligonucleotide
  Target: ATXN1; (-) strand; PAM type: NNAGAAW; PAM sequence: GTAGAAT
attatgcaactcaccataat

SEQ ID NO: 8686 - DNA, 20 bp, Artificial Sequence
  Description of Artificial Sequence: Synthetic oligonucleotide
  Target: ATXN1; (-) strand; PAM type: NNAGAAW; PAM sequence: AAAGAAT
atctggtcaatgtcctgcct

SEQ ID NO: 8687 - DNA, 20 bp, Artificial Sequence
  Description of Artificial Sequence: Synthetic oligonucleotide
  Target: ATXN1; (-) strand; PAM type: NNAGAAW; PAM sequence: ACAGAAA
caggaccatgggaaaggaaa

SEQ ID NO: 8688 - DNA, 20 bp, Artificial Sequence
  Description of Artificial Sequence: Synthetic oligonucleotide
  Target: ATXN1; (-) strand; PAM type: NNAGAAW; PAM sequence: GAAGAAA
tcagtttcctcccctatgaa

SEQ ID NO: 8689 - DNA, 20 bp, Artificial Sequence
  Description of Artificial Sequence: Synthetic oligonucleotide
  Target: ATXN1; (-) strand; PAM type: NNAGAAW; PAM sequence: GGAGAAA
agggctgcctgggggctggg

SEQ ID NO: 8690 - DNA, 20 bp, Artificial Sequence
  Description of Artificial Sequence: Synthetic oligonucleotide
  Target: ATXN1; (-) strand; PAM type: NNAGAAW; PAM sequence: CAAGAAA
gacctgggaagaaaagatcc

SEQ ID NO: 8691 - DNA, 20 bp, Artificial Sequence
  Description of Artificial Sequence: Synthetic oligonucleotide
  Target: ATXN1; (-) strand; PAM type: NNAGAAW; PAM sequence: GAAGAAA
acagcactgctatgacctgg

SEQ ID NO: 8692 - DNA, 20 bp, Artificial Sequence
  Description of Artificial Sequence: Synthetic oligonucleotide
  Target: ATXN1; (-) strand; PAM type: NNAGAAW; PAM sequence: TGAGAAT
ttgtccttgcgataatttgc

SEQ ID NO: 8693 - DNA, 20 bp, Artificial Sequence
  Description of Artificial Sequence: Synthetic oligonucleotide
  Target: ATXN1; (-) strand; PAM type: NNAGAAW; PAM sequence: GGAGAAA
tgttataggtgactctaatt

SEQ ID NO: 8694 - DNA, 20 bp, Artificial Sequence
  Description of Artificial Sequence: Synthetic oligonucleotide
  Target: ATXN1; (-) strand; PAM type: NNAGAAW; PAM sequence: TAAGAAT
tttaaggtgattttccctgc

SEQ ID NO: 8695 - DNA, 20 bp, Artificial Sequence
  Description of Artificial Sequence: Synthetic oligonucleotide
  Target: ATXN1; (-) strand; PAM type: NNAGAAW; PAM sequence: CAAGAAA
cttcttgtcccatgccaatt

SEQ ID NO: 8696 - DNA, 20 bp, Artificial Sequence
  Description of Artificial Sequence: Synthetic oligonucleotide
  Target: ATXN1; (-) strand; PAM type: NNAGAAW; PAM sequence: ACAGAAA
ttttacaatccccttgtaag

SEQ ID NO: 8697 - DNA, 20 bp, Artificial Sequence
  Description of Artificial Sequence: Synthetic oligonucleotide
  Target: ATXN1; (-) strand; PAM type: NNAGAAW; PAM sequence: CAAGAAT
gtttgtggtcttgctgactt

SEQ ID NO: 8698 - DNA, 20 bp, Artificial Sequence
  Description of Artificial Sequence: Synthetic oligonucleotide
  Target: ATXN1; (-) strand; PAM type: NNAGAAW; PAM sequence: GGAGAAT
ctacttaggcggctgaggca

SEQ ID NO: 8699 - DNA, 20 bp, Artificial Sequence
  Description of Artificial Sequence: Synthetic oligonucleotide
  Target: ATXN1; (-) strand; PAM type: NNAGAAW; PAM sequence: GGAGAAA
agaaccagcctgaccaacat

SEQ ID NO: 8700 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
ggagctccaaaagccttaag

SEQ ID NO: 8701 - DNA, 20 bp, Artificial Sequence
  Description of Artificial Sequence: Synthetic oligonucleotide
  Target: ATXN1; (-) strand; PAM type: NNAGAAW; PAM sequence: TAAGAAA
ccttggagctccaaaagcct

SEQ ID NO: 8702 - DNA, 20 bp, Artificial Sequence
  Description of Artificial Sequence: Synthetic oligonucleotide
  Target: ATXN1; (-) strand; PAM type: NNAGAAW; PAM sequence: GGAGAAT
cacatgtgatgcctactgtt

SEQ ID NO: 8703 - DNA, 20 bp, Artificial Sequence
  Description of Artificial Sequence: Synthetic oligonucleotide
  Target: ATXN1; (-) strand; PAM type: NNAGAAW; PAM sequence: GCAGAAT
tactccttgatccatgggtt

SEQ ID NO: 8704 - DNA, 20 bp, Artificial Sequence
  Description of Artificial Sequence: Synthetic oligonucleotide
  Target: ATXN1; (-) strand; PAM type: NNAGAAW; PAM sequence: ACAGAAT
tctgtggcaatgatagcctt

SEQ ID NO: 8705 - DNA, 20 bp, Artificial Sequence
  Description of Artificial Sequence: Synthetic oligonucleotide
  Target: ATXN1; (-) strand; PAM type: NNAGAAW; PAM sequence: TCAGAAT
tagtgcctgttaggaagagt

SEQ ID NO: 8706 - DNA, 20 bp, Artificial Sequence
  Description of Artificial Sequence: Synthetic oligonucleotide
  Target: ATXN1; (-) strand; PAM type: NNAGAAW; PAM sequence: TCAGAAT
ctatttggcccgaattcttc

SEQ ID NO: 8707 - DNA, 20 bp, Artificial Sequence
  Description of Artificial Sequence: Synthetic oligonucleotide
  Target: ATXN1; (-) strand; PAM type: NNAGAAW; PAM sequence: AGAGAAT
tttttcttcttaataactga

SEQ ID NO: 8708 - DNA, 20 bp, Artificial Sequence
  Description of Artificial Sequence: Synthetic oligonucleotide
  Target: ATXN1; (-) strand; PAM type: NNAGAAW; PAM sequence: TCAGAAA
aataagttctcattctaatt

SEQ ID NO: 8709 - DNA, 20 bp, Artificial Sequence
  Description of Artificial Sequence: Synthetic oligonucleotide
  Target: ATXN1; (-) strand; PAM type: NNAGAAW; PAM sequence: TCAGAAT
gcccagcatcctgcattggg

SEQ ID NO: 8710 - DNA, 20 bp, Artificial Sequence
  Description of Artificial Sequence: Synthetic oligonucleotide
  Target: ATXN1; (-) strand; PAM type: NNAGAAW; PAM sequence: CCAGAAT
tcaataatctgtcctcagga

SEQ ID NO: 8711 - DNA, 20 bp, Artificial Sequence
  Description of Artificial Sequence: Synthetic oligonucleotide
  Target: ATXN1; (-) strand; PAM type: NNAGAAW; PAM sequence: GAAGAAA
tggatgaggtcactgggact

SEQ ID NO: 8712 - DNA, 20 bp, Artificial Sequence
  Description of Artificial Sequence: Synthetic oligonucleotide
  Target: ATXN1; (-) strand; PAM type: NNAGAAW; PAM sequence: GAAGAAA
tgtacaatttcctttttaaa

SEQ ID NO: 8713 - DNA, 20 bp, Artificial Sequence
  Description of Artificial Sequence: Synthetic oligonucleotide
  Target: ATXN1; (-) strand; PAM type: NNAGAAW; PAM sequence: TGAGAAA
agctatccacattttacaga

SEQ ID NO: 8714 - DNA, 20 bp, Artificial Sequence
  Description of Artificial Sequence: Synthetic oligonucleotide
  Target: ATXN1; (-) strand; PAM type: NNAGAAW; PAM sequence: GAAGAAT
gaagcatcagagctgacttg

SEQ ID NO: 8715 - DNA, 20 bp, Artificial Sequence
  Description of Artificial Sequence: Synthetic oligonucleotide
  Target: ATXN1; (-) strand; PAM type: NNAGAAW; PAM sequence: GGAGAAT
ctacttgggcgtctgagaca

SEQ ID NO: 8716 - DNA, 20 bp, Artificial Sequence
  Description of Artificial Sequence: Synthetic oligonucleotide
  Target: ATXN1; (-) strand; PAM type: NNAGAAW; PAM sequence: TAAGAAA
cagtttatcaatccatgaaa

SEQ ID NO: 8717 - DNA, 20 bp, Artificial Sequence
  Description of Artificial Sequence: Synthetic oligonucleotide
  Target: ATXN1; (-) strand; PAM type: NNAGAAW; PAM sequence: TGAGAAA
ataaatagttataatgctgc

SEQ ID NO: 8718 - DNA, 20 bp, Artificial Sequence
  Description of Artificial Sequence: Synthetic oligonucleotide
  Target: ATXN1; (-) strand; PAM type: NNAGAAW; PAM sequence: TAAGAAA
ctgtcactggattaactaat

SEQ ID NO: 8719 - DNA, 20 bp, Artificial Sequence
  Description of Artificial Sequence: Synthetic oligonucleotide
  Target: ATXN1; (-) strand; PAM type: NNAGAAW; PAM sequence: TCAGAAT
ttgtacgtgtgacaaggaat

SEQ ID NO: 8720 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
catgtcaaaaacaccactaa

SEQ ID NO: 8721 - DNA, 20 bp, Artificial Sequence
  Description of Artificial Sequence: Synthetic oligonucleotide
  Target: ATXN1; (-) strand; PAM type: NNAGAAW; PAM sequence: AGAGAAA
tgtttggctaaaataccaaa

SEQ ID NO: 8722 - DNA, 20 bp, Artificial Sequence
  Description of Artificial Sequence: Synthetic oligonucleotide
  Target: ATXN1; (-) strand; PAM type: NNAGAAW; PAM sequence: TAAGAAT
actattttttttttcatttc

SEQ ID NO: 8723 - DNA, 20 bp, Artificial Sequence
  Description of Artificial Sequence: Synthetic oligonucleotide
  Target: ATXN1; (-) strand; PAM type: NNAGAAW; PAM sequence: TCAGAAA
gcataaccatgtcggccaaa

SEQ ID NO: 8724 - DNA, 20 bp, Artificial Sequence
  Description of Artificial Sequence: Synthetic oligonucleotide
  Target: ATXN1; (-) strand; PAM type: NNAGAAW; PAM sequence: ATAGAAT
ttagaaaattctaacatcag

SEQ ID NO: 8725 - DNA, 20 bp, Artificial Sequence
  Description of Artificial Sequence: Synthetic oligonucleotide
  Target: ATXN1; (-) strand; PAM type: NNAGAAW; PAM sequence: TTAGAAA
actggcgtatatctttggca

SEQ ID NO: 8726 - DNA, 20 bp, Artificial Sequence
  Description of Artificial Sequence: Synthetic oligonucleotide
  Target: ATXN1; (-) strand; PAM type: NNAGAAW; PAM sequence: ACAGAAA
gaaagagcccatttagaaat

SEQ ID NO: 8727 - DNA, 20 bp, Artificial Sequence
  Description of Artificial Sequence: Synthetic oligonucleotide
  Target: ATXN1; (-) strand; PAM type: NNAGAAW; PAM sequence: TTAGAAA
gaagaaaggaaagagcccat

SEQ ID NO: 8728 - DNA, 20 bp, Artificial Sequence
  Description of Artificial Sequence: Synthetic oligonucleotide
  Target: ATXN1; (-) strand; PAM type: NNAGAAW; PAM sequence: GAAGAAA
ataaatatttacaaaggtaa

SEQ ID NO: 8729 - DNA, 20 bp, Artificial Sequence
  Description of Artificial Sequence: Synthetic oligonucleotide
  Target: ATXN1; (-) strand; PAM type: NNAGAAW; PAM sequence: ACAGAAA
ttggtaaatgattcatgaag

SEQ ID NO: 8730 - DNA, 20 bp, Artificial Sequence
  Description of Artificial Sequence: Synthetic oligonucleotide
  Target: ATXN1; (-) strand; PAM type: NNAGAAW; PAM sequence: ACAGAAA
caaggaaaaaaaaaaacaaa

SEQ ID NO: 8731 - DNA, 20 bp, Artificial Sequence
  Description of Artificial Sequence: Synthetic oligonucleotide
  Target: ATXN1; (-) strand; PAM type: NNAGAAW; PAM sequence: CCAGAAA
gggaagaggatttcttgagc

SEQ ID NO: 8732 - DNA, 20 bp, Artificial Sequence
  Description of Artificial Sequence: Synthetic oligonucleotide
  Target: ATXN1; (-) strand; PAM type: NNAGAAW; PAM sequence: CAAGAAT
aaggctagaagtaaagaaaa

SEQ ID NO: 8733 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
tatccacaaaggctagaagt

SEQ ID NO: 8734 - DNA, 20 bp, Artificial Sequence
  Description of Artificial Sequence: Synthetic oligonucleotide
  Target: ATXN1; (-) strand; PAM type: NNAGAAW; PAM sequence: GGAGAAA
ggttacggttcactgcatgc

SEQ ID NO: 8735 - DNA, 20 bp, Artificial Sequence
  Description of Artificial Sequence: Synthetic oligonucleotide
  Target: ATXN1; (-) strand; PAM type: NNAGAAW; PAM sequence: CAAGAAT
ccgaaacccagagattggta

SEQ ID NO: 8736 - DNA, 20 bp, Artificial Sequence
  Description of Artificial Sequence: Synthetic oligonucleotide
  Target: ATXN1; (-) strand; PAM type: NNAGAAW; PAM sequence: ACAGAAA
acagaaaacagaagtgaggt

SEQ ID NO: 8737 - DNA, 20 bp, Artificial Sequence
  Description of Artificial Sequence: Synthetic oligonucleotide
  Target: ATXN1; (-) strand; PAM type: NNAGAAW; PAM sequence: ACAGAAA
cagaaaaaggaaaacgacgg

SEQ ID NO: 8738 - DNA, 20 bp, Artificial Sequence
  Description of Artificial Sequence: Synthetic oligonucleotide
  Target: ATXN1; (-) strand; PAM type: NNAGAAW; PAM sequence: ACAGAAA
tggttggagaggatttatag

SEQ ID NO: 8739 - DNA, 20 bp, Artificial Sequence
  Description of Artificial Sequence: Synthetic oligonucleotide
  Target: ATXN1; (-) strand; PAM type: NNAGAAW; PAM sequence: CTAGAAT
tctactcctttcctcccgaa

SEQ ID NO: 8740 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
actcataatctaatgtgtta

SEQ ID NO: 8741 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
cttttgagaattctcatatg

SEQ ID NO: 8742 - DNA, 20 bp, Artificial Sequence
  Description of Artificial Sequence: Synthetic oligonucleotide
  Target: ATXN1; (-) strand; PAM type: NNAGAAW; PAM sequence: TGAGAAT
ttccatttattctactcttt

SEQ ID NO: 8743 - DNA, 20 bp, Artificial Sequence
  Description of Artificial Sequence: Synthetic oligonucleotide
  Target: ATXN1; (-) strand; PAM type: NNAGAAW; PAM sequence: TCAGAAT
ttgccgtgcatcagaagaaa

SEQ ID NO: 8744 - DNA, 20 bp, Artificial Sequence
  Description of Artificial Sequence: Synthetic oligonucleotide
  Target: ATXN1; (-) strand; PAM type: NNAGAAW; PAM sequence: GAAGAAA
gaggcatttgccgtgcatca

SEQ ID NO: 8745 - DNA, 20 bp, Artificial Sequence
  Description of Artificial Sequence: Synthetic oligonucleotide
  Target: ATXN1; (-) strand; PAM type: NNAGAAW; PAM sequence: TTAGAAA
acccccactaaagaccatcg

SEQ ID NO: 8746 - DNA, 20 bp, Artificial Sequence
  Description of Artificial Sequence: Synthetic oligonucleotide
  Target: ATXN1; (-) strand; PAM type: NNAGAAW; PAM sequence: TTAGAAA
ctaaaagagcatttgtctag

SEQ ID NO: 8747 - DNA, 20 bp, Artificial Sequence
  Description of Artificial Sequence: Synthetic oligonucleotide
  Target: ATXN1; (-) strand; PAM type: NNAGAAW; PAM sequence: ACAGAAA
taaccatccatggtaggaaa

SEQ ID NO: 8748 - DNA, 20 bp, Artificial Sequence
  Description of Artificial Sequence: Synthetic oligonucleotide
  Target: ATXN1; (-) strand; PAM type: NNAGAAW; PAM sequence: AGAGAAA
gccaggttgtcagctacaga

SEQ ID NO: 8749 - DNA, 20 bp, Artificial Sequence
  Description of Artificial Sequence: Synthetic oligonucleotide
  Target: ATXN1; (-) strand; PAM type: NNAGAAW; PAM sequence: GCAGAAA
gactaaaggaggtttggcga

SEQ ID NO: 8750 - DNA, 20 bp, Artificial Sequence
  Description of Artificial Sequence: Synthetic oligonucleotide
  Target: ATXN1; (-) strand; PAM type: NNAGAAW; PAM sequence: CTAGAAA
ctcacagaagcttagctagc

SEQ ID NO: 8751 - DNA, 20 bp, Artificial Sequence
  Description of Artificial Sequence: Synthetic oligonucleotide
  Target: ATXN1; (-) strand; PAM type: NNAGAAW; PAM sequence: GGAGAAA
tgggctggagcagcaggcta

SEQ ID NO: 8752 - DNA, 20 bp, Artificial Sequence
  Description of Artificial Sequence: Synthetic oligonucleotide
  Target: ATXN1; (-) strand; PAM type: NNAGAAW; PAM sequence: TTAGAAA
tcagcatattctctgaacct

SEQ ID NO: 8753 - DNA, 20 bp, Artificial Sequence
  Description of Artificial Sequence: Synthetic oligonucleotide
  Target: ATXN1; (-) strand; PAM type: NNAGAAW; PAM sequence: TGAGAAT
aacttttgcacactgaggtt

SEQ ID NO: 8754 - DNA, 20 bp, Artificial Sequence
  Description of Artificial Sequence: Synthetic oligonucleotide
  Target: ATXN1; (-) strand; PAM type: NNAGAAW; PAM sequence: ACAGAAT
acatttagggcctgcttctt

SEQ ID NO: 8755 - DNA, 20 bp, Artificial Sequence
  Description of Artificial Sequence: Synthetic oligonucleotide
  Target: ATXN1; (-) strand; PAM type: NNAGAAW; PAM sequence: GTAGAAA
agctaatttttctattttta

SEQ ID NO: 8756 - DNA, 20 bp, Artificial Sequence
  Description of Artificial Sequence: Synthetic oligonucleotide
  Target: ATXN1; (-) strand; PAM type: NNAGAAW; PAM sequence: GTAGAAA
caggaaaccacatgaatgtg

SEQ ID NO: 8757 - DNA, 20 bp, Artificial Sequence
  Description of Artificial Sequence: Synthetic oligonucleotide
  Target: ATXN1; (-) strand; PAM type: NNAGAAW; PAM sequence: TCAGAAA
cccctttctgaagcagagct

SEQ ID NO: 8758 - DNA, 20 bp, Artificial Sequence
  Description of Artificial Sequence: Synthetic oligonucleotide
  Target: ATXN1; (-) strand; PAM type: NNAGAAW; PAM sequence: ACAGAAT
tccacttcagttcttgccca

SEQ ID NO: 8759 - DNA, 20 bp, Artificial Sequence
  Description of Artificial Sequence: Synthetic oligonucleotide
  Target: ATXN1; (-) strand; PAM type: NNAGAAW; PAM sequence: GCAGAAT
ctacttgggaggctgaggca

SEQ ID NO: 8760 - DNA, 20 bp, Artificial Sequence
  Description of Artificial Sequence: Synthetic oligonucleotide
  Target: ATXN1; (-) strand; PAM type: NNAGAAW; PAM sequence: TAAGAAT
cggtgaaaccctgtctctac

SEQ ID NO: 8761 - DNA, 20 bp, Artificial Sequence
  Description of Artificial Sequence: Synthetic oligonucleotide
  Target: ATXN1; (-) strand; PAM type: NNAGAAW; PAM sequence: TTAGAAA
tgaatagaatgtatttgtgg

SEQ ID NO: 8762 - DNA, 20 bp, Artificial Sequence
  Description of Artificial Sequence: Synthetic oligonucleotide
  Target: ATXN1; (-) strand; PAM type: NNAGAAW; PAM sequence: ATAGAAT
tgcagaatagtatgatctga

SEQ ID NO: 8763 - DNA, 20 bp, Artificial Sequence
  Description of Artificial Sequence: Synthetic oligonucleotide
  Target: ATXN1; (-) strand; PAM type: NNAGAAW; PAM sequence: GCAGAAT
tgtgtttgtttctgaaactt

SEQ ID NO: 8764 - DNA, 20 bp, Artificial Sequence
  Description of Artificial Sequence: Synthetic oligonucleotide
  Target: ATXN1; (-) strand; PAM type: NNAGAAW; PAM sequence: AGAGAAA
tgctgcagaccaggaacaag

SEQ ID NO: 8765 - DNA, 20 bp, Artificial Sequence
  Description of Artificial Sequence: Synthetic oligonucleotide
  Target: ATXN1; (-) strand; PAM type: NNAGAAW; PAM sequence: TGAGAAA
gaggttatgaaatatacatt

SEQ ID NO: 8766 - DNA, 20 bp, Artificial Sequence
  Description of Artificial Sequence: Synthetic oligonucleotide
  Target: ATXN1; (-) strand; PAM type: NNAGAAW; PAM sequence: CAAGAAT
tgggtggagaaagtatttat

SEQ ID NO: 8767 - DNA, 20 bp, Artificial Sequence
  Description of Artificial Sequence: Synthetic oligonucleotide
  Target: ATXN1; (-) strand; PAM type: NNAGAAW; PAM sequence: GGAGAAA
tactgcttttcagcttgggt

SEQ ID NO: 8768 - DNA, 20 bp, Artificial Sequence
  Description of Artificial Sequence: Synthetic oligonucleotide
  Target: ATXN1; (-) strand; PAM type: NNAGAAW; PAM sequence: GCAGAAA
gagcgttaaaagctcacaag

SEQ ID NO: 8769 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
gcaagatatttttagttaaa

SEQ ID NO: 8770 - DNA, 20 bp, Artificial Sequence
  Description of Artificial Sequence: Synthetic oligonucleotide
  Target: ATXN1; (-) strand; PAM type: NNAGAAW; PAM sequence: AGAGAAA
tatgaagttggtaacaaata

SEQ ID NO: 8771 - DNA, 20 bp, Artificial Sequence
  Description of Artificial Sequence: Synthetic oligonucleotide
  Target: ATXN1; (-) strand; PAM type: NNAGAAW; PAM sequence: ATAGAAT
gtcaaggacctcttccaatt

SEQ ID NO: 8772 - DNA, 20 bp, Artificial Sequence
  Description of Artificial Sequence: Synthetic oligonucleotide
  Target: ATXN1; (-) strand; PAM type: NNAGAAW; PAM sequence: CCAGAAT
atgagcatgagtggttgaac

SEQ ID NO: 8773 - DNA, 20 bp, Artificial Sequence
  Description of Artificial Sequence: Synthetic oligonucleotide
  Target: ATXN1; (-) strand; PAM type: NNAGAAW; PAM sequence: ACAGAAA
tttcttatggcaaaaacaaa

SEQ ID NO: 8774 - DNA, 20 bp, Artificial Sequence
  Description of Artificial Sequence: Synthetic oligonucleotide
  Target: ATXN1; (-) strand; PAM type: NNAGAAW; PAM sequence: CCAGAAA
atagttgaaaataatataat

SEQ ID NO: 8775 - DNA, 20 bp, Artificial Sequence
  Description of Artificial Sequence: Synthetic oligonucleotide
  Target: ATXN1; (-) strand; PAM type: NNAGAAW; PAM sequence: TAAGAAT
ttcacatctacagatataag

SEQ ID NO: 8776 - DNA, 20 bp, Artificial Sequence
  Description of Artificial Sequence: Synthetic oligonucleotide
  Target: ATXN1; (-) strand; PAM type: NNAGAAW; PAM sequence: ACAGAAT
atgaaggtcagcgataaatc

SEQ ID NO: 8777 - DNA, 20 bp, Artificial Sequence
  Description of Artificial Sequence: Synthetic oligonucleotide
  Target: ATXN1; (-) strand; PAM type: NNAGAAW; PAM sequence: GTAGAAT
tattgcttaaaaagaagtgt

SEQ ID NO: 8778 - DNA, 20 bp, Artificial Sequence
  Description of Artificial Sequence: Synthetic oligonucleotide
  Target: ATXN1; (-) strand; PAM type: NNAGAAW; PAM sequence: TCAGAAA
ctgctgttgcttataactgt

SEQ ID NO: 8779 - DNA, 20 bp, Artificial Sequence
  Description of Artificial Sequence: Synthetic oligonucleotide
  Target: ATXN1; (-) strand; PAM type: NNAGAAW; PAM sequence: TGAGAAT
atgtaaaaacaaattataat

SEQ ID NO: 8780 - DNA, 20 bp, Artificial Sequence
  Description of Artificial Sequence: Synthetic oligonucleotide
  Target: ATXN1; (-) strand; PAM type: NNAGAAW; PAM sequence: GGAGAAT
ctacttgggagcctgaggca

SEQ ID NO: 8781 - DNA, 20 bp, Artificial Sequence
  Description of Artificial Sequence: Synthetic oligonucleotide
  Target: ATXN1; (-) strand; PAM type: NNAGAAW; PAM sequence: CTAGAAT
ttatatgtttagttatatat

SEQ ID NO: 8782 - DNA, 20 bp, Artificial Sequence
  Description of Artificial Sequence: Synthetic oligonucleotide
  Target: ATXN1; (-) strand; PAM type: NNAGAAW; PAM sequence: CTAGAAT
cctttgccacagtctgtttg

SEQ ID NO: 8783 - DNA, 20 bp, Artificial Sequence
  Description of Artificial Sequence: Synthetic oligonucleotide
  Target: ATXN1; (-) strand; PAM type: NNAGAAW; PAM sequence: GGAGAAT
ctacttgggaggctgaggca

SEQ ID NO: 8784 - DNA, 20 bp, Artificial Sequence
  Description of Artificial Sequence: Synthetic oligonucleotide
  Target: ATXN1; (-) strand; PAM type: NNAGAAW; PAM sequence: CAAGAAT
tagttaaggtatcaaagatg

SEQ ID NO: 8785 - DNA, 20 bp, Artificial Sequence
  Description of Artificial Sequence: Synthetic oligonucleotide
  Target: ATXN1; (-) strand; PAM type: NNAGAAW; PAM sequence: ACAGAAA
aaaaaaaaaaaaaaatccaa

SEQ ID NO: 8786 - DNA, 20 bp, Artificial Sequence
  Description of Artificial Sequence: Synthetic oligonucleotide
  Target: ATXN1; (-) strand; PAM type: NNAGAAW; PAM sequence: GGAGAAT
ctgcttgggaggctgaggca

SEQ ID NO: 8787 - DNA, 20 bp, Artificial Sequence
  Description of Artificial Sequence: Synthetic oligonucleotide
  Target: ATXN1; (-) strand; PAM type: NNAGAAW; PAM sequence: ATAGAAA
atgtctatgccacagaaaga

SEQ ID NO: 8788 - DNA, 20 bp, Artificial Sequence
  Description of Artificial Sequence: Synthetic oligonucleotide
  Target: ATXN1; (-) strand; PAM type: NNAGAAW; PAM sequence: AAAGAAT
ttcacatgtctatgccacag

SEQ ID NO: 8789 - DNA, 20 bp, Artificial Sequence
  Description of Artificial Sequence: Synthetic oligonucleotide
  Target: ATXN1; (-) strand; PAM type: NNAGAAW; PAM sequence: ACAGAAA
gtatttcacatgtctatgcc

SEQ ID NO: 8790 - DNA, 20 bp, Artificial Sequence
  Description of Artificial Sequence: Synthetic oligonucleotide
  Target: ATXN1; (-) strand; PAM type: NNAGAAW; PAM sequence: CGAGAAT
gtattgaggcaggagtgcag

SEQ ID NO: 8791 - DNA, 20 bp, Artificial Sequence
  Description of Artificial Sequence: Synthetic oligonucleotide
  Target: ATXN1; (-) strand; PAM type: NNAGAAW; PAM sequence: AAAGAAT
cctaagagtcagaccaaaat

SEQ ID NO: 8792 - DNA, 20 bp, Artificial Sequence
  Description of Artificial Sequence: Synthetic oligonucleotide
  Target: ATXN1; (-) strand; PAM type: NNAGAAW; PAM sequence: TTAGAAA
actttgggtaacagaaagat

SEQ ID NO: 8793 - DNA, 20 bp, Artificial Sequence
  Description of Artificial Sequence: Synthetic oligonucleotide
  Target: ATXN1; (-) strand; PAM type: NNAGAAW; PAM sequence: ACAGAAA
aaacacagtcactttgggta

SEQ ID NO: 8794 - DNA, 20 bp, Artificial Sequence
  Description of Artificial Sequence: Synthetic oligonucleotide
  Target: ATXN1; (-) strand; PAM type: NNAGAAW; PAM sequence: AGAGAAT
actgaattcagaggcacaga

SEQ ID NO: 8795 - DNA, 20 bp, Artificial Sequence
  Description of Artificial Sequence: Synthetic oligonucleotide
  Target: ATXN1; (-) strand; PAM type: NNAGAAW; PAM sequence: ACAGAAA
cttcaaccaaacaacatatc

SEQ ID NO: 8796 - DNA, 20 bp, Artificial Sequence
  Description of Artificial Sequence: Synthetic oligonucleotide
  Target: ATXN1; (-) strand; PAM type: NNAGAAW; PAM sequence: AAAGAAT
agttttggtatgatataaaa

SEQ ID NO: 8797 - DNA, 20 bp, Artificial Sequence
  Description of Artificial Sequence: Synthetic oligonucleotide
  Target: ATXN1; (-) strand; PAM type: NNAGAAW; PAM sequence: TAAGAAA
tccatggtgctgctcccctt

SEQ ID NO: 8798 - DNA, 20 bp, Artificial Sequence
  Description of Artificial Sequence: Synthetic oligonucleotide
  Target: ATXN1; (-) strand; PAM type: NNAGAAW; PAM sequence: AAAGAAT
gactaatgaattttaatata

SEQ ID NO: 8799 - DNA, 20 bp, Artificial Sequence
  Description of Artificial Sequence: Synthetic oligonucleotide
  Target: ATXN1; (-) strand; PAM type: NNAGAAW; PAM sequence: TTAGAAT
ccagtagggatctgtggggt

SEQ ID NO: 8800 - DNA, 20 bp, Artificial Sequence
  Description of Artificial Sequence: Synthetic oligonucleotide
  Target: ATXN1; (-) strand; PAM type: NNAGAAW; PAM sequence: GTAGAAT
ttctcacagtttcttgccta

SEQ ID NO: 8801 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
atttggaatgtccctaacaa

SEQ ID NO: 8802 - DNA, 20 bp, Artificial Sequence
  Description of Artificial Sequence: Synthetic oligonucleotide
  Target: ATXN1; (-) strand; PAM type: NNAGAAW; PAM sequence: GTAGAAT
tgacgtcatggagacagaga

SEQ ID NO: 8803 - DNA, 20 bp, Artificial Sequence
  Description of Artificial Sequence: Synthetic oligonucleotide
  Target: ATXN1; (-) strand; PAM type: NNAGAAW; PAM sequence: TAAGAAA
tctcactcatatgagggagc

SEQ ID NO: 8804 - DNA, 20 bp, Artificial Sequence
  Description of Artificial Sequence: Synthetic oligonucleotide
  Target: ATXN1; (-) strand; PAM type: NNAGAAW; PAM sequence: ACAGAAA
ttaagtaaaataagccaggc

SEQ ID NO: 8805 - DNA, 20 bp, Artificial Sequence
  Description of Artificial Sequence: Synthetic oligonucleotide
  Target: ATXN1; (-) strand; PAM type: NNAGAAW; PAM sequence: AAAGAAT
gaatattattcagccataca

SEQ ID NO: 8806 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
ccatcaatgaaggaatggat

SEQ ID NO: 8807 - DNA, 20 bp, Artificial Sequence
  Description of Artificial Sequence: Synthetic oligonucleotide
  Target: ATXN1; (-) strand; PAM type: NNAGAAW; PAM sequence: GAAGAAA
aaaagtcatgtatatatcca

SEQ ID NO: 8808 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
caaaaaaaaagaaagaaaga

SEQ ID NO: 8809 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
gactccaaaaaaaaagaaag

SEQ ID NO: 8810 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
gctagactccaaaaaaaaag

SEQ ID NO: 8811 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
cacagctagactccaaaaaa

SEQ ID NO: 8812 - DNA, 20 bp, Artificial Sequence
  Description of Artificial Sequence: Synthetic oligonucleotide
  Target: ATXN1; (-) strand; PAM type: NNAGAAW; PAM sequence: GGAGAAT
ctactcgggaggctgaggca

SEQ ID NO: 8813 - DNA, 20 bp, Artificial Sequence
  Description of Artificial Sequence: Synthetic oligonucleotide
  Target: ATXN1; (-) strand; PAM type: NNAGAAW; PAM sequence: GAAGAAA
gattcttaaagcctagattg

SEQ ID NO: 8814 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
aaagtttattcctttagtta

SEQ ID NO: 8815 - DNA, 20 bp, Artificial Sequence
  Description of Artificial Sequence: Synthetic oligonucleotide
  Target: ATXN1; (-) strand; PAM type: NNAGAAW; PAM sequence: AGAGAAT
aggcagcagactgaggagat

SEQ ID NO: 8816 - DNA, 20 bp, Artificial Sequence
  Description of Artificial Sequence: Synthetic oligonucleotide
  Target: ATXN1; (-) strand; PAM type: NNAGAAW; PAM sequence: GAAGAAT
ttgtggaatacctgccagag

SEQ ID NO: 8817 - DNA, 20 bp, Artificial Sequence
  Description of Artificial Sequence: Synthetic oligonucleotide
  Target: ATXN1; (-) strand; PAM type: NNAGAAW; PAM sequence: CAAGAAA
gccaactcctcactttgaaa

SEQ ID NO: 8818 - DNA, 20 bp, Artificial Sequence
  Description of Artificial Sequence: Synthetic oligonucleotide
  Target: ATXN1; (-) strand; PAM type: NNAGAAW; PAM sequence: AAAGAAT
cggtctgctttggggaggca

SEQ ID NO: 8819 - DNA, 20 bp, Artificial Sequence
  Description of Artificial Sequence: Synthetic oligonucleotide
  Target: ATXN1; (-) strand; PAM type: NNAGAAW; PAM sequence: ACAGAAT
gaatcaaaagttttaacctc

SEQ ID NO: 8820 - DNA, 20 bp, Artificial Sequence
  Description of Artificial Sequence: Synthetic oligonucleotide
  Target: ATXN1; (-) strand; PAM type: NNAGAAW; PAM sequence: TAAGAAT
gctctatcctcatgtccttc

SEQ ID NO: 8821 - DNA, 20 bp, Artificial Sequence
  Description of Artificial Sequence: Synthetic oligonucleotide
  Target: ATXN1; (-) strand; PAM type: NNAGAAW; PAM sequence: TTAGAAA
gacccaagggagttaagcgt

SEQ ID NO: 8822 - DNA, 20 bp, Artificial Sequence
  Description of Artificial Sequence: Synthetic oligonucleotide
  Target: ATXN1; (-) strand; PAM type: NNAGAAW; PAM sequence: AGAGAAA
aaggaaagccatctgaggtg

SEQ ID NO: 8823 - DNA, 20 bp, Artificial Sequence
  Description of Artificial Sequence: Synthetic oligonucleotide
  Target: ATXN1; (-) strand; PAM type: NNAGAAW; PAM sequence: CTAGAAA
gaaaaatgactaagaataat

SEQ ID NO: 8824 - DNA, 20 bp, Artificial Sequence
  Description of Artificial Sequence: Synthetic oligonucleotide
  Target: ATXN1; (-) strand; PAM type: NNAGAAW; PAM sequence: TAAGAAT
gccgggcattgaaaaatgac

SEQ ID NO: 8825 - DNA, 20 bp, Artificial Sequence
  Description of Artificial Sequence: Synthetic oligonucleotide
  Target: ATXN1; (-) strand; PAM type: NNAGAAW; PAM sequence: ATAGAAA
aagagtgagctgcagtggtt

SEQ ID NO: 8826 - DNA, 20 bp, Artificial Sequence
  Description of Artificial Sequence: Synthetic oligonucleotide
  Target: ATXN1; (-) strand; PAM type: NNAGAAW; PAM sequence: AGAGAAA
tctttagtcctcactcaatt

SEQ ID NO: 8827 - DNA, 20 bp, Artificial Sequence
  Description of Artificial Sequence: Synthetic oligonucleotide
  Target: ATXN1; (-) strand; PAM type: NNAGAAW; PAM sequence: TAAGAAA
tagtaataaaaacaaaaaaa

SEQ ID NO: 8828 - DNA, 20 bp, Artificial Sequence
  Description of Artificial Sequence: Synthetic oligonucleotide
  Target: ATXN1; (-) strand; PAM type: NNAGAAW; PAM sequence: TGAGAAA
acagacctaattctcttccc

SEQ ID NO: 8829 - DNA, 20 bp, Artificial Sequence
  Description of Artificial Sequence: Synthetic oligonucleotide
  Target: ATXN1; (-) strand; PAM type: NNAGAAW; PAM sequence: TGAGAAT
tggatgtcattaagaatggc

SEQ ID NO: 8830 - DNA, 20 bp, Artificial Sequence
  Description of Artificial Sequence: Synthetic oligonucleotide
  Target: ATXN1; (-) strand; PAM type: NNAGAAW; PAM sequence: TAAGAAT
actggaggtatggatgtcat

SEQ ID NO: 8831 - DNA, 20 bp, Artificial Sequence
  Description of Artificial Sequence: Synthetic oligonucleotide
  Target: ATXN1; (-) strand; PAM type: NNAGAAW; PAM sequence: CAAGAAA
tcaaagagtaattatgatgc

SEQ ID NO: 8832 - DNA, 20 bp, Artificial Sequence
  Description of Artificial Sequence: Synthetic oligonucleotide
  Target: ATXN1; (-) strand; PAM type: NNAGAAW; PAM sequence: AGAGAAA
tcaattacttggtttgtctg

SEQ ID NO: 8833 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
gcacagaagtttgatgtggt

SEQ ID NO: 8834 - DNA, 20 bp, Artificial Sequence
  Description of Artificial Sequence: Synthetic oligonucleotide
  Target: ATXN1; (-) strand; PAM type: NNAGAAW; PAM sequence: GCAGAAA
atggaaatgcaccattcaag

SEQ ID NO: 8835 - DNA, 20 bp, Artificial Sequence
  Description of Artificial Sequence: Synthetic oligonucleotide
  Target: ATXN1; (-) strand; PAM type: NNAGAAW; PAM sequence: TCAGAAA
tactgattaatagcagtgat

SEQ ID NO: 8836 - DNA, 20 bp, Artificial Sequence
  Description of Artificial Sequence: Synthetic oligonucleotide
  Target: ATXN1; (-) strand; PAM type: NNAGAAW; PAM sequence: ATAGAAT
tcaagtagcataaccaggaa

SEQ ID NO: 8837 - DNA, 20 bp, Artificial Sequence
  Description of Artificial Sequence: Synthetic oligonucleotide
  Target: ATXN1; (-) strand; PAM type: NNAGAAW; PAM sequence: GCAGAAA
gagccagacttgctggagag

SEQ ID NO: 8838 - DNA, 20 bp, Artificial Sequence
  Description of Artificial Sequence: Synthetic oligonucleotide
  Target: ATXN1; (-) strand; PAM type: NNAGAAW; PAM sequence: TCAGAAT
gacttttataaaagcaaatt

SEQ ID NO: 8839 - DNA, 20 bp, Artificial Sequence
  Description of Artificial Sequence: Synthetic oligonucleotide
  Target: ATXN1; (-) strand; PAM type: NNAGAAW; PAM sequence: TTAGAAA
agctattggttttcacttgt

SEQ ID NO: 8840 - DNA, 20 bp, Artificial Sequence
  Description of Artificial Sequence: Synthetic oligonucleotide
  Target: ATXN1; (-) strand; PAM type: NNAGAAW; PAM sequence: GCAGAAT
ttcttattacaaactacctg

SEQ ID NO: 8841 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
aaaaaaaaaaaaaagaaaga

SEQ ID NO: 8842 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
ctgcaaaaaaaaaaaaaaag

SEQ ID NO: 8843 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
gttactgcaaaaaaaaaaaa

SEQ ID NO: 8844 - DNA, 20 bp, Artificial Sequence
  Description of Artificial Sequence: Synthetic oligonucleotide
  Target: ATXN1; (-) strand; PAM type: NNAGAAW; PAM sequence: CCAGAAT
tcctgaggcccactttctta

SEQ ID NO: 8845 - DNA, 20 bp, Artificial Sequence
  Description of Artificial Sequence: Synthetic oligonucleotide
  Target: ATXN1; (-) strand; PAM type: NNAGAAW; PAM sequence: TCAGAAA
acacattgattagtttcact

SEQ ID NO: 8846 - DNA, 20 bp, Artificial Sequence
  Description of Artificial Sequence: Synthetic oligonucleotide
  Target: ATXN1; (-) strand; PAM type: NNAGAAW; PAM sequence: GTAGAAA
ttgctcaataaatgttaact

SEQ ID NO: 8847 - DNA, 20 bp, Artificial Sequence
  Description of Artificial Sequence: Synthetic oligonucleotide
  Target: ATXN1; (-) strand; PAM type: NNAGAAW; PAM sequence: TTAGAAT
cataatactgatgttagagg

SEQ ID NO: 8848 - DNA, 20 bp, Artificial Sequence
  Description of Artificial Sequence: Synthetic oligonucleotide
  Target: ATXN1; (-) strand; PAM type: NNAGAAW; PAM sequence: GTAGAAA
acacttggagaaacactgct

SEQ ID NO: 8849 - DNA, 20 bp, Artificial Sequence
  Description of Artificial Sequence: Synthetic oligonucleotide
  Target: ATXN1; (-) strand; PAM type: NNAGAAW; PAM sequence: GGAGAAA
aaggtccttggctcacactt

SEQ ID NO: 8850 - DNA, 20 bp, Artificial Sequence
  Description of Artificial Sequence: Synthetic oligonucleotide
  Target: ATXN1; (-) strand; PAM type: NNAGAAW; PAM sequence: ACAGAAA
ttcttttaatgcagtatgac

SEQ ID NO: 8851 - DNA, 20 bp, Artificial Sequence
  Description of Artificial Sequence: Synthetic oligonucleotide
  Target: ATXN1; (-) strand; PAM type: NNAGAAW; PAM sequence: AGAGAAT
tcattctctgtagggactct

SEQ ID NO: 8852 - DNA, 20 bp, Artificial Sequence
  Description of Artificial Sequence: Synthetic oligonucleotide
  Target: ATXN1; (-) strand; PAM type: NNAGAAW; PAM sequence: TCAGAAA
ttatctgacagttctgcagg

SEQ ID NO: 8853 - DNA, 20 bp, Artificial Sequence
  Description of Artificial Sequence: Synthetic oligonucleotide
  Target: ATXN1; (-) strand; PAM type: NNAGAAW; PAM sequence: GGAGAAA
agcaggataaggaaggaaac

SEQ ID NO: 8854 - DNA, 20 bp, Artificial Sequence
  Description of Artificial Sequence: Synthetic oligonucleotide
  Target: ATXN1; (-) strand; PAM type: NNAGAAW; PAM sequence: TGAGAAA
aatgttaatagtgctggagt

SEQ ID NO: 8855 - DNA, 20 bp, Artificial Sequence
  Description of Artificial Sequence: Synthetic oligonucleotide
  Target: ATXN1; (-) strand; PAM type: NNAGAAW; PAM sequence: CCAGAAA
tggcatctagtgagtagagg

SEQ ID NO: 8856 - DNA, 20 bp, Artificial Sequence
  Description of Artificial Sequence: Synthetic oligonucleotide
  Target: ATXN1; (-) strand; PAM type: NNAGAAW; PAM sequence: TAAGAAT
gaatgagaccagcagcaatg

SEQ ID NO: 8857 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
aaaaaaaaaaaaaaaaaaaa

SEQ ID NO: 8858 - DNA, 20 bp, Artificial Sequence
  Description of Artificial Sequence: Synthetic oligonucleotide
  Target: ATXN1; (-) strand; PAM type: NNAGAAW; PAM sequence: GGAGAAT
ctacttgggaggctgaggca

SEQ ID NO: 8859 - DNA, 20 bp, Artificial Sequence
  Description of Artificial Sequence: Synthetic oligonucleotide
  Target: ATXN1; (-) strand; PAM type: NNAGAAW; PAM sequence: GCAGAAT
ttttgaaattgaaagtctga

SEQ ID NO: 8860 - DNA, 20 bp, Artificial Sequence
  Description of Artificial Sequence: Synthetic oligonucleotide
  Target: ATXN1; (-) strand; PAM type: NNAGAAW; PAM sequence: AAAGAAT
cagtctgtttaagatttcag

SEQ ID NO: 8861 - DNA, 20 bp, Artificial Sequence
  Description of Artificial Sequence: Synthetic oligonucleotide
  Target: ATXN1; (-) strand; PAM type: NNAGAAW; PAM sequence: TCAGAAA
gctgcagtctgtttaagatt

SEQ ID NO: 8862 - DNA, 20 bp, Artificial Sequence
  Description of Artificial Sequence: Synthetic oligonucleotide
  Target: ATXN1; (-) strand; PAM type: NNAGAAW; PAM sequence: ACAGAAA
caattgaagaaaggcttttg

SEQ ID NO: 8863 - DNA, 20 bp, Artificial Sequence
  Description of Artificial Sequence: Synthetic oligonucleotide
  Target: ATXN1; (-) strand; PAM type: NNAGAAW; PAM sequence: GAAGAAA
tatgggactatggtgcaatt

SEQ ID NO: 8864 - DNA, 20 bp, Artificial Sequence
  Description of Artificial Sequence: Synthetic oligonucleotide
  Target: ATXN1; (-) strand; PAM type: NNAGAAW; PAM sequence: TGAGAAA
ttatttatttatttattttt

SEQ ID NO: 8865 - DNA, 20 bp, Artificial Sequence
  Description of Artificial Sequence: Synthetic oligonucleotide
  Target: ATXN1; (-) strand; PAM type: NNAGAAW; PAM sequence: TTAGAAA
gtaagttagtgaattatctt

SEQ ID NO: 8866 - DNA, 20 bp, Artificial Sequence
  Description of Artificial Sequence: Synthetic oligonucleotide
  Target: ATXN1; (-) strand; PAM type: NNAGAAW; PAM sequence: CCAGAAA
gtatgaaactagtgctaata

SEQ ID NO: 8867 - DNA, 20 bp, Artificial Sequence
  Description of Artificial Sequence: Synthetic oligonucleotide
  Target: ATXN1; (-) strand; PAM type: NNAGAAW; PAM sequence: GAAGAAT
ttatattctttttataggaa

SEQ ID NO: 8868 - DNA, 20 bp, Artificial Sequence
  Description of Artificial Sequence: Synthetic oligonucleotide
  Target: ATXN1; (-) strand; PAM type: NNAGAAW; PAM sequence: ATAGAAA
atccccaatcttgtgatgga

SEQ ID NO: 8869 - DNA, 20 bp, Artificial Sequence
  Description of Artificial Sequence: Synthetic oligonucleotide
  Target: ATXN1; (-) strand; PAM type: NNAGAAW; PAM sequence: AGAGAAA
acctaatgatgaggacacag

SEQ ID NO: 8870 - DNA, 20 bp, Artificial Sequence
  Description of Artificial Sequence: Synthetic oligonucleotide
  Target: ATXN1; (-) strand; PAM type: NNAGAAW; PAM sequence: ATAGAAA
agaatgaattaagagcagta

SEQ ID NO: 8871 - DNA, 20 bp, Artificial Sequence
  Description of Artificial Sequence: Synthetic oligonucleotide
  Target: ATXN1; (-) strand; PAM type: NNAGAAW; PAM sequence: ACAGAAT
gggtatgatagttgacagaa

SEQ ID NO: 8872 - DNA, 20 bp, Artificial Sequence
  Description of Artificial Sequence: Synthetic oligonucleotide
  Target: ATXN1; (-) strand; PAM type: NNAGAAW; PAM sequence: ACAGAAA
aaaatagggtatgatagttg

SEQ ID NO: 8873 - DNA, 20 bp, Artificial Sequence
  Description of Artificial Sequence: Synthetic oligonucleotide
  Target: ATXN1; (-) strand; PAM type: NNAGAAW; PAM sequence: ATAGAAA
atttcaagtgcactgtaaat

SEQ ID NO: 8874 - DNA, 20 bp, Artificial Sequence
  Description of Artificial Sequence: Synthetic oligonucleotide
  Target: ATXN1; (-) strand; PAM type: NNAGAAW; PAM sequence: CAAGAAA
acagcccctgataaaagttg

SEQ ID NO: 8875 - DNA, 20 bp, Artificial Sequence
  Description of Artificial Sequence: Synthetic oligonucleotide
  Target: ATXN1; (-) strand; PAM type: NNAGAAW; PAM sequence: CTAGAAT
agatagctctgaggttattg

SEQ ID NO: 8876 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
tcttggtaaaattaagtggc

SEQ ID NO: 8877 - DNA, 20 bp, Artificial Sequence
  Description of Artificial Sequence: Synthetic oligonucleotide
  Target: ATXN1; (-) strand; PAM type: NNAGAAW; PAM sequence: AAAGAAT
tgtacattttctcaaaatca

SEQ ID NO: 8878 - DNA, 20 bp, Artificial Sequence
  Description of Artificial Sequence: Synthetic oligonucleotide
  Target: ATXN1; (-) strand; PAM type: NNAGAAW; PAM sequence: TTAGAAT
ttgaatagttggctgagact

SEQ ID NO: 8879 - DNA, 20 bp, Artificial Sequence
  Description of Artificial Sequence: Synthetic oligonucleotide
  Target: ATXN1; (-) strand; PAM type: NNAGAAW; PAM sequence: TAAGAAT
atactatgtggcattgttag

SEQ ID NO: 8880 - DNA, 20 bp, Artificial Sequence
  Description of Artificial Sequence: Synthetic oligonucleotide
  Target: ATXN1; (-) strand; PAM type: NNAGAAW; PAM sequence: ATAGAAT
aagccatcttctaatataag

SEQ ID NO: 8881 - DNA, 20 bp, Artificial Sequence
  Description of Artificial Sequence: Synthetic oligonucleotide
  Target: ATXN1; (-) strand; PAM type: NNAGAAW; PAM sequence: TAAGAAA
atagcatatcaaactaactg

SEQ ID NO: 8882 - DNA, 20 bp, Artificial Sequence
  Description of Artificial Sequence: Synthetic oligonucleotide
  Target: ATXN1; (-) strand; PAM type: NNAGAAW; PAM sequence: TCAGAAA
gatgtctacttatatttaaa

SEQ ID NO: 8883 - DNA, 20 bp, Artificial Sequence
  Description of Artificial Sequence: Synthetic oligonucleotide
  Target: ATXN1; (-) strand; PAM type: NNAGAAW; PAM sequence: ACAGAAT
taaagaagcttactattaca

SEQ ID NO: 8884 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
acattaaatatttatcttta

SEQ ID NO: 8885 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
caagacagtgaaaaactagg

SEQ ID NO: 8886 - DNA, 20 bp, Artificial Sequence
  Description of Artificial Sequence: Synthetic oligonucleotide
  Target: ATXN1; (-) strand; PAM type: NNAGAAW; PAM sequence: ATAGAAT
tttgaactttacacattctg

SEQ ID NO: 8887 - DNA, 20 bp, Artificial Sequence
  Description of Artificial Sequence: Synthetic oligonucleotide
  Target: ATXN1; (-) strand; PAM type: NNAGAAW; PAM sequence: CCAGAAA
acaggccaattctgctccca

SEQ ID NO: 8888 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
gtagattagagaaggaaaag

SEQ ID NO: 8889 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
cactgtagattagagaagga

SEQ ID NO: 8890 - DNA, 20 bp, Artificial Sequence
  Description of Artificial Sequence: Synthetic oligonucleotide
  Target: ATXN1; (-) strand; PAM type: NNAGAAW; PAM sequence: TGAGAAT
aagctgaaaagtataatgga

SEQ ID NO: 8891 - DNA, 20 bp, Artificial Sequence
  Description of Artificial Sequence: Synthetic oligonucleotide
  Target: ATXN1; (-) strand; PAM type: NNAGAAW; PAM sequence: TAAGAAT
tcagcttttttctggttgtt

SEQ ID NO: 8892 - DNA, 20 bp, Artificial Sequence
  Description of Artificial Sequence: Synthetic oligonucleotide
  Target: ATXN1; (-) strand; PAM type: NNAGAAW; PAM sequence: AAAGAAT
tagtcctaaagagggggaag

SEQ ID NO: 8893 - DNA, 20 bp, Artificial Sequence
  Description of Artificial Sequence: Synthetic oligonucleotide
  Target: ATXN1; (-) strand; PAM type: NNAGAAW; PAM sequence: GAAGAAA
tgtttagtcctaaagagggg

SEQ ID NO: 8894 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
taataattccaaccattctc

SEQ ID NO: 8895 - DNA, 20 bp, Artificial Sequence
  Description of Artificial Sequence: Synthetic oligonucleotide
  Target: ATXN1; (-) strand; PAM type: NNAGAAW; PAM sequence: GGAGAAA
gagcactgtcccattggtgg

SEQ ID NO: 8896 - DNA, 20 bp, Artificial Sequence
  Description of Artificial Sequence: Synthetic oligonucleotide
  Target: ATXN1; (-) strand; PAM type: NNAGAAW; PAM sequence: ATAGAAT
ctgtgctctggtttcttggg

SEQ ID NO: 8897 - DNA, 20 bp, Artificial Sequence
  Description of Artificial Sequence: Synthetic oligonucleotide
  Target: ATXN1; (-) strand; PAM type: NNAGAAW; PAM sequence: TAAGAAA
tgaggcctgggaatctttaa

SEQ ID NO: 8898 - DNA, 20 bp, Artificial Sequence
  Description of Artificial Sequence: Synthetic oligonucleotide
  Target: ATXN1; (-) strand; PAM type: NNAGAAW; PAM sequence: CGAGAAT
ctacttgggaggctgaggca

SEQ ID NO: 8899 - DNA, 20 bp, Artificial Sequence
  Description of Artificial Sequence: Synthetic oligonucleotide
  Target: ATXN1; (-) strand; PAM type: NNAGAAW; PAM sequence: TCAGAAA
acatgtaagtctatgtggct

SEQ ID NO: 8900 - DNA, 20 bp, Artificial Sequence
  Description of Artificial Sequence: Synthetic oligonucleotide
  Target: ATXN1; (-) strand; PAM type: NNAGAAW; PAM sequence: GGAGAAA
ttttttttaatggccagatg

SEQ ID NO: 8901 - DNA, 20 bp, Artificial Sequence
  Description of Artificial Sequence: Synthetic oligonucleotide
  Target: ATXN1; (-) strand; PAM type: NNAGAAW; PAM sequence: AAAGAAT
agtgattgattgtattacaa

SEQ ID NO: 8902 - DNA, 20 bp, Artificial Sequence
  Description of Artificial Sequence: Synthetic oligonucleotide
  Target: ATXN1; (-) strand; PAM type: NNAGAAW; PAM sequence: GAAGAAA
aggttgttctagtccaaggt

SEQ ID NO: 8903 - DNA, 20 bp, Artificial Sequence
  Description of Artificial Sequence: Synthetic oligonucleotide
  Target: ATXN1; (-) strand; PAM type: NNAGAAW; PAM sequence: TTAGAAA
agaagctcagggctgtcaat

SEQ ID NO: 8904 - DNA, 20 bp, Artificial Sequence
  Description of Artificial Sequence: Synthetic oligonucleotide
  Target: ATXN1; (-) strand; PAM type: NNAGAAW; PAM sequence: TGAGAAA
aaccttaaaggcactgaagc

SEQ ID NO: 8905 - DNA, 20 bp, Artificial Sequence
  Description of Artificial Sequence: Synthetic oligonucleotide
  Target: ATXN1; (-) strand; PAM type: NNAGAAW; PAM sequence: TGAGAAA
ttcagctgtctgatgaggag

SEQ ID NO: 8906 - DNA, 20 bp, Artificial Sequence
  Description of Artificial Sequence: Synthetic oligonucleotide
  Target: ATXN1; (-) strand; PAM type: NNAGAAW; PAM sequence: CCAGAAT
aaatcccttcaatgtgatct

SEQ ID NO: 8907 - DNA, 20 bp, Artificial Sequence
  Description of Artificial Sequence: Synthetic oligonucleotide
  Target: ATXN1; (-) strand; PAM type: NNAGAAW; PAM sequence: CTAGAAT
agttgccaagcatgtttgta

SEQ ID NO: 8908 - DNA, 20 bp, Artificial Sequence
  Description of Artificial Sequence: Synthetic oligonucleotide
  Target: ATXN1; (-) strand; PAM type: NNAGAAW; PAM sequence: GAAGAAA
gcggcagagcaatttgccag

SEQ ID NO: 8909 - DNA, 20 bp, Artificial Sequence
  Description of Artificial Sequence: Synthetic oligonucleotide
  Target: ATXN1; (-) strand; PAM type: NNAGAAW; PAM sequence: TGAGAAA
agatctttccaaaggagatc

SEQ ID NO: 8910 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
tctcccataaagaatccaat

SEQ ID NO: 8911 - DNA, 20 bp, Artificial Sequence
  Description of Artificial Sequence: Synthetic oligonucleotide
  Target: ATXN1; (-) strand; PAM type: NNAGAAW; PAM sequence: AAAGAAT
taaggaacttggtctcccat

SEQ ID NO: 8912 - DNA, 20 bp, Artificial Sequence
  Description of Artificial Sequence: Synthetic oligonucleotide
  Target: ATXN1; (-) strand; PAM type: NNAGAAW; PAM sequence: CTAGAAA
tctcaagtttcaataagtcc

SEQ ID NO: 8913 - DNA, 20 bp, Artificial Sequence
  Description of Artificial Sequence: Synthetic oligonucleotide
  Target: ATXN1; (-) strand; PAM type: NNAGAAW; PAM sequence: TGAGAAT
taaggggtggggctgagacc

SEQ ID NO: 8914 - DNA, 20 bp, Artificial Sequence
  Description of Artificial Sequence: Synthetic oligonucleotide
  Target: ATXN1; (-) strand; PAM type: NNAGAAW; PAM sequence: TCAGAAA
agtggttttcaaatgtggct

SEQ ID NO: 8915 - DNA, 20 bp, Artificial Sequence
  Description of Artificial Sequence: Synthetic oligonucleotide
  Target: ATXN1; (-) strand; PAM type: NNAGAAW; PAM sequence: TCAGAAA
ttttactgaacgctaaatgc

SEQ ID NO: 8916 - DNA, 20 bp, Artificial Sequence
  Description of Artificial Sequence: Synthetic oligonucleotide
  Target: ATXN1; (-) strand; PAM type: NNAGAAW; PAM sequence: TAAGAAT
aaattgaattatatattcat

SEQ ID NO: 8917 - DNA, 20 bp, Artificial Sequence
  Description of Artificial Sequence: Synthetic oligonucleotide
  Target: ATXN1; (-) strand; PAM type: NNAGAAW; PAM sequence: TAAGAAA
aaaaaaaaccagccctaatt

SEQ ID NO: 8918 - DNA, 20 bp, Artificial Sequence
  Description of Artificial Sequence: Synthetic oligonucleotide
  Target: ATXN1; (-) strand; PAM type: NNAGAAW; PAM sequence: GAAGAAT
gaacatgaaggcgaattaat

SEQ ID NO: 8919 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
accatttctttcgttgtcct

SEQ ID NO: 8920 - DNA, 20 bp, Artificial Sequence
  Description of Artificial Sequence: Synthetic oligonucleotide
  Target: ATXN1; (-) strand; PAM type: NNAGAAW; PAM sequence: CCAGAAA
actcattcatttgttcctcc

SEQ ID NO: 8921 - DNA, 20 bp, Artificial Sequence
  Description of Artificial Sequence: Synthetic oligonucleotide
  Target: ATXN1; (-) strand; PAM type: NNAGAAW; PAM sequence: AAAGAAT
cattttagtttttacagttt

SEQ ID NO: 8922 - DNA, 20 bp, Artificial Sequence
  Description of Artificial Sequence: Synthetic oligonucleotide
  Target: ATXN1; (-) strand; PAM type: NNAGAAW; PAM sequence: TAAGAAT
aaaaaaacagaacttttcat

SEQ ID NO: 8923 - DNA, 20 bp, Artificial Sequence
  Description of Artificial Sequence: Synthetic oligonucleotide
  Target: ATXN1; (-) strand; PAM type: NNAGAAW; PAM sequence: TTAGAAT
caatgcattttgagtaattt

SEQ ID NO: 8924 - DNA, 20 bp, Artificial Sequence
  Description of Artificial Sequence: Synthetic oligonucleotide
  Target: ATXN1; (-) strand; PAM type: NNAGAAW; PAM sequence: CAAGAAT
tactgagtagctcgagtggt

SEQ ID NO: 8925 - DNA, 20 bp, Artificial Sequence
  Description of Artificial Sequence: Synthetic oligonucleotide
  Target: ATXN1; (-) strand; PAM type: NNAGAAW; PAM sequence: AGAGAAA
cttttctgtttctagcctag

SEQ ID NO: 8926 - DNA, 20 bp, Artificial Sequence
  Description of Artificial Sequence: Synthetic oligonucleotide
  Target: ATXN1; (-) strand; PAM type: NNAGAAW; PAM sequence: ATAGAAA
tccaagttcatgggacttag

SEQ ID NO: 8927 - DNA, 20 bp, Artificial Sequence
  Description of Artificial Sequence: Synthetic oligonucleotide
  Target: ATXN1; (-) strand; PAM type: NNAGAAW; PAM sequence: GAAGAAA
agactagcccccaaaaatta

SEQ ID NO: 8928 - DNA, 20 bp, Artificial Sequence
  Description of Artificial Sequence: Synthetic oligonucleotide
  Target: ATXN1; (-) strand; PAM type: NNAGAAW; PAM sequence: GGAGAAA
gaatttggttgatgctctat

SEQ ID NO: 8929 - DNA, 20 bp, Artificial Sequence
  Description of Artificial Sequence: Synthetic oligonucleotide
  Target: ATXN1; (-) strand; PAM type: NNAGAAW; PAM sequence: CCAGAAT
aaaagcagattggatgtcac

SEQ ID NO: 8930 - DNA, 20 bp, Artificial Sequence
  Description of Artificial Sequence: Synthetic oligonucleotide
  Target: ATXN1; (-) strand; PAM type: NNAGAAW; PAM sequence: TTAGAAT
aaaatagtttattggtagtt

SEQ ID NO: 8931 - DNA, 20 bp, Artificial Sequence
  Description of Artificial Sequence: Synthetic oligonucleotide
  Target: ATXN1; (-) strand; PAM type: NNAGAAW; PAM sequence: TGAGAAT
gttgtcagggatatcataaa

SEQ ID NO: 8932 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
aaaaaaaaaggaaggaaaaa

SEQ ID NO: 8933 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
aaaaaaaaaaaagaaaaaaa

SEQ ID NO: 8934 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
catctctacaaaaaaaaaaa

SEQ ID NO: 8935 - DNA, 20 bp, Artificial Sequence
  Description of Artificial Sequence: Synthetic oligonucleotide
  Target: ATXN1; (-) strand; PAM type: NNAGAAW; PAM sequence: AAAGAAT
tataaatgtcaagattgcta

SEQ ID NO: 8936 - DNA, 20 bp, Artificial Sequence
  Description of Artificial Sequence: Synthetic oligonucleotide
  Target: ATXN1; (-) strand; PAM type: NNAGAAW; PAM sequence: TCAGAAT
aacccaacccagtgttccct

SEQ ID NO: 8937 - DNA, 20 bp, Artificial Sequence
  Description of Artificial Sequence: Synthetic oligonucleotide
  Target: ATXN1; (-) strand; PAM type: NNAGAAW; PAM sequence: GAAGAAT
tcaagaggttaattaccttt

SEQ ID NO: 8938 - DNA, 20 bp, Artificial Sequence
  Description of Artificial Sequence: Synthetic oligonucleotide
  Target: ATXN1; (-) strand; PAM type: NNAGAAW; PAM sequence: GCAGAAT
ctggcaccatctttttcact

SEQ ID NO: 8939 - DNA, 20 bp, Artificial Sequence
  Description of Artificial Sequence: Synthetic oligonucleotide
  Target: ATXN1; (-) strand; PAM type: NNAGAAW; PAM sequence: ACAGAAA
gtcttctttcattttccttt

SEQ ID NO: 8940 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
aggtttgaatttaaaagcac

SEQ ID NO: 8941 - DNA, 20 bp, Artificial Sequence
  Description of Artificial Sequence: Synthetic oligonucleotide
  Target: ATXN1; (-) strand; PAM type: NNAGAAW; PAM sequence: TTAGAAA
tattccttagccttcatgtt

SEQ ID NO: 8942 - DNA, 20 bp, Artificial Sequence
  Description of Artificial Sequence: Synthetic oligonucleotide
  Target: ATXN1; (-) strand; PAM type: NNAGAAW; PAM sequence: GGAGAAA
atacactgagcttaagtaga

SEQ ID NO: 8943 - DNA, 20 bp, Artificial Sequence
  Description of Artificial Sequence: Synthetic oligonucleotide
  Target: ATXN1; (-) strand; PAM type: NNAGAAW; PAM sequence: AGAGAAT
gtattaaattctcaggcagg

SEQ ID NO: 8944 - DNA, 20 bp, Artificial Sequence
  Description of Artificial Sequence: Synthetic oligonucleotide
  Target: ATXN1; (-) strand; PAM type: NNAGAAW; PAM sequence: AAAGAAT
ttcctaggtcaccaattttc

SEQ ID NO: 8945 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
gtctcttaaaaaaaaaaaaa

SEQ ID NO: 8946 - DNA, 20 bp, Artificial Sequence
  Description of Artificial Sequence: Synthetic oligonucleotide
  Target: ATXN1; (-) strand; PAM type: NNAGAAW; PAM sequence: ACAGAAT
aagaatggtcactgtggttc

SEQ ID NO: 8947 - DNA, 20 bp, Artificial Sequence
  Description of Artificial Sequence: Synthetic oligonucleotide
  Target: ATXN1; (-) strand; PAM type: NNAGAAW; PAM sequence: GAAGAAT
agtgggtggtaggtggttgt

SEQ ID NO: 8948 - DNA, 20 bp, Artificial Sequence
  Description of Artificial Sequence: Synthetic oligonucleotide
  Target: ATXN1; (-) strand; PAM type: NNAGAAW; PAM sequence: AGAGAAA
attgtaagtctaagtttctc

SEQ ID NO: 8949 - DNA, 20 bp, Artificial Sequence
  Description of Artificial Sequence: Synthetic oligonucleotide
  Target: ATXN1; (-) strand; PAM type: NNAGAAW; PAM sequence: TCAGAAA
taatttataatgtatccttt

SEQ ID NO: 8950 - DNA, 20 bp, Artificial Sequence
  Description of Artificial Sequence: Synthetic oligonucleotide
  Target: ATXN1; (-) strand; PAM type: NNAGAAW; PAM sequence: GTAGAAA
gaaacagatttttcccaaaa

SEQ ID NO: 8951 - DNA, 20 bp, Artificial Sequence
  Description of Artificial Sequence: Synthetic oligonucleotide
  Target: ATXN1; (-) strand; PAM type: NNAGAAW; PAM sequence: CTAGAAT
cctaggctgggcccagggct

SEQ ID NO: 8952 - DNA, 20 bp, Artificial Sequence
  Description of Artificial Sequence: Synthetic oligonucleotide
  Target: ATXN1; (-) strand; PAM type: NNAGAAW; PAM sequence: AGAGAAA
atttatttgtatatatagag

SEQ ID NO: 8953 - DNA, 20 bp, Artificial Sequence
  Description of Artificial Sequence: Synthetic oligonucleotide
  Target: ATXN1; (-) strand; PAM type: NNAGAAW; PAM sequence: AGAGAAA
tgcctatatctgtaaactta

SEQ ID NO: 8954 - DNA, 20 bp, Artificial Sequence
  Description of Artificial Sequence: Synthetic oligonucleotide
  Target: ATXN1; (-) strand; PAM type: NNAGAAW; PAM sequence: GCAGAAA
agaaaactcaacattttccg

SEQ ID NO: 8955 - DNA, 20 bp, Artificial Sequence
  Description of Artificial Sequence: Synthetic oligonucleotide
  Target: ATXN1; (-) strand; PAM type: NNAGAAW; PAM sequence: GGAGAAA
tgctgacattgttagaaagg

SEQ ID NO: 8956 - DNA, 20 bp, Artificial Sequence
  Description of Artificial Sequence: Synthetic oligonucleotide
  Target: ATXN1; (-) strand; PAM type: NNAGAAW; PAM sequence: TTAGAAA
atgcattaatgctgacattg

SEQ ID NO: 8957 - DNA, 20 bp, Artificial Sequence
  Description of Artificial Sequence: Synthetic oligonucleotide
  Target: ATXN1; (-) strand; PAM type: NNAGAAW; PAM sequence: TCAGAAT
cttccagatagtatatttac

SEQ ID NO: 8958 - DNA, 20 bp, Artificial Sequence
  Description of Artificial Sequence: Synthetic oligonucleotide
  Target: ATXN1; (-) strand; PAM type: NNAGAAW; PAM sequence: AGAGAAT
tcataggttcctctctacac

SEQ ID NO: 8959 - DNA, 20 bp, Artificial Sequence
  Description of Artificial Sequence: Synthetic oligonucleotide
  Target: ATXN1; (-) strand; PAM type: NNAGAAW; PAM sequence: GGAGAAA
ttctcttggaaatgagaagg

SEQ ID NO: 8960 - DNA, 20 bp, Artificial Sequence
  Description of Artificial Sequence: Synthetic oligonucleotide
  Target: ATXN1; (-) strand; PAM type: NNAGAAW; PAM sequence: CGAGAAA
aatattagagaaagaagagt

SEQ ID NO: 8961 - DNA, 20 bp, Artificial Sequence
  Description of Artificial Sequence: Synthetic oligonucleotide
  Target: ATXN1; (-) strand; PAM type: NNAGAAW; PAM sequence: AGAGAAA
gtttatatagcaagaatatt

SEQ ID NO: 8962 - DNA, 20 bp, Artificial Sequence
  Description of Artificial Sequence: Synthetic oligonucleotide
  Target: ATXN1; (-) strand; PAM type: NNAGAAW; PAM sequence: CAAGAAT
gaactaccatgtttatatag

SEQ ID NO: 8963 - DNA, 20 bp, Artificial Sequence
  Description of Artificial Sequence: Synthetic oligonucleotide
  Target: ATXN1; (-) strand; PAM type: NNAGAAW; PAM sequence: TTAGAAT
tggcaaaaacttacttgtaa

SEQ ID NO: 8964 - DNA, 20 bp, Artificial Sequence
  Description of Artificial Sequence: Synthetic oligonucleotide
  Target: ATXN1; (-) strand; PAM type: NNAGAAW; PAM sequence: GAAGAAA
aaaaaggatttaagtggaaa

SEQ ID NO: 8965 - DNA, 20 bp, Artificial Sequence
  Description of Artificial Sequence: Synthetic oligonucleotide
  Target: ATXN1; (-) strand; PAM type: NNAGAAW; PAM sequence: TTAGAAA
gcataggaaaaaaaagatct

SEQ ID NO: 8966 - DNA, 20 bp, Artificial Sequence
  Description of Artificial Sequence: Synthetic oligonucleotide
  Target: ATXN1; (-) strand; PAM type: NNAGAAW; PAM sequence: GAAGAAA
gagtttaaaatactcagaag

SEQ ID NO: 8967 - DNA, 20 bp, Artificial Sequence
  Description of Artificial Sequence: Synthetic oligonucleotide
  Target: ATXN1; (-) strand; PAM type: NNAGAAW; PAM sequence: TTAGAAT
tgcgccattagaagggatga

SEQ ID NO: 8968 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
ttggtactatgagctgctct

SEQ ID NO: 8969 - DNA, 20 bp, Artificial Sequence
  Description of Artificial Sequence: Synthetic oligonucleotide
  Target: ATXN1; (-) strand; PAM type: NNAGAAW; PAM sequence: TGAGAAT
catctcccagctactgggag

SEQ ID NO: 8970 - DNA, 20 bp, Artificial Sequence
  Description of Artificial Sequence: Synthetic oligonucleotide
  Target: ATXN1; (-) strand; PAM type: NNAGAAW; PAM sequence: TAAGAAA
tagcaaaaggtttatttgtt

SEQ ID NO: 8971 - DNA, 20 bp, Artificial Sequence
  Description of Artificial Sequence: Synthetic oligonucleotide
  Target: ATXN1; (-) strand; PAM type: NNAGAAW; PAM sequence: GTAGAAT
attgaattggacggacaatc

SEQ ID NO: 8972 - DNA, 20 bp, Artificial Sequence
  Description of Artificial Sequence: Synthetic oligonucleotide
  Target: ATXN1; (-) strand; PAM type: NNAGAAW; PAM sequence: ATAGAAA
ggtaagctgtacactgaaca

SEQ ID NO: 8973 - DNA, 20 bp, Artificial Sequence
  Description of Artificial Sequence: Synthetic oligonucleotide
  Target: ATXN1; (-) strand; PAM type: NNAGAAW; PAM sequence: TCAGAAT
gggacacagttgattcttac

SEQ ID NO: 8974 - DNA, 20 bp, Artificial Sequence
  Description of Artificial Sequence: Synthetic oligonucleotide
  Target: ATXN1; (-) strand; PAM type: NNAGAAW; PAM sequence: AAAGAAT
agcaaaatctatttggtcaa

SEQ ID NO: 8975 - DNA, 20 bp, Artificial Sequence
  Description of Artificial Sequence: Synthetic oligonucleotide
  Target: ATXN1; (-) strand; PAM type: NNAGAAW; PAM sequence: TAAGAAT
gtgtttcatcctgagcggat

SEQ ID NO: 8976 - DNA, 20 bp, Artificial Sequence
  Description of Artificial Sequence: Synthetic oligonucleotide
  Target: ATXN1; (-) strand; PAM type: NNAGAAW; PAM sequence: TGAGAAT
aatgtcactgaaaaggagag

SEQ ID NO: 8977 - DNA, 20 bp, Artificial Sequence
  Description of Artificial Sequence: Synthetic oligonucleotide
  Target: ATXN1; (-) strand; PAM type: NNAGAAW; PAM sequence: GCAGAAA
gcacagcaagatatgcacca

SEQ ID NO: 8978 - DNA, 20 bp, Artificial Sequence
  Description of Artificial Sequence: Synthetic oligonucleotide
  Target: ATXN1; (-) strand; PAM type: NNAGAAW; PAM sequence: TTAGAAA
tcttaagatctgttttccac

SEQ ID NO: 8979 - DNA, 20 bp, Artificial Sequence
  Description of Artificial Sequence: Synthetic oligonucleotide
  Target: ATXN1; (-) strand; PAM type: NNAGAAW; PAM sequence: TAAGAAT
gtttgtctgttagtggtgta

SEQ ID NO: 8980 - DNA, 20 bp, Artificial Sequence
  Description of Artificial Sequence: Synthetic oligonucleotide
  Target: ATXN1; (-) strand; PAM type: NNAGAAW; PAM sequence: GAAGAAA
gtagttttttccaattctgt

SEQ ID NO: 8981 - DNA, 20 bp, Artificial Sequence
  Description of Artificial Sequence: Synthetic oligonucleotide
  Target: ATXN1; (-) strand; PAM type: NNAGAAW; PAM sequence: TGAGAAT
ttgtccttgcgatagtttgc

SEQ ID NO: 8982 - DNA, 20 bp, Artificial Sequence
  Description of Artificial Sequence: Synthetic oligonucleotide
  Target: ATXN1; (-) strand; PAM type: NNAGAAW; PAM sequence: AGAGAAA
acttttcatagaggttataa

SEQ ID NO: 8983 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
cacagtttcctaaactgagt

SEQ ID NO: 8984 - DNA, 20 bp, Artificial Sequence
  Description of Artificial Sequence: Synthetic oligonucleotide
  Target: ATXN1; (-) strand; PAM type: NNAGAAW; PAM sequence: GTAGAAA
gccattgctcttgcacccga

SEQ ID NO: 8985 - DNA, 20 bp, Artificial Sequence
  Description of Artificial Sequence: Synthetic oligonucleotide
  Target: ATXN1; (-) strand; PAM type: NNAGAAW; PAM sequence: GCAGAAA
caaaggaaaagtaaaaaagt

SEQ ID NO: 8986 - DNA, 20 bp, Artificial Sequence
  Description of Artificial Sequence: Synthetic oligonucleotide
  Target: ATXN1; (-) strand; PAM type: NNAGAAW; PAM sequence: GTAGAAT
ggaattgtttcaccccgggt

SEQ ID NO: 8987 - DNA, 20 bp, Artificial Sequence
  Description of Artificial Sequence: Synthetic oligonucleotide
  Target: ATXN1; (-) strand; PAM type: NNAGAAW; PAM sequence: AAAGAAT
cgtgacttactggatcaggg

SEQ ID NO: 8988 - DNA, 20 bp, Artificial Sequence
  Description of Artificial Sequence: Synthetic oligonucleotide
  Target: ATXN1; (-) strand; PAM type: NNAGAAW; PAM sequence: AGAGAAT
tcactgtgattggggaacca

SEQ ID NO: 8989 - DNA, 20 bp, Artificial Sequence
  Description of Artificial Sequence: Synthetic oligonucleotide
  Target: ATXN1; (-) strand; PAM type: NNAGAAW; PAM sequence: AAAGAAT
caatggaagtgacagaatgg

SEQ ID NO: 8990 - DNA, 20 bp, Artificial Sequence
  Description of Artificial Sequence: Synthetic oligonucleotide
  Target: ATXN1; (-) strand; PAM type: NNAGAAW; PAM sequence: ACAGAAT
ttggagtggcaatggaagtg

SEQ ID NO: 8991 - DNA, 20 bp, Artificial Sequence
  Description of Artificial Sequence: Synthetic oligonucleotide
  Target: ATXN1; (-) strand; PAM type: NNAGAAW; PAM sequence: GTAGAAA
agaccagagaggaagcagtt

SEQ ID NO: 8992 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
ttgttcagacaagcttgggc

SEQ ID NO: 8993 - DNA, 20 bp, Artificial Sequence
  Description of Artificial Sequence: Synthetic oligonucleotide
  Target: ATXN1; (-) strand; PAM type: NNAGAAW; PAM sequence: TCAGAAT
cgtccttcagtccaagcttt

SEQ ID NO: 8994 - DNA, 20 bp, Artificial Sequence
  Description of Artificial Sequence: Synthetic oligonucleotide
  Target: ATXN1; (-) strand; PAM type: NNAGAAW; PAM sequence: AGAGAAA
tggaagaaggaggatccatc

SEQ ID NO: 8995 - DNA, 20 bp, Artificial Sequence
  Description of Artificial Sequence: Synthetic oligonucleotide
  Target: ATXN1; (-) strand; PAM type: NNAGAAW; PAM sequence: AGAGAAA
gaggtgataaagtgaagaga

SEQ ID NO: 8996 - DNA, 20 bp, Artificial Sequence
  Description of Artificial Sequence: Synthetic oligonucleotide
  Target: ATXN1; (-) strand; PAM type: NNAGAAW; PAM sequence: ACAGAAA
gccaatgagacatttaggtg

SEQ ID NO: 8997 - DNA, 20 bp, Artificial Sequence
  Description of Artificial Sequence: Synthetic oligonucleotide
  Target: ATXN1; (-) strand; PAM type: NNAGAAW; PAM sequence: TTAGAAA
ttttcttggtggcagggtgg

SEQ ID NO: 8998 - DNA, 20 bp, Artificial Sequence
  Description of Artificial Sequence: Synthetic oligonucleotide
  Target: ATXN1; (-) strand; PAM type: NNAGAAW; PAM sequence: ATAGAAA
cacatggtatatgtcctagt

SEQ ID NO: 8999 - DNA, 20 bp, Artificial Sequence
  Description of Artificial Sequence: Synthetic oligonucleotide
  Target: ATXN1; (-) strand; PAM type: NNAGAAW; PAM sequence: TGAGAAA
ggtgttgtatttgaggagtt

SEQ ID NO: 9000 - DNA, 20 bp, Artificial Sequence
  Description of Artificial Sequence: Synthetic oligonucleotide
  Target: ATXN1; (-) strand; PAM type: NNAGAAW; PAM sequence: ATAGAAT
ttctctgggcagagtagaag

SEQ ID NO: 9001 - DNA, 20 bp, Artificial Sequence
  Description of Artificial Sequence: Synthetic oligonucleotide
  Target: ATXN1; (-) strand; PAM type: NNAGAAW; PAM sequence: TTAGAAA
accggaaatgacttctactt

SEQ ID NO: 9002 - DNA, 20 bp, Artificial Sequence
  Description of Artificial Sequence: Synthetic oligonucleotide
  Target: ATXN1; (-) strand; PAM type: NNAGAAW; PAM sequence: CAAGAAT
cttaaccaccttctttcctg

SEQ ID NO: 9003 - DNA, 20 bp, Artificial Sequence
  Description of Artificial Sequence: Synthetic oligonucleotide
  Target: ATXN1; (-) strand; PAM type: NNAGAAW; PAM sequence: CTAGAAA
actctggcaattctccttgt

SEQ ID NO: 9004 - DNA, 20 bp, Artificial Sequence
  Description of Artificial Sequence: Synthetic oligonucleotide
  Target: ATXN1; (-) strand; PAM type: NNAGAAW; PAM sequence: AAAGAAT
ttaattttattaagctcttc

SEQ ID NO: 9005 - DNA, 20 bp, Artificial Sequence
  Description of Artificial Sequence: Synthetic oligonucleotide
  Target: ATXN1; (-) strand; PAM type: NNAGAAW; PAM sequence: AAAGAAT
ctgttttttactattttctg

SEQ ID NO: 9006 - DNA, 20 bp, Artificial Sequence
  Description of Artificial Sequence: Synthetic oligonucleotide
  Target: ATXN1; (-) strand; PAM type: NNAGAAW; PAM sequence: TAAGAAT
tccttctattctcttttttc

SEQ ID NO: 9007 - DNA, 20 bp, Artificial Sequence
  Description of Artificial Sequence: Synthetic oligonucleotide
  Target: ATXN1; (-) strand; PAM type: NNAGAAW; PAM sequence: AGAGAAA
agattgcactgaatcataag

SEQ ID NO: 9008 - DNA, 20 bp, Artificial Sequence
  Description of Artificial Sequence: Synthetic oligonucleotide
  Target: ATXN1; (-) strand; PAM type: NNAGAAW; PAM sequence: GCAGAAA
cagtactttgggaggccgag

SEQ ID NO: 9009 - DNA, 20 bp, Artificial Sequence
  Description of Artificial Sequence: Synthetic oligonucleotide
  Target: ATXN1; (-) strand; PAM type: NNAGAAW; PAM sequence: TCAGAAA
gtctggatttaagtcattta

SEQ ID NO: 9010 - DNA, 20 bp, Artificial Sequence
  Description of Artificial Sequence: Synthetic oligonucleotide
  Target: ATXN1; (-) strand; PAM type: NNAGAAW; PAM sequence: ACAGAAT
ctgcacttccagcctgggca

SEQ ID NO: 9011 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
tagtttattattaatagtga

SEQ ID NO: 9012 - DNA, 20 bp, Artificial Sequence
  Description of Artificial Sequence: Synthetic oligonucleotide
  Target: ATXN1; (-) strand; PAM type: NNAGAAW; PAM sequence: GTAGAAA
tatccccacagaccctccag

SEQ ID NO: 9013 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
aggtggctgattaaggggca

SEQ ID NO: 9014 - DNA, 20 bp, Artificial Sequence
  Description of Artificial Sequence: Synthetic oligonucleotide
  Target: ATXN1; (-) strand; PAM type: NNAGAAW; PAM sequence: CTAGAAA
ccacaggcaggacgttagcc

SEQ ID NO: 9015 - DNA, 20 bp, Artificial Sequence
  Description of Artificial Sequence: Synthetic oligonucleotide
  Target: ATXN1; (-) strand; PAM type: NNAGAAW; PAM sequence: GGAGAAA
tagtaattcagctggaaaaa

SEQ ID NO: 9016 - DNA, 20 bp, Artificial Sequence
  Description of Artificial Sequence: Synthetic oligonucleotide
  Target: ATXN1; (-) strand; PAM type: NNAGAAW; PAM sequence: ACAGAAA
tctagattcagatagtttgg

SEQ ID NO: 9017 - DNA, 20 bp, Artificial Sequence
  Description of Artificial Sequence: Synthetic oligonucleotide
  Target: ATXN1; (-) strand; PAM type: NNAGAAW; PAM sequence: TCAGAAA
gctaattttataggaatgtc

SEQ ID NO: 9018 - DNA, 20 bp, Artificial Sequence
  Description of Artificial Sequence: Synthetic oligonucleotide
  Target: ATXN1; (-) strand; PAM type: NNAGAAW; PAM sequence: GTAGAAA
tctctcttcatgttcagtca

SEQ ID NO: 9019 - DNA, 20 bp, Artificial Sequence
  Description of Artificial Sequence: Synthetic oligonucleotide
  Target: ATXN1; (-) strand; PAM type: NNAGAAW; PAM sequence: TGAGAAT
aatagttctagggtggagcc

SEQ ID NO: 9020 - DNA, 20 bp, Artificial Sequence
  Description of Artificial Sequence: Synthetic oligonucleotide
  Target: ATXN1; (-) strand; PAM type: NNAGAAW; PAM sequence: TTAGAAA
aaatatttatatattgatgc

SEQ ID NO: 9021 - DNA, 20 bp, Artificial Sequence
  Description of Artificial Sequence: Synthetic oligonucleotide
  Target: ATXN1; (-) strand; PAM type: NNAGAAW; PAM sequence: CAAGAAA
agctttcaaaggaatgtata

SEQ ID NO: 9022 - DNA, 20 bp, Artificial Sequence
  Description of Artificial Sequence: Synthetic oligonucleotide
  Target: ATXN1; (-) strand; PAM type: NNAGAAW; PAM sequence: TTAGAAT
ccctttgaaacacagaaaaa

SEQ ID NO: 9023 - DNA, 20 bp, Artificial Sequence
  Description of Artificial Sequence: Synthetic oligonucleotide
  Target: ATXN1; (-) strand; PAM type: NNAGAAW; PAM sequence: ACAGAAA
aatagccccccctttgaaac

SEQ ID NO: 9024 - DNA, 20 bp, Artificial Sequence
  Description of Artificial Sequence: Synthetic oligonucleotide
  Target: ATXN1; (-) strand; PAM type: NNAGAAW; PAM sequence: TAAGAAT
actcctggaattgatctgga

SEQ ID NO: 9025 - DNA, 20 bp, Artificial Sequence
  Description of Artificial Sequence: Synthetic oligonucleotide
  Target: ATXN1; (-) strand; PAM type: NNAGAAW; PAM sequence: ATAGAAT
agtttctgtgacttgatggc

SEQ ID NO: 9026 - DNA, 20 bp, Artificial Sequence
  Description of Artificial Sequence: Synthetic oligonucleotide
  Target: ATXN1; (-) strand; PAM type: NNAGAAW; PAM sequence: TGAGAAA
gtccactttaggtaatgaag

SEQ ID NO: 9027 - DNA, 20 bp, Artificial Sequence
  Description of Artificial Sequence: Synthetic oligonucleotide
  Target: ATXN1; (-) strand; PAM type: NNAGAAW; PAM sequence: TGAGAAA
cgaccttcctgttatccaag

SEQ ID NO: 9028 - DNA, 20 bp, Artificial Sequence
  Description of Artificial Sequence: Synthetic oligonucleotide
  Target: ATXN1; (-) strand; PAM type: NNAGAAW; PAM sequence: GAAGAAA
agtctgcaacatttttgatt

SEQ ID NO: 9029 - DNA, 20 bp, Artificial Sequence
  Description of Artificial Sequence: Synthetic oligonucleotide
  Target: ATXN1; (-) strand; PAM type: NNAGAAW; PAM sequence: CCAGAAT
ctgatattgtaagtcattag

SEQ ID NO: 9030 - DNA, 20 bp, Artificial Sequence
  Description of Artificial Sequence: Synthetic oligonucleotide
  Target: ATXN1; (-) strand; PAM type: NNAGAAW; PAM sequence: ACAGAAA
tttggtcatcagaatcacta

SEQ ID NO: 9031 - DNA, 20 bp, Artificial Sequence
  Description of Artificial Sequence: Synthetic oligonucleotide
  Target: ATXN1; (-) strand; PAM type: NNAGAAW; PAM sequence: TCAGAAT
atggtctgtagatttggtca

SEQ ID NO: 9032 - DNA, 20 bp, Artificial Sequence
  Description of Artificial Sequence: Synthetic oligonucleotide
  Target: ATXN1; (-) strand; PAM type: NNAGAAW; PAM sequence: GCAGAAA
tcttcaggtagagaattgca

SEQ ID NO: 9033 - DNA, 20 bp, Artificial Sequence
  Description of Artificial Sequence: Synthetic oligonucleotide
  Target: ATXN1; (-) strand; PAM type: NNAGAAW; PAM sequence: AGAGAAT
ggagattgagttcttcaggt

SEQ ID NO: 9034 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
ttaaccattacaacatactg

SEQ ID NO: 9035 - DNA, 20 bp, Artificial Sequence
  Description of Artificial Sequence: Synthetic oligonucleotide
  Target: ATXN1; (-) strand; PAM type: NNAGAAW; PAM sequence: AGAGAAT
agtctatacctttgcacgtc

SEQ ID NO: 9036 - DNA, 20 bp, Artificial Sequence
  Description of Artificial Sequence: Synthetic oligonucleotide
  Target: ATXN1; (-) strand; PAM type: NNAGAAW; PAM sequence: TCAGAAA
tatctactatctgatcctca

SEQ ID NO: 9037 - DNA, 20 bp, Artificial Sequence
  Description of Artificial Sequence: Synthetic oligonucleotide
  Target: ATXN1; (-) strand; PAM type: NNAGAAW; PAM sequence: CAAGAAA
tggtgaaagagaccatagtc

SEQ ID NO: 9038 - DNA, 20 bp, Artificial Sequence
  Description of Artificial Sequence: Synthetic oligonucleotide
  Target: ATXN1; (-) strand; PAM type: NNAGAAW; PAM sequence: GCAGAAT
gcagtttttgcactacactg

SEQ ID NO: 9039 - DNA, 20 bp, Artificial Sequence
  Description of Artificial Sequence: Synthetic oligonucleotide
  Target: ATXN1; (-) strand; PAM type: NNAGAAW; PAM sequence: TGAGAAA
gctactttattgatgtgcct

SEQ ID NO: 9040 - DNA, 20 bp, Artificial Sequence
  Description of Artificial Sequence: Synthetic oligonucleotide
  Target: ATXN1; (-) strand; PAM type: NNAGAAW; PAM sequence: CCAGAAT
agacccacgagatcgttatg

SEQ ID NO: 9041 - DNA, 20 bp, Artificial Sequence
  Description of Artificial Sequence: Synthetic oligonucleotide
  Target: ATXN1; (-) strand; PAM type: NNAGAAW; PAM sequence: ACAGAAA
atacatgtatagggaagcaa

SEQ ID NO: 9042 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
cactatgatttagatttttt

SEQ ID NO: 9043 - DNA, 20 bp, Artificial Sequence
  Description of Artificial Sequence: Synthetic oligonucleotide
  Target: ATXN1; (-) strand; PAM type: NNAGAAW; PAM sequence: GGAGAAA
ttagaagttctggaacagaa

SEQ ID NO: 9044 - DNA, 20 bp, Artificial Sequence
  Description of Artificial Sequence: Synthetic oligonucleotide
  Target: ATXN1; (-) strand; PAM type: NNAGAAW; PAM sequence: GTAGAAA
cacttcccaaattatggtgg

SEQ ID NO: 9045 - DNA, 20 bp, Artificial Sequence
  Description of Artificial Sequence: Synthetic oligonucleotide
  Target: ATXN1; (-) strand; PAM type: NNAGAAW; PAM sequence: AGAGAAA
ccccaggaagtctagtagtc

SEQ ID NO: 9046 - DNA, 20 bp, Artificial Sequence
  Description of Artificial Sequence: Synthetic oligonucleotide
  Target: ATXN1; (-) strand; PAM type: NNAGAAW; PAM sequence: GTAGAAA
ttccctggagaatttttgat

SEQ ID NO: 9047 - DNA, 20 bp, Artificial Sequence
  Description of Artificial Sequence: Synthetic oligonucleotide
  Target: ATXN1; (-) strand; PAM type: NNAGAAW; PAM sequence: GGAGAAT
atgtatgtttatccttccct

SEQ ID NO: 9048 - DNA, 20 bp, Artificial Sequence
  Description of Artificial Sequence: Synthetic oligonucleotide
  Target: ATXN1; (-) strand; PAM type: NNAGAAW; PAM sequence: CCAGAAA
agggctgctctaataaatta

SEQ ID NO: 9049 - DNA, 20 bp, Artificial Sequence
  Description of Artificial Sequence: Synthetic oligonucleotide
  Target: ATXN1; (-) strand; PAM type: NNAGAAW; PAM sequence: AGAGAAT
aggatgagcactgtaaagga

SEQ ID NO: 9050 - DNA, 20 bp, Artificial Sequence
  Description of Artificial Sequence: Synthetic oligonucleotide
  Target: ATXN1; (-) strand; PAM type: NNAGAAW; PAM sequence: TGAGAAT
gggagtggtgaagggtgaga

SEQ ID NO: 9051 - DNA, 20 bp, Artificial Sequence
  Description of Artificial Sequence: Synthetic oligonucleotide
  Target: ATXN1; (-) strand; PAM type: NNAGAAW; PAM sequence: GGAGAAA
aaatagagtaggatatgtta

SEQ ID NO: 9052 - DNA, 20 bp, Artificial Sequence
  Description of Artificial Sequence: Synthetic oligonucleotide
  Target: ATXN1; (-) strand; PAM type: NNAGAAW; PAM sequence: ACAGAAA
ttttataattgagtgaaagc

SEQ ID NO: 9053 - DNA, 20 bp, Artificial Sequence
  Description of Artificial Sequence: Synthetic oligonucleotide
  Target: ATXN1; (-) strand; PAM type: NNAGAAW; PAM sequence: AGAGAAT
gcattcttgacttgcaatgc

SEQ ID NO: 9054 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
atctggcctgaacagcatct

SEQ ID NO: 9055 - DNA, 20 bp, Artificial Sequence
  Description of Artificial Sequence: Synthetic oligonucleotide
  Target: ATXN1; (-) strand; PAM type: NNAGAAW; PAM sequence: TTAGAAA
gctcctgatttttatctgta

SEQ ID NO: 9056 - DNA, 20 bp, Artificial Sequence
  Description of Artificial Sequence: Synthetic oligonucleotide
  Target: ATXN1; (-) strand; PAM type: NNAGAAW; PAM sequence: ACAGAAA
caaaatgttaaggctgagtt

SEQ ID NO: 9057 - DNA, 20 bp, Artificial Sequence
  Description of Artificial Sequence: Synthetic oligonucleotide
  Target: ATXN1; (-) strand; PAM type: NNAGAAW; PAM sequence: TTAGAAT
ggttcataggaaccatttat

SEQ ID NO: 9058 - DNA, 20 bp, Artificial Sequence
  Description of Artificial Sequence: Synthetic oligonucleotide
  Target: ATXN1; (-) strand; PAM type: NNAGAAW; PAM sequence: CAAGAAT
tagctttcaatcagatcctc

SEQ ID NO: 9059 - DNA, 20 bp, Artificial Sequence
  Description of Artificial Sequence: Synthetic oligonucleotide
  Target: ATXN1; (-) strand; PAM type: NNAGAAW; PAM sequence: GCAGAAA
aaatgcattttgagttgaaa

SEQ ID NO: 9060 - DNA, 20 bp, Artificial Sequence
  Description of Artificial Sequence: Synthetic oligonucleotide
  Target: ATXN1; (-) strand; PAM type: NNAGAAW; PAM sequence: CCAGAAA
tgcgctcatatacatgtagc

SEQ ID NO: 9061 - DNA, 20 bp, Artificial Sequence
  Description of Artificial Sequence: Synthetic oligonucleotide
  Target: ATXN1; (-) strand; PAM type: NNAGAAW; PAM sequence: GCAGAAA
aacagatcttttgaagcaga

SEQ ID NO: 9062 - DNA, 20 bp, Artificial Sequence
  Description of Artificial Sequence: Synthetic oligonucleotide
  Target: ATXN1; (-) strand; PAM type: NNAGAAW; PAM sequence: GTAGAAA
aacaccttgtaccttctttg

SEQ ID NO: 9063 - DNA, 20 bp, Artificial Sequence
  Description of Artificial Sequence: Synthetic oligonucleotide
  Target: ATXN1; (-) strand; PAM type: NNAGAAW; PAM sequence: GTAGAAT
gcagtgacttttaatcctta

SEQ ID NO: 9064 - DNA, 20 bp, Artificial Sequence
  Description of Artificial Sequence: Synthetic oligonucleotide
  Target: ATXN1; (-) strand; PAM type: NNAGAAW; PAM sequence: CCAGAAA
gttgaatgcagggaatttgt

SEQ ID NO: 9065 - DNA, 20 bp, Artificial Sequence
  Description of Artificial Sequence: Synthetic oligonucleotide
  Target: ATXN1; (-) strand; PAM type: NNAGAAW; PAM sequence: TCAGAAA
ttttttaatggcttttgggt

SEQ ID NO: 9066 - DNA, 20 bp, Artificial Sequence
  Description of Artificial Sequence: Synthetic oligonucleotide
  Target: ATXN1; (-) strand; PAM type: NNAGAAW; PAM sequence: CCAGAAA
aatttaaaattgcatgatag

SEQ ID NO: 9067 - DNA, 20 bp, Artificial Sequence
  Description of Artificial Sequence: Synthetic oligonucleotide
  Target: ATXN1; (-) strand; PAM type: NNAGAAW; PAM sequence: TAAGAAT
agtctcttttatgatttgtg

SEQ ID NO: 9068 - DNA, 20 bp, Artificial Sequence
  Description of Artificial Sequence: Synthetic oligonucleotide
  Target: ATXN1; (-) strand; PAM type: NNAGAAW; PAM sequence: TGAGAAA
agatttaaatgttattaaca

SEQ ID NO: 9069 - DNA, 20 bp, Artificial Sequence
  Description of Artificial Sequence: Synthetic oligonucleotide
  Target: ATXN1; (-) strand; PAM type: NNAGAAW; PAM sequence: GAAGAAA
tccatgaccatacatgctta

SEQ ID NO: 9070 - DNA, 20 bp, Artificial Sequence
  Description of Artificial Sequence: Synthetic oligonucleotide
  Target: ATXN1; (-) strand; PAM type: NNAGAAW; PAM sequence: GTAGAAA
cgggtctgaatggttgtccc

SEQ ID NO: 9071 - DNA, 20 bp, Artificial Sequence
  Description of Artificial Sequence: Synthetic oligonucleotide
  Target: ATXN1; (-) strand; PAM type: NNAGAAW; PAM sequence: ACAGAAA
ttctcgaaacctaaataaac

SEQ ID NO: 9072 - DNA, 20 bp, Artificial Sequence
  Description of Artificial Sequence: Synthetic oligonucleotide
  Target: ATXN1; (-) strand; PAM type: NNAGAAW; PAM sequence: AGAGAAA
cttactgatgagaggaagga

SEQ ID NO: 9073 - DNA, 20 bp, Artificial Sequence
  Description of Artificial Sequence: Synthetic oligonucleotide
  Target: ATXN1; (-) strand; PAM type: NNAGAAW; PAM sequence: TGAGAAT
ggcataaatattgttgaatg

SEQ ID NO: 9074 - DNA, 20 bp, Artificial Sequence
  Description of Artificial Sequence: Synthetic oligonucleotide
  Target: ATXN1; (-) strand; PAM type: NNAGAAW; PAM sequence: AGAGAAA
gggctaggggcaaagcgggc

SEQ ID NO: 9075 - DNA, 20 bp, Artificial Sequence
  Description of Artificial Sequence: Synthetic oligonucleotide
  Target: ATXN1; (-) strand; PAM type: NNAGAAW; PAM sequence: CAAGAAA
tgtgagctaccgggcccggc

SEQ ID NO: 9076 - DNA, 20 bp, Artificial Sequence
  Description of Artificial Sequence: Synthetic oligonucleotide
  Target: ATXN1; (-) strand; PAM type: NNAGAAW; PAM sequence: TAAGAAA
catctgaagtaggaccctgt

SEQ ID NO: 9077 - DNA, 20 bp, Artificial Sequence
  Description of Artificial Sequence: Synthetic oligonucleotide
  Target: ATXN1; (-) strand; PAM type: NNAGAAW; PAM sequence: CCAGAAA
tttgtcatactggcccagat

SEQ ID NO: 9078 - DNA, 20 bp, Artificial Sequence
  Description of Artificial Sequence: Synthetic oligonucleotide
  Target: ATXN1; (-) strand; PAM type: NNAGAAW; PAM sequence: AGAGAAA
taatttactagaggagagaa

SEQ ID NO: 9079 - DNA, 20 bp, Artificial Sequence
  Description of Artificial Sequence: Synthetic oligonucleotide
  Target: ATXN1; (-) strand; PAM type: NNAGAAW; PAM sequence: AGAGAAA
ttaacataatttactagagg

SEQ ID NO: 9080 - DNA, 20 bp, Artificial Sequence
  Description of Artificial Sequence: Synthetic oligonucleotide
  Target: ATXN1; (-) strand; PAM type: NNAGAAW; PAM sequence: GAAGAAA
tatattagtaatatgtctaa

SEQ ID NO: 9081 - DNA, 20 bp, Artificial Sequence
  Description of Artificial Sequence: Synthetic oligonucleotide
  Target: ATXN1; (-) strand; PAM type: NNAGAAW; PAM sequence: ACAGAAA
cgaattttcactttcagtag

SEQ ID NO: 9082 - DNA, 20 bp, Artificial Sequence
  Description of Artificial Sequence: Synthetic oligonucleotide
  Target: ATXN1; (-) strand; PAM type: NNAGAAW; PAM sequence: GCAGAAA
ttcagctccagggtagtgtg

SEQ ID NO: 9083 - DNA, 20 bp, Artificial Sequence
  Description of Artificial Sequence: Synthetic oligonucleotide
  Target: ATXN1; (-) strand; PAM type: NNAGAAW; PAM sequence: GTAGAAA
tgagagggagaccttgagtt

SEQ ID NO: 9084 - DNA, 20 bp, Artificial Sequence
  Description of Artificial Sequence: Synthetic oligonucleotide
  Target: ATXN1; (-) strand; PAM type: NNAGAAW; PAM sequence: TAAGAAA
attatagtcaatgtaaggac

SEQ ID NO: 9085 - DNA, 20 bp, Artificial Sequence
  Description of Artificial Sequence: Synthetic oligonucleotide
  Target: ATXN1; (-) strand; PAM type: NNAGAAW; PAM sequence: CCAGAAT
ctcatctgtggttgggtata

SEQ ID NO: 9086 - DNA, 20 bp, Artificial Sequence
  Description of Artificial Sequence: Synthetic oligonucleotide
  Target: ATXN1; (-) strand; PAM type: NNAGAAW; PAM sequence: GGAGAAT
gtaactaggaataaatagaa

SEQ ID NO: 9087 - DNA, 20 bp, Artificial Sequence
  Description of Artificial Sequence: Synthetic oligonucleotide
  Target: ATXN1; (-) strand; PAM type: NNAGAAW; PAM sequence: AGAGAAA
cttgggagaataagggtgag

SEQ ID NO: 9088 - DNA, 20 bp, Artificial Sequence
  Description of Artificial Sequence: Synthetic oligonucleotide
  Target: ATXN1; (-) strand; PAM type: NNAGAAW; PAM sequence: GGAGAAT
acatataaatatacaccttg

SEQ ID NO: 9089 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
tttagatgagaaaacatttc

SEQ ID NO: 9090 - DNA, 20 bp, Artificial Sequence
  Description of Artificial Sequence: Synthetic oligonucleotide
  Target: ATXN1; (-) strand; PAM type: NNAGAAW; PAM sequence: TGAGAAA
cagcagctcccaagtttaga

SEQ ID NO: 9091 - DNA, 20 bp, Artificial Sequence
  Description of Artificial Sequence: Synthetic oligonucleotide
  Target: ATXN1; (-) strand; PAM type: NNAGAAW; PAM sequence: AAAGAAT
caatgcctaaaattcgaacg

SEQ ID NO: 9092 - DNA, 20 bp, Artificial Sequence
  Description of Artificial Sequence: Synthetic oligonucleotide
  Target: ATXN1; (-) strand; PAM type: NNAGAAW; PAM sequence: CCAGAAT
tcaggaatcaggtgggaggg

SEQ ID NO: 9093 - DNA, 20 bp, Artificial Sequence
  Description of Artificial Sequence: Synthetic oligonucleotide
  Target: ATXN1; (-) strand; PAM type: NNAGAAW; PAM sequence: GAAGAAA
tcattcatttggggaaaaag

SEQ ID NO: 9094 - DNA, 20 bp, Artificial Sequence
  Description of Artificial Sequence: Synthetic oligonucleotide
  Target: ATXN1; (-) strand; PAM type: NNAGAAW; PAM sequence: CCAGAAA
tactgttttaccctttaact

SEQ ID NO: 9095 - DNA, 20 bp, Artificial Sequence
  Description of Artificial Sequence: Synthetic oligonucleotide
  Target: ATXN1; (-) strand; PAM type: NNAGAAW; PAM sequence: TAAGAAA
ctttctgtattttgtagaat

SEQ ID NO: 9096 - DNA, 20 bp, Artificial Sequence
  Description of Artificial Sequence: Synthetic oligonucleotide
  Target: ATXN1; (-) strand; PAM type: NNAGAAW; PAM sequence: GTAGAAT
taatattctttctgtatttt

SEQ ID NO: 9097 - DNA, 20 bp, Artificial Sequence
  Description of Artificial Sequence: Synthetic oligonucleotide
  Target: ATXN1; (-) strand; PAM type: NNAGAAW; PAM sequence: CAAGAAT
tgttaggaaagaacagtggg

SEQ ID NO: 9098 - DNA, 20 bp, Artificial Sequence
  Description of Artificial Sequence: Synthetic oligonucleotide
  Target: ATXN1; (-) strand; PAM type: NNAGAAW; PAM sequence: CCAGAAT
cctgaatgcatcttgcactc

SEQ ID NO: 9099 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
aaaaaaaaaaaaaaaaaaga

SEQ ID NO: 9100 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
aaaaaaaaaaaaaaaaaaaa

SEQ ID NO: 9101 - DNA, 20 bp, Artificial Sequence
  Description of Artificial Sequence: Synthetic oligonucleotide
  Target: ATXN1; (-) strand; PAM type: NNAGAAW; PAM sequence: GCAGAAA
agtaatcttctagtgtggta

SEQ ID NO: 9102 - DNA, 20 bp, Artificial Sequence
  Description of Artificial Sequence: Synthetic oligonucleotide
  Target: ATXN1; (-) strand; PAM type: NNAGAAW; PAM sequence: GGAGAAA
aggaggggtgggggtaggtg

SEQ ID NO: 9103 - DNA, 20 bp, Artificial Sequence
  Description of Artificial Sequence: Synthetic oligonucleotide
  Target: ATXN1; (-) strand; PAM type: NNAGAAW; PAM sequence: AGAGAAT
gaaacagattctttgaccac

SEQ ID NO: 9104 - DNA, 20 bp, Artificial Sequence
  Description of Artificial Sequence: Synthetic oligonucleotide
  Target: ATXN1; (-) strand; PAM type: NNAGAAW; PAM sequence: TAAGAAA
ctataggaattggcaccagc

SEQ ID NO: 9105 - DNA, 20 bp, Artificial Sequence
  Description of Artificial Sequence: Synthetic oligonucleotide
  Target: ATXN1; (-) strand; PAM type: NNAGAAW; PAM sequence: CTAGAAA
atgctataaaaatatgacaa

SEQ ID NO: 9106 - DNA, 20 bp, Artificial Sequence
  Description of Artificial Sequence: Synthetic oligonucleotide
  Target: ATXN1; (-) strand; PAM type: NNAGAAW; PAM sequence: GGAGAAA
tctatctcatctttttgctt

SEQ ID NO: 9107 - DNA, 20 bp, Artificial Sequence
  Description of Artificial Sequence: Synthetic oligonucleotide
  Target: ATXN1; (-) strand; PAM type: NNAGAAW; PAM sequence: AGAGAAT
gtcccggcatggcaggaata

SEQ ID NO: 9108 - DNA, 20 bp, Artificial Sequence
  Description of Artificial Sequence: Synthetic oligonucleotide
  Target: ATXN1; (-) strand; PAM type: NNAGAAW; PAM sequence: TCAGAAT
tggtatggtgggtgtaaaac

SEQ ID NO: 9109 - DNA, 20 bp, Artificial Sequence
  Description of Artificial Sequence: Synthetic oligonucleotide
  Target: ATXN1; (-) strand; PAM type: NNAGAAW; PAM sequence: CAAGAAA
tggttttgaactcctgacca

SEQ ID NO: 9110 - DNA, 20 bp, Artificial Sequence
  Description of Artificial Sequence: Synthetic oligonucleotide
  Target: ATXN1; (-) strand; PAM type: NNAGAAW; PAM sequence: GGAGAAT
ctactcaggaggctgaggca

SEQ ID NO: 9111 - DNA, 20 bp, Artificial Sequence
  Description of Artificial Sequence: Synthetic oligonucleotide
  Target: ATXN1; (-) strand; PAM type: NNAGAAW; PAM sequence: ATAGAAA
ccacctcagaaggaaccact

SEQ ID NO: 9112 - DNA, 20 bp, Artificial Sequence
  Description of Artificial Sequence: Synthetic oligonucleotide
  Target: ATXN1; (-) strand; PAM type: NNAGAAW; PAM sequence: ATAGAAA
ataaaataaaatacagtaaa

SEQ ID NO: 9113 - DNA, 20 bp, Artificial Sequence
  Description of Artificial Sequence: Synthetic oligonucleotide
  Target: ATXN1; (-) strand; PAM type: NNAGAAW; PAM sequence: TCAGAAA
caaggagggagtgtacacac

SEQ ID NO: 9114 - DNA, 20 bp, Artificial Sequence
  Description of Artificial Sequence: Synthetic oligonucleotide
  Target: ATXN1; (-) strand; PAM type: NNAGAAW; PAM sequence: TCAGAAA
taataaatatttatttgcga

SEQ ID NO: 9115 - DNA, 20 bp, Artificial Sequence
  Description of Artificial Sequence: Synthetic oligonucleotide
  Target: ATXN1; (-) strand; PAM type: NNAGAAW; PAM sequence: ACAGAAT
gattttgtctgtaccccgag

SEQ ID NO: 9116 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
aagggagattaggaactgtt

SEQ ID NO: 9117 - DNA, 20 bp, Artificial Sequence
  Description of Artificial Sequence: Synthetic oligonucleotide
  Target: ATXN1; (-) strand; PAM type: NNAGAAW; PAM sequence: GCAGAAA
tttttgccttgttatgtgct

SEQ ID NO: 9118 - DNA, 20 bp, Artificial Sequence
  Description of Artificial Sequence: Synthetic oligonucleotide
  Target: ATXN1; (-) strand; PAM type: NNAGAAW; PAM sequence: GCAGAAA
gtttctgaaccaggcggttg

SEQ ID NO: 9119 - DNA, 20 bp, Artificial Sequence
  Description of Artificial Sequence: Synthetic oligonucleotide
  Target: ATXN1; (-) strand; PAM type: NNAGAAW; PAM sequence: TTAGAAA
tgggtttattgttttcttac

SEQ ID NO: 9120 - DNA, 20 bp, Artificial Sequence
  Description of Artificial Sequence: Synthetic oligonucleotide
  Target: ATXN1; (-) strand; PAM type: NNAGAAW; PAM sequence: AGAGAAA
aattttagggctattgatca

SEQ ID NO: 9121 - DNA, 20 bp, Artificial Sequence
  Description of Artificial Sequence: Synthetic oligonucleotide
  Target: ATXN1; (-) strand; PAM type: NNAGAAW; PAM sequence: ACAGAAT
agtacattaaggacttaaat

SEQ ID NO: 9122 - DNA, 20 bp, Artificial Sequence
  Description of Artificial Sequence: Synthetic oligonucleotide
  Target: ATXN1; (-) strand; PAM type: NNAGAAW; PAM sequence: GGAGAAA
tccatttctactctcctcaa

SEQ ID NO: 9123 - DNA, 20 bp, Artificial Sequence
  Description of Artificial Sequence: Synthetic oligonucleotide
  Target: ATXN1; (-) strand; PAM type: NNAGAAW; PAM sequence: TCAGAAT
gcggtttaaggaactgagct

SEQ ID NO: 9124 - DNA, 20 bp, Artificial Sequence
  Description of Artificial Sequence: Synthetic oligonucleotide
  Target: ATXN1; (-) strand; PAM type: NNAGAAW; PAM sequence: ATAGAAA
agtggctagtgttacaacaa

SEQ ID NO: 9125 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
atttttgctttctttcactt

SEQ ID NO: 9126 - DNA, 20 bp, Artificial Sequence
  Description of Artificial Sequence: Synthetic oligonucleotide
  Target: ATXN1; (-) strand; PAM type: NNAGAAW; PAM sequence: ACAGAAA
tcatttaactagaatatccc

SEQ ID NO: 9127 - DNA, 20 bp, Artificial Sequence
  Description of Artificial Sequence: Synthetic oligonucleotide
  Target: ATXN1; (-) strand; PAM type: NNAGAAW; PAM sequence: CTAGAAT
gttgaatagctttcatttaa

SEQ ID NO: 9128 - DNA, 20 bp, Artificial Sequence
  Description of Artificial Sequence: Synthetic oligonucleotide
  Target: ATXN1; (-) strand; PAM type: NNAGAAW; PAM sequence: GGAGAAT
atataaatctgctgtgtatt

SEQ ID NO: 9129 - DNA, 20 bp, Artificial Sequence
  Description of Artificial Sequence: Synthetic oligonucleotide
  Target: ATXN1; (-) strand; PAM type: NNAGAAW; PAM sequence: ACAGAAT
tatgggtgcttcaaggtggt

SEQ ID NO: 9130 - DNA, 20 bp, Artificial Sequence
  Description of Artificial Sequence: Synthetic oligonucleotide
  Target: ATXN1; (-) strand; PAM type: NNAGAAW; PAM sequence: GAAGAAT
atgtgtggattgttggattg

SEQ ID NO: 9131 - DNA, 20 bp, Artificial Sequence
  Description of Artificial Sequence: Synthetic oligonucleotide
  Target: ATXN1; (-) strand; PAM type: NNAGAAW; PAM sequence: CTAGAAA
ggagtctttacacaaataca

SEQ ID NO: 9132 - DNA, 20 bp, Artificial Sequence
  Description of Artificial Sequence: Synthetic oligonucleotide
  Target: ATXN1; (-) strand; PAM type: NNAGAAW; PAM sequence: TGAGAAT
ctcctcttggacgacatccc

SEQ ID NO: 9133 - DNA, 20 bp, Artificial Sequence
  Description of Artificial Sequence: Synthetic oligonucleotide
  Target: ATXN1; (-) strand; PAM type: NNAGAAW; PAM sequence: ACAGAAA
tctctctaacaggtcacaga

SEQ ID NO: 9134 - DNA, 20 bp, Artificial Sequence
  Description of Artificial Sequence: Synthetic oligonucleotide
  Target: ATXN1; (-) strand; PAM type: NNAGAAW; PAM sequence: TAAGAAT
ttgcttggtgatggagtagc

SEQ ID NO: 9135 - DNA, 20 bp, Artificial Sequence
  Description of Artificial Sequence: Synthetic oligonucleotide
  Target: ATXN1; (-) strand; PAM type: NNAGAAW; PAM sequence: TCAGAAT
attgttagttgcagaaatac

SEQ ID NO: 9136 - DNA, 20 bp, Artificial Sequence
  Description of Artificial Sequence: Synthetic oligonucleotide
  Target: ATXN1; (-) strand; PAM type: NNAGAAW; PAM sequence: GCAGAAA
tggtgaccatattgttagtt

SEQ ID NO: 9137 - DNA, 20 bp, Artificial Sequence
  Description of Artificial Sequence: Synthetic oligonucleotide
  Target: ATXN1; (-) strand; PAM type: NNAGAAW; PAM sequence: AGAGAAT
cctaaacttgatggataaac

SEQ ID NO: 9138 - DNA, 20 bp, Artificial Sequence
  Description of Artificial Sequence: Synthetic oligonucleotide
  Target: ATXN1; (-) strand; PAM type: NNAGAAW; PAM sequence: GAAGAAA
tgagatggagctggaatggt

SEQ ID NO: 9139 - DNA, 20 bp, Artificial Sequence
  Description of Artificial Sequence: Synthetic oligonucleotide
  Target: ATXN1; (-) strand; PAM type: NNAGAAW; PAM sequence: CCAGAAA
ccttgtacagccaagatacc

SEQ ID NO: 9140 - DNA, 20 bp, Artificial Sequence
  Description of Artificial Sequence: Synthetic oligonucleotide
  Target: ATXN1; (-) strand; PAM type: NNAGAAW; PAM sequence: TTAGAAA
gatttactagattccagtgg

SEQ ID NO: 9141 - DNA, 20 bp, Artificial Sequence
  Description of Artificial Sequence: Synthetic oligonucleotide
  Target: ATXN1; (-) strand; PAM type: NNAGAAW; PAM sequence: GGAGAAA
aagtaccctcattttctagg

SEQ ID NO: 9142 - DNA, 20 bp, Artificial Sequence
  Description of Artificial Sequence: Synthetic oligonucleotide
  Target: ATXN1; (-) strand; PAM type: NNAGAAW; PAM sequence: GTAGAAA
tagtcataatgactgcttga

SEQ ID NO: 9143 - DNA, 20 bp, Artificial Sequence
  Description of Artificial Sequence: Synthetic oligonucleotide
  Target: ATXN1; (-) strand; PAM type: NNAGAAW; PAM sequence: ACAGAAT
tcagctgataatagcacatc

SEQ ID NO: 9144 - DNA, 20 bp, Artificial Sequence
  Description of Artificial Sequence: Synthetic oligonucleotide
  Target: ATXN1; (-) strand; PAM type: NNAGAAW; PAM sequence: CAAGAAA
aactttttgccctgaagtct

SEQ ID NO: 9145 - DNA, 20 bp, Artificial Sequence
  Description of Artificial Sequence: Synthetic oligonucleotide
  Target: ATXN1; (-) strand; PAM type: NNAGAAW; PAM sequence: GAAGAAA
gtaataaacaacattaaaat

SEQ ID NO: 9146 - DNA, 20 bp, Artificial Sequence
  Description of Artificial Sequence: Synthetic oligonucleotide
  Target: ATXN1; (-) strand; PAM type: NNAGAAW; PAM sequence: GCAGAAT
ttcagtcatcctagtgatta

SEQ ID NO: 9147 - DNA, 20 bp, Artificial Sequence
  Description of Artificial Sequence: Synthetic oligonucleotide
  Target: ATXN1; (-) strand; PAM type: NNAGAAW; PAM sequence: GAAGAAA
agtttattattgtattgaca

SEQ ID NO: 9148 - DNA, 20 bp, Artificial Sequence
  Description of Artificial Sequence: Synthetic oligonucleotide
  Target: ATXN1; (-) strand; PAM type: NNAGAAW; PAM sequence: AAAGAAT
ccttcatctaaggaagtggg

SEQ ID NO: 9149 - DNA, 20 bp, Artificial Sequence
  Description of Artificial Sequence: Synthetic oligonucleotide
  Target: ATXN1; (-) strand; PAM type: NNAGAAW; PAM sequence: GCAGAAA
ctggcaggttccaaggggag

SEQ ID NO: 9150 - DNA, 20 bp, Artificial Sequence
  Description of Artificial Sequence: Synthetic oligonucleotide
  Target: ATXN1; (-) strand; PAM type: NNAGAAW; PAM sequence: TTAGAAA
tttcgattatatgaagattt

SEQ ID NO: 9151 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
tccaatgatgaattttctgg

SEQ ID NO: 9152 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
aagaagcctgtgctaaggag

SEQ ID NO: 9153 - DNA, 20 bp, Artificial Sequence
  Description of Artificial Sequence: Synthetic oligonucleotide
  Target: ATXN1; (-) strand; PAM type: NNAGAAW; PAM sequence: GGAGAAA
gtgtaagaagcctgtgctaa

SEQ ID NO: 9154 - DNA, 20 bp, Artificial Sequence
  Description of Artificial Sequence: Synthetic oligonucleotide
  Target: ATXN1; (-) strand; PAM type: NNAGAAW; PAM sequence: CTAGAAT
catggtcctcaggataaagt

SEQ ID NO: 9155 - DNA, 20 bp, Artificial Sequence
  Description of Artificial Sequence: Synthetic oligonucleotide
  Target: ATXN1; (-) strand; PAM type: NNAGAAW; PAM sequence: GTAGAAA
ccctgtcctgggagcagtgg

SEQ ID NO: 9156 - DNA, 20 bp, Artificial Sequence
  Description of Artificial Sequence: Synthetic oligonucleotide
  Target: ATXN1; (-) strand; PAM type: NNAGAAW; PAM sequence: TAAGAAT
ttacattgttactaatgata

SEQ ID NO: 9157 - DNA, 20 bp, Artificial Sequence
  Description of Artificial Sequence: Synthetic oligonucleotide
  Target: ATXN1; (-) strand; PAM type: NNAGAAW; PAM sequence: ACAGAAA
tccgcaggtagctctgctct

SEQ ID NO: 9158 - DNA, 20 bp, Artificial Sequence
  Description of Artificial Sequence: Synthetic oligonucleotide
  Target: ATXN1; (-) strand; PAM type: NNAGAAW; PAM sequence: ACAGAAT
atgataatatcacctaactc

SEQ ID NO: 9159 - DNA, 20 bp, Artificial Sequence
  Description of Artificial Sequence: Synthetic oligonucleotide
  Target: ATXN1; (-) strand; PAM type: NNAGAAW; PAM sequence: ATAGAAA
tctttaggcagctagtgcaa

SEQ ID NO: 9160 - DNA, 20 bp, Artificial Sequence
  Description of Artificial Sequence: Synthetic oligonucleotide
  Target: ATXN1; (-) strand; PAM type: NNAGAAW; PAM sequence: GTAGAAA
attctgcttttaatttgcaa

SEQ ID NO: 9161 - DNA, 20 bp, Artificial Sequence
  Description of Artificial Sequence: Synthetic oligonucleotide
  Target: ATXN1; (-) strand; PAM type: NNAGAAW; PAM sequence: AAAGAAT
gtggaatgcagtataactgg

SEQ ID NO: 9162 - DNA, 20 bp, Artificial Sequence
  Description of Artificial Sequence: Synthetic oligonucleotide
  Target: ATXN1; (-) strand; PAM type: NNAGAAW; PAM sequence: TTAGAAT
ttgttagattttgtatttaa

SEQ ID NO: 9163 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
tccaaaacacaaggaggttg

SEQ ID NO: 9164 - DNA, 20 bp, Artificial Sequence
  Description of Artificial Sequence: Synthetic oligonucleotide
  Target: ATXN1; (-) strand; PAM type: NNAGAAW; PAM sequence: ATAGAAT
taaaaaggaatttaatatgt

SEQ ID NO: 9165 - DNA, 20 bp, Artificial Sequence
  Description of Artificial Sequence: Synthetic oligonucleotide
  Target: ATXN1; (-) strand; PAM type: NNAGAAW; PAM sequence: TTAGAAA
ttaaaatgtgcccctgtgca

SEQ ID NO: 9166 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
gagcagcgtgcagttttcca

SEQ ID NO: 9167 - DNA, 20 bp, Artificial Sequence
  Description of Artificial Sequence: Synthetic oligonucleotide
  Target: ATXN1; (-) strand; PAM type: NNAGAAW; PAM sequence: CCAGAAA
cgtggagtttaatgtgtgct

SEQ ID NO: 9168 - DNA, 20 bp, Artificial Sequence
  Description of Artificial Sequence: Synthetic oligonucleotide
  Target: ATXN1; (-) strand; PAM type: NNAGAAW; PAM sequence: GAAGAAA
attcatgtcaagatgataga

SEQ ID NO: 9169 - DNA, 20 bp, Artificial Sequence
  Description of Artificial Sequence: Synthetic oligonucleotide
  Target: ATXN1; (-) strand; PAM type: NNAGAAW; PAM sequence: TAAGAAT
gtggcgctgaacgcaagctc

SEQ ID NO: 9170 - DNA, 20 bp, Artificial Sequence
  Description of Artificial Sequence: Synthetic oligonucleotide
  Target: ATXN1; (-) strand; PAM type: NNAGAAW; PAM sequence: GAAGAAA
actttcaataattattaatt

SEQ ID NO: 9171 - DNA, 20 bp, Artificial Sequence
  Description of Artificial Sequence: Synthetic oligonucleotide
  Target: ATXN1; (-) strand; PAM type: NNAGAAW; PAM sequence: ATAGAAT
ggtttcccagctgttaagtg

SEQ ID NO: 9172 - DNA, 20 bp, Artificial Sequence
  Description of Artificial Sequence: Synthetic oligonucleotide
  Target: ATXN1; (-) strand; PAM type: NNAGAAW; PAM sequence: TCAGAAT
tctgtgtagcccaaaagggc

SEQ ID NO: 9173 - DNA, 20 bp, Artificial Sequence
  Description of Artificial Sequence: Synthetic oligonucleotide
  Target: ATXN1; (-) strand; PAM type: NNAGAAW; PAM sequence: AGAGAAA
cagtctgatttaatgtaatg

SEQ ID NO: 9174 - DNA, 20 bp, Artificial Sequence
  Description of Artificial Sequence: Synthetic oligonucleotide
  Target: ATXN1; (-) strand; PAM type: NNAGAAW; PAM sequence: GGAGAAA
ttggtgaatcttgggtctgg

SEQ ID NO: 9175 - DNA, 20 bp, Artificial Sequence
  Description of Artificial Sequence: Synthetic oligonucleotide
  Target: ATXN1; (-) strand; PAM type: NNAGAAW; PAM sequence: ATAGAAT
tttatagaaaataaagagat

SEQ ID NO: 9176 - DNA, 20 bp, Artificial Sequence
  Description of Artificial Sequence: Synthetic oligonucleotide
  Target: ATXN1; (-) strand; PAM type: NNAGAAW; PAM sequence: ATAGAAA
tggcttcccatttatacttt

SEQ ID NO: 9177 - DNA, 20 bp, Artificial Sequence
  Description of Artificial Sequence: Synthetic oligonucleotide
  Target: ATXN1; (-) strand; PAM type: NNAGAAW; PAM sequence: GTAGAAT
cagggatgacgtcagctggt

SEQ ID NO: 9178 - DNA, 20 bp, Artificial Sequence
  Description of Artificial Sequence: Synthetic oligonucleotide
  Target: ATXN1; (-) strand; PAM type: NNAGAAW; PAM sequence: ATAGAAT
ctctgaaataatgaatacga

SEQ ID NO: 9179 - DNA, 20 bp, Artificial Sequence
  Description of Artificial Sequence: Synthetic oligonucleotide
  Target: ATXN1; (-) strand; PAM type: NNAGAAW; PAM sequence: GAAGAAA
tcctggtcaggcaggggaaa

SEQ ID NO: 9180 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
ttcacagtcactatttatgt

SEQ ID NO: 9181 - DNA, 20 bp, Artificial Sequence
  Description of Artificial Sequence: Synthetic oligonucleotide
  Target: ATXN1; (-) strand; PAM type: NNAGAAW; PAM sequence: GCAGAAA
cgattgacggctcaacgtag

SEQ ID NO: 9182 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
cattttctatgattgcattt

SEQ ID NO: 9183 - DNA, 20 bp, Artificial Sequence
  Description of Artificial Sequence: Synthetic oligonucleotide
  Target: ATXN1; (-) strand; PAM type: NNAGAAW; PAM sequence: CAAGAAT
ttgtgataacagaaatatct

SEQ ID NO: 9184 - DNA, 20 bp, Artificial Sequence
  Description of Artificial Sequence: Synthetic oligonucleotide
  Target: ATXN1; (-) strand; PAM type: NNAGAAW; PAM sequence: ACAGAAA
aaagggagtcatttgtgata

SEQ ID NO: 9185 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
aaaaaaaaagagaggaaaga

SEQ ID NO: 9186 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
aaaaaaaaaaaaaagagagg

SEQ ID NO: 9187 - DNA, 20 bp, Artificial Sequence
  Description of Artificial Sequence: Synthetic oligonucleotide
  Target: ATXN1; (-) strand; PAM type: NNAGAAW; PAM sequence: GGAGAAT
ctacttgggacactgaggca

SEQ ID NO: 9188 - DNA, 20 bp, Artificial Sequence
  Description of Artificial Sequence: Synthetic oligonucleotide
  Target: ATXN1; (-) strand; PAM type: NNAGAAW; PAM sequence: CTAGAAA
tgctcctgaaccatacatga

SEQ ID NO: 9189 - DNA, 20 bp, Artificial Sequence
  Description of Artificial Sequence: Synthetic oligonucleotide
  Target: ATXN1; (-) strand; PAM type: NNAGAAW; PAM sequence: GTAGAAT
aaatagtagatatactgtgg

SEQ ID NO: 9190 - DNA, 20 bp, Artificial Sequence
  Description of Artificial Sequence: Synthetic oligonucleotide
  Target: ATXN1; (-) strand; PAM type: NNAGAAW; PAM sequence: GAAGAAA
ataattgaccagatttcttt

SEQ ID NO: 9191 - DNA, 20 bp, Artificial Sequence
  Description of Artificial Sequence: Synthetic oligonucleotide
  Target: ATXN1; (-) strand; PAM type: NNAGAAW; PAM sequence: TCAGAAT
tccaccctagacttgatgaa

SEQ ID NO: 9192 - DNA, 20 bp, Artificial Sequence
  Description of Artificial Sequence: Synthetic oligonucleotide
  Target: ATXN1; (-) strand; PAM type: NNAGAAW; PAM sequence: ATAGAAT
cacctggagagcttaaaaaa

SEQ ID NO: 9193 - DNA, 20 bp, Artificial Sequence
  Description of Artificial Sequence: Synthetic oligonucleotide
  Target: ATXN1; (-) strand; PAM type: NNAGAAW; PAM sequence: ACAGAAT
ttcccaagcctggctaggca

SEQ ID NO: 9194 - DNA, 20 bp, Artificial Sequence
  Description of Artificial Sequence: Synthetic oligonucleotide
  Target: ATXN1; (-) strand; PAM type: NNAGAAW; PAM sequence: ATAGAAA
taaccaagggagattgtgaa

SEQ ID NO: 9195 - DNA, 20 bp, Artificial Sequence
  Description of Artificial Sequence: Synthetic oligonucleotide
  Target: ATXN1; (-) strand; PAM type: NNAGAAW; PAM sequence: GAAGAAA
atgactcatggttctctatt

SEQ ID NO: 9196 - DNA, 20 bp, Artificial Sequence
  Description of Artificial Sequence: Synthetic oligonucleotide
  Target: ATXN1; (-) strand; PAM type: NNAGAAW; PAM sequence: TAAGAAT
tcagttttccttaatacaat

SEQ ID NO: 9197 - DNA, 20 bp, Artificial Sequence
  Description of Artificial Sequence: Synthetic oligonucleotide
  Target: ATXN1; (-) strand; PAM type: NNAGAAW; PAM sequence: TGAGAAA
ttgggcatagtgtgggaagt

SEQ ID NO: 9198 - DNA, 20 bp, Artificial Sequence
  Description of Artificial Sequence: Synthetic oligonucleotide
  Target: ATXN1; (-) strand; PAM type: NNAGAAW; PAM sequence: ACAGAAT
atctgtgtaattctcataca

SEQ ID NO: 9199 - DNA, 20 bp, Artificial Sequence
  Description of Artificial Sequence: Synthetic oligonucleotide
  Target: ATXN1; (-) strand; PAM type: NNAGAAW; PAM sequence: AAAGAAT
ttggctagaatcattggaga

SEQ ID NO: 9200 - DNA, 20 bp, Artificial Sequence
  Description of Artificial Sequence: Synthetic oligonucleotide
  Target: ATXN1; (-) strand; PAM type: NNAGAAW; PAM sequence: GGAGAAA
gatgattggctagaatcatt

SEQ ID NO: 9201 - DNA, 20 bp, Artificial Sequence
  Description of Artificial Sequence: Synthetic oligonucleotide
  Target: ATXN1; (-) strand; PAM type: NNAGAAW; PAM sequence: CTAGAAT
tgtgtttatcagatgattgg

SEQ ID NO: 9202 - DNA, 20 bp, Artificial Sequence
  Description of Artificial Sequence: Synthetic oligonucleotide
  Target: ATXN1; (-) strand; PAM type: NNAGAAW; PAM sequence: TAAGAAT
aattggtaattaccggtatt

SEQ ID NO: 9203 - DNA, 20 bp, Artificial Sequence
  Description of Artificial Sequence: Synthetic oligonucleotide
  Target: ATXN1; (-) strand; PAM type: NNAGAAW; PAM sequence: CCAGAAT
tggagatcatattcatagct

SEQ ID NO: 9204 - DNA, 20 bp, Artificial Sequence
  Description of Artificial Sequence: Synthetic oligonucleotide
  Target: ATXN1; (-) strand; PAM type: NNAGAAW; PAM sequence: CAAGAAT
tgtggggaaaccaaggacta

SEQ ID NO: 9205 - DNA, 20 bp, Artificial Sequence
  Description of Artificial Sequence: Synthetic oligonucleotide
  Target: ATXN1; (-) strand; PAM type: NNAGAAW; PAM sequence: ATAGAAT
taaagaagtactaagattaa

SEQ ID NO: 9206 - DNA, 20 bp, Artificial Sequence
  Description of Artificial Sequence: Synthetic oligonucleotide
  Target: ATXN1; (-) strand; PAM type: NNAGAAW; PAM sequence: TGAGAAT
tatggtacctgcacctcatt

SEQ ID NO: 9207 - DNA, 20 bp, Artificial Sequence
  Description of Artificial Sequence: Synthetic oligonucleotide
  Target: ATXN1; (-) strand; PAM type: NNAGAAW; PAM sequence: TAAGAAA
caacacaaatacttttgaaa

SEQ ID NO: 9208 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
catctatccttctaacgttc

SEQ ID NO: 9209 - DNA, 20 bp, Artificial Sequence
  Description of Artificial Sequence: Synthetic oligonucleotide
  Target: ATXN1; (-) strand; PAM type: NNAGAAW; PAM sequence: TCAGAAT
gaaaattcatggtagtgtac

SEQ ID NO: 9210 - DNA, 20 bp, Artificial Sequence
  Description of Artificial Sequence: Synthetic oligonucleotide
  Target: ATXN1; (-) strand; PAM type: NNAGAAW; PAM sequence: CCAGAAA
tcctacctgaaaattacttt

SEQ ID NO: 9211 - DNA, 20 bp, Artificial Sequence
  Description of Artificial Sequence: Synthetic oligonucleotide
  Target: ATXN1; (-) strand; PAM type: NNAGAAW; PAM sequence: GCAGAAA
gtttgacatatttcatgtta

SEQ ID NO: 9212 - DNA, 20 bp, Artificial Sequence
  Description of Artificial Sequence: Synthetic oligonucleotide
  Target: ATXN1; (-) strand; PAM type: NNAGAAW; PAM sequence: AAAGAAT
taaaattacagaagtaataa

SEQ ID NO: 9213 - DNA, 20 bp, Artificial Sequence
  Description of Artificial Sequence: Synthetic oligonucleotide
  Target: ATXN1; (-) strand; PAM type: NNAGAAW; PAM sequence: ACAGAAT
tgatatacagtgtcagtttt

SEQ ID NO: 9214 - DNA, 20 bp, Artificial Sequence
  Description of Artificial Sequence: Synthetic oligonucleotide
  Target: ATXN1; (-) strand; PAM type: NNAGAAW; PAM sequence: TAAGAAT
tagaacttccttttctaaga

SEQ ID NO: 9215 - DNA, 20 bp, Artificial Sequence
  Description of Artificial Sequence: Synthetic oligonucleotide
  Target: ATXN1; (-) strand; PAM type: NNAGAAW; PAM sequence: ATAGAAA
aatacattgtagaaatggta

SEQ ID NO: 9216 - DNA, 20 bp, Artificial Sequence
  Description of Artificial Sequence: Synthetic oligonucleotide
  Target: ATXN1; (-) strand; PAM type: NNAGAAW; PAM sequence: GTAGAAA
agcattgaaagcaatacatt

SEQ ID NO: 9217 - DNA, 20 bp, Artificial Sequence
  Description of Artificial Sequence: Synthetic oligonucleotide
  Target: ATXN1; (-) strand; PAM type: NNAGAAW; PAM sequence: ACAGAAA
tacacttagaggaagattaa

SEQ ID NO: 9218 - DNA, 20 bp, Artificial Sequence
  Description of Artificial Sequence: Synthetic oligonucleotide
  Target: ATXN1; (-) strand; PAM type: NNAGAAW; PAM sequence: ATAGAAA
tggattctattttgcaacat

SEQ ID NO: 9219 - DNA, 20 bp, Artificial Sequence
  Description of Artificial Sequence: Synthetic oligonucleotide
  Target: ATXN1; (-) strand; PAM type: NNAGAAW; PAM sequence: TGAGAAT
tatttgaaagaaaagataat

SEQ ID NO: 9220 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
tttcataaccctggtatttg

SEQ ID NO: 9221 - DNA, 20 bp, Artificial Sequence
  Description of Artificial Sequence: Synthetic oligonucleotide
  Target: ATXN1; (-) strand; PAM type: NNAGAAW; PAM sequence: AGAGAAA
tgataaagctggctaagcaa

SEQ ID NO: 9222 - DNA, 20 bp, Artificial Sequence
  Description of Artificial Sequence: Synthetic oligonucleotide
  Target: ATXN1; (-) strand; PAM type: NNAGAAW; PAM sequence: TTAGAAA
ggatgtaatttagtgagcag

SEQ ID NO: 9223 - DNA, 20 bp, Artificial Sequence
  Description of Artificial Sequence: Synthetic oligonucleotide
  Target: ATXN1; (-) strand; PAM type: NNAGAAW; PAM sequence: CGAGAAA
tttttttttccttagctaag

SEQ ID NO: 9224 - DNA, 20 bp, Artificial Sequence
  Description of Artificial Sequence: Synthetic oligonucleotide
  Target: ATXN1; (-) strand; PAM type: NNAGAAW; PAM sequence: TTAGAAA
caacaagtatttggtacttg

SEQ ID NO: 9225 - DNA, 20 bp, Artificial Sequence
  Description of Artificial Sequence: Synthetic oligonucleotide
  Target: ATXN1; (-) strand; PAM type: NNAGAAW; PAM sequence: AGAGAAA
tgaggaaaccaccagagaga

SEQ ID NO: 9226 - DNA, 20 bp, Artificial Sequence
  Description of Artificial Sequence: Synthetic oligonucleotide
  Target: ATXN1; (-) strand; PAM type: NNAGAAW; PAM sequence: ACAGAAT
tagaagaccctattacaccc

SEQ ID NO: 9227 - DNA, 20 bp, Artificial Sequence
  Description of Artificial Sequence: Synthetic oligonucleotide
  Target: ATXN1; (-) strand; PAM type: NNAGAAW; PAM sequence: CAAGAAA
ataatgcgcgatgtggctaa

SEQ ID NO: 9228 - DNA, 20 bp, Artificial Sequence
  Description of Artificial Sequence: Synthetic oligonucleotide
  Target: ATXN1; (-) strand; PAM type: NNAGAAW; PAM sequence: CCAGAAA
gggtggtgatcgagactctg

SEQ ID NO: 9229 - DNA, 20 bp, Artificial Sequence
  Description of Artificial Sequence: Synthetic oligonucleotide
  Target: ATXN1; (-) strand; PAM type: NNAGAAW; PAM sequence: TTAGAAT
ggaccaaggacacgtcggga

SEQ ID NO: 9230 - DNA, 20 bp, Artificial Sequence
  Description of Artificial Sequence: Synthetic oligonucleotide
  Target: ATXN1; (-) strand; PAM type: NNAGAAW; PAM sequence: AGAGAAA
ttccggacctgcgtgcgaag

SEQ ID NO: 9231 - DNA, 20 bp, Artificial Sequence
  Description of Artificial Sequence: Synthetic oligonucleotide
  Target: ATXN1; (-) strand; PAM type: NNAGAAW; PAM sequence: CCAGAAT
gcccgacacctaccggcctt

SEQ ID NO: 9232 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
tcaagattggtggctttcag

SEQ ID NO: 9233 - DNA, 20 bp, Artificial Sequence
  Description of Artificial Sequence: Synthetic oligonucleotide
  Target: ATXN1; (-) strand; PAM type: NNAGAAW; PAM sequence: TCAGAAA
acagtcaagattggtggctt

SEQ ID NO: 9234 - DNA, 20 bp, Artificial Sequence
  Description of Artificial Sequence: Synthetic oligonucleotide
  Target: ATXN1; (-) strand; PAM type: NNAGAAW; PAM sequence: TGAGAAA
tgcatggtatttcaaaaatg

SEQ ID NO: 9235 - DNA, 20 bp, Artificial Sequence
  Description of Artificial Sequence: Synthetic oligonucleotide
  Target: ATXN1; (-) strand; PAM type: NNAGAAW; PAM sequence: GTAGAAA
taaatggaaaaaaaaaagtt

SEQ ID NO: 9236 - DNA, 20 bp, Artificial Sequence
  Description of Artificial Sequence: Synthetic oligonucleotide
  Target: ATXN1; (-) strand; PAM type: NNAGAAW; PAM sequence: TAAGAAA
atggctttaaacttaatggc

SEQ ID NO: 9237 - DNA, 20 bp, Artificial Sequence
  Description of Artificial Sequence: Synthetic oligonucleotide
  Target: ATXN1; (-) strand; PAM type: NNAGAAW; PAM sequence: GAAGAAA
gtttatgttggatcttgcag

SEQ ID NO: 9238 - DNA, 20 bp, Artificial Sequence
  Description of Artificial Sequence: Synthetic oligonucleotide
  Target: ATXN1; (-) strand; PAM type: NNAGAAW; PAM sequence: AAAGAAT
cacgagaaagtcttgtttct

SEQ ID NO: 9239 - DNA, 20 bp, Artificial Sequence
  Description of Artificial Sequence: Synthetic oligonucleotide
  Target: ATXN1; (-) strand; PAM type: NNAGAAW; PAM sequence: CGAGAAA
tcattgagtttttatttgca

SEQ ID NO: 9240 - DNA, 20 bp, Artificial Sequence
  Description of Artificial Sequence: Synthetic oligonucleotide
  Target: ATXN1; (-) strand; PAM type: NNAGAAW; PAM sequence: TTAGAAA
ttcttcacatgataatgtgt

SEQ ID NO: 9241 - DNA, 20 bp, Artificial Sequence
  Description of Artificial Sequence: Synthetic oligonucleotide
  Target: ATXN1; (-) strand; PAM type: NNAGAAW; PAM sequence: AAAGAAA
acttactaaaaaggagcaaa

SEQ ID NO: 9242 - DNA, 20 bp, Artificial Sequence
  Description of Artificial Sequence: Synthetic oligonucleotide
  Target: ATXN1; (-) strand; PAM type: NNAGAAW; PAM sequence: GAAGAAA
tgtgctccctctgctgccat

SEQ ID NO: 9243 - DNA, 20 bp, Artificial Sequence
  Description of Artificial Sequence: Synthetic oligonucleotide
  Target: ATXN1; (-) strand; PAM type: NNAGAAW; PAM sequence: TAAGAAT
ttttgaggtccactttcttt

SEQ ID NO: 9244 - DNA, 20 bp, Artificial Sequence
  Description of Artificial Sequence: Synthetic oligonucleotide
  Target: ATXN1; (-) strand; PAM type: NNAGAAW; PAM sequence: GGAGAAA
ctcaccactgcaagcattaa

SEQ ID NO: 9245 - DNA, 20 bp, Artificial Sequence
  Description of Artificial Sequence: Synthetic oligonucleotide
  Target: ATXN1; (-) strand; PAM type: NNAGAAW; PAM sequence: TAAGAAT
aaatatataaacatattatc

SEQ ID NO: 9246 - DNA, 20 bp, Artificial Sequence
  Description of Artificial Sequence: Synthetic oligonucleotide
  Target: ATXN1; (-) strand; PAM type: NNAGAAW; PAM sequence: TTAGAAA
gaaaaattcttttcagcatt

SEQ ID NO: 9247 - DNA, 20 bp, Artificial Sequence
  Description of Artificial Sequence: Synthetic oligonucleotide
  Target: ATXN1; (-) strand; PAM type: NNAGAAW; PAM sequence: GGAGAAA
ggcaaaccctctttagtgtg

SEQ ID NO: 9248 - DNA, 20 bp, Artificial Sequence
  Description of Artificial Sequence: Synthetic oligonucleotide
  Target: ATXN1; (-) strand; PAM type: NNAGAAW; PAM sequence: GCAGAAA
gccataacaaattgctccag

SEQ ID NO: 9249 - DNA, 20 bp, Artificial Sequence
  Description of Artificial Sequence: Synthetic oligonucleotide
  Target: ATXN1; (-) strand; PAM type: NNAGAAW; PAM sequence: CAAGAAA
gctacagtttggtggagggt

SEQ ID NO: 9250 - DNA, 20 bp, Artificial Sequence
  Description of Artificial Sequence: Synthetic oligonucleotide
  Target: ATXN1; (+) strand; PAM type: NNAGAAW; PAM sequence: GCAGAAA
tggccagtgtacccagcaaa

SEQ ID NO: 9251 - DNA, 20 bp, Artificial Sequence
  Description of Artificial Sequence: Synthetic oligonucleotide
  Target: ATXN1; (+) strand; PAM type: NNAGAAW; PAM sequence: GTAGAAT
aagttggtgtgcatgttgag

SEQ ID NO: 9252 - DNA, 20 bp, Artificial Sequence
  Description of Artificial Sequence: Synthetic oligonucleotide
  Target: ATXN1; (+) strand; PAM type: NNAGAAW; PAM sequence: ATAGAAA
ggtgtgcatgttgaggtaga

SEQ ID NO: 9253 - DNA, 20 bp, Artificial Sequence
  Description of Artificial Sequence: Synthetic oligonucleotide
  Target: ATXN1; (+) strand; PAM type: NNAGAAW; PAM sequence: AGAGAAT
agaggggagcacgttgctgg

SEQ ID NO: 9254 - DNA, 20 bp, Artificial Sequence
  Description of Artificial Sequence: Synthetic oligonucleotide
  Target: ATXN1; (+) strand; PAM type: NNAGAAW; PAM sequence: GTAGAAA
ggtgatcatcttggcacttg

SEQ ID NO: 9255 - DNA, 20 bp, Artificial Sequence
  Description of Artificial Sequence: Synthetic oligonucleotide
  Target: ATXN1; (+) strand; PAM type: NNAGAAW; PAM sequence: ACAGAAA
ttctgagtgccttgggggct

SEQ ID NO: 9256 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
tggggcgggaaactagataa

SEQ ID NO: 9257 - DNA, 20 bp, Artificial Sequence
  Description of Artificial Sequence: Synthetic oligonucleotide
  Target: ATXN1; (+) strand; PAM type: NNAGAAW; PAM sequence: CAAGAAA
tttatgggaaggttgtctcc

SEQ ID NO: 9258 - DNA, 20 bp, Artificial Sequence
  Description of Artificial Sequence: Synthetic oligonucleotide
  Target: ATXN1; (+) strand; PAM type: NNAGAAW; PAM sequence: GGAGAAT
gggaacaatgacattgtctt

SEQ ID NO: 9259 - DNA, 20 bp, Artificial Sequence
  Description of Artificial Sequence: Synthetic oligonucleotide
  Target: ATXN1; (+) strand; PAM type: NNAGAAW; PAM sequence: TAAGAAT
agccactgtgcccggcccat

SEQ ID NO: 9260 - DNA, 20 bp, Artificial Sequence
  Description of Artificial Sequence: Synthetic oligonucleotide
  Target: ATXN1; (+) strand; PAM type: NNAGAAW; PAM sequence: GTAGAAA
taagaataactcttgcacct

SEQ ID NO: 9261 - DNA, 20 bp, Artificial Sequence
  Description of Artificial Sequence: Synthetic oligonucleotide
  Target: ATXN1; (+) strand; PAM type: NNAGAAW; PAM sequence: TCAGAAA
accattttgaagcagagcct

SEQ ID NO: 9262 - DNA, 20 bp, Artificial Sequence
  Description of Artificial Sequence: Synthetic oligonucleotide
  Target: ATXN1; (+) strand; PAM type: NNAGAAW; PAM sequence: AGAGAAT
ttgaagcagagccttcagaa

SEQ ID NO: 9263 - DNA, 20 bp, Artificial Sequence
  Description of Artificial Sequence: Synthetic oligonucleotide
  Target: ATXN1; (+) strand; PAM type: NNAGAAW; PAM sequence: GAAGAAA
aggaggcataaacatgaact

SEQ ID NO: 9264 - DNA, 20 bp, Artificial Sequence
  Description of Artificial Sequence: Synthetic oligonucleotide
  Target: ATXN1; (+) strand; PAM type: NNAGAAW; PAM sequence: CTAGAAA
aataatgaaataatttctac

SEQ ID NO: 9265 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
gaaaacctgcaagcaccatc

SEQ ID NO: 9266 - DNA, 20 bp, Artificial Sequence
  Description of Artificial Sequence: Synthetic oligonucleotide
  Target: ATXN1; (+) strand; PAM type: NNAGAAW; PAM sequence: TTAGAAA
tacaaatagacacaccacga

SEQ ID NO: 9267 - DNA, 20 bp, Artificial Sequence
  Description of Artificial Sequence: Synthetic oligonucleotide
  Target: ATXN1; (+) strand; PAM type: NNAGAAW; PAM sequence: ATAGAAT
agacacaccacgattagaaa

SEQ ID NO: 9268 - DNA, 20 bp, Artificial Sequence
  Description of Artificial Sequence: Synthetic oligonucleotide
  Target: ATXN1; (+) strand; PAM type: NNAGAAW; PAM sequence: CCAGAAA
ggatttaccccactcctggg

SEQ ID NO: 9269 - DNA, 20 bp, Artificial Sequence
  Description of Artificial Sequence: Synthetic oligonucleotide
  Target: ATXN1; (+) strand; PAM type: NNAGAAW; PAM sequence: AGAGAAA
aggtggttcctgtaagaacc

SEQ ID NO: 9270 - DNA, 20 bp, Artificial Sequence
  Description of Artificial Sequence: Synthetic oligonucleotide
  Target: ATXN1; (+) strand; PAM type: NNAGAAW; PAM sequence: ACAGAAA
cgaaggccttcagattggcc

SEQ ID NO: 9271 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
acagcaaacaaactaaaggg

SEQ ID NO: 9272 - DNA, 20 bp, Artificial Sequence
  Description of Artificial Sequence: Synthetic oligonucleotide
  Target: ATXN1; (+) strand; PAM type: NNAGAAW; PAM sequence: TAAGAAA
aagacttgagtcctttcaga

SEQ ID NO: 9273 - DNA, 20 bp, Artificial Sequence
  Description of Artificial Sequence: Synthetic oligonucleotide
  Target: ATXN1; (+) strand; PAM type: NNAGAAW; PAM sequence: GGAGAAA
ttccctcccgccattacaca

SEQ ID NO: 9274 - DNA, 20 bp, Artificial Sequence
  Description of Artificial Sequence: Synthetic oligonucleotide
  Target: ATXN1; (+) strand; PAM type: NNAGAAW; PAM sequence: TAAGAAT
aggggacgagattctgaatt

SEQ ID NO: 9275 - DNA, 20 bp, Artificial Sequence
  Description of Artificial Sequence: Synthetic oligonucleotide
  Target: ATXN1; (+) strand; PAM type: NNAGAAW; PAM sequence: GAAGAAA
aaatgtcaaacatcatctct

SEQ ID NO: 9276 - DNA, 20 bp, Artificial Sequence
  Description of Artificial Sequence: Synthetic oligonucleotide
  Target: ATXN1; (+) strand; PAM type: NNAGAAW; PAM sequence: GCAGAAT
atgaacagtattctcaaatc

SEQ ID NO: 9277 - DNA, 20 bp, Artificial Sequence
  Description of Artificial Sequence: Synthetic oligonucleotide
  Target: ATXN1; (+) strand; PAM type: NNAGAAW; PAM sequence: CAAGAAA
tcccacaaggtatagtgcta

SEQ ID NO: 9278 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
gaagcgaggtcatctatgta

SEQ ID NO: 9279 - DNA, 20 bp, Artificial Sequence
  Description of Artificial Sequence: Synthetic oligonucleotide
  Target: ATXN1; (+) strand; PAM type: NNAGAAW; PAM sequence: CCAGAAA
ttgtttggagtttccctatg

SEQ ID NO: 9280 - DNA, 20 bp, Artificial Sequence
  Description of Artificial Sequence: Synthetic oligonucleotide
  Target: ATXN1; (+) strand; PAM type: NNAGAAW; PAM sequence: TCAGAAA
gtgttcttaaattctctatt

SEQ ID NO: 9281 - DNA, 20 bp, Artificial Sequence
  Description of Artificial Sequence: Synthetic oligonucleotide
  Target: ATXN1; (+) strand; PAM type: NNAGAAW; PAM sequence: GAAGAAA
tctcctttcacatcaccacc

SEQ ID NO: 9282 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
tggagatttttctctctatg

SEQ ID NO: 9283 - DNA, 20 bp, Artificial Sequence
  Description of Artificial Sequence: Synthetic oligonucleotide
  Target: ATXN1; (+) strand; PAM type: NNAGAAW; PAM sequence: TGAGAAA
acacacacctgccccgtccc

SEQ ID NO: 9284 - DNA, 20 bp, Artificial Sequence
  Description of Artificial Sequence: Synthetic oligonucleotide
  Target: ATXN1; (+) strand; PAM type: NNAGAAW; PAM sequence: ACAGAAA
aaacccaacacactcaccta

SEQ ID NO: 9285 - DNA, 20 bp, Artificial Sequence
  Description of Artificial Sequence: Synthetic oligonucleotide
  Target: ATXN1; (+) strand; PAM type: NNAGAAW; PAM sequence: TTAGAAA
tagaggctcacaattccaag

SEQ ID NO: 9286 - DNA, 20 bp, Artificial Sequence
  Description of Artificial Sequence: Synthetic oligonucleotide
  Target: ATXN1; (+) strand; PAM type: NNAGAAW; PAM sequence: ACAGAAA
tagaaatgggatcaacaaca

SEQ ID NO: 9287 - DNA, 20 bp, Artificial Sequence
  Description of Artificial Sequence: Synthetic oligonucleotide
  Target: ATXN1; (+) strand; PAM type: NNAGAAW; PAM sequence: ATAGAAA
aaaacgaaaagttgaccaac

SEQ ID NO: 9288 - DNA, 20 bp, Artificial Sequence
  Description of Artificial Sequence: Synthetic oligonucleotide
  Target: ATXN1; (+) strand; PAM type: NNAGAAW; PAM sequence: TTAGAAA
ggaacagtcattttatatat

SEQ ID NO: 9289 - DNA, 20 bp, Artificial Sequence
  Description of Artificial Sequence: Synthetic oligonucleotide
  Target: ATXN1; (+) strand; PAM type: NNAGAAW; PAM sequence: CTAGAAA
ttttatatatttagaaatcc

SEQ ID NO: 9290 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
gtttaaaaatggaaaacagg

SEQ ID NO: 9291 - DNA, 20 bp, Artificial Sequence
  Description of Artificial Sequence: Synthetic oligonucleotide
  Target: ATXN1; (+) strand; PAM type: NNAGAAW; PAM sequence: GAAGAAT
cttgtaagctgaacggcacc

SEQ ID NO: 9292 - DNA, 20 bp, Artificial Sequence
  Description of Artificial Sequence: Synthetic oligonucleotide
  Target: ATXN1; (+) strand; PAM type: NNAGAAW; PAM sequence: AGAGAAA
tgtgcgttcttcctatttga

SEQ ID NO: 9293 - DNA, 20 bp, Artificial Sequence
  Description of Artificial Sequence: Synthetic oligonucleotide
  Target: ATXN1; (+) strand; PAM type: NNAGAAW; PAM sequence: GCAGAAA
gaggaggggcctgcccactt

SEQ ID NO: 9294 - DNA, 20 bp, Artificial Sequence
  Description of Artificial Sequence: Synthetic oligonucleotide
  Target: ATXN1; (+) strand; PAM type: NNAGAAW; PAM sequence: TTAGAAA
acatggctccagagtgcgtc

SEQ ID NO: 9295 - DNA, 20 bp, Artificial Sequence
  Description of Artificial Sequence: Synthetic oligonucleotide
  Target: ATXN1; (+) strand; PAM type: NNAGAAW; PAM sequence: CCAGAAT
tccctccagccctgctctgg

SEQ ID NO: 9296 - DNA, 20 bp, Artificial Sequence
  Description of Artificial Sequence: Synthetic oligonucleotide
  Target: ATXN1; (+) strand; PAM type: NNAGAAW; PAM sequence: ACAGAAA
actggtcagactctattggc

SEQ ID NO: 9297 - DNA, 20 bp, Artificial Sequence
  Description of Artificial Sequence: Synthetic oligonucleotide
  Target: ATXN1; (+) strand; PAM type: NNAGAAW; PAM sequence: AGAGAAT
ttgcacatgctaaaaaagca

SEQ ID NO: 9298 - DNA, 20 bp, Artificial Sequence
  Description of Artificial Sequence: Synthetic oligonucleotide
  Target: ATXN1; (+) strand; PAM type: NNAGAAW; PAM sequence: TTAGAAA
gaatgaaatgggacaagtgt

SEQ ID NO: 9299 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
catcaaaggctaaaaaacaa

SEQ ID NO: 9300 - DNA, 20 bp, Artificial Sequence
  Description of Artificial Sequence: Synthetic oligonucleotide
  Target: ATXN1; (+) strand; PAM type: NNAGAAW; PAM sequence: GCAGAAT
aataattgcaagtgccctga

SEQ ID NO: 9301 - DNA, 20 bp, Artificial Sequence
  Description of Artificial Sequence: Synthetic oligonucleotide
  Target: ATXN1; (+) strand; PAM type: NNAGAAW; PAM sequence: ACAGAAA
agattaagcaagttctctga

SEQ ID NO: 9302 - DNA, 20 bp, Artificial Sequence
  Description of Artificial Sequence: Synthetic oligonucleotide
  Target: ATXN1; (+) strand; PAM type: NNAGAAW; PAM sequence: CAAGAAT
ctaaataagcagtatgactg

SEQ ID NO: 9303 - DNA, 20 bp, Artificial Sequence
  Description of Artificial Sequence: Synthetic oligonucleotide
  Target: ATXN1; (+) strand; PAM type: NNAGAAW; PAM sequence: CCAGAAA
tcaaatgtttttggtacacc

SEQ ID NO: 9304 - DNA, 20 bp, Artificial Sequence
  Description of Artificial Sequence: Synthetic oligonucleotide
  Target: ATXN1; (+) strand; PAM type: NNAGAAW; PAM sequence: GAAGAAA
ttttttttaatttgtgaaac

SEQ ID NO: 9305 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
gtactattttcaatggggta

SEQ ID NO: 9306 - DNA, 20 bp, Artificial Sequence
  Description of Artificial Sequence: Synthetic oligonucleotide
  Target: ATXN1; (+) strand; PAM type: NNAGAAW; PAM sequence: TAAGAAT
tttagttgcagccatccaag

SEQ ID NO: 9307 - DNA, 20 bp, Artificial Sequence
  Description of Artificial Sequence: Synthetic oligonucleotide
  Target: ATXN1; (+) strand; PAM type: NNAGAAW; PAM sequence: ATAGAAA
aaatctcgatttgattttga

SEQ ID NO: 9308 - DNA, 20 bp, Artificial Sequence
  Description of Artificial Sequence: Synthetic oligonucleotide
  Target: ATXN1; (+) strand; PAM type: NNAGAAW; PAM sequence: GAAGAAA
aaaactctctcaatgaatct

SEQ ID NO: 9309 - DNA, 20 bp, Artificial Sequence
  Description of Artificial Sequence: Synthetic oligonucleotide
  Target: ATXN1; (+) strand; PAM type: NNAGAAW; PAM sequence: TTAGAAA
tggcctagagtttaggcagg

SEQ ID NO: 9310 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
ctagagtttaggcaggttag

SEQ ID NO: 9311 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
tctttaaaagttcatcttaa

SEQ ID NO: 9312 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
tgtagttacagtgttgaaaa

SEQ ID NO: 9313 - DNA, 20 bp, Artificial Sequence
  Description of Artificial Sequence: Synthetic oligonucleotide
  Target: ATXN1; (+) strand; PAM type: NNAGAAW; PAM sequence: ACAGAAA
attggttttcctaacactgc

SEQ ID NO: 9314 - DNA, 20 bp, Artificial Sequence
  Description of Artificial Sequence: Synthetic oligonucleotide
  Target: ATXN1; (+) strand; PAM type: NNAGAAW; PAM sequence: GCAGAAA
catcgctgcactagtaaaaa

SEQ ID NO: 9315 - DNA, 20 bp, Artificial Sequence
  Description of Artificial Sequence: Synthetic oligonucleotide
  Target: ATXN1; (+) strand; PAM type: NNAGAAW; PAM sequence: AGAGAAA
tttattgtaaaatatgttgg

SEQ ID NO: 9316 - DNA, 20 bp, Artificial Sequence
  Description of Artificial Sequence: Synthetic oligonucleotide
  Target: ATXN1; (+) strand; PAM type: NNAGAAW; PAM sequence: AGAGAAA
agagtgaggcagagggaggc

SEQ ID NO: 9317 - DNA, 20 bp, Artificial Sequence
  Description of Artificial Sequence: Synthetic oligonucleotide
  Target: ATXN1; (+) strand; PAM type: NNAGAAW; PAM sequence: ACAGAAA
actctaatgacaaggttaga

SEQ ID NO: 9318 - DNA, 20 bp, Artificial Sequence
  Description of Artificial Sequence: Synthetic oligonucleotide
  Target: ATXN1; (+) strand; PAM type: NNAGAAW; PAM sequence: CTAGAAT
ctacttgggaggctgaaaca

SEQ ID NO: 9319 - DNA, 20 bp, Artificial Sequence
  Description of Artificial Sequence: Synthetic oligonucleotide
  Target: ATXN1; (+) strand; PAM type: NNAGAAW; PAM sequence: GGAGAAT
ctactcaggaggctgaggca

SEQ ID NO: 9320 - DNA, 20 bp, Artificial Sequence
  Description of Artificial Sequence: Synthetic oligonucleotide
  Target: ATXN1; (+) strand; PAM type: NNAGAAW; PAM sequence: AGAGAAT
ctactcaggaggctgaggca

SEQ ID NO: 9321 - DNA, 20 bp, Artificial Sequence
  Description of Artificial Sequence: Synthetic oligonucleotide
  Target: ATXN1; (+) strand; PAM type: NNAGAAW; PAM sequence: TGAGAAT
taagaagattaaagacagct

SEQ ID NO: 9322 - DNA, 20 bp, Artificial Sequence
  Description of Artificial Sequence: Synthetic oligonucleotide
  Target: ATXN1; (+) strand; PAM type: NNAGAAW; PAM sequence: CTAGAAT
ttgagaattttgataggaaa

SEQ ID NO: 9323 - DNA, 20 bp, Artificial Sequence
  Description of Artificial Sequence: Synthetic oligonucleotide
  Target: ATXN1; (+) strand; PAM type: NNAGAAW; PAM sequence: ACAGAAA
caaaatgagaccccgtttct

SEQ ID NO: 9324 - DNA, 20 bp, Artificial Sequence
  Description of Artificial Sequence: Synthetic oligonucleotide
  Target: ATXN1; (+) strand; PAM type: NNAGAAW; PAM sequence: TGAGAAT
aattaattaaaaaaggtcta

SEQ ID NO: 9325 - DNA, 20 bp, Artificial Sequence
  Description of Artificial Sequence: Synthetic oligonucleotide
  Target: ATXN1; (+) strand; PAM type: NNAGAAW; PAM sequence: GTAGAAT
aaaaaaggtctatgagaatt

SEQ ID NO: 9326 - DNA, 20 bp, Artificial Sequence
  Description of Artificial Sequence: Synthetic oligonucleotide
  Target: ATXN1; (+) strand; PAM type: NNAGAAW; PAM sequence: CAAGAAT
aaaatatacaccactgaaat

SEQ ID NO: 9327 - DNA, 20 bp, Artificial Sequence
  Description of Artificial Sequence: Synthetic oligonucleotide
  Target: ATXN1; (+) strand; PAM type: NNAGAAW; PAM sequence: TAAGAAA
ccagttgaatagacatggat

SEQ ID NO: 9328 - DNA, 20 bp, Artificial Sequence
  Description of Artificial Sequence: Synthetic oligonucleotide
  Target: ATXN1; (+) strand; PAM type: NNAGAAW; PAM sequence: AAAGAAT
ttgaatagacatggattaag

SEQ ID NO: 9329 - DNA, 20 bp, Artificial Sequence
  Description of Artificial Sequence: Synthetic oligonucleotide
  Target: ATXN1; (+) strand; PAM type: NNAGAAW; PAM sequence: TAAGAAT
atacttgaggaggtaatggc

SEQ ID NO: 9330 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
caaacaggaaaaataaacaa

SEQ ID NO: 9331 - DNA, 20 bp, Artificial Sequence
  Description of Artificial Sequence: Synthetic oligonucleotide
  Target: ATXN1; (+) strand; PAM type: NNAGAAW; PAM sequence: TGAGAAT
gaaatcctcactgaggcaga

SEQ ID NO: 9332 - DNA, 20 bp, Artificial Sequence
  Description of Artificial Sequence: Synthetic oligonucleotide
  Target: ATXN1; (+) strand; PAM type: NNAGAAW; PAM sequence: GGAGAAT
ctactcggggggctgaggca

SEQ ID NO: 9333 - DNA, 20 bp, Artificial Sequence
  Description of Artificial Sequence: Synthetic oligonucleotide
  Target: ATXN1; (+) strand; PAM type: NNAGAAW; PAM sequence: AGAGAAA
actctagactgggcgacaat

SEQ ID NO: 9334 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
tggaatatctttacagtgct

SEQ ID NO: 9335 - DNA, 20 bp, Artificial Sequence
  Description of Artificial Sequence: Synthetic oligonucleotide
  Target: ATXN1; (+) strand; PAM type: NNAGAAW; PAM sequence: AAAGAAT
atctttacagtgctaaagaa

SEQ ID NO: 9336 - DNA, 20 bp, Artificial Sequence
  Description of Artificial Sequence: Synthetic oligonucleotide
  Target: ATXN1; (+) strand; PAM type: NNAGAAW; PAM sequence: CCAGAAT
tatggagcaaaaagatcctt

SEQ ID NO: 9337 - DNA, 20 bp, Artificial Sequence
  Description of Artificial Sequence: Synthetic oligonucleotide
  Target: ATXN1; (+) strand; PAM type: NNAGAAW; PAM sequence: AAAGAAT
gttcagacaaacagtaatta

SEQ ID NO: 9338 - DNA, 20 bp, Artificial Sequence
  Description of Artificial Sequence: Synthetic oligonucleotide
  Target: ATXN1; (+) strand; PAM type: NNAGAAW; PAM sequence: ATAGAAA
accatcaacagatctgcatt

SEQ ID NO: 9339 - DNA, 20 bp, Artificial Sequence
  Description of Artificial Sequence: Synthetic oligonucleotide
  Target: ATXN1; (+) strand; PAM type: NNAGAAW; PAM sequence: AGAGAAA
ctaaaaggtattctttaggt

SEQ ID NO: 9340 - DNA, 20 bp, Artificial Sequence
  Description of Artificial Sequence: Synthetic oligonucleotide
  Target: ATXN1; (+) strand; PAM type: NNAGAAW; PAM sequence: CTAGAAT
gatctagttctgatacattt

SEQ ID NO: 9341 - DNA, 20 bp, Artificial Sequence
  Description of Artificial Sequence: Synthetic oligonucleotide
  Target: ATXN1; (+) strand; PAM type: NNAGAAW; PAM sequence: ACAGAAA
aaactacatttacatcacac

SEQ ID NO: 9342 - DNA, 20 bp, Artificial Sequence
  Description of Artificial Sequence: Synthetic oligonucleotide
  Target: ATXN1; (+) strand; PAM type: NNAGAAW; PAM sequence: TAAGAAA
ccaagtatctgtagactcat

SEQ ID NO: 9343 - DNA, 20 bp, Artificial Sequence
  Description of Artificial Sequence: Synthetic oligonucleotide
  Target: ATXN1; (+) strand; PAM type: NNAGAAW; PAM sequence: TTAGAAA
caaacaacaatcatgtactt

SEQ ID NO: 9344 - DNA, 20 bp, Artificial Sequence
  Description of Artificial Sequence: Synthetic oligonucleotide
  Target: ATXN1; (+) strand; PAM type: NNAGAAW; PAM sequence: TTAGAAT
caaatctccaaagacaggcc

SEQ ID NO: 9345 - DNA, 20 bp, Artificial Sequence
  Description of Artificial Sequence: Synthetic oligonucleotide
  Target: ATXN1; (+) strand; PAM type: NNAGAAW; PAM sequence: AGAGAAA
agcctgccgaaaaattcacg

SEQ ID NO: 9346 - DNA, 20 bp, Artificial Sequence
  Description of Artificial Sequence: Synthetic oligonucleotide
  Target: ATXN1; (+) strand; PAM type: NNAGAAW; PAM sequence: AGAGAAT
gagagaaaagtgatggagag

SEQ ID NO: 9347 - DNA, 20 bp, Artificial Sequence
  Description of Artificial Sequence: Synthetic oligonucleotide
  Target: ATXN1; (+) strand; PAM type: NNAGAAW; PAM sequence: GAAGAAA
actgatcattaaccgttaat

SEQ ID NO: 9348 - DNA, 20 bp, Artificial Sequence
  Description of Artificial Sequence: Synthetic oligonucleotide
  Target: ATXN1; (+) strand; PAM type: NNAGAAW; PAM sequence: TGAGAAT
ctcactgaggggtttctcag

SEQ ID NO: 9349 - DNA, 20 bp, Artificial Sequence
  Description of Artificial Sequence: Synthetic oligonucleotide
  Target: ATXN1; (+) strand; PAM type: NNAGAAW; PAM sequence: CTAGAAT
ggttccttttccaaatacac

SEQ ID NO: 9350 - DNA, 20 bp, Artificial Sequence
  Description of Artificial Sequence: Synthetic oligonucleotide
  Target: ATXN1; (+) strand; PAM type: NNAGAAW; PAM sequence: TGAGAAT
tccaggttgtgcactcctta

SEQ ID NO: 9351 - DNA, 20 bp, Artificial Sequence
  Description of Artificial Sequence: Synthetic oligonucleotide
  Target: ATXN1; (+) strand; PAM type: NNAGAAW; PAM sequence: GGAGAAT
ctactctgaaggctgaagca

SEQ ID NO: 9352 - DNA, 20 bp, Artificial Sequence
  Description of Artificial Sequence: Synthetic oligonucleotide
  Target: ATXN1; (+) strand; PAM type: NNAGAAW; PAM sequence: AAAGAAT
acaaaacaaaaaaaaaactg

SEQ ID NO: 9353 - DNA, 20 bp, Artificial Sequence
  Description of Artificial Sequence: Synthetic oligonucleotide
  Target: ATXN1; (+) strand; PAM type: NNAGAAW; PAM sequence: CCAGAAT
gctggggttccacacatttt

SEQ ID NO: 9354 - DNA, 20 bp, Artificial Sequence
  Description of Artificial Sequence: Synthetic oligonucleotide
  Target: ATXN1; (+) strand; PAM type: NNAGAAW; PAM sequence: GTAGAAT
tcaaacaccctaagcagtaa

SEQ ID NO: 9355 - DNA, 20 bp, Artificial Sequence
  Description of Artificial Sequence: Synthetic oligonucleotide
  Target: ATXN1; (+) strand; PAM type: NNAGAAW; PAM sequence: TAAGAAA
tctgactaatgactggcttt

SEQ ID NO: 9356 - DNA, 20 bp, Artificial Sequence
  Description of Artificial Sequence: Synthetic oligonucleotide
  Target: ATXN1; (+) strand; PAM type: NNAGAAW; PAM sequence: ATAGAAA
tacatatcaccaaaaacaag

SEQ ID NO: 9357 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
tatcaccaaaaacaagatag

SEQ ID NO: 9358 - DNA, 20 bp, Artificial Sequence
  Description of Artificial Sequence: Synthetic oligonucleotide
  Target: ATXN1; (+) strand; PAM type: NNAGAAW; PAM sequence: AGAGAAA
ctcagtcttgttttacctgt

SEQ ID NO: 9359 - DNA, 20 bp, Artificial Sequence
  Description of Artificial Sequence: Synthetic oligonucleotide
  Target: ATXN1; (+) strand; PAM type: NNAGAAW; PAM sequence: TCAGAAA
cgttctcagcatgaaaaaaa

SEQ ID NO: 9360 - DNA, 20 bp, Artificial Sequence
  Description of Artificial Sequence: Synthetic oligonucleotide
  Target: ATXN1; (+) strand; PAM type: NNAGAAW; PAM sequence: TAAGAAT
caaaacgctttggctgagtg

SEQ ID NO: 9361 - DNA, 20 bp, Artificial Sequence
  Description of Artificial Sequence: Synthetic oligonucleotide
  Target: ATXN1; (+) strand; PAM type: NNAGAAW; PAM sequence: ATAGAAA
gaccccgtctctacaaaaaa

SEQ ID NO: 9362 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
aacataatattcagtgctaa

SEQ ID NO: 9363 - DNA, 20 bp, Artificial Sequence
  Description of Artificial Sequence: Synthetic oligonucleotide
  Target: ATXN1; (+) strand; PAM type: NNAGAAW; PAM sequence: AGAGAAT
ctataaacaacaacagtctg

SEQ ID NO: 9364 - DNA, 20 bp, Artificial Sequence
  Description of Artificial Sequence: Synthetic oligonucleotide
  Target: ATXN1; (+) strand; PAM type: NNAGAAW; PAM sequence: GTAGAAT
cagaagtcaaccaaaaaata

SEQ ID NO: 9365 - DNA, 20 bp, Artificial Sequence
  Description of Artificial Sequence: Synthetic oligonucleotide
  Target: ATXN1; (+) strand; PAM type: NNAGAAW; PAM sequence: TCAGAAA
ccctcaaatccagttcatac

SEQ ID NO: 9366 - DNA, 20 bp, Artificial Sequence
  Description of Artificial Sequence: Synthetic oligonucleotide
  Target: ATXN1; (+) strand; PAM type: NNAGAAW; PAM sequence: TTAGAAA
tggcatgacatcatttagcc

SEQ ID NO: 9367 - DNA, 20 bp, Artificial Sequence
  Description of Artificial Sequence: Synthetic oligonucleotide
  Target: ATXN1; (+) strand; PAM type: NNAGAAW; PAM sequence: CCAGAAT
tcatcctttgggactctcaa

SEQ ID NO: 9368 - DNA, 20 bp, Artificial Sequence
  Description of Artificial Sequence: Synthetic oligonucleotide
  Target: ATXN1; (+) strand; PAM type: NNAGAAW; PAM sequence: GGAGAAA
catagacgctttgctcgagt

SEQ ID NO: 9369 - DNA, 20 bp, Artificial Sequence
  Description of Artificial Sequence: Synthetic oligonucleotide
  Target: ATXN1; (+) strand; PAM type: NNAGAAW; PAM sequence: GAAGAAT
ctcaagagattatctcctat

SEQ ID NO: 9370 - DNA, 20 bp, Artificial Sequence
  Description of Artificial Sequence: Synthetic oligonucleotide
  Target: ATXN1; (+) strand; PAM type: NNAGAAW; PAM sequence: ACAGAAA
ccctgtctctacaaaaaaac

SEQ ID NO: 9371 - DNA, 20 bp, Artificial Sequence
  Description of Artificial Sequence: Synthetic oligonucleotide
  Target: ATXN1; (+) strand; PAM type: NNAGAAW; PAM sequence: ACAGAAA
acaaacgaacacaaaaaccc

SEQ ID NO: 9372 - DNA, 20 bp, Artificial Sequence
  Description of Artificial Sequence: Synthetic oligonucleotide
  Target: ATXN1; (+) strand; PAM type: NNAGAAW; PAM sequence: GGAGAAA
gtcacaatgccatctgtttt

SEQ ID NO: 9373 - DNA, 20 bp, Artificial Sequence
  Description of Artificial Sequence: Synthetic oligonucleotide
  Target: ATXN1; (+) strand; PAM type: NNAGAAW; PAM sequence: GGAGAAA
ggaagattcttcaggctagg

SEQ ID NO: 9374 - DNA, 20 bp, Artificial Sequence
  Description of Artificial Sequence: Synthetic oligonucleotide
  Target: ATXN1; (+) strand; PAM type: NNAGAAW; PAM sequence: GAAGAAT
ctacttgggaggctgaggca

SEQ ID NO: 9375 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
acagtgacatctcataatac

SEQ ID NO: 9376 - DNA, 20 bp, Artificial Sequence
  Description of Artificial Sequence: Synthetic oligonucleotide
  Target: ATXN1; (+) strand; PAM type: NNAGAAW; PAM sequence: TAAGAAA
cctttcctcacttgggcatt

SEQ ID NO: 9377 - DNA, 20 bp, Artificial Sequence
  Description of Artificial Sequence: Synthetic oligonucleotide
  Target: ATXN1; (+) strand; PAM type: NNAGAAW; PAM sequence: CAAGAAA
ctgcattccagcctaggaga

SEQ ID NO: 9378 - DNA, 20 bp, Artificial Sequence
  Description of Artificial Sequence: Synthetic oligonucleotide
  Target: ATXN1; (+) strand; PAM type: NNAGAAW; PAM sequence: GTAGAAA
aatcctagatggaaacactt

SEQ ID NO: 9379 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
tcccagcaacttgggcagtg

SEQ ID NO: 9380 - DNA, 20 bp, Artificial Sequence
  Description of Artificial Sequence: Synthetic oligonucleotide
  Target: ATXN1; (+) strand; PAM type: NNAGAAW; PAM sequence: TAAGAAA
catcctctgtcttttcctgg

SEQ ID NO: 9381 - DNA, 20 bp, Artificial Sequence
  Description of Artificial Sequence: Synthetic oligonucleotide
  Target: ATXN1; (+) strand; PAM type: NNAGAAW; PAM sequence: ACAGAAT
cagggttcctcatcttaatc

SEQ ID NO: 9382 - DNA, 20 bp, Artificial Sequence
  Description of Artificial Sequence: Synthetic oligonucleotide
  Target: ATXN1; (+) strand; PAM type: NNAGAAW; PAM sequence: GGAGAAA
caaagggaaaaggaaaggga

SEQ ID NO: 9383 - DNA, 20 bp, Artificial Sequence
  Description of Artificial Sequence: Synthetic oligonucleotide
  Target: ATXN1; (+) strand; PAM type: NNAGAAW; PAM sequence: AGAGAAA
cataccccaagcactgaagc

SEQ ID NO: 9384 - DNA, 20 bp, Artificial Sequence
  Description of Artificial Sequence: Synthetic oligonucleotide
  Target: ATXN1; (+) strand; PAM type: NNAGAAW; PAM sequence: GGAGAAT
ctacttgagaggctgaggca

SEQ ID NO: 9385 - DNA, 20 bp, Artificial Sequence
  Description of Artificial Sequence: Synthetic oligonucleotide
  Target: ATXN1; (+) strand; PAM type: NNAGAAW; PAM sequence: TCAGAAA
gcagttcttaaatttccttt

SEQ ID NO: 9386 - DNA, 20 bp, Artificial Sequence
  Description of Artificial Sequence: Synthetic oligonucleotide
  Target: ATXN1; (+) strand; PAM type: NNAGAAW; PAM sequence: TGAGAAA
ctgccctcagagccaggcac

SEQ ID NO: 9387 - DNA, 20 bp, Artificial Sequence
  Description of Artificial Sequence: Synthetic oligonucleotide
  Target: ATXN1; (+) strand; PAM type: NNAGAAW; PAM sequence: CCAGAAA
cgccaactcagcagaggccg

SEQ ID NO: 9388 - DNA, 20 bp, Artificial Sequence
  Description of Artificial Sequence: Synthetic oligonucleotide
  Target: ATXN1; (+) strand; PAM type: NNAGAAW; PAM sequence: AAAGAAT
cctgttctctgcaagtttca

SEQ ID NO: 9389 - DNA, 20 bp, Artificial Sequence
  Description of Artificial Sequence: Synthetic oligonucleotide
  Target: ATXN1; (+) strand; PAM type: NNAGAAW; PAM sequence: CAAGAAA
tggtcttgaaatcctggcct

SEQ ID NO: 9390 - DNA, 20 bp, Artificial Sequence
  Description of Artificial Sequence: Synthetic oligonucleotide
  Target: ATXN1; (+) strand; PAM type: NNAGAAW; PAM sequence: ACAGAAA
atgaaatgacaaatgataca

SEQ ID NO: 9391 - DNA, 20 bp, Artificial Sequence
  Description of Artificial Sequence: Synthetic oligonucleotide
  Target: ATXN1; (+) strand; PAM type: NNAGAAW; PAM sequence: TTAGAAA
atatctaggaaggtgcaggt

SEQ ID NO: 9392 - DNA, 20 bp, Artificial Sequence
  Description of Artificial Sequence: Synthetic oligonucleotide
  Target: ATXN1; (+) strand; PAM type: NNAGAAW; PAM sequence: TAAGAAT
gatatcaaaggacatttcag

SEQ ID NO: 9393 - DNA, 20 bp, Artificial Sequence
  Description of Artificial Sequence: Synthetic oligonucleotide
  Target: ATXN1; (+) strand; PAM type: NNAGAAW; PAM sequence: ATAGAAT
caaaggacatttcagtaaga

SEQ ID NO: 9394 - DNA, 20 bp, Artificial Sequence
  Description of Artificial Sequence: Synthetic oligonucleotide
  Target: ATXN1; (+) strand; PAM type: NNAGAAW; PAM sequence: GAAGAAA
aaccctaaaacacttatgct

SEQ ID NO: 9395 - DNA, 20 bp, Artificial Sequence
  Description of Artificial Sequence: Synthetic oligonucleotide
  Target: ATXN1; (+) strand; PAM type: NNAGAAW; PAM sequence: TAAGAAA
taaatttcaagactcactct

SEQ ID NO: 9396 - DNA, 20 bp, Artificial Sequence
  Description of Artificial Sequence: Synthetic oligonucleotide
  Target: ATXN1; (+) strand; PAM type: NNAGAAW; PAM sequence: TCAGAAT
atttatgcaagagtgatgtg

SEQ ID NO: 9397 - DNA, 20 bp, Artificial Sequence
  Description of Artificial Sequence: Synthetic oligonucleotide
  Target: ATXN1; (+) strand; PAM type: NNAGAAW; PAM sequence: GAAGAAA
tagcccaaggcagcactagg

SEQ ID NO: 9398 - DNA, 20 bp, Artificial Sequence
  Description of Artificial Sequence: Synthetic oligonucleotide
  Target: ATXN1; (+) strand; PAM type: NNAGAAW; PAM sequence: CTAGAAA
tgaatgcacaatacacaaaa

SEQ ID NO: 9399 - DNA, 20 bp, Artificial Sequence
  Description of Artificial Sequence: Synthetic oligonucleotide
  Target: ATXN1; (+) strand; PAM type: NNAGAAW; PAM sequence: AAAGAAT
ccagctttcgtaaatttgaa

SEQ ID NO: 9400 - DNA, 20 bp, Artificial Sequence
  Description of Artificial Sequence: Synthetic oligonucleotide
  Target: ATXN1; (+) strand; PAM type: NNAGAAW; PAM sequence: TGAGAAA
tcttttccagagattgccaa

SEQ ID NO: 9401 - DNA, 20 bp, Artificial Sequence
  Description of Artificial Sequence: Synthetic oligonucleotide
  Target: ATXN1; (+) strand; PAM type: NNAGAAW; PAM sequence: AGAGAAA
agatttggaaaataaggaag

SEQ ID NO: 9402 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
ggaaaataaggaagagagaa

SEQ ID NO: 9403 - DNA, 20 bp, Artificial Sequence
  Description of Artificial Sequence: Synthetic oligonucleotide
  Target: ATXN1; (+) strand; PAM type: NNAGAAW; PAM sequence: GAAGAAA
agagagaaaaagaaacgaaa

SEQ ID NO: 9404 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
aaaagaaacgaaagaagaaa

SEQ ID NO: 9405 - DNA, 20 bp, Artificial Sequence
  Description of Artificial Sequence: Synthetic oligonucleotide
  Target: ATXN1; (+) strand; PAM type: NNAGAAW; PAM sequence: TGAGAAA
attctatgcacagtaaggtt

SEQ ID NO: 9406 - DNA, 20 bp, Artificial Sequence
  Description of Artificial Sequence: Synthetic oligonucleotide
  Target: ATXN1; (+) strand; PAM type: NNAGAAW; PAM sequence: AGAGAAA
ctggttctttacacaactgc

SEQ ID NO: 9407 - DNA, 20 bp, Artificial Sequence
  Description of Artificial Sequence: Synthetic oligonucleotide
  Target: ATXN1; (+) strand; PAM type: NNAGAAW; PAM sequence: GAAGAAA
cacaactcaatcattcccag

SEQ ID NO: 9408 - DNA, 20 bp, Artificial Sequence
  Description of Artificial Sequence: Synthetic oligonucleotide
  Target: ATXN1; (+) strand; PAM type: NNAGAAW; PAM sequence: CGAGAAA
tctttgctataatttcattt

SEQ ID NO: 9409 - DNA, 20 bp, Artificial Sequence
  Description of Artificial Sequence: Synthetic oligonucleotide
  Target: ATXN1; (+) strand; PAM type: NNAGAAW; PAM sequence: TCAGAAT
agtaaatagcagccaactgc

SEQ ID NO: 9410 - DNA, 20 bp, Artificial Sequence
  Description of Artificial Sequence: Synthetic oligonucleotide
  Target: ATXN1; (+) strand; PAM type: NNAGAAW; PAM sequence: TTAGAAT
gctcagaatggaagatgctc

SEQ ID NO: 9411 - DNA, 20 bp, Artificial Sequence
  Description of Artificial Sequence: Synthetic oligonucleotide
  Target: ATXN1; (+) strand; PAM type: NNAGAAW; PAM sequence: CAAGAAA
aatacatcttaaacctaggg

SEQ ID NO: 9412 - DNA, 20 bp, Artificial Sequence
  Description of Artificial Sequence: Synthetic oligonucleotide
  Target: ATXN1; (+) strand; PAM type: NNAGAAW; PAM sequence: GCAGAAT
gtatgcaaacactgaagagg

SEQ ID NO: 9413 - DNA, 20 bp, Artificial Sequence
  Description of Artificial Sequence: Synthetic oligonucleotide
  Target: ATXN1; (+) strand; PAM type: NNAGAAW; PAM sequence: GCAGAAA
aaggcctgtgtggtgcactg

SEQ ID NO: 9414 - DNA, 20 bp, Artificial Sequence
  Description of Artificial Sequence: Synthetic oligonucleotide
  Target: ATXN1; (+) strand; PAM type: NNAGAAW; PAM sequence: CTAGAAT
acccgacatgcttggagtat

SEQ ID NO: 9415 - DNA, 20 bp, Artificial Sequence
  Description of Artificial Sequence: Synthetic oligonucleotide
  Target: ATXN1; (+) strand; PAM type: NNAGAAW; PAM sequence: GGAGAAA
atgcttggagtatctagaat

SEQ ID NO: 9416 - DNA, 20 bp, Artificial Sequence
  Description of Artificial Sequence: Synthetic oligonucleotide
  Target: ATXN1; (+) strand; PAM type: NNAGAAW; PAM sequence: TGAGAAT
accaggaaaattaagatcaa

SEQ ID NO: 9417 - DNA, 20 bp, Artificial Sequence
  Description of Artificial Sequence: Synthetic oligonucleotide
  Target: ATXN1; (+) strand; PAM type: NNAGAAW; PAM sequence: CCAGAAA
aatggtttcaatgaaagagc

SEQ ID NO: 9418 - DNA, 20 bp, Artificial Sequence
  Description of Artificial Sequence: Synthetic oligonucleotide
  Target: ATXN1; (+) strand; PAM type: NNAGAAW; PAM sequence: CAAGAAA
gataaagcaagaccctgtct

SEQ ID NO: 9419 - DNA, 20 bp, Artificial Sequence
  Description of Artificial Sequence: Synthetic oligonucleotide
  Target: ATXN1; (+) strand; PAM type: NNAGAAW; PAM sequence: AGAGAAA
caagaccctgtctcaagaaa

SEQ ID NO: 9420 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
accctgtctcaagaaaagag

SEQ ID NO: 9421 - DNA, 20 bp, Artificial Sequence
  Description of Artificial Sequence: Synthetic oligonucleotide
  Target: ATXN1; (+) strand; PAM type: NNAGAAW; PAM sequence: TCAGAAT
aaagagaaagaaaacaatgt

SEQ ID NO: 9422 - DNA, 20 bp, Artificial Sequence
  Description of Artificial Sequence: Synthetic oligonucleotide
  Target: ATXN1; (+) strand; PAM type: NNAGAAW; PAM sequence: ACAGAAA
aatgagtgccctggggaaga

SEQ ID NO: 9423 - DNA, 20 bp, Artificial Sequence
  Description of Artificial Sequence: Synthetic oligonucleotide
  Target: ATXN1; (+) strand; PAM type: NNAGAAW; PAM sequence: TGAGAAT
gctgcagcattaggaagcaa

SEQ ID NO: 9424 - DNA, 20 bp, Artificial Sequence
  Description of Artificial Sequence: Synthetic oligonucleotide
  Target: ATXN1; (+) strand; PAM type: NNAGAAW; PAM sequence: ATAGAAA
gggtcaccccaagggtcagg

SEQ ID NO: 9425 - DNA, 20 bp, Artificial Sequence
  Description of Artificial Sequence: Synthetic oligonucleotide
  Target: ATXN1; (+) strand; PAM type: NNAGAAW; PAM sequence: CCAGAAA
cctgtctagagacatccagg

SEQ ID NO: 9426 - DNA, 20 bp, Artificial Sequence
  Description of Artificial Sequence: Synthetic oligonucleotide
  Target: ATXN1; (+) strand; PAM type: NNAGAAW; PAM sequence: AGAGAAA
cggaagtgtagtgagtgaga

SEQ ID NO: 9427 - DNA, 20 bp, Artificial Sequence
  Description of Artificial Sequence: Synthetic oligonucleotide
  Target: ATXN1; (+) strand; PAM type: NNAGAAW; PAM sequence: CAAGAAA
gtgagtgagaagagaaaaag

SEQ ID NO: 9428 - DNA, 20 bp, Artificial Sequence
  Description of Artificial Sequence: Synthetic oligonucleotide
  Target: ATXN1; (+) strand; PAM type: NNAGAAW; PAM sequence: AGAGAAA
caaagacaaatgtccttata

SEQ ID NO: 9429 - DNA, 20 bp, Artificial Sequence
  Description of Artificial Sequence: Synthetic oligonucleotide
  Target: ATXN1; (+) strand; PAM type: NNAGAAW; PAM sequence: AGAGAAA
tgtccttataagagaaaggc

SEQ ID NO: 9430 - DNA, 20 bp, Artificial Sequence
  Description of Artificial Sequence: Synthetic oligonucleotide
  Target: ATXN1; (+) strand; PAM type: NNAGAAW; PAM sequence: AGAGAAT
ttcaagcctccaggagtgtt

SEQ ID NO: 9431 - DNA, 20 bp, Artificial Sequence
  Description of Artificial Sequence: Synthetic oligonucleotide
  Target: ATXN1; (+) strand; PAM type: NNAGAAW; PAM sequence: TAAGAAA
gtaatttattatggcagccc

SEQ ID NO: 9432 - DNA, 20 bp, Artificial Sequence
  Description of Artificial Sequence: Synthetic oligonucleotide
  Target: ATXN1; (+) strand; PAM type: NNAGAAW; PAM sequence: GTAGAAA
tatgcctatttatttttcat

SEQ ID NO: 9433 - DNA, 20 bp, Artificial Sequence
  Description of Artificial Sequence: Synthetic oligonucleotide
  Target: ATXN1; (+) strand; PAM type: NNAGAAW; PAM sequence: ACAGAAT
atttttcatgtagaaaaggg

SEQ ID NO: 9434 - DNA, 20 bp, Artificial Sequence
  Description of Artificial Sequence: Synthetic oligonucleotide
  Target: ATXN1; (+) strand; PAM type: NNAGAAW; PAM sequence: GGAGAAA
cagtgggtcaagcaaaggca

SEQ ID NO: 9435 - DNA, 20 bp, Artificial Sequence
  Description of Artificial Sequence: Synthetic oligonucleotide
  Target: ATXN1; (+) strand; PAM type: NNAGAAW; PAM sequence: AAAGAAT
ggccttgaaggggaggctgg

SEQ ID NO: 9436 - DNA, 20 bp, Artificial Sequence
  Description of Artificial Sequence: Synthetic oligonucleotide
  Target: ATXN1; (+) strand; PAM type: NNAGAAW; PAM sequence: TAAGAAA
agaggttgagttggagtttt

SEQ ID NO: 9437 - DNA, 20 bp, Artificial Sequence
  Description of Artificial Sequence: Synthetic oligonucleotide
  Target: ATXN1; (+) strand; PAM type: NNAGAAW; PAM sequence: TTAGAAT
attcacatccactgtcctat

SEQ ID NO: 9438 - DNA, 20 bp, Artificial Sequence
  Description of Artificial Sequence: Synthetic oligonucleotide
  Target: ATXN1; (+) strand; PAM type: NNAGAAW; PAM sequence: ACAGAAT
gctattactactaaggacac

SEQ ID NO: 9439 - DNA, 20 bp, Artificial Sequence
  Description of Artificial Sequence: Synthetic oligonucleotide
  Target: ATXN1; (+) strand; PAM type: NNAGAAW; PAM sequence: GGAGAAT
ctacgagggaggctaaggca

SEQ ID NO: 9440 - DNA, 20 bp, Artificial Sequence
  Description of Artificial Sequence: Synthetic oligonucleotide
  Target: ATXN1; (+) strand; PAM type: NNAGAAW; PAM sequence: GAAGAAT
atctctgcctttaaaatggg

SEQ ID NO: 9441 - DNA, 20 bp, Artificial Sequence
  Description of Artificial Sequence: Synthetic oligonucleotide
  Target: ATXN1; (+) strand; PAM type: NNAGAAW; PAM sequence: ATAGAAA
gttttttcctcacatctgtg

SEQ ID NO: 9442 - DNA, 20 bp, Artificial Sequence
  Description of Artificial Sequence: Synthetic oligonucleotide
  Target: ATXN1; (+) strand; PAM type: NNAGAAW; PAM sequence: GCAGAAT
gaaggcaattcagcacacaa

SEQ ID NO: 9443 - DNA, 20 bp, Artificial Sequence
  Description of Artificial Sequence: Synthetic oligonucleotide
  Target: ATXN1; (+) strand; PAM type: NNAGAAW; PAM sequence: ACAGAAA
tcagcacacaagcagaataa

SEQ ID NO: 9444 - DNA, 20 bp, Artificial Sequence
  Description of Artificial Sequence: Synthetic oligonucleotide
  Target: ATXN1; (+) strand; PAM type: NNAGAAW; PAM sequence: GCAGAAT
aagacgcatggtggggaaat

SEQ ID NO: 9445 - DNA, 20 bp, Artificial Sequence
  Description of Artificial Sequence: Synthetic oligonucleotide
  Target: ATXN1; (+) strand; PAM type: NNAGAAW; PAM sequence: GCAGAAA
gattacatggctaaaaaagg

SEQ ID NO: 9446 - DNA, 20 bp, Artificial Sequence
  Description of Artificial Sequence: Synthetic oligonucleotide
  Target: ATXN1; (+) strand; PAM type: NNAGAAW; PAM sequence: GAAGAAT
gtgggtcattagtgtgtagt

SEQ ID NO: 9447 - DNA, 20 bp, Artificial Sequence
  Description of Artificial Sequence: Synthetic oligonucleotide
  Target: ATXN1; (+) strand; PAM type: NNAGAAW; PAM sequence: GAAGAAT
gagccaccgcgcctgaccat

SEQ ID NO: 9448 - DNA, 20 bp, Artificial Sequence
  Description of Artificial Sequence: Synthetic oligonucleotide
  Target: ATXN1; (+) strand; PAM type: NNAGAAW; PAM sequence: TAAGAAT
catccatcagcgttcagtga

SEQ ID NO: 9449 - DNA, 20 bp, Artificial Sequence
  Description of Artificial Sequence: Synthetic oligonucleotide
  Target: ATXN1; (+) strand; PAM type: NNAGAAW; PAM sequence: ACAGAAA
ggaacaggcagatgggtggt

SEQ ID NO: 9450 - DNA, 20 bp, Artificial Sequence
  Description of Artificial Sequence: Synthetic oligonucleotide
  Target: ATXN1; (+) strand; PAM type: NNAGAAW; PAM sequence: AGAGAAA
gtcaccagggccaaaggctc

SEQ ID NO: 9451 - DNA, 20 bp, Artificial Sequence
  Description of Artificial Sequence: Synthetic oligonucleotide
  Target: ATXN1; (+) strand; PAM type: NNAGAAW; PAM sequence: CTAGAAA
cactgagtgaaattgactta

SEQ ID NO: 9452 - DNA, 20 bp, Artificial Sequence
  Description of Artificial Sequence: Synthetic oligonucleotide
  Target: ATXN1; (+) strand; PAM type: NNAGAAW; PAM sequence: ATAGAAT
tgacttactagaaatctacc

SEQ ID NO: 9453 - DNA, 20 bp, Artificial Sequence
  Description of Artificial Sequence: Synthetic oligonucleotide
  Target: ATXN1; (+) strand; PAM type: NNAGAAW; PAM sequence: GCAGAAT
agggccatactctctcacct

SEQ ID NO: 9454 - DNA, 20 bp, Artificial Sequence
  Description of Artificial Sequence: Synthetic oligonucleotide
  Target: ATXN1; (+) strand; PAM type: NNAGAAW; PAM sequence: TAAGAAA
atactctctcacctgcagaa

SEQ ID NO: 9455 - DNA, 20 bp, Artificial Sequence
  Description of Artificial Sequence: Synthetic oligonucleotide
  Target: ATXN1; (+) strand; PAM type: NNAGAAW; PAM sequence: TAAGAAT
tctaccccagaccaactgaa

SEQ ID NO: 9456 - DNA, 20 bp, Artificial Sequence
  Description of Artificial Sequence: Synthetic oligonucleotide
  Target: ATXN1; (+) strand; PAM type: NNAGAAW; PAM sequence: ACAGAAT
agttcctcaaaatgtgaaat

SEQ ID NO: 9457 - DNA, 20 bp, Artificial Sequence
  Description of Artificial Sequence: Synthetic oligonucleotide
  Target: ATXN1; (+) strand; PAM type: NNAGAAW; PAM sequence: CTAGAAT
attccccttctatgaggaat

SEQ ID NO: 9458 - DNA, 20 bp, Artificial Sequence
  Description of Artificial Sequence: Synthetic oligonucleotide
  Target: ATXN1; (+) strand; PAM type: NNAGAAW; PAM sequence: CCAGAAT
atgggagttgtttaacggtt

SEQ ID NO: 9459 - DNA, 20 bp, Artificial Sequence
  Description of Artificial Sequence: Synthetic oligonucleotide
  Target: ATXN1; (+) strand; PAM type: NNAGAAW; PAM sequence: CAAGAAT
agatggtggtgatggttgaa

SEQ ID NO: 9460 - DNA, 20 bp, Artificial Sequence
  Description of Artificial Sequence: Synthetic oligonucleotide
  Target: ATXN1; (+) strand; PAM type: NNAGAAW; PAM sequence: ATAGAAA
aaccctgtctctactaaaaa

SEQ ID NO: 9461 - DNA, 20 bp, Artificial Sequence
  Description of Artificial Sequence: Synthetic oligonucleotide
  Target: ATXN1; (+) strand; PAM type: NNAGAAW; PAM sequence: GGAGAAT
ctactcgagaggctgagaca

SEQ ID NO: 9462 - DNA, 20 bp, Artificial Sequence
  Description of Artificial Sequence: Synthetic oligonucleotide
  Target: ATXN1; (+) strand; PAM type: NNAGAAW; PAM sequence: CTAGAAT
ctaatcagctgccagtgagg

SEQ ID NO: 9463 - DNA, 20 bp, Artificial Sequence
  Description of Artificial Sequence: Synthetic oligonucleotide
  Target: ATXN1; (+) strand; PAM type: NNAGAAW; PAM sequence: AAAGAAT
aataatgttgtggtatctgc

SEQ ID NO: 9464 - DNA, 20 bp, Artificial Sequence
  Description of Artificial Sequence: Synthetic oligonucleotide
  Target: ATXN1; (+) strand; PAM type: NNAGAAW; PAM sequence: TAAGAAT
gctgtacacatcggccaaga

SEQ ID NO: 9465 - DNA, 20 bp, Artificial Sequence
  Description of Artificial Sequence: Synthetic oligonucleotide
  Target: ATXN1; (+) strand; PAM type: NNAGAAW; PAM sequence: TCAGAAT
actttctacctccactgact

SEQ ID NO: 9466 - DNA, 20 bp, Artificial Sequence
  Description of Artificial Sequence: Synthetic oligonucleotide
  Target: ATXN1; (+) strand; PAM type: NNAGAAW; PAM sequence: GAAGAAA
tgctggtcacagactaaaga

SEQ ID NO: 9467 - DNA, 20 bp, Artificial Sequence
  Description of Artificial Sequence: Synthetic oligonucleotide
  Target: ATXN1; (+) strand; PAM type: NNAGAAW; PAM sequence: AGAGAAT
aacatgggtagggccagata

SEQ ID NO: 9468 - DNA, 20 bp, Artificial Sequence
  Description of Artificial Sequence: Synthetic oligonucleotide
  Target: ATXN1; (+) strand; PAM type: NNAGAAW; PAM sequence: TTAGAAT
cattttggctttccatagtg

SEQ ID NO: 9469 - DNA, 20 bp, Artificial Sequence
  Description of Artificial Sequence: Synthetic oligonucleotide
  Target: ATXN1; (+) strand; PAM type: NNAGAAW; PAM sequence: TAAGAAA
ctaagctttgatttcctctt

SEQ ID NO: 9470 - DNA, 20 bp, Artificial Sequence
  Description of Artificial Sequence: Synthetic oligonucleotide
  Target: ATXN1; (+) strand; PAM type: NNAGAAW; PAM sequence: GAAGAAT
attccagggaggctgaggca

SEQ ID NO: 9471 - DNA, 20 bp, Artificial Sequence
  Description of Artificial Sequence: Synthetic oligonucleotide
  Target: ATXN1; (+) strand; PAM type: NNAGAAW; PAM sequence: TTAGAAA
gacaggagtgaaactctgcc

SEQ ID NO: 9472 - DNA, 20 bp, Artificial Sequence
  Description of Artificial Sequence: Synthetic oligonucleotide
  Target: ATXN1; (+) strand; PAM type: NNAGAAW; PAM sequence: TGAGAAT
cttatttcatgaagttgtta

SEQ ID NO: 9473 - DNA, 20 bp, Artificial Sequence
  Description of Artificial Sequence: Synthetic oligonucleotide
  Target: ATXN1; (+) strand; PAM type: NNAGAAW; PAM sequence: GAAGAAT
tgctgtgagttcacacataa

SEQ ID NO: 9474 - DNA, 20 bp, Artificial Sequence
  Description of Artificial Sequence: Synthetic oligonucleotide
  Target: ATXN1; (+) strand; PAM type: NNAGAAW; PAM sequence: TAAGAAA
tggttgttccgattattttc

SEQ ID NO: 9475 - DNA, 20 bp, Artificial Sequence
  Description of Artificial Sequence: Synthetic oligonucleotide
  Target: ATXN1; (+) strand; PAM type: NNAGAAW; PAM sequence: GAAGAAT
ctactcgggaggctgaggca

SEQ ID NO: 9476 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
gagcgagactgtgtctcaaa

SEQ ID NO: 9477 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
gagactgtgtctcaaaaaag

SEQ ID NO: 9478 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
ctgtgtctcaaaaaagaaag

SEQ ID NO: 9479 - DNA, 20 bp, Artificial Sequence
  Description of Artificial Sequence: Synthetic oligonucleotide
  Target: ATXN1; (+) strand; PAM type: NNAGAAW; PAM sequence: CTAGAAT
aaaaaaacacattttcctcc

SEQ ID NO: 9480 - DNA, 20 bp, Artificial Sequence
  Description of Artificial Sequence: Synthetic oligonucleotide
  Target: ATXN1; (+) strand; PAM type: NNAGAAW; PAM sequence: TCAGAAA
gcatttcaagtcttaccggt

SEQ ID NO: 9481 - DNA, 20 bp, Artificial Sequence
  Description of Artificial Sequence: Synthetic oligonucleotide
  Target: ATXN1; (+) strand; PAM type: NNAGAAW; PAM sequence: TTAGAAA
gtctctaaaattgtcttctt

SEQ ID NO: 9482 - DNA, 20 bp, Artificial Sequence
  Description of Artificial Sequence: Synthetic oligonucleotide
  Target: ATXN1; (+) strand; PAM type: NNAGAAW; PAM sequence: TTAGAAT
taaatcaatgcttttccttt

SEQ ID NO: 9483 - DNA, 20 bp, Artificial Sequence
  Description of Artificial Sequence: Synthetic oligonucleotide
  Target: ATXN1; (+) strand; PAM type: NNAGAAW; PAM sequence: CTAGAAT
tttagaataccatgccctaa

SEQ ID NO: 9484 - DNA, 20 bp, Artificial Sequence
  Description of Artificial Sequence: Synthetic oligonucleotide
  Target: ATXN1; (+) strand; PAM type: NNAGAAW; PAM sequence: TAAGAAA
agcaactataatgcctagca

SEQ ID NO: 9485 - DNA, 20 bp, Artificial Sequence
  Description of Artificial Sequence: Synthetic oligonucleotide
  Target: ATXN1; (+) strand; PAM type: NNAGAAW; PAM sequence: AAAGAAT
tcccatatttactgtgtagg

SEQ ID NO: 9486 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
aagaccctgtctcaaaaaat

SEQ ID NO: 9487 - DNA, 20 bp, Artificial Sequence
  Description of Artificial Sequence: Synthetic oligonucleotide
  Target: ATXN1; (+) strand; PAM type: NNAGAAW; PAM sequence: GTAGAAA
atgcattcaacaaatgtgag

SEQ ID NO: 9488 - DNA, 20 bp, Artificial Sequence
  Description of Artificial Sequence: Synthetic oligonucleotide
  Target: ATXN1; (+) strand; PAM type: NNAGAAW; PAM sequence: GCAGAAT
gaaatgggcagaggattcca

SEQ ID NO: 9489 - DNA, 20 bp, Artificial Sequence
  Description of Artificial Sequence: Synthetic oligonucleotide
  Target: ATXN1; (+) strand; PAM type: NNAGAAW; PAM sequence: TAAGAAA
ttttgctggtattcttctac

SEQ ID NO: 9490 - DNA, 20 bp, Artificial Sequence
  Description of Artificial Sequence: Synthetic oligonucleotide
  Target: ATXN1; (+) strand; PAM type: NNAGAAW; PAM sequence: TCAGAAA
taaataagcagaggcttcca

SEQ ID NO: 9491 - DNA, 20 bp, Artificial Sequence
  Description of Artificial Sequence: Synthetic oligonucleotide
  Target: ATXN1; (+) strand; PAM type: NNAGAAW; PAM sequence: CCAGAAA
ttttttcatcaggacacgtt

SEQ ID NO: 9492 - DNA, 20 bp, Artificial Sequence
  Description of Artificial Sequence: Synthetic oligonucleotide
  Target: ATXN1; (+) strand; PAM type: NNAGAAW; PAM sequence: ACAGAAA
gaaaatatacaaagaacttc

SEQ ID NO: 9493 - DNA, 20 bp, Artificial Sequence
  Description of Artificial Sequence: Synthetic oligonucleotide
  Target: ATXN1; (+) strand; PAM type: NNAGAAW; PAM sequence: GGAGAAA
cgctgcgcagcggacaagct

SEQ ID NO: 9494 - DNA, 20 bp, Artificial Sequence
  Description of Artificial Sequence: Synthetic oligonucleotide
  Target: ATXN1; (+) strand; PAM type: NNAGAAW; PAM sequence: TCAGAAA
ctttcagtctgcagttggcc

SEQ ID NO: 9495 - DNA, 20 bp, Artificial Sequence
  Description of Artificial Sequence: Synthetic oligonucleotide
  Target: ATXN1; (+) strand; PAM type: NNAGAAW; PAM sequence: ACAGAAA
ggctgagaacgaggtctatg

SEQ ID NO: 9496 - DNA, 20 bp, Artificial Sequence
  Description of Artificial Sequence: Synthetic oligonucleotide
  Target: ATXN1; (+) strand; PAM type: NNAGAAW; PAM sequence: CAAGAAA
ggtctatgacagaaatgtgc

SEQ ID NO: 9497 - DNA, 20 bp, Artificial Sequence
  Description of Artificial Sequence: Synthetic oligonucleotide
  Target: ATXN1; (+) strand; PAM type: NNAGAAW; PAM sequence: GCAGAAA
gacagaaatgtgccaagaaa

SEQ ID NO: 9498 - DNA, 20 bp, Artificial Sequence
  Description of Artificial Sequence: Synthetic oligonucleotide
  Target: ATXN1; (+) strand; PAM type: NNAGAAW; PAM sequence: ATAGAAT
agcagaaaggaaaagcgctc

SEQ ID NO: 9499 - DNA, 20 bp, Artificial Sequence
  Description of Artificial Sequence: Synthetic oligonucleotide
  Target: ATXN1; (+) strand; PAM type: NNAGAAW; PAM sequence: TCAGAAA
ctgctggttggttagtggct

SEQ ID NO: 9500 - DNA, 20 bp, Artificial Sequence
  Description of Artificial Sequence: Synthetic oligonucleotide
  Target: ATXN1; (+) strand; PAM type: NNAGAAW; PAM sequence: TGAGAAT
ctactcaggaggctgaggca

SEQ ID NO: 9501 - DNA, 20 bp, Artificial Sequence
  Description of Artificial Sequence: Synthetic oligonucleotide
  Target: ATXN1; (+) strand; PAM type: NNAGAAW; PAM sequence: CGAGAAT
gtgaaaaacagcttcgtcta

SEQ ID NO: 9502 - DNA, 20 bp, Artificial Sequence
  Description of Artificial Sequence: Synthetic oligonucleotide
  Target: ATXN1; (+) strand; PAM type: NNAGAAW; PAM sequence: TCAGAAA
agggtcccctgagtcgataa

SEQ ID NO: 9503 - DNA, 20 bp, Artificial Sequence
  Description of Artificial Sequence: Synthetic oligonucleotide
  Target: ATXN1; (+) strand; PAM type: NNAGAAW; PAM sequence: GGAGAAT
ttcttaaccttggcagcaca

SEQ ID NO: 9504 - DNA, 20 bp, Artificial Sequence
  Description of Artificial Sequence: Synthetic oligonucleotide
  Target: ATXN1; (+) strand; PAM type: NNAGAAW; PAM sequence: TGAGAAT
tttcaatgtgcagccatggt

SEQ ID NO: 9505 - DNA, 20 bp, Artificial Sequence
  Description of Artificial Sequence: Synthetic oligonucleotide
  Target: ATXN1; (+) strand; PAM type: NNAGAAW; PAM sequence: CCAGAAA
tgtattaaaccaagcttttc

SEQ ID NO: 9506 - DNA, 20 bp, Artificial Sequence
  Description of Artificial Sequence: Synthetic oligonucleotide
  Target: ATXN1; (+) strand; PAM type: NNAGAAW; PAM sequence: CAAGAAA
cttctgatttgtgatgggta

SEQ ID NO: 9507 - DNA, 20 bp, Artificial Sequence
  Description of Artificial Sequence: Synthetic oligonucleotide
  Target: ATXN1; (+) strand; PAM type: NNAGAAW; PAM sequence: CAAGAAA
gtctcagattttctgatatg

SEQ ID NO: 9508 - DNA, 20 bp, Artificial Sequence
  Description of Artificial Sequence: Synthetic oligonucleotide
  Target: ATXN1; (+) strand; PAM type: NNAGAAW; PAM sequence: ACAGAAA
ttgtagcctatggtcagagc

SEQ ID NO: 9509 - DNA, 20 bp, Artificial Sequence
  Description of Artificial Sequence: Synthetic oligonucleotide
  Target: ATXN1; (+) strand; PAM type: NNAGAAW; PAM sequence: TAAGAAA
gggaggagaagccccatgga

SEQ ID NO: 9510 - DNA, 20 bp, Artificial Sequence
  Description of Artificial Sequence: Synthetic oligonucleotide
  Target: ATXN1; (+) strand; PAM type: NNAGAAW; PAM sequence: TCAGAAA
tgacctaatttggccttaag

SEQ ID NO: 9511 - DNA, 20 bp, Artificial Sequence
  Description of Artificial Sequence: Synthetic oligonucleotide
  Target: ATXN1; (+) strand; PAM type: NNAGAAW; PAM sequence: GAAGAAA
acactgagtttcaaagcaaa

SEQ ID NO: 9512 - DNA, 20 bp, Artificial Sequence
  Description of Artificial Sequence: Synthetic oligonucleotide
  Target: ATXN1; (+) strand; PAM type: NNAGAAW; PAM sequence: TCAGAAT
gctttccatgaataaatttt

SEQ ID NO: 9513 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
gtatgaactgtcctggaact

SEQ ID NO: 9514 - DNA, 20 bp, Artificial Sequence
  Description of Artificial Sequence: Synthetic oligonucleotide
  Target: ATXN1; (+) strand; PAM type: NNAGAAW; PAM sequence: CAAGAAA
tgctggtttcagcataaggc

SEQ ID NO: 9515 - DNA, 20 bp, Artificial Sequence
  Description of Artificial Sequence: Synthetic oligonucleotide
  Target: ATXN1; (+) strand; PAM type: NNAGAAW; PAM sequence: CCAGAAT
aattaaatgcttaaccgagt

SEQ ID NO: 9516 - DNA, 20 bp, Artificial Sequence
  Description of Artificial Sequence: Synthetic oligonucleotide
  Target: ATXN1; (+) strand; PAM type: NNAGAAW; PAM sequence: ACAGAAT
gtacaactgcaataagatac

SEQ ID NO: 9517 - DNA, 20 bp, Artificial Sequence
  Description of Artificial Sequence: Synthetic oligonucleotide
  Target: ATXN1; (+) strand; PAM type: NNAGAAW; PAM sequence: GGAGAAA
cgggagggaagctgacactg

SEQ ID NO: 9518 - DNA, 20 bp, Artificial Sequence
  Description of Artificial Sequence: Synthetic oligonucleotide
  Target: ATXN1; (+) strand; PAM type: NNAGAAW; PAM sequence: CAAGAAA
ctgacactgggagaaatatc

SEQ ID NO: 9519 - DNA, 20 bp, Artificial Sequence
  Description of Artificial Sequence: Synthetic oligonucleotide
  Target: ATXN1; (+) strand; PAM type: NNAGAAW; PAM sequence: GCAGAAA
cagcagcacaattcgcaatt

SEQ ID NO: 9520 - DNA, 20 bp, Artificial Sequence
  Description of Artificial Sequence: Synthetic oligonucleotide
  Target: ATXN1; (+) strand; PAM type: NNAGAAW; PAM sequence: ACAGAAT
aattattgtatgtatatatc

SEQ ID NO: 9521 - DNA, 20 bp, Artificial Sequence
  Description of Artificial Sequence: Synthetic oligonucleotide
  Target: ATXN1; (+) strand; PAM type: NNAGAAW; PAM sequence: GCAGAAA
ggaggaagacagggtccggg

SEQ ID NO: 9522 - DNA, 20 bp, Artificial Sequence
  Description of Artificial Sequence: Synthetic oligonucleotide
  Target: ATXN1; (+) strand; PAM type: NNAGAAW; PAM sequence: AGAGAAT
cagggacaaagggggcagag

SEQ ID NO: 9523 - DNA, 20 bp, Artificial Sequence
  Description of Artificial Sequence: Synthetic oligonucleotide
  Target: ATXN1; (+) strand; PAM type: NNAGAAW; PAM sequence: GCAGAAT
gaggagtgcttcagagacct

SEQ ID NO: 9524 - DNA, 20 bp, Artificial Sequence
  Description of Artificial Sequence: Synthetic oligonucleotide
  Target: ATXN1; (+) strand; PAM type: NNAGAAW; PAM sequence: TCAGAAA
gcggccacagaagtttccca

SEQ ID NO: 9525 - DNA, 20 bp, Artificial Sequence
  Description of Artificial Sequence: Synthetic oligonucleotide
  Target: ATXN1; (+) strand; PAM type: NNAGAAW; PAM sequence: GGAGAAA
cagtggactttggggacttg

SEQ ID NO: 9526 - DNA, 20 bp, Artificial Sequence
  Description of Artificial Sequence: Synthetic oligonucleotide
  Target: ATXN1; (+) strand; PAM type: NNAGAAW; PAM sequence: TCAGAAA
tgatggctgcaccgaaaatc

SEQ ID NO: 9527 - DNA, 20 bp, Artificial Sequence
  Description of Artificial Sequence: Synthetic oligonucleotide
  Target: ATXN1; (+) strand; PAM type: NNAGAAW; PAM sequence: GAAGAAA
aaataaaaataaaaaagaca

SEQ ID NO: 9528 - DNA, 20 bp, Artificial Sequence
  Description of Artificial Sequence: Synthetic oligonucleotide
  Target: ATXN1; (+) strand; PAM type: NNAGAAW; PAM sequence: AGAGAAA
tcaattatattaaatgcagc

SEQ ID NO: 9529 - DNA, 20 bp, Artificial Sequence
  Description of Artificial Sequence: Synthetic oligonucleotide
  Target: ATXN1; (+) strand; PAM type: NNAGAAW; PAM sequence: ACAGAAA
atattaaatgcagcagagaa

SEQ ID NO: 9530 - DNA, 20 bp, Artificial Sequence
  Description of Artificial Sequence: Synthetic oligonucleotide
  Target: ATXN1; (+) strand; PAM type: NNAGAAW; PAM sequence: TAAGAAT
cagcagagaaacagaaagac

SEQ ID NO: 9531 - DNA, 20 bp, Artificial Sequence
  Description of Artificial Sequence: Synthetic oligonucleotide
  Target: ATXN1; (+) strand; PAM type: NNAGAAW; PAM sequence: CCAGAAT
agcttctacaagacactaac

SEQ ID NO: 9532 - DNA, 20 bp, Artificial Sequence
  Description of Artificial Sequence: Synthetic oligonucleotide
  Target: ATXN1; (+) strand; PAM type: NNAGAAW; PAM sequence: TGAGAAA
ttgaataaacatatgggctc

SEQ ID NO: 9533 - DNA, 20 bp, Artificial Sequence
  Description of Artificial Sequence: Synthetic oligonucleotide
  Target: ATXN1; (+) strand; PAM type: NNAGAAW; PAM sequence: TGAGAAA
tctaatcgtaacatattcag

SEQ ID NO: 9534 - DNA, 20 bp, Artificial Sequence
  Description of Artificial Sequence: Synthetic oligonucleotide
  Target: ATXN1; (+) strand; PAM type: NNAGAAW; PAM sequence: TTAGAAA
taaggtcaggcaaattgttg

SEQ ID NO: 9535 - DNA, 20 bp, Artificial Sequence
  Description of Artificial Sequence: Synthetic oligonucleotide
  Target: ATXN1; (+) strand; PAM type: NNAGAAW; PAM sequence: GAAGAAA
gatccagcaactttaggttt

SEQ ID NO: 9536 - DNA, 20 bp, Artificial Sequence
  Description of Artificial Sequence: Synthetic oligonucleotide
  Target: ATXN1; (+) strand; PAM type: NNAGAAW; PAM sequence: GGAGAAA
taggtttgaagaaatccagt

SEQ ID NO: 9537 - DNA, 20 bp, Artificial Sequence
  Description of Artificial Sequence: Synthetic oligonucleotide
  Target: ATXN1; (+) strand; PAM type: NNAGAAW; PAM sequence: TGAGAAA
agacgcctgaaactagcaag

SEQ ID NO: 9538 - DNA, 20 bp, Artificial Sequence
  Description of Artificial Sequence: Synthetic oligonucleotide
  Target: ATXN1; (+) strand; PAM type: NNAGAAW; PAM sequence: GGAGAAT
gaatatgtctgagcccctat

SEQ ID NO: 9539 - DNA, 20 bp, Artificial Sequence
  Description of Artificial Sequence: Synthetic oligonucleotide
  Target: ATXN1; (+) strand; PAM type: NNAGAAW; PAM sequence: GAAGAAT
taactgtctctgagaggcaa

SEQ ID NO: 9540 - DNA, 20 bp, Artificial Sequence
  Description of Artificial Sequence: Synthetic oligonucleotide
  Target: ATXN1; (+) strand; PAM type: NNAGAAW; PAM sequence: AGAGAAA
tcaggggtaacaagggtgaa

SEQ ID NO: 9541 - DNA, 20 bp, Artificial Sequence
  Description of Artificial Sequence: Synthetic oligonucleotide
  Target: ATXN1; (+) strand; PAM type: NNAGAAW; PAM sequence: GCAGAAA
ggagcttgcttcaaaccaag

SEQ ID NO: 9542 - DNA, 20 bp, Artificial Sequence
  Description of Artificial Sequence: Synthetic oligonucleotide
  Target: ATXN1; (+) strand; PAM type: NNAGAAW; PAM sequence: GGAGAAA
attaaccagttcgtgactat

SEQ ID NO: 9543 - DNA, 20 bp, Artificial Sequence
  Description of Artificial Sequence: Synthetic oligonucleotide
  Target: ATXN1; (+) strand; PAM type: NNAGAAW; PAM sequence: AGAGAAA
cctttaagtgttggagcttc

SEQ ID NO: 9544 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
atcacccccgctccggagtg

SEQ ID NO: 9545 - DNA, 20 bp, Artificial Sequence
  Description of Artificial Sequence: Synthetic oligonucleotide
  Target: ATXN1; (+) strand; PAM type: NNAGAAW; PAM sequence: GCAGAAT
aagtgttcagatcattcttt

SEQ ID NO: 9546 - DNA, 20 bp, Artificial Sequence
  Description of Artificial Sequence: Synthetic oligonucleotide
  Target: ATXN1; (+) strand; PAM type: NNAGAAW; PAM sequence: TCAGAAA
tcagttggctgttcacagtt

SEQ ID NO: 9547 - DNA, 20 bp, Artificial Sequence
  Description of Artificial Sequence: Synthetic oligonucleotide
  Target: ATXN1; (+) strand; PAM type: NNAGAAW; PAM sequence: GGAGAAA
acagtttcagaaatacaagt

SEQ ID NO: 9548 - DNA, 20 bp, Artificial Sequence
  Description of Artificial Sequence: Synthetic oligonucleotide
  Target: ATXN1; (+) strand; PAM type: NNAGAAW; PAM sequence: TCAGAAT
agtaataactgctgaggact

SEQ ID NO: 9549 - DNA, 20 bp, Artificial Sequence
  Description of Artificial Sequence: Synthetic oligonucleotide
  Target: ATXN1; (+) strand; PAM type: NNAGAAW; PAM sequence: TAAGAAA
tatggaagccatggcataaa

SEQ ID NO: 9550 - DNA, 20 bp, Artificial Sequence
  Description of Artificial Sequence: Synthetic oligonucleotide
  Target: ATXN1; (+) strand; PAM type: NNAGAAW; PAM sequence: ATAGAAT
ggcaaagttttccttcaagc

SEQ ID NO: 9551 - DNA, 20 bp, Artificial Sequence
  Description of Artificial Sequence: Synthetic oligonucleotide
  Target: ATXN1; (+) strand; PAM type: NNAGAAW; PAM sequence: CTAGAAA
gaatccatgttccgctggct

SEQ ID NO: 9552 - DNA, 20 bp, Artificial Sequence
  Description of Artificial Sequence: Synthetic oligonucleotide
  Target: ATXN1; (+) strand; PAM type: NNAGAAW; PAM sequence: ACAGAAA
tgattcagagcacctcattt

SEQ ID NO: 9553 - DNA, 20 bp, Artificial Sequence
  Description of Artificial Sequence: Synthetic oligonucleotide
  Target: ATXN1; (+) strand; PAM type: NNAGAAW; PAM sequence: TAAGAAT
ttctagatattttgaggtgg

SEQ ID NO: 9554 - DNA, 20 bp, Artificial Sequence
  Description of Artificial Sequence: Synthetic oligonucleotide
  Target: ATXN1; (+) strand; PAM type: NNAGAAW; PAM sequence: ATAGAAA
ggacccaggcattgagccca

SEQ ID NO: 9555 - DNA, 20 bp, Artificial Sequence
  Description of Artificial Sequence: Synthetic oligonucleotide
  Target: ATXN1; (+) strand; PAM type: NNAGAAW; PAM sequence: ATAGAAA
attgagcccaatagaaagcc

SEQ ID NO: 9556 - DNA, 20 bp, Artificial Sequence
  Description of Artificial Sequence: Synthetic oligonucleotide
  Target: ATXN1; (+) strand; PAM type: NNAGAAW; PAM sequence: CCAGAAT
aggcagttgctcctgtcttc

SEQ ID NO: 9557 - DNA, 20 bp, Artificial Sequence
  Description of Artificial Sequence: Synthetic oligonucleotide
  Target: ATXN1; (+) strand; PAM type: NNAGAAW; PAM sequence: ACAGAAT
gcagagcaaggagttccaaa

SEQ ID NO: 9558 - DNA, 20 bp, Artificial Sequence
  Description of Artificial Sequence: Synthetic oligonucleotide
  Target: ATXN1; (+) strand; PAM type: NNAGAAW; PAM sequence: ATAGAAA
gaaaaaaatgacataaccaa

SEQ ID NO: 9559 - DNA, 20 bp, Artificial Sequence
  Description of Artificial Sequence: Synthetic oligonucleotide
  Target: ATXN1; (+) strand; PAM type: NNAGAAW; PAM sequence: CTAGAAA
cataaccaaatagaaaatct

SEQ ID NO: 9560 - DNA, 20 bp, Artificial Sequence
  Description of Artificial Sequence: Synthetic oligonucleotide
  Target: ATXN1; (+) strand; PAM type: NNAGAAW; PAM sequence: GTAGAAA
ttaccttttccttcccagct

SEQ ID NO: 9561 - DNA, 20 bp, Artificial Sequence
  Description of Artificial Sequence: Synthetic oligonucleotide
  Target: ATXN1; (+) strand; PAM type: NNAGAAW; PAM sequence: ATAGAAT
tgctgctcttccacatttat

SEQ ID NO: 9562 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
tctgcccaacagcaatcttt

SEQ ID NO: 9563 - DNA, 20 bp, Artificial Sequence
  Description of Artificial Sequence: Synthetic oligonucleotide
  Target: ATXN1; (+) strand; PAM type: NNAGAAW; PAM sequence: CCAGAAT
aggaaatgacattatattac

SEQ ID NO: 9564 - DNA, 20 bp, Artificial Sequence
  Description of Artificial Sequence: Synthetic oligonucleotide
  Target: ATXN1; (+) strand; PAM type: NNAGAAW; PAM sequence: TTAGAAT
aatcagaagcaggaatgaat

SEQ ID NO: 9565 - DNA, 20 bp, Artificial Sequence
  Description of Artificial Sequence: Synthetic oligonucleotide
  Target: ATXN1; (+) strand; PAM type: NNAGAAW; PAM sequence: CAAGAAT
cttggattttgttagttgat

SEQ ID NO: 9566 - DNA, 20 bp, Artificial Sequence
  Description of Artificial Sequence: Synthetic oligonucleotide
  Target: ATXN1; (+) strand; PAM type: NNAGAAW; PAM sequence: GGAGAAT
ctactcgggaggctgagaca

SEQ ID NO: 9567 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
tctgtctgaaaaaaaaaaaa

SEQ ID NO: 9568 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
tgaaaaaaaaaaaaaaagaa

SEQ ID NO: 9569 - DNA, 20 bp, Artificial Sequence
  Description of Artificial Sequence: Synthetic oligonucleotide
  Target: ATXN1; (+) strand; PAM type: NNAGAAW; PAM sequence: CCAGAAT
tatccaatgggggttctgac

SEQ ID NO: 9570 - DNA, 20 bp, Artificial Sequence
  Description of Artificial Sequence: Synthetic oligonucleotide
  Target: ATXN1; (+) strand; PAM type: NNAGAAW; PAM sequence: CCAGAAA
attgtataggtcaaattttc

SEQ ID NO: 9571 - DNA, 20 bp, Artificial Sequence
  Description of Artificial Sequence: Synthetic oligonucleotide
  Target: ATXN1; (+) strand; PAM type: NNAGAAW; PAM sequence: GTAGAAA
tttccttcttttccttagaa

SEQ ID NO: 9572 - DNA, 20 bp, Artificial Sequence
  Description of Artificial Sequence: Synthetic oligonucleotide
  Target: ATXN1; (+) strand; PAM type: NNAGAAW; PAM sequence: CAAGAAT
ctccagcctgggagacagag

SEQ ID NO: 9573 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
agaatctgtctcaaaaaaaa

SEQ ID NO: 9574 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
tctgtctcaaaaaaaaaaag

SEQ ID NO: 9575 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
ctcaaaaaaaaaaagaaaga

SEQ ID NO: 9576 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
aaaaaaaaagaaagaaaaga

SEQ ID NO: 9577 - DNA, 20 bp, Artificial Sequence
  Description of Artificial Sequence: Synthetic oligonucleotide
  Target: ATXN1; (+) strand; PAM type: NNAGAAW; PAM sequence: GCAGAAT
aagaaatatactacagcatg

SEQ ID NO: 9578 - DNA, 20 bp, Artificial Sequence
  Description of Artificial Sequence: Synthetic oligonucleotide
  Target: ATXN1; (+) strand; PAM type: NNAGAAW; PAM sequence: ATAGAAA
atatactacagcatggcaga

SEQ ID NO: 9579 - DNA, 20 bp, Artificial Sequence
  Description of Artificial Sequence: Synthetic oligonucleotide
  Target: ATXN1; (+) strand; PAM type: NNAGAAW; PAM sequence: AGAGAAA
ctcaaaaccacttttatgtg

SEQ ID NO: 9580 - DNA, 20 bp, Artificial Sequence
  Description of Artificial Sequence: Synthetic oligonucleotide
  Target: ATXN1; (+) strand; PAM type: NNAGAAW; PAM sequence: TGAGAAA
ggaatagtaatgaacagact

SEQ ID NO: 9581 - DNA, 20 bp, Artificial Sequence
  Description of Artificial Sequence: Synthetic oligonucleotide
  Target: ATXN1; (+) strand; PAM type: NNAGAAW; PAM sequence: TTAGAAA
tattaattttcactggtatt

SEQ ID NO: 9582 - DNA, 20 bp, Artificial Sequence
  Description of Artificial Sequence: Synthetic oligonucleotide
  Target: ATXN1; (+) strand; PAM type: NNAGAAW; PAM sequence: ACAGAAT
atatatccctggatgctttt

SEQ ID NO: 9583 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
agtctccaacccacacagac

SEQ ID NO: 9584 - DNA, 20 bp, Artificial Sequence
  Description of Artificial Sequence: Synthetic oligonucleotide
  Target: ATXN1; (+) strand; PAM type: NNAGAAW; PAM sequence: CTAGAAA
cacggttatggcccaaaaag

SEQ ID NO: 9585 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
caatgggcatcctttcagat

SEQ ID NO: 9586 - DNA, 20 bp, Artificial Sequence
  Description of Artificial Sequence: Synthetic oligonucleotide
  Target: ATXN1; (+) strand; PAM type: NNAGAAW; PAM sequence: ACAGAAA
ttcagataaagaaatacgct

SEQ ID NO: 9587 - DNA, 20 bp, Artificial Sequence
  Description of Artificial Sequence: Synthetic oligonucleotide
  Target: ATXN1; (+) strand; PAM type: NNAGAAW; PAM sequence: GCAGAAT
atacgctacagaaatgagca

SEQ ID NO: 9588 - DNA, 20 bp, Artificial Sequence
  Description of Artificial Sequence: Synthetic oligonucleotide
  Target: ATXN1; (+) strand; PAM type: NNAGAAW; PAM sequence: CAAGAAA
tctgaaatgctaacggaagc

SEQ ID NO: 9589 - DNA, 20 bp, Artificial Sequence
  Description of Artificial Sequence: Synthetic oligonucleotide
  Target: ATXN1; (+) strand; PAM type: NNAGAAW; PAM sequence: GTAGAAA
gtccagaagcaggaactgat

SEQ ID NO: 9590 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
aaattgtttgcagtgtcgtg

SEQ ID NO: 9591 - DNA, 20 bp, Artificial Sequence
  Description of Artificial Sequence: Synthetic oligonucleotide
  Target: ATXN1; (+) strand; PAM type: NNAGAAW; PAM sequence: TAAGAAA
gaaactggcaaacacgattt

SEQ ID NO: 9592 - DNA, 20 bp, Artificial Sequence
  Description of Artificial Sequence: Synthetic oligonucleotide
  Target: ATXN1; (+) strand; PAM type: NNAGAAW; PAM sequence: GAAGAAA
gaaaagaggcaactgtgaca

SEQ ID NO: 9593 - DNA, 20 bp, Artificial Sequence
  Description of Artificial Sequence: Synthetic oligonucleotide
  Target: ATXN1; (+) strand; PAM type: NNAGAAW; PAM sequence: ACAGAAA
gtgtgatcatatgtggaaac

SEQ ID NO: 9594 - DNA, 20 bp, Artificial Sequence
  Description of Artificial Sequence: Synthetic oligonucleotide
  Target: ATXN1; (+) strand; PAM type: NNAGAAW; PAM sequence: TTAGAAT
atctatgcatgtttacaaag

SEQ ID NO: 9595 - DNA, 20 bp, Artificial Sequence
  Description of Artificial Sequence: Synthetic oligonucleotide
  Target: ATXN1; (+) strand; PAM type: NNAGAAW; PAM sequence: CTAGAAT
cacttaacattgtattgtaa

SEQ ID NO: 9596 - DNA, 20 bp, Artificial Sequence
  Description of Artificial Sequence: Synthetic oligonucleotide
  Target: ATXN1; (+) strand; PAM type: NNAGAAW; PAM sequence: GAAGAAT
ttttttaaagctagttaaag

SEQ ID NO: 9597 - DNA, 20 bp, Artificial Sequence
  Description of Artificial Sequence: Synthetic oligonucleotide
  Target: ATXN1; (+) strand; PAM type: NNAGAAW; PAM sequence: CCAGAAA
aaaggaagaatgaagtaaag

SEQ ID NO: 9598 - DNA, 20 bp, Artificial Sequence
  Description of Artificial Sequence: Synthetic oligonucleotide
  Target: ATXN1; (+) strand; PAM type: NNAGAAW; PAM sequence: TCAGAAA
actattgggagcatagagtg

SEQ ID NO: 9599 - DNA, 20 bp, Artificial Sequence
  Description of Artificial Sequence: Synthetic oligonucleotide
  Target: ATXN1; (+) strand; PAM type: NNAGAAW; PAM sequence: AGAGAAT
gcatagagtgtcagaaatta

SEQ ID NO: 9600 - DNA, 20 bp, Artificial Sequence
  Description of Artificial Sequence: Synthetic oligonucleotide
  Target: ATXN1; (+) strand; PAM type: NNAGAAW; PAM sequence: CTAGAAT
tcaatttgctttcacaccaa

SEQ ID NO: 9601 - DNA, 20 bp, Artificial Sequence
  Description of Artificial Sequence: Synthetic oligonucleotide
  Target: ATXN1; (+) strand; PAM type: NNAGAAW; PAM sequence: AAAGAAT
acaccaactagaatggtgtg

SEQ ID NO: 9602 - DNA, 20 bp, Artificial Sequence
  Description of Artificial Sequence: Synthetic oligonucleotide
  Target: ATXN1; (+) strand; PAM type: NNAGAAW; PAM sequence: TAAGAAT
gaatgatgcataccatcgtc

SEQ ID NO: 9603 - DNA, 20 bp, Artificial Sequence
  Description of Artificial Sequence: Synthetic oligonucleotide
  Target: ATXN1; (+) strand; PAM type: NNAGAAW; PAM sequence: GAAGAAA
catttcagctggtcagataa

SEQ ID NO: 9604 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
tgttaatctgctcttaaaaa

SEQ ID NO: 9605 - DNA, 20 bp, Artificial Sequence
  Description of Artificial Sequence: Synthetic oligonucleotide
  Target: ATXN1; (+) strand; PAM type: NNAGAAW; PAM sequence: TTAGAAA
cacatttttaaaattgcttt

SEQ ID NO: 9606 - DNA, 20 bp, Artificial Sequence
  Description of Artificial Sequence: Synthetic oligonucleotide
  Target: ATXN1; (+) strand; PAM type: NNAGAAW; PAM sequence: TTAGAAA
ttataaaacaggaaggaata

SEQ ID NO: 9607 - DNA, 20 bp, Artificial Sequence
  Description of Artificial Sequence: Synthetic oligonucleotide
  Target: ATXN1; (+) strand; PAM type: NNAGAAW; PAM sequence: TAAGAAA
cagacccagggccagaccaa

SEQ ID NO: 9608 - DNA, 20 bp, Artificial Sequence
  Description of Artificial Sequence: Synthetic oligonucleotide
  Target: ATXN1; (+) strand; PAM type: NNAGAAW; PAM sequence: ACAGAAA
aaaagaagccagagatatgg

SEQ ID NO: 9609 - DNA, 20 bp, Artificial Sequence
  Description of Artificial Sequence: Synthetic oligonucleotide
  Target: ATXN1; (+) strand; PAM type: NNAGAAW; PAM sequence: AGAGAAT
ggacagaaacaagaggaagg

SEQ ID NO: 9610 - DNA, 20 bp, Artificial Sequence
  Description of Artificial Sequence: Synthetic oligonucleotide
  Target: ATXN1; (+) strand; PAM type: NNAGAAW; PAM sequence: ACAGAAA
ggaaaagaagttgagaggga

SEQ ID NO: 9611 - DNA, 20 bp, Artificial Sequence
  Description of Artificial Sequence: Synthetic oligonucleotide
  Target: ATXN1; (+) strand; PAM type: NNAGAAW; PAM sequence: GTAGAAT
aacagaaaagaagtacacag

SEQ ID NO: 9612 - DNA, 20 bp, Artificial Sequence
  Description of Artificial Sequence: Synthetic oligonucleotide
  Target: ATXN1; (+) strand; PAM type: NNAGAAW; PAM sequence: GGAGAAA
agaattggtgggtgagctgt

SEQ ID NO: 9613 - DNA, 20 bp, Artificial Sequence
  Description of Artificial Sequence: Synthetic oligonucleotide
  Target: ATXN1; (+) strand; PAM type: NNAGAAW; PAM sequence: AGAGAAT
aaatgaacctgtggtagagt

SEQ ID NO: 9614 - DNA, 20 bp, Artificial Sequence
  Description of Artificial Sequence: Synthetic oligonucleotide
  Target: ATXN1; (+) strand; PAM type: NNAGAAW; PAM sequence: TTAGAAA
ataaacgtcctggccaccat

SEQ ID NO: 9615 - DNA, 20 bp, Artificial Sequence
  Description of Artificial Sequence: Synthetic oligonucleotide
  Target: ATXN1; (+) strand; PAM type: NNAGAAW; PAM sequence: GAAGAAA
aggaacttacaatccagctt

SEQ ID NO: 9616 - DNA, 20 bp, Artificial Sequence
  Description of Artificial Sequence: Synthetic oligonucleotide
  Target: ATXN1; (+) strand; PAM type: NNAGAAW; PAM sequence: TTAGAAA
ttagcaagctagagggttta

SEQ ID NO: 9617 - DNA, 20 bp, Artificial Sequence
  Description of Artificial Sequence: Synthetic oligonucleotide
  Target: ATXN1; (+) strand; PAM type: NNAGAAW; PAM sequence: AGAGAAA
tctaagtgagcatcaattaa

SEQ ID NO: 9618 - DNA, 20 bp, Artificial Sequence
  Description of Artificial Sequence: Synthetic oligonucleotide
  Target: ATXN1; (+) strand; PAM type: NNAGAAW; PAM sequence: GAAGAAA
agctggggcctgggatgaaa

SEQ ID NO: 9619 - DNA, 20 bp, Artificial Sequence
  Description of Artificial Sequence: Synthetic oligonucleotide
  Target: ATXN1; (+) strand; PAM type: NNAGAAW; PAM sequence: AGAGAAA
gaaggaggaattctgaaaga

SEQ ID NO: 9620 - DNA, 20 bp, Artificial Sequence
  Description of Artificial Sequence: Synthetic oligonucleotide
  Target: ATXN1; (+) strand; PAM type: NNAGAAW; PAM sequence: ACAGAAT
gagaaatacatctgagcaac

SEQ ID NO: 9621 - DNA, 20 bp, Artificial Sequence
  Description of Artificial Sequence: Synthetic oligonucleotide
  Target: ATXN1; (+) strand; PAM type: NNAGAAW; PAM sequence: TGAGAAT
taattctgtaggcatgcaaa

SEQ ID NO: 9622 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
agaactcagcttgggctagc

SEQ ID NO: 9623 - DNA, 20 bp, Artificial Sequence
  Description of Artificial Sequence: Synthetic oligonucleotide
  Target: ATXN1; (+) strand; PAM type: NNAGAAW; PAM sequence: GAAGAAA
tgctgcagggtgaagacaat

SEQ ID NO: 9624 - DNA, 20 bp, Artificial Sequence
  Description of Artificial Sequence: Synthetic oligonucleotide
  Target: ATXN1; (+) strand; PAM type: NNAGAAW; PAM sequence: GAAGAAA
caatgaagaaaggcaaggct

SEQ ID NO: 9625 - DNA, 20 bp, Artificial Sequence
  Description of Artificial Sequence: Synthetic oligonucleotide
  Target: ATXN1; (+) strand; PAM type: NNAGAAW; PAM sequence: GGAGAAA
catcaaaagaagaacaccaa

SEQ ID NO: 9626 - DNA, 20 bp, Artificial Sequence
  Description of Artificial Sequence: Synthetic oligonucleotide
  Target: ATXN1; (+) strand; PAM type: NNAGAAW; PAM sequence: ACAGAAA
ttccatgactaagccacttg

SEQ ID NO: 9627 - DNA, 20 bp, Artificial Sequence
  Description of Artificial Sequence: Synthetic oligonucleotide
  Target: ATXN1; (+) strand; PAM type: NNAGAAW; PAM sequence: TTAGAAT
aagaactacagctctgttac

SEQ ID NO: 9628 - DNA, 20 bp, Artificial Sequence
  Description of Artificial Sequence: Synthetic oligonucleotide
  Target: ATXN1; (+) strand; PAM type: NNAGAAW; PAM sequence: TGAGAAA
ctttattaaattttggaaca

SEQ ID NO: 9629 - DNA, 20 bp, Artificial Sequence
  Description of Artificial Sequence: Synthetic oligonucleotide
  Target: ATXN1; (+) strand; PAM type: NNAGAAW; PAM sequence: CAAGAAA
caaggtgtttccttctggca

SEQ ID NO: 9630 - DNA, 20 bp, Artificial Sequence
  Description of Artificial Sequence: Synthetic oligonucleotide
  Target: ATXN1; (+) strand; PAM type: NNAGAAW; PAM sequence: AGAGAAA
tttccttctggcacaagaaa

SEQ ID NO: 9631 - DNA, 20 bp, Artificial Sequence
  Description of Artificial Sequence: Synthetic oligonucleotide
  Target: ATXN1; (+) strand; PAM type: NNAGAAW; PAM sequence: TTAGAAA
atttcccactgggctttact

SEQ ID NO: 9632 - DNA, 20 bp, Artificial Sequence
  Description of Artificial Sequence: Synthetic oligonucleotide
  Target: ATXN1; (+) strand; PAM type: NNAGAAW; PAM sequence: ACAGAAA
aaagccctttcagtaatgtt

SEQ ID NO: 9633 - DNA, 20 bp, Artificial Sequence
  Description of Artificial Sequence: Synthetic oligonucleotide
  Target: ATXN1; (+) strand; PAM type: NNAGAAW; PAM sequence: AGAGAAA
gaaatggctataggcaaaag

SEQ ID NO: 9634 - DNA, 20 bp, Artificial Sequence
  Description of Artificial Sequence: Synthetic oligonucleotide
  Target: ATXN1; (+) strand; PAM type: NNAGAAW; PAM sequence: ACAGAAT
tttgactagcctgtctaccc

SEQ ID NO: 9635 - DNA, 20 bp, Artificial Sequence
  Description of Artificial Sequence: Synthetic oligonucleotide
  Target: ATXN1; (+) strand; PAM type: NNAGAAW; PAM sequence: GGAGAAT
gacaatttccctttatttca

SEQ ID NO: 9636 - DNA, 20 bp, Artificial Sequence
  Description of Artificial Sequence: Synthetic oligonucleotide
  Target: ATXN1; (+) strand; PAM type: NNAGAAW; PAM sequence: CGAGAAT
tccctttatttcaggagaat

SEQ ID NO: 9637 - DNA, 20 bp, Artificial Sequence
  Description of Artificial Sequence: Synthetic oligonucleotide
  Target: ATXN1; (+) strand; PAM type: NNAGAAW; PAM sequence: TTAGAAT
tggactcaaaaaaacagtct

SEQ ID NO: 9638 - DNA, 20 bp, Artificial Sequence
  Description of Artificial Sequence: Synthetic oligonucleotide
  Target: ATXN1; (+) strand; PAM type: NNAGAAW; PAM sequence: TGAGAAA
cttcccagccaccagcactg

SEQ ID NO: 9639 - DNA, 20 bp, Artificial Sequence
  Description of Artificial Sequence: Synthetic oligonucleotide
  Target: ATXN1; (+) strand; PAM type: NNAGAAW; PAM sequence: GAAGAAA
aaaatacatccacctcaaag

SEQ ID NO: 9640 - DNA, 20 bp, Artificial Sequence
  Description of Artificial Sequence: Synthetic oligonucleotide
  Target: ATXN1; (+) strand; PAM type: NNAGAAW; PAM sequence: GAAGAAT
atgagcctgcttttctgtgt

SEQ ID NO: 9641 - DNA, 20 bp, Artificial Sequence
  Description of Artificial Sequence: Synthetic oligonucleotide
  Target: ATXN1; (+) strand; PAM type: NNAGAAW; PAM sequence: CAAGAAA
tctcgcggggagacagacac

SEQ ID NO: 9642 - DNA, 20 bp, Artificial Sequence
  Description of Artificial Sequence: Synthetic oligonucleotide
  Target: ATXN1; (+) strand; PAM type: NNAGAAW; PAM sequence: GGAGAAT
ataagcacacgcagtgtttg

SEQ ID NO: 9643 - DNA, 20 bp, Artificial Sequence
  Description of Artificial Sequence: Synthetic oligonucleotide
  Target: ATXN1; (+) strand; PAM type: NNAGAAW; PAM sequence: ACAGAAT
taagggaagttcccaggagc

SEQ ID NO: 9644 - DNA, 20 bp, Artificial Sequence
  Description of Artificial Sequence: Synthetic oligonucleotide
  Target: ATXN1; (+) strand; PAM type: NNAGAAW; PAM sequence: CTAGAAA
tgtaacttgtggagccagga

SEQ ID NO: 9645 - DNA, 20 bp, Artificial Sequence
  Description of Artificial Sequence: Synthetic oligonucleotide
  Target: ATXN1; (+) strand; PAM type: NNAGAAW; PAM sequence: CAAGAAT
ttattctaagtgaagtaact

SEQ ID NO: 9646 - DNA, 20 bp, Artificial Sequence
  Description of Artificial Sequence: Synthetic oligonucleotide
  Target: ATXN1; (+) strand; PAM type: NNAGAAW; PAM sequence: TAAGAAT
gctatgaggatgcaaaggca

SEQ ID NO: 9647 - DNA, 20 bp, Artificial Sequence
  Description of Artificial Sequence: Synthetic oligonucleotide
  Target: ATXN1; (+) strand; PAM type: NNAGAAW; PAM sequence: GAAGAAT
ccttgtgatgcaacgcaact

SEQ ID NO: 9648 - DNA, 20 bp, Artificial Sequence
  Description of Artificial Sequence: Synthetic oligonucleotide
  Target: ATXN1; (+) strand; PAM type: NNAGAAW; PAM sequence: GCAGAAA
tctagaacagtgctatgcaa

SEQ ID NO: 9649 - DNA, 20 bp, Artificial Sequence
  Description of Artificial Sequence: Synthetic oligonucleotide
  Target: ATXN1; (+) strand; PAM type: NNAGAAW; PAM sequence: GGAGAAA
gcatcagcaagacgctggaa

SEQ ID NO: 9650 - DNA, 20 bp, Artificial Sequence
  Description of Artificial Sequence: Synthetic oligonucleotide
  Target: ATXN1; (+) strand; PAM type: NNAGAAW; PAM sequence: TAAGAAA
tcaataagtggcttaaaaag

SEQ ID NO: 9651 - DNA, 20 bp, Artificial Sequence
  Description of Artificial Sequence: Synthetic oligonucleotide
  Target: ATXN1; (+) strand; PAM type: NNAGAAW; PAM sequence: CAAGAAA
aaagaggaaggaaaggaaaa

SEQ ID NO: 9652 - DNA, 20 bp, Artificial Sequence
  Description of Artificial Sequence: Synthetic oligonucleotide
  Target: ATXN1; (+) strand; PAM type: NNAGAAW; PAM sequence: ATAGAAT
acacatccacccagcaggct

SEQ ID NO: 9653 - DNA, 20 bp, Artificial Sequence
  Description of Artificial Sequence: Synthetic oligonucleotide
  Target: ATXN1; (+) strand; PAM type: NNAGAAW; PAM sequence: GCAGAAA
tctgcccagatcacagatgc

SEQ ID NO: 9654 - DNA, 20 bp, Artificial Sequence
  Description of Artificial Sequence: Synthetic oligonucleotide
  Target: ATXN1; (+) strand; PAM type: NNAGAAW; PAM sequence: GGAGAAT
cctataattccagctactcg

SEQ ID NO: 9655 - DNA, 20 bp, Artificial Sequence
  Description of Artificial Sequence: Synthetic oligonucleotide
  Target: ATXN1; (+) strand; PAM type: NNAGAAW; PAM sequence: GGAGAAT
ctactcgggagaatgaggga

SEQ ID NO: 9656 - DNA, 20 bp, Artificial Sequence
  Description of Artificial Sequence: Synthetic oligonucleotide
  Target: ATXN1; (+) strand; PAM type: NNAGAAW; PAM sequence: ACAGAAT
agatttagacatggagttat

SEQ ID NO: 9657 - DNA, 20 bp, Artificial Sequence
  Description of Artificial Sequence: Synthetic oligonucleotide
  Target: ATXN1; (+) strand; PAM type: NNAGAAW; PAM sequence: GGAGAAT
cttaaaaaaatagccaggca

SEQ ID NO: 9658 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
aagagtgagactctctccct

SEQ ID NO: 9659 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
tgagactctctccctaaaga

SEQ ID NO: 9660 - DNA, 20 bp, Artificial Sequence
  Description of Artificial Sequence: Synthetic oligonucleotide
  Target: ATXN1; (+) strand; PAM type: NNAGAAW; PAM sequence: AAAGAAT
tctctccctaaagaaaagaa

SEQ ID NO: 9661 - DNA, 20 bp, Artificial Sequence
  Description of Artificial Sequence: Synthetic oligonucleotide
  Target: ATXN1; (+) strand; PAM type: NNAGAAW; PAM sequence: TTAGAAA
ccttggaaggttttgctttt

SEQ ID NO: 9662 - DNA, 20 bp, Artificial Sequence
  Description of Artificial Sequence: Synthetic oligonucleotide
  Target: ATXN1; (+) strand; PAM type: NNAGAAW; PAM sequence: TAAGAAA
tttttagaaataagattagc

SEQ ID NO: 9663 - DNA, 20 bp, Artificial Sequence
  Description of Artificial Sequence: Synthetic oligonucleotide
  Target: ATXN1; (+) strand; PAM type: NNAGAAW; PAM sequence: GGAGAAA
ttccctgggccacactggaa

SEQ ID NO: 9664 - DNA, 20 bp, Artificial Sequence
  Description of Artificial Sequence: Synthetic oligonucleotide
  Target: ATXN1; (+) strand; PAM type: NNAGAAW; PAM sequence: TCAGAAA
tagggagcatggcaccatgc

SEQ ID NO: 9665 - DNA, 20 bp, Artificial Sequence
  Description of Artificial Sequence: Synthetic oligonucleotide
  Target: ATXN1; (+) strand; PAM type: NNAGAAW; PAM sequence: AGAGAAT
cctccttagatggtgaggaa

SEQ ID NO: 9666 - DNA, 20 bp, Artificial Sequence
  Description of Artificial Sequence: Synthetic oligonucleotide
  Target: ATXN1; (+) strand; PAM type: NNAGAAW; PAM sequence: ATAGAAT
ttcacgtaatgggagaggcg

SEQ ID NO: 9667 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
aggtcagtgagtgaacacac

SEQ ID NO: 9668 - DNA, 20 bp, Artificial Sequence
  Description of Artificial Sequence: Synthetic oligonucleotide
  Target: ATXN1; (+) strand; PAM type: NNAGAAW; PAM sequence: ATAGAAA
aaagaaatgattaacctgtc

SEQ ID NO: 9669 - DNA, 20 bp, Artificial Sequence
  Description of Artificial Sequence: Synthetic oligonucleotide
  Target: ATXN1; (+) strand; PAM type: NNAGAAW; PAM sequence: AGAGAAA
taaaggaattatccgtgtaa

SEQ ID NO: 9670 - DNA, 20 bp, Artificial Sequence
  Description of Artificial Sequence: Synthetic oligonucleotide
  Target: ATXN1; (+) strand; PAM type: NNAGAAW; PAM sequence: GTAGAAT
gccaaggttatgtggggtat

SEQ ID NO: 9671 - DNA, 20 bp, Artificial Sequence
  Description of Artificial Sequence: Synthetic oligonucleotide
  Target: ATXN1; (+) strand; PAM type: NNAGAAW; PAM sequence: CAAGAAA
ttttgcacatccaggaaagc

SEQ ID NO: 9672 - DNA, 20 bp, Artificial Sequence
  Description of Artificial Sequence: Synthetic oligonucleotide
  Target: ATXN1; (+) strand; PAM type: NNAGAAW; PAM sequence: GGAGAAT
aagatatctcttgaaggtat

SEQ ID NO: 9673 - DNA, 20 bp, Artificial Sequence
  Description of Artificial Sequence: Synthetic oligonucleotide
  Target: ATXN1; (+) strand; PAM type: NNAGAAW; PAM sequence: GGAGAAA
ccatttgcacaagagatatg

SEQ ID NO: 9674 - DNA, 20 bp, Artificial Sequence
  Description of Artificial Sequence: Synthetic oligonucleotide
  Target: ATXN1; (+) strand; PAM type: NNAGAAW; PAM sequence: AGAGAAA
tactttgcctttgtgaaaga

SEQ ID NO: 9675 - DNA, 20 bp, Artificial Sequence
  Description of Artificial Sequence: Synthetic oligonucleotide
  Target: ATXN1; (+) strand; PAM type: NNAGAAW; PAM sequence: AAAGAAT
aaatagcttgcaacttattc

SEQ ID NO: 9676 - DNA, 20 bp, Artificial Sequence
  Description of Artificial Sequence: Synthetic oligonucleotide
  Target: ATXN1; (+) strand; PAM type: NNAGAAW; PAM sequence: TAAGAAT
tttgcaaaggcacaagattg

SEQ ID NO: 9677 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
actcttaacacttttacatg

SEQ ID NO: 9678 - DNA, 20 bp, Artificial Sequence
  Description of Artificial Sequence: Synthetic oligonucleotide
  Target: ATXN1; (+) strand; PAM type: NNAGAAW; PAM sequence: GGAGAAA
tttacatgaaagaaatgcaa

SEQ ID NO: 9679 - DNA, 20 bp, Artificial Sequence
  Description of Artificial Sequence: Synthetic oligonucleotide
  Target: ATXN1; (+) strand; PAM type: NNAGAAW; PAM sequence: CTAGAAA
tatgtggatatcgtgtgcct

SEQ ID NO: 9680 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
gtataatggtaacaaaaata

SEQ ID NO: 9681 - DNA, 20 bp, Artificial Sequence
  Description of Artificial Sequence: Synthetic oligonucleotide
  Target: ATXN1; (+) strand; PAM type: NNAGAAW; PAM sequence: GAAGAAA
gtaacaaaaataaaagaaat

SEQ ID NO: 9682 - DNA, 20 bp, Artificial Sequence
  Description of Artificial Sequence: Synthetic oligonucleotide
  Target: ATXN1; (+) strand; PAM type: NNAGAAW; PAM sequence: AGAGAAA
ggactaaaagatgtacatag

SEQ ID NO: 9683 - DNA, 20 bp, Artificial Sequence
  Description of Artificial Sequence: Synthetic oligonucleotide
  Target: ATXN1; (+) strand; PAM type: NNAGAAW; PAM sequence: TCAGAAA
cattgctccctatagggtca

SEQ ID NO: 9684 - DNA, 20 bp, Artificial Sequence
  Description of Artificial Sequence: Synthetic oligonucleotide
  Target: ATXN1; (+) strand; PAM type: NNAGAAW; PAM sequence: AAAGAAT
ccactgacagtctcttaacc

SEQ ID NO: 9685 - DNA, 20 bp, Artificial Sequence
  Description of Artificial Sequence: Synthetic oligonucleotide
  Target: ATXN1; (+) strand; PAM type: NNAGAAW; PAM sequence: GGAGAAA
gcttttgaaataaggatgca

SEQ ID NO: 9686 - DNA, 20 bp, Artificial Sequence
  Description of Artificial Sequence: Synthetic oligonucleotide
  Target: ATXN1; (+) strand; PAM type: NNAGAAW; PAM sequence: TCAGAAA
tcagcattttatggaccata

SEQ ID NO: 9687 - DNA, 20 bp, Artificial Sequence
  Description of Artificial Sequence: Synthetic oligonucleotide
  Target: ATXN1; (+) strand; PAM type: NNAGAAW; PAM sequence: TCAGAAA
ctggcatgattcaataagat

SEQ ID NO: 9688 - DNA, 20 bp, Artificial Sequence
  Description of Artificial Sequence: Synthetic oligonucleotide
  Target: ATXN1; (+) strand; PAM type: NNAGAAW; PAM sequence: TAAGAAA
gtaagctctggatatgactg

SEQ ID NO: 9689 - DNA, 20 bp, Artificial Sequence
  Description of Artificial Sequence: Synthetic oligonucleotide
  Target: ATXN1; (+) strand; PAM type: NNAGAAW; PAM sequence: GGAGAAT
ctactcgggaggctgaggca

SEQ ID NO: 9690 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
gagactccatctccaaaaaa

SEQ ID NO: 9691 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
aaaaagaaaaaaaaaaaagg

SEQ ID NO: 9692 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
atgtggtttatgcagttcta

SEQ ID NO: 9693 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
ctcattttccttctggagga

SEQ ID NO: 9694 - DNA, 20 bp, Artificial Sequence
  Description of Artificial Sequence: Synthetic oligonucleotide
  Target: ATXN1; (+) strand; PAM type: NNAGAAW; PAM sequence: CAAGAAA
aaaattagatttccttactg

SEQ ID NO: 9695 - DNA, 20 bp, Artificial Sequence
  Description of Artificial Sequence: Synthetic oligonucleotide
  Target: ATXN1; (+) strand; PAM type: NNAGAAW; PAM sequence: GGAGAAT
ctaatcaggaggctgaggca

SEQ ID NO: 9696 - DNA, 20 bp, Artificial Sequence
  Description of Artificial Sequence: Synthetic oligonucleotide
  Target: ATXN1; (+) strand; PAM type: NNAGAAW; PAM sequence: CAAGAAA
ttatgaaggtcttctgaaaa

SEQ ID NO: 9697 - DNA, 20 bp, Artificial Sequence
  Description of Artificial Sequence: Synthetic oligonucleotide
  Target: ATXN1; (+) strand; PAM type: NNAGAAW; PAM sequence: TCAGAAT
ttctcaaacatggctgccca

SEQ ID NO: 9698 - DNA, 20 bp, Artificial Sequence
  Description of Artificial Sequence: Synthetic oligonucleotide
  Target: ATXN1; (+) strand; PAM type: NNAGAAW; PAM sequence: GAAGAAT
tggcaagagagagttttcag

SEQ ID NO: 9699 - DNA, 20 bp, Artificial Sequence
  Description of Artificial Sequence: Synthetic oligonucleotide
  Target: ATXN1; (+) strand; PAM type: NNAGAAW; PAM sequence: AGAGAAA
aggggcaggcaccaggaggc

SEQ ID NO: 9700 - DNA, 20 bp, Artificial Sequence
  Description of Artificial Sequence: Synthetic oligonucleotide
  Target: ATXN1; (+) strand; PAM type: NNAGAAW; PAM sequence: GCAGAAA
cagagaaacagagctgggtg

SEQ ID NO: 9701 - DNA, 20 bp, Artificial Sequence
  Description of Artificial Sequence: Synthetic oligonucleotide
  Target: ATXN1; (+) strand; PAM type: NNAGAAW; PAM sequence: GCAGAAA
ctttgcctgcctggttggca

SEQ ID NO: 9702 - DNA, 20 bp, Artificial Sequence
  Description of Artificial Sequence: Synthetic oligonucleotide
  Target: ATXN1; (+) strand; PAM type: NNAGAAW; PAM sequence: ACAGAAA
cccagctgatacccatggat

SEQ ID NO: 9703 - DNA, 20 bp, Artificial Sequence
  Description of Artificial Sequence: Synthetic oligonucleotide
  Target: ATXN1; (+) strand; PAM type: NNAGAAW; PAM sequence: GAAGAAT
gacttacgaatgatcacaga

SEQ ID NO: 9704 - DNA, 20 bp, Artificial Sequence
  Description of Artificial Sequence: Synthetic oligonucleotide
  Target: ATXN1; (+) strand; PAM type: NNAGAAW; PAM sequence: CCAGAAA
gaacccttaaggatagatag

SEQ ID NO: 9705 - DNA, 20 bp, Artificial Sequence
  Description of Artificial Sequence: Synthetic oligonucleotide
  Target: ATXN1; (+) strand; PAM type: NNAGAAW; PAM sequence: CTAGAAT
tctcttcttgggaatatttt

SEQ ID NO: 9706 - DNA, 20 bp, Artificial Sequence
  Description of Artificial Sequence: Synthetic oligonucleotide
  Target: ATXN1; (+) strand; PAM type: NNAGAAW; PAM sequence: GAAGAAA
gtcttctcttaaggaccaaa

SEQ ID NO: 9707 - DNA, 20 bp, Artificial Sequence
  Description of Artificial Sequence: Synthetic oligonucleotide
  Target: ATXN1; (+) strand; PAM type: NNAGAAW; PAM sequence: AGAGAAT
tagccaaagagatatgcagt

SEQ ID NO: 9708 - DNA, 20 bp, Artificial Sequence
  Description of Artificial Sequence: Synthetic oligonucleotide
  Target: ATXN1; (+) strand; PAM type: NNAGAAW; PAM sequence: ACAGAAA
agacagccagtccaaagtcc

SEQ ID NO: 9709 - DNA, 20 bp, Artificial Sequence
  Description of Artificial Sequence: Synthetic oligonucleotide
  Target: ATXN1; (+) strand; PAM type: NNAGAAW; PAM sequence: GGAGAAA
ttgtactgtaacacagccaa

SEQ ID NO: 9710 - DNA, 20 bp, Artificial Sequence
  Description of Artificial Sequence: Synthetic oligonucleotide
  Target: ATXN1; (+) strand; PAM type: NNAGAAW; PAM sequence: GGAGAAA
gagaccagtcggaccaacat

SEQ ID NO: 9711 - DNA, 20 bp, Artificial Sequence
  Description of Artificial Sequence: Synthetic oligonucleotide
  Target: ATXN1; (+) strand; PAM type: NNAGAAW; PAM sequence: GGAGAAT
ctactcaggaggctgaggca

SEQ ID NO: 9712 - DNA, 20 bp, Artificial Sequence
  Description of Artificial Sequence: Synthetic oligonucleotide
  Target: ATXN1; (+) strand; PAM type: NNAGAAW; PAM sequence: TAAGAAA
gagtggactctttctaccta

SEQ ID NO: 9713 - DNA, 20 bp, Artificial Sequence
  Description of Artificial Sequence: Synthetic oligonucleotide
  Target: ATXN1; (+) strand; PAM type: NNAGAAW; PAM sequence: GAAGAAT
ctcttcgggtggctgaggca

SEQ ID NO: 9714 - DNA, 20 bp, Artificial Sequence
  Description of Artificial Sequence: Synthetic oligonucleotide
  Target: ATXN1; (+) strand; PAM type: NNAGAAW; PAM sequence: ACAGAAA
tgtttgtgtcttagttttta

SEQ ID NO: 9715 - DNA, 20 bp, Artificial Sequence
  Description of Artificial Sequence: Synthetic oligonucleotide
  Target: ATXN1; (+) strand; PAM type: NNAGAAW; PAM sequence: TAAGAAA
aaaaaaaaaactttttttaa

SEQ ID NO: 9716 - DNA, 20 bp, Artificial Sequence
  Description of Artificial Sequence: Synthetic oligonucleotide
  Target: ATXN1; (+) strand; PAM type: NNAGAAW; PAM sequence: ATAGAAT
gtttctacaaaaacaagctt

SEQ ID NO: 9717 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
agcttatagaataaagatat

SEQ ID NO: 9718 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
tatagaataaagatataaag

SEQ ID NO: 9719 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
agcgtggttaatttattatc

SEQ ID NO: 9720 - DNA, 20 bp, Artificial Sequence
  Description of Artificial Sequence: Synthetic oligonucleotide
  Target: ATXN1; (+) strand; PAM type: NNAGAAW; PAM sequence: TCAGAAT
acgatgtaaggatgcatttc

SEQ ID NO: 9721 - DNA, 20 bp, Artificial Sequence
  Description of Artificial Sequence: Synthetic oligonucleotide
  Target: ATXN1; (+) strand; PAM type: NNAGAAW; PAM sequence: ACAGAAA
acagtgagagtatttatatt

SEQ ID NO: 9722 - DNA, 20 bp, Artificial Sequence
  Description of Artificial Sequence: Synthetic oligonucleotide
  Target: ATXN1; (+) strand; PAM type: NNAGAAW; PAM sequence: TCAGAAA
gctactgaaatcagtctgac

SEQ ID NO: 9723 - DNA, 20 bp, Artificial Sequence
  Description of Artificial Sequence: Synthetic oligonucleotide
  Target: ATXN1; (+) strand; PAM type: NNAGAAW; PAM sequence: CAAGAAT
tgtgttggcaagaactcaca

SEQ ID NO: 9724 - DNA, 20 bp, Artificial Sequence
  Description of Artificial Sequence: Synthetic oligonucleotide
  Target: ATXN1; (+) strand; PAM type: NNAGAAW; PAM sequence: ACAGAAT
tatcatccttcaccacggcc

SEQ ID NO: 9725 - DNA, 20 bp, Artificial Sequence
  Description of Artificial Sequence: Synthetic oligonucleotide
  Target: ATXN1; (+) strand; PAM type: NNAGAAW; PAM sequence: CCAGAAA
tgcatagacaggactcaaat

SEQ ID NO: 9726 - DNA, 20 bp, Artificial Sequence
  Description of Artificial Sequence: Synthetic oligonucleotide
  Target: ATXN1; (+) strand; PAM type: NNAGAAW; PAM sequence: GCAGAAA
agctcccttcctgcccaaag

SEQ ID NO: 9727 - DNA, 20 bp, Artificial Sequence
  Description of Artificial Sequence: Synthetic oligonucleotide
  Target: ATXN1; (+) strand; PAM type: NNAGAAW; PAM sequence: AAAGAAT
aaatagaagtaatcgtgaat

SEQ ID NO: 9728 - DNA, 20 bp, Artificial Sequence
  Description of Artificial Sequence: Synthetic oligonucleotide
  Target: ATXN1; (+) strand; PAM type: NNAGAAW; PAM sequence: GAAGAAA
aggagttatacagcaaaaaa

SEQ ID NO: 9729 - DNA, 20 bp, Artificial Sequence
  Description of Artificial Sequence: Synthetic oligonucleotide
  Target: ATXN1; (+) strand; PAM type: NNAGAAW; PAM sequence: GAAGAAT
ctaaatcctgggaaaaatgt

SEQ ID NO: 9730 - DNA, 20 bp, Artificial Sequence
  Description of Artificial Sequence: Synthetic oligonucleotide
  Target: ATXN1; (+) strand; PAM type: NNAGAAW; PAM sequence: TCAGAAA
aggtaggttttctttggctt

SEQ ID NO: 9731 - DNA, 20 bp, Artificial Sequence
  Description of Artificial Sequence: Synthetic oligonucleotide
  Target: ATXN1; (+) strand; PAM type: NNAGAAW; PAM sequence: AGAGAAA
aaatgtggcagtgaatgcac

SEQ ID NO: 9732 - DNA, 20 bp, Artificial Sequence
  Description of Artificial Sequence: Synthetic oligonucleotide
  Target: ATXN1; (+) strand; PAM type: NNAGAAW; PAM sequence: ACAGAAA
ctttctcaacatttctaaag

SEQ ID NO: 9733 - DNA, 20 bp, Artificial Sequence
  Description of Artificial Sequence: Synthetic oligonucleotide
  Target: ATXN1; (+) strand; PAM type: NNAGAAW; PAM sequence: GCAGAAA
attccctgctctaaagggaa

SEQ ID NO: 9734 - DNA, 20 bp, Artificial Sequence
  Description of Artificial Sequence: Synthetic oligonucleotide
  Target: ATXN1; (+) strand; PAM type: NNAGAAW; PAM sequence: AGAGAAT
agaaaagatcagctgcagcc

SEQ ID NO: 9735 - DNA, 20 bp, Artificial Sequence
  Description of Artificial Sequence: Synthetic oligonucleotide
  Target: ATXN1; (+) strand; PAM type: NNAGAAW; PAM sequence: GCAGAAT
ctagggagcatgtgggaaat

SEQ ID NO: 9736 - DNA, 20 bp, Artificial Sequence
  Description of Artificial Sequence: Synthetic oligonucleotide
  Target: ATXN1; (+) strand; PAM type: NNAGAAW; PAM sequence: CCAGAAT
tcccacccagactgacagaa

SEQ ID NO: 9737 - DNA, 20 bp, Artificial Sequence
  Description of Artificial Sequence: Synthetic oligonucleotide
  Target: ATXN1; (+) strand; PAM type: NNAGAAW; PAM sequence: CAAGAAT
tatgtggatgacatcttaca

SEQ ID NO: 9738 - DNA, 20 bp, Artificial Sequence
  Description of Artificial Sequence: Synthetic oligonucleotide
  Target: ATXN1; (+) strand; PAM type: NNAGAAW; PAM sequence: AGAGAAA
agcttcgggaattacaagcc

SEQ ID NO: 9739 - DNA, 20 bp, Artificial Sequence
  Description of Artificial Sequence: Synthetic oligonucleotide
  Target: ATXN1; (+) strand; PAM type: NNAGAAW; PAM sequence: GAAGAAA
cagggccaatccgtggaaat

SEQ ID NO: 9740 - DNA, 20 bp, Artificial Sequence
  Description of Artificial Sequence: Synthetic oligonucleotide
  Target: ATXN1; (+) strand; PAM type: NNAGAAW; PAM sequence: TTAGAAA
tcccttcctttttaaaaaga

SEQ ID NO: 9741 - DNA, 20 bp, Artificial Sequence
  Description of Artificial Sequence: Synthetic oligonucleotide
  Target: ATXN1; (+) strand; PAM type: NNAGAAW; PAM sequence: GGAGAAA
ccaggaggtcaagatcagcc

SEQ ID NO: 9742 - DNA, 20 bp, Artificial Sequence
  Description of Artificial Sequence: Synthetic oligonucleotide
  Target: ATXN1; (+) strand; PAM type: NNAGAAW; PAM sequence: GGAGAAT
gctactcagaggctgagggt

SEQ ID NO: 9743 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
ccgagactgagcaatttaca

SEQ ID NO: 9744 - DNA, 20 bp, Artificial Sequence
  Description of Artificial Sequence: Synthetic oligonucleotide
  Target: ATXN1; (+) strand; PAM type: NNAGAAW; PAM sequence: TCAGAAT
gtcattaatttctctagaac

SEQ ID NO: 9745 - DNA, 20 bp, Artificial Sequence
  Description of Artificial Sequence: Synthetic oligonucleotide
  Target: ATXN1; (+) strand; PAM type: NNAGAAW; PAM sequence: ACAGAAA
agaacaacagaagaggagag

SEQ ID NO: 9746 - DNA, 20 bp, Artificial Sequence
  Description of Artificial Sequence: Synthetic oligonucleotide
  Target: ATXN1; (+) strand; PAM type: NNAGAAW; PAM sequence: GCAGAAA
agggctgttgtctcactgtt

SEQ ID NO: 9747 - DNA, 20 bp, Artificial Sequence
  Description of Artificial Sequence: Synthetic oligonucleotide
  Target: ATXN1; (+) strand; PAM type: NNAGAAW; PAM sequence: ACAGAAA
tcaaacgttatcttaactcc

SEQ ID NO: 9748 - DNA, 20 bp, Artificial Sequence
  Description of Artificial Sequence: Synthetic oligonucleotide
  Target: ATXN1; (+) strand; PAM type: NNAGAAW; PAM sequence: TCAGAAA
acatgtacacacacatacac

SEQ ID NO: 9749 - DNA, 20 bp, Artificial Sequence
  Description of Artificial Sequence: Synthetic oligonucleotide
  Target: ATXN1; (+) strand; PAM type: NNAGAAW; PAM sequence: CCAGAAT
gactgggactctggcaggaa

SEQ ID NO: 9750 - DNA, 20 bp, Artificial Sequence
  Description of Artificial Sequence: Synthetic oligonucleotide
  Target: ATXN1; (+) strand; PAM type: NNAGAAW; PAM sequence: CCAGAAT
aatgcatcatcaccttcacg

SEQ ID NO: 9751 - DNA, 20 bp, Artificial Sequence
  Description of Artificial Sequence: Synthetic oligonucleotide
  Target: ATXN1; (+) strand; PAM type: NNAGAAW; PAM sequence: AAAGAAT
tactctccctgctatggtta

SEQ ID NO: 9752 - DNA, 20 bp, Artificial Sequence
  Description of Artificial Sequence: Synthetic oligonucleotide
  Target: ATXN1; (+) strand; PAM type: NNAGAAW; PAM sequence: GCAGAAA
ttcttggagagttctttaaa

SEQ ID NO: 9753 - DNA, 20 bp, Artificial Sequence
  Description of Artificial Sequence: Synthetic oligonucleotide
  Target: ATXN1; (+) strand; PAM type: NNAGAAW; PAM sequence: GGAGAAT
tcagtccctcaccttttcct

SEQ ID NO: 9754 - DNA, 20 bp, Artificial Sequence
  Description of Artificial Sequence: Synthetic oligonucleotide
  Target: ATXN1; (+) strand; PAM type: NNAGAAW; PAM sequence: ACAGAAA
agtgctcctcagcacacacg

SEQ ID NO: 9755 - DNA, 20 bp, Artificial Sequence
  Description of Artificial Sequence: Synthetic oligonucleotide
  Target: ATXN1; (+) strand; PAM type: NNAGAAW; PAM sequence: AGAGAAA
tctcagggagctgggagcaa

SEQ ID NO: 9756 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
cattaaatttactggcggtg

SEQ ID NO: 9757 - DNA, 20 bp, Artificial Sequence
  Description of Artificial Sequence: Synthetic oligonucleotide
  Target: ATXN1; (+) strand; PAM type: NNAGAAW; PAM sequence: TCAGAAA
ttactgcacaatgttcactc

SEQ ID NO: 9758 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
tgcacaatgttcactctcag

SEQ ID NO: 9759 - DNA, 20 bp, Artificial Sequence
  Description of Artificial Sequence: Synthetic oligonucleotide
  Target: ATXN1; (+) strand; PAM type: NNAGAAW; PAM sequence: CAAGAAT
cccaagttaaataatttttt

SEQ ID NO: 9760 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
aaatatctgctagctgtaat

SEQ ID NO: 9761 - DNA, 20 bp, Artificial Sequence
  Description of Artificial Sequence: Synthetic oligonucleotide
  Target: ATXN1; (+) strand; PAM type: NNAGAAW; PAM sequence: ACAGAAT
gctagccattcgggacaaat

SEQ ID NO: 9762 - DNA, 20 bp, Artificial Sequence
  Description of Artificial Sequence: Synthetic oligonucleotide
  Target: ATXN1; (+) strand; PAM type: NNAGAAW; PAM sequence: GCAGAAA
ctggcaagtgtaccctttct

SEQ ID NO: 9763 - DNA, 20 bp, Artificial Sequence
  Description of Artificial Sequence: Synthetic oligonucleotide
  Target: ATXN1; (+) strand; PAM type: NNAGAAW; PAM sequence: CTAGAAA
ggcacagttgtggagttagg

SEQ ID NO: 9764 - DNA, 20 bp, Artificial Sequence
  Description of Artificial Sequence: Synthetic oligonucleotide
  Target: ATXN1; (+) strand; PAM type: NNAGAAW; PAM sequence: GAAGAAA
cctgtttgatgagcctcctg

SEQ ID NO: 9765 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
tgatgagcctcctggaagaa

SEQ ID NO: 9766 - DNA, 20 bp, Artificial Sequence
  Description of Artificial Sequence: Synthetic oligonucleotide
  Target: ATXN1; (+) strand; PAM type: NNAGAAW; PAM sequence: GCAGAAA
aaccctcatgacatcacagg

SEQ ID NO: 9767 - DNA, 20 bp, Artificial Sequence
  Description of Artificial Sequence: Synthetic oligonucleotide
  Target: ATXN1; (+) strand; PAM type: NNAGAAW; PAM sequence: TGAGAAT
gtgagaaccctggaagaaga

SEQ ID NO: 9768 - DNA, 20 bp, Artificial Sequence
  Description of Artificial Sequence: Synthetic oligonucleotide
  Target: ATXN1; (+) strand; PAM type: NNAGAAW; PAM sequence: AAAGAAT
attggtgactgaacaaataa

SEQ ID NO: 9769 - DNA, 20 bp, Artificial Sequence
  Description of Artificial Sequence: Synthetic oligonucleotide
  Target: ATXN1; (+) strand; PAM type: NNAGAAW; PAM sequence: ATAGAAA
tacctcagtcatttaaccta

SEQ ID NO: 9770 - DNA, 20 bp, Artificial Sequence
  Description of Artificial Sequence: Synthetic oligonucleotide
  Target: ATXN1; (+) strand; PAM type: NNAGAAW; PAM sequence: GCAGAAT
ttttaaaagcttccagacgt

SEQ ID NO: 9771 - DNA, 20 bp, Artificial Sequence
  Description of Artificial Sequence: Synthetic oligonucleotide
  Target: ATXN1; (+) strand; PAM type: NNAGAAW; PAM sequence: CTAGAAT
gggtgcaatcatttgtttta

SEQ ID NO: 9772 - DNA, 20 bp, Artificial Sequence
  Description of Artificial Sequence: Synthetic oligonucleotide
  Target: ATXN1; (+) strand; PAM type: NNAGAAW; PAM sequence: TCAGAAT
tccaatgaactacaagcttg

SEQ ID NO: 9773 - DNA, 20 bp, Artificial Sequence
  Description of Artificial Sequence: Synthetic oligonucleotide
  Target: ATXN1; (+) strand; PAM type: NNAGAAW; PAM sequence: GGAGAAT
ctacttgggaggctgaggca

SEQ ID NO: 9774 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
gtcaaaaaaaaaaaaaaaaa

SEQ ID NO: 9775 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
aaaaaaaaaaaaaaaaaaga

SEQ ID NO: 9776 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
aaaaaaaaaaaaagaaaaga

SEQ ID NO: 9777 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
aaaaaaaagaaaagaaaaga

SEQ ID NO: 9778 - DNA, 20 bp, Artificial Sequence
  Description of Artificial Sequence: Synthetic oligonucleotide
  Target: ATXN1; (+) strand; PAM type: NNAGAAW; PAM sequence: GGAGAAA
atcaggatttaagacattgg

SEQ ID NO: 9779 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
ggatttaagacattggggag

SEQ ID NO: 9780 - DNA, 20 bp, Artificial Sequence
  Description of Artificial Sequence: Synthetic oligonucleotide
  Target: ATXN1; (+) strand; PAM type: NNAGAAW; PAM sequence: GGAGAAA
ctgcccatagctggcctggg

SEQ ID NO: 9781 - DNA, 20 bp, Artificial Sequence
  Description of Artificial Sequence: Synthetic oligonucleotide
  Target: ATXN1; (+) strand; PAM type: NNAGAAW; PAM sequence: ATAGAAT
gattcactgaattgtgaact

SEQ ID NO: 9782 - DNA, 20 bp, Artificial Sequence
  Description of Artificial Sequence: Synthetic oligonucleotide
  Target: ATXN1; (+) strand; PAM type: NNAGAAW; PAM sequence: GGAGAAA
gaatatgaaccctgtcaata

SEQ ID NO: 9783 - DNA, 20 bp, Artificial Sequence
  Description of Artificial Sequence: Synthetic oligonucleotide
  Target: ATXN1; (+) strand; PAM type: NNAGAAW; PAM sequence: CAAGAAA
tttcacccggaaactcaaaa

SEQ ID NO: 9784 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
atactaattttctctttcca

SEQ ID NO: 9785 - DNA, 20 bp, Artificial Sequence
  Description of Artificial Sequence: Synthetic oligonucleotide
  Target: ATXN1; (+) strand; PAM type: NNAGAAW; PAM sequence: TCAGAAA
acggcaacagcgtcagtttc

SEQ ID NO: 9786 - DNA, 20 bp, Artificial Sequence
  Description of Artificial Sequence: Synthetic oligonucleotide
  Target: ATXN1; (+) strand; PAM type: NNAGAAW; PAM sequence: GAAGAAA
ccccacttcaatggacaata

SEQ ID NO: 9787 - DNA, 20 bp, Artificial Sequence
  Description of Artificial Sequence: Synthetic oligonucleotide
  Target: ATXN1; (+) strand; PAM type: NNAGAAW; PAM sequence: TAAGAAA
ggatgccctcacccacaccc

SEQ ID NO: 9788 - DNA, 20 bp, Artificial Sequence
  Description of Artificial Sequence: Synthetic oligonucleotide
  Target: ATXN1; (+) strand; PAM type: NNAGAAW; PAM sequence: GAAGAAA
aggtctctatctattcacaa

SEQ ID NO: 9789 - DNA, 20 bp, Artificial Sequence
  Description of Artificial Sequence: Synthetic oligonucleotide
  Target: ATXN1; (+) strand; PAM type: NNAGAAW; PAM sequence: TTAGAAA
taaaccattcccaaactatg

SEQ ID NO: 9790 - DNA, 20 bp, Artificial Sequence
  Description of Artificial Sequence: Synthetic oligonucleotide
  Target: ATXN1; (+) strand; PAM type: NNAGAAW; PAM sequence: GAAGAAA
tcccaaactatgttagaaat

SEQ ID NO: 9791 - DNA, 20 bp, Artificial Sequence
  Description of Artificial Sequence: Synthetic oligonucleotide
  Target: ATXN1; (+) strand; PAM type: NNAGAAW; PAM sequence: GTAGAAA
tcctcacacaaccctacaaa

SEQ ID NO: 9792 - DNA, 20 bp, Artificial Sequence
  Description of Artificial Sequence: Synthetic oligonucleotide
  Target: ATXN1; (+) strand; PAM type: NNAGAAW; PAM sequence: GCAGAAT
acagttagcacattatggat

SEQ ID NO: 9793 - DNA, 20 bp, Artificial Sequence
  Description of Artificial Sequence: Synthetic oligonucleotide
  Target: ATXN1; (+) strand; PAM type: NNAGAAW; PAM sequence: GGAGAAA
gacatgatgtttgggtgtct

SEQ ID NO: 9794 - DNA, 20 bp, Artificial Sequence
  Description of Artificial Sequence: Synthetic oligonucleotide
  Target: ATXN1; (+) strand; PAM type: NNAGAAW; PAM sequence: TCAGAAT
ggccttcattctctctccac

SEQ ID NO: 9795 - DNA, 20 bp, Artificial Sequence
  Description of Artificial Sequence: Synthetic oligonucleotide
  Target: ATXN1; (+) strand; PAM type: NNAGAAW; PAM sequence: TAAGAAA
gaattcactttaagctatta

SEQ ID NO: 9796 - DNA, 20 bp, Artificial Sequence
  Description of Artificial Sequence: Synthetic oligonucleotide
  Target: ATXN1; (+) strand; PAM type: NNAGAAW; PAM sequence: AGAGAAT
cacaatttgtagcatctgaa

SEQ ID NO: 9797 - DNA, 20 bp, Artificial Sequence
  Description of Artificial Sequence: Synthetic oligonucleotide
  Target: ATXN1; (+) strand; PAM type: NNAGAAW; PAM sequence: CCAGAAA
tcaggcattgtaccaagggc

SEQ ID NO: 9798 - DNA, 20 bp, Artificial Sequence
  Description of Artificial Sequence: Synthetic oligonucleotide
  Target: ATXN1; (+) strand; PAM type: NNAGAAW; PAM sequence: GAAGAAA
tcttggtttgtacaacagaa

SEQ ID NO: 9799 - DNA, 20 bp, Artificial Sequence
  Description of Artificial Sequence: Synthetic oligonucleotide
  Target: ATXN1; (+) strand; PAM type: NNAGAAW; PAM sequence: ATAGAAA
aatatatggaatataataaa

SEQ ID NO: 9800 - DNA, 20 bp, Artificial Sequence
  Description of Artificial Sequence: Synthetic oligonucleotide
  Target: ATXN1; (+) strand; PAM type: NNAGAAW; PAM sequence: AGAGAAA
aaaaccagagcagaagtagc

SEQ ID NO: 9801 - DNA, 20 bp, Artificial Sequence
  Description of Artificial Sequence: Synthetic oligonucleotide
  Target: ATXN1; (+) strand; PAM type: NNAGAAW; PAM sequence: ACAGAAT
cttcatgctgtaggtaggga

SEQ ID NO: 9802 - DNA, 20 bp, Artificial Sequence
  Description of Artificial Sequence: Synthetic oligonucleotide
  Target: ATXN1; (+) strand; PAM type: NNAGAAW; PAM sequence: TCAGAAT
aatcgtttttttccctccct

SEQ ID NO: 9803 - DNA, 20 bp, Artificial Sequence
  Description of Artificial Sequence: Synthetic oligonucleotide
  Target: ATXN1; (+) strand; PAM type: NNAGAAW; PAM sequence: GGAGAAT
cctcccttcagaatgagtgg

SEQ ID NO: 9804 - DNA, 20 bp, Artificial Sequence
  Description of Artificial Sequence: Synthetic oligonucleotide
  Target: ATXN1; (+) strand; PAM type: NNAGAAW; PAM sequence: TAAGAAA
atagtgcaaactataaaata

SEQ ID NO: 9805 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
ttcatagggagatgtttcct

SEQ ID NO: 9806 - DNA, 20 bp, Artificial Sequence
  Description of Artificial Sequence: Synthetic oligonucleotide
  Target: ATXN1; (+) strand; PAM type: NNAGAAW; PAM sequence: GCAGAAA
aggcctttagtttccataaa

SEQ ID NO: 9807 - DNA, 20 bp, Artificial Sequence
  Description of Artificial Sequence: Synthetic oligonucleotide
  Target: ATXN1; (+) strand; PAM type: NNAGAAW; PAM sequence: GTAGAAT
cgtgtatcattgcatactca

SEQ ID NO: 9808 - DNA, 20 bp, Artificial Sequence
  Description of Artificial Sequence: Synthetic oligonucleotide
  Target: ATXN1; (+) strand; PAM type: NNAGAAW; PAM sequence: GCAGAAT
gttatggcttttaatggaaa

SEQ ID NO: 9809 - DNA, 20 bp, Artificial Sequence
  Description of Artificial Sequence: Synthetic oligonucleotide
  Target: ATXN1; (+) strand; PAM type: NNAGAAW; PAM sequence: TAAGAAA
gcttttaatggaaagcagaa

SEQ ID NO: 9810 - DNA, 20 bp, Artificial Sequence
  Description of Artificial Sequence: Synthetic oligonucleotide
  Target: ATXN1; (+) strand; PAM type: NNAGAAW; PAM sequence: GAAGAAA
tgatgccattcatgcttgaa

SEQ ID NO: 9811 - DNA, 20 bp, Artificial Sequence
  Description of Artificial Sequence: Synthetic oligonucleotide
  Target: ATXN1; (+) strand; PAM type: NNAGAAW; PAM sequence: AAAGAAT
cttaaaatgctcattaaatg

SEQ ID NO: 9812 - DNA, 20 bp, Artificial Sequence
  Description of Artificial Sequence: Synthetic oligonucleotide
  Target: ATXN1; (+) strand; PAM type: NNAGAAW; PAM sequence: ACAGAAA
caaaaactccttgcatttgt

SEQ ID NO: 9813 - DNA, 20 bp, Artificial Sequence
  Description of Artificial Sequence: Synthetic oligonucleotide
  Target: ATXN1; (+) strand; PAM type: NNAGAAW; PAM sequence: GTAGAAA
tgcttagcctttggaataaa

SEQ ID NO: 9814 - DNA, 20 bp, Artificial Sequence
  Description of Artificial Sequence: Synthetic oligonucleotide
  Target: ATXN1; (+) strand; PAM type: NNAGAAW; PAM sequence: ACAGAAA
tttggaataaagtagaaagt

SEQ ID NO: 9815 - DNA, 20 bp, Artificial Sequence
  Description of Artificial Sequence: Synthetic oligonucleotide
  Target: ATXN1; (+) strand; PAM type: NNAGAAW; PAM sequence: GAAGAAA
cacatcccatatttcccttt

SEQ ID NO: 9816 - DNA, 20 bp, Artificial Sequence
  Description of Artificial Sequence: Synthetic oligonucleotide
  Target: ATXN1; (+) strand; PAM type: NNAGAAW; PAM sequence: ATAGAAA
atcctcactaaatgatttga

SEQ ID NO: 9817 - DNA, 20 bp, Artificial Sequence
  Description of Artificial Sequence: Synthetic oligonucleotide
  Target: ATXN1; (+) strand; PAM type: NNAGAAW; PAM sequence: TGAGAAT
gtctgtatcacttaagaggt

SEQ ID NO: 9818 - DNA, 20 bp, Artificial Sequence
  Description of Artificial Sequence: Synthetic oligonucleotide
  Target: ATXN1; (+) strand; PAM type: NNAGAAW; PAM sequence: TTAGAAA
ctattagacaatatagagta

SEQ ID NO: 9819 - DNA, 20 bp, Artificial Sequence
  Description of Artificial Sequence: Synthetic oligonucleotide
  Target: ATXN1; (+) strand; PAM type: NNAGAAW; PAM sequence: TTAGAAA
tttcaaatctgaagtaatta

SEQ ID NO: 9820 - DNA, 20 bp, Artificial Sequence
  Description of Artificial Sequence: Synthetic oligonucleotide
  Target: ATXN1; (+) strand; PAM type: NNAGAAW; PAM sequence: TGAGAAA
ctgaagtaattattagaaag

SEQ ID NO: 9821 - DNA, 20 bp, Artificial Sequence
  Description of Artificial Sequence: Synthetic oligonucleotide
  Target: ATXN1; (+) strand; PAM type: NNAGAAW; PAM sequence: ATAGAAT
atagtctaagttgccactag

SEQ ID NO: 9822 - DNA, 20 bp, Artificial Sequence
  Description of Artificial Sequence: Synthetic oligonucleotide
  Target: ATXN1; (+) strand; PAM type: NNAGAAW; PAM sequence: GTAGAAA
tcattttcgtcactttaaca

SEQ ID NO: 9823 - DNA, 20 bp, Artificial Sequence
  Description of Artificial Sequence: Synthetic oligonucleotide
  Target: ATXN1; (+) strand; PAM type: NNAGAAW; PAM sequence: AAAGAAT
gaaaggacacaggaaaaaaa

SEQ ID NO: 9824 - DNA, 20 bp, Artificial Sequence
  Description of Artificial Sequence: Synthetic oligonucleotide
  Target: ATXN1; (+) strand; PAM type: NNAGAAW; PAM sequence: ACAGAAA
tacagctctgagattaggag

SEQ ID NO: 9825 - DNA, 20 bp, Artificial Sequence
  Description of Artificial Sequence: Synthetic oligonucleotide
  Target: ATXN1; (+) strand; PAM type: NNAGAAW; PAM sequence: GAAGAAT
tttatttgcctctgtgctaa

SEQ ID NO: 9826 - DNA, 20 bp, Artificial Sequence
  Description of Artificial Sequence: Synthetic oligonucleotide
  Target: ATXN1; (+) strand; PAM type: NNAGAAW; PAM sequence: TGAGAAA
cagtgaggtagattctgcct

SEQ ID NO: 9827 - DNA, 20 bp, Artificial Sequence
  Description of Artificial Sequence: Synthetic oligonucleotide
  Target: ATXN1; (+) strand; PAM type: NNAGAAW; PAM sequence: GCAGAAA
ctgagcaaatgtttttgcca

SEQ ID NO: 9828 - DNA, 20 bp, Artificial Sequence
  Description of Artificial Sequence: Synthetic oligonucleotide
  Target: ATXN1; (+) strand; PAM type: NNAGAAW; PAM sequence: GAAGAAT
ttttacaataaagattcagt

SEQ ID NO: 9829 - DNA, 20 bp, Artificial Sequence
  Description of Artificial Sequence: Synthetic oligonucleotide
  Target: ATXN1; (+) strand; PAM type: NNAGAAW; PAM sequence: ATAGAAT
tcagtaaggtgctttaaaaa

SEQ ID NO: 9830 - DNA, 20 bp, Artificial Sequence
  Description of Artificial Sequence: Synthetic oligonucleotide
  Target: ATXN1; (+) strand; PAM type: NNAGAAW; PAM sequence: TAAGAAA
catatctgatctgattcagg

SEQ ID NO: 9831 - DNA, 20 bp, Artificial Sequence
  Description of Artificial Sequence: Synthetic oligonucleotide
  Target: ATXN1; (+) strand; PAM type: NNAGAAW; PAM sequence: TCAGAAA
tctgattcaggtaagaaatt

SEQ ID NO: 9832 - DNA, 20 bp, Artificial Sequence
  Description of Artificial Sequence: Synthetic oligonucleotide
  Target: ATXN1; (+) strand; PAM type: NNAGAAW; PAM sequence: CTAGAAT
gaaatttcagaaagggaact

SEQ ID NO: 9833 - DNA, 20 bp, Artificial Sequence
  Description of Artificial Sequence: Synthetic oligonucleotide
  Target: ATXN1; (+) strand; PAM type: NNAGAAW; PAM sequence: ACAGAAA
ccttccagtcactcctcttt

SEQ ID NO: 9834 - DNA, 20 bp, Artificial Sequence
  Description of Artificial Sequence: Synthetic oligonucleotide
  Target: ATXN1; (+) strand; PAM type: NNAGAAW; PAM sequence: AGAGAAT
aggggctctcttcacagatg

SEQ ID NO: 9835 - DNA, 20 bp, Artificial Sequence
  Description of Artificial Sequence: Synthetic oligonucleotide
  Target: ATXN1; (+) strand; PAM type: NNAGAAW; PAM sequence: ACAGAAA
aggtgaagctttgtgagtgg

SEQ ID NO: 9836 - DNA, 20 bp, Artificial Sequence
  Description of Artificial Sequence: Synthetic oligonucleotide
  Target: ATXN1; (+) strand; PAM type: NNAGAAW; PAM sequence: CGAGAAT
tatggattggactagcctta

SEQ ID NO: 9837 - DNA, 20 bp, Artificial Sequence
  Description of Artificial Sequence: Synthetic oligonucleotide
  Target: ATXN1; (+) strand; PAM type: NNAGAAW; PAM sequence: GCAGAAT
caacatcattgctcctacag

SEQ ID NO: 9838 - DNA, 20 bp, Artificial Sequence
  Description of Artificial Sequence: Synthetic oligonucleotide
  Target: ATXN1; (+) strand; PAM type: NNAGAAW; PAM sequence: ACAGAAA
gatgaggagtcagggtgaag

SEQ ID NO: 9839 - DNA, 20 bp, Artificial Sequence
  Description of Artificial Sequence: Synthetic oligonucleotide
  Target: ATXN1; (+) strand; PAM type: NNAGAAW; PAM sequence: GGAGAAT
ttaaaatgcctttcggtaaa

SEQ ID NO: 9840 - DNA, 20 bp, Artificial Sequence
  Description of Artificial Sequence: Synthetic oligonucleotide
  Target: ATXN1; (+) strand; PAM type: NNAGAAW; PAM sequence: TAAGAAT
gttactcactattcaaaatt

SEQ ID NO: 9841 - DNA, 20 bp, Artificial Sequence
  Description of Artificial Sequence: Synthetic oligonucleotide
  Target: ATXN1; (+) strand; PAM type: NNAGAAW; PAM sequence: GGAGAAA
taagaataagaagtcatctg

SEQ ID NO: 9842 - DNA, 20 bp, Artificial Sequence
  Description of Artificial Sequence: Synthetic oligonucleotide
  Target: ATXN1; (+) strand; PAM type: NNAGAAW; PAM sequence: TTAGAAT
accctataagcatgatgaca

SEQ ID NO: 9843 - DNA, 20 bp, Artificial Sequence
  Description of Artificial Sequence: Synthetic oligonucleotide
  Target: ATXN1; (+) strand; PAM type: NNAGAAW; PAM sequence: TGAGAAT
ggtgaagccagccaggcaaa

SEQ ID NO: 9844 - DNA, 20 bp, Artificial Sequence
  Description of Artificial Sequence: Synthetic oligonucleotide
  Target: ATXN1; (+) strand; PAM type: NNAGAAW; PAM sequence: TGAGAAA
gccagccaggcaaatgagaa

SEQ ID NO: 9845 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
taagatccaaaaactggggg

SEQ ID NO: 9846 - DNA, 20 bp, Artificial Sequence
  Description of Artificial Sequence: Synthetic oligonucleotide
  Target: ATXN1; (+) strand; PAM type: NNAGAAW; PAM sequence: CCAGAAA
caggatcgagattaaagtgg

SEQ ID NO: 9847 - DNA, 20 bp, Artificial Sequence
  Description of Artificial Sequence: Synthetic oligonucleotide
  Target: ATXN1; (+) strand; PAM type: NNAGAAW; PAM sequence: TTAGAAT
ccacggcggagggagcaaaa

SEQ ID NO: 9848 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
gtctgctgtgtgcacccaaa

SEQ ID NO: 9849 - DNA, 20 bp, Artificial Sequence
  Description of Artificial Sequence: Synthetic oligonucleotide
  Target: ATXN1; (+) strand; PAM type: NNAGAAW; PAM sequence: GCAGAAA
acccaaaaaagaaagcagac

SEQ ID NO: 9850 - DNA, 20 bp, Artificial Sequence
  Description of Artificial Sequence: Synthetic oligonucleotide
  Target: ATXN1; (+) strand; PAM type: NNAGAAW; PAM sequence: TTAGAAT
cgatgaacacgcacagaaca

SEQ ID NO: 9851 - DNA, 20 bp, Artificial Sequence
  Description of Artificial Sequence: Synthetic oligonucleotide
  Target: ATXN1; (+) strand; PAM type: NNAGAAW; PAM sequence: GCAGAAA
actggcactgcaaaatatat

SEQ ID NO: 9852 - DNA, 20 bp, Artificial Sequence
  Description of Artificial Sequence: Synthetic oligonucleotide
  Target: ATXN1; (+) strand; PAM type: NNAGAAW; PAM sequence: TGAGAAA
tcgttttttttttttttttt

SEQ ID NO: 9853 - DNA, 20 bp, Artificial Sequence
  Description of Artificial Sequence: Synthetic oligonucleotide
  Target: ATXN1; (+) strand; PAM type: NNAGAAW; PAM sequence: TCAGAAT
aggcaaaatcacaataagac

SEQ ID NO: 9854 - DNA, 20 bp, Artificial Sequence
  Description of Artificial Sequence: Synthetic oligonucleotide
  Target: ATXN1; (+) strand; PAM type: NNAGAAW; PAM sequence: TGAGAAT
tttgtggcgggtgttgagac

SEQ ID NO: 9855 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
gaaggataggaaaaaaaaaa

SEQ ID NO: 9856 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
aaaaaaaaaaaaagaaaggg

SEQ ID NO: 9857 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
tttttgcatatggctcagcc

SEQ ID NO: 9858 - DNA, 20 bp, Artificial Sequence
  Description of Artificial Sequence: Synthetic oligonucleotide
  Target: ATXN1; (+) strand; PAM type: NNAGAAW; PAM sequence: GGAGAAT
aactgactgtgtaagggaga

SEQ ID NO: 9859 - DNA, 20 bp, Artificial Sequence
  Description of Artificial Sequence: Synthetic oligonucleotide
  Target: ATXN1; (+) strand; PAM type: NNAGAAW; PAM sequence: GAAGAAA
aaaagggttgaatatttaca

SEQ ID NO: 9860 - DNA, 20 bp, Artificial Sequence
  Description of Artificial Sequence: Synthetic oligonucleotide
  Target: ATXN1; (+) strand; PAM type: NNAGAAW; PAM sequence: GGAGAAA
tacagaagaaaaaagaggcg

SEQ ID NO: 9861 - DNA, 20 bp, Artificial Sequence
  Description of Artificial Sequence: Synthetic oligonucleotide
  Target: ATXN1; (+) strand; PAM type: NNAGAAW; PAM sequence: TTAGAAT
aatccaagcataccaggttt

SEQ ID NO: 9862 - DNA, 20 bp, Artificial Sequence
  Description of Artificial Sequence: Synthetic oligonucleotide
  Target: ATXN1; (+) strand; PAM type: NNAGAAW; PAM sequence: AGAGAAA
gcataccaggtttttagaat

SEQ ID NO: 9863 - DNA, 20 bp, Artificial Sequence
  Description of Artificial Sequence: Synthetic oligonucleotide
  Target: ATXN1; (+) strand; PAM type: NNAGAAW; PAM sequence: GCAGAAA
atgttataagattggtgtgg

SEQ ID NO: 9864 - DNA, 20 bp, Artificial Sequence
  Description of Artificial Sequence: Synthetic oligonucleotide
  Target: ATXN1; (+) strand; PAM type: NNAGAAW; PAM sequence: GAAGAAA
agttcatttctctcttttct

SEQ ID NO: 9865 - DNA, 20 bp, Artificial Sequence
  Description of Artificial Sequence: Synthetic oligonucleotide
  Target: ATXN1; (+) strand; PAM type: NNAGAAW; PAM sequence: CAAGAAA
tcatcacccccatttacggg

SEQ ID NO: 9866 - DNA, 20 bp, Artificial Sequence
  Description of Artificial Sequence: Synthetic oligonucleotide
  Target: ATXN1; (+) strand; PAM type: NNAGAAW; PAM sequence: TGAGAAA
tgcattttgctcagtggttc

SEQ ID NO: 9867 - DNA, 20 bp, Artificial Sequence
  Description of Artificial Sequence: Synthetic oligonucleotide
  Target: ATXN1; (+) strand; PAM type: NNAGAAW; PAM sequence: TGAGAAT
caaggctgccaggctcatgc

SEQ ID NO: 9868 - DNA, 20 bp, Artificial Sequence
  Description of Artificial Sequence: Synthetic oligonucleotide
  Target: ATXN1; (+) strand; PAM type: NNAGAAW; PAM sequence: CTAGAAA
ttttcctttgtgcatcagat

SEQ ID NO: 9869 - DNA, 20 bp, Artificial Sequence
  Description of Artificial Sequence: Synthetic oligonucleotide
  Target: ATXN1; (+) strand; PAM type: NNAGAAW; PAM sequence: TGAGAAA
catcagatctagaaacaggg

SEQ ID NO: 9870 - DNA, 20 bp, Artificial Sequence
  Description of Artificial Sequence: Synthetic oligonucleotide
  Target: ATXN1; (+) strand; PAM type: NNAGAAW; PAM sequence: GAAGAAA
cagggtgagaaaagaaggtt

SEQ ID NO: 9871 - DNA, 20 bp, Artificial Sequence
  Description of Artificial Sequence: Synthetic oligonucleotide
  Target: ATXN1; (+) strand; PAM type: NNAGAAW; PAM sequence: ATAGAAT
catgctttatggaataaagc

SEQ ID NO: 9872 - DNA, 20 bp, Artificial Sequence
  Description of Artificial Sequence: Synthetic oligonucleotide
  Target: ATXN1; (+) strand; PAM type: NNAGAAW; PAM sequence: ACAGAAA
caaatttcacctggaccgca

SEQ ID NO: 9873 - DNA, 20 bp, Artificial Sequence
  Description of Artificial Sequence: Synthetic oligonucleotide
  Target: ATXN1; (+) strand; PAM type: NNAGAAW; PAM sequence: TAAGAAA
tgcatgaaacagaacaaaag

SEQ ID NO: 9874 - DNA, 20 bp, Artificial Sequence
  Description of Artificial Sequence: Synthetic oligonucleotide
  Target: ATXN1; (+) strand; PAM type: NNAGAAW; PAM sequence: CCAGAAA
gaaaagtgctcaaaggaagg

SEQ ID NO: 9875 - DNA, 20 bp, Artificial Sequence
  Description of Artificial Sequence: Synthetic oligonucleotide
  Target: ATXN1; (+) strand; PAM type: NNAGAAW; PAM sequence: AGAGAAT
acgacgcgtcctctaacctc

SEQ ID NO: 9876 - DNA, 20 bp, Artificial Sequence
  Description of Artificial Sequence: Synthetic oligonucleotide
  Target: ATXN1; (+) strand; PAM type: NNAGAAW; PAM sequence: TGAGAAA
tcagagaatttttgtgaaat

SEQ ID NO: 9877 - DNA, 20 bp, Artificial Sequence
  Description of Artificial Sequence: Synthetic oligonucleotide
  Target: ATXN1; (+) strand; PAM type: NNAGAAW; PAM sequence: ACAGAAA
gggttcatccttctccatgt

SEQ ID NO: 9878 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
ttggcaattcctccactatt

SEQ ID NO: 9879 - DNA, 20 bp, Artificial Sequence
  Description of Artificial Sequence: Synthetic oligonucleotide
  Target: ATXN1; (+) strand; PAM type: NNAGAAW; PAM sequence: TCAGAAT
aggaggtgctatctttgtcc

SEQ ID NO: 9880 - DNA, 20 bp, Artificial Sequence
  Description of Artificial Sequence: Synthetic oligonucleotide
  Target: ATXN1; (+) strand; PAM type: NNAGAAW; PAM sequence: AGAGAAT
atgtacctcccttttaaaat

SEQ ID NO: 9881 - DNA, 20 bp, Artificial Sequence
  Description of Artificial Sequence: Synthetic oligonucleotide
  Target: ATXN1; (+) strand; PAM type: NNAGAAW; PAM sequence: GGAGAAT
tcaacaaatcaaatactgat

SEQ ID NO: 9882 - DNA, 20 bp, Artificial Sequence
  Description of Artificial Sequence: Synthetic oligonucleotide
  Target: ATXN1; (+) strand; PAM type: NNAGAAW; PAM sequence: GGAGAAA
aggagctgaggattgaacgg

SEQ ID NO: 9883 - DNA, 20 bp, Artificial Sequence
  Description of Artificial Sequence: Synthetic oligonucleotide
  Target: ATXN1; (+) strand; PAM type: NNAGAAW; PAM sequence: GGAGAAA
tcatagtgcttcttagttgg

SEQ ID NO: 9884 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
tatatgtaaaaaatgttgtc

SEQ ID NO: 9885 - DNA, 20 bp, Artificial Sequence
  Description of Artificial Sequence: Synthetic oligonucleotide
  Target: ATXN1; (+) strand; PAM type: NNAGAAW; PAM sequence: CTAGAAA
ctccagagaagctgtggctc

SEQ ID NO: 9886 - DNA, 20 bp, Artificial Sequence
  Description of Artificial Sequence: Synthetic oligonucleotide
  Target: ATXN1; (+) strand; PAM type: NNAGAAW; PAM sequence: CTAGAAT
aaagaaggtaggttttagga

SEQ ID NO: 9887 - DNA, 20 bp, Artificial Sequence
  Description of Artificial Sequence: Synthetic oligonucleotide
  Target: ATXN1; (+) strand; PAM type: NNAGAAW; PAM sequence: ACAGAAA
ttagatgcagaggaagaggg

SEQ ID NO: 9888 - DNA, 20 bp, Artificial Sequence
  Description of Artificial Sequence: Synthetic oligonucleotide
  Target: ATXN1; (+) strand; PAM type: NNAGAAW; PAM sequence: CTAGAAA
aagatgatgagaggtctggc

SEQ ID NO: 9889 - DNA, 20 bp, Artificial Sequence
  Description of Artificial Sequence: Synthetic oligonucleotide
  Target: ATXN1; (+) strand; PAM type: NNAGAAW; PAM sequence: GTAGAAA
gaactccaacacttagaggc

SEQ ID NO: 9890 - DNA, 20 bp, Artificial Sequence
  Description of Artificial Sequence: Synthetic oligonucleotide
  Target: ATXN1; (+) strand; PAM type: NNAGAAW; PAM sequence: GTAGAAA
cttagaggcgtagaaagcag

SEQ ID NO: 9891 - DNA, 20 bp, Artificial Sequence
  Description of Artificial Sequence: Synthetic oligonucleotide
  Target: ATXN1; (+) strand; PAM type: NNAGAAW; PAM sequence: CCAGAAA
gaagacttaggaaggagggg

SEQ ID NO: 9892 - DNA, 20 bp, Artificial Sequence
  Description of Artificial Sequence: Synthetic oligonucleotide
  Target: ATXN1; (+) strand; PAM type: NNAGAAW; PAM sequence: GCAGAAT
atttagacaggagggggaga

SEQ ID NO: 9893 - DNA, 20 bp, Artificial Sequence
  Description of Artificial Sequence: Synthetic oligonucleotide
  Target: ATXN1; (+) strand; PAM type: NNAGAAW; PAM sequence: GGAGAAA
agcagaattggcaaagctgt

SEQ ID NO: 9894 - DNA, 20 bp, Artificial Sequence
  Description of Artificial Sequence: Synthetic oligonucleotide
  Target: ATXN1; (+) strand; PAM type: NNAGAAW; PAM sequence: GCAGAAA
gatagatgctaaaaagttaa

SEQ ID NO: 9895 - DNA, 20 bp, Artificial Sequence
  Description of Artificial Sequence: Synthetic oligonucleotide
  Target: ATXN1; (+) strand; PAM type: NNAGAAW; PAM sequence: GAAGAAA
taacttttggggaaaagcct

SEQ ID NO: 9896 - DNA, 20 bp, Artificial Sequence
  Description of Artificial Sequence: Synthetic oligonucleotide
  Target: ATXN1; (+) strand; PAM type: NNAGAAW; PAM sequence: ATAGAAA
aaaagcctgaagaaagggaa

SEQ ID NO: 9897 - DNA, 20 bp, Artificial Sequence
  Description of Artificial Sequence: Synthetic oligonucleotide
  Target: ATXN1; (+) strand; PAM type: NNAGAAW; PAM sequence: ACAGAAA
ctgggggaagagccttcctg

SEQ ID NO: 9898 - DNA, 20 bp, Artificial Sequence
  Description of Artificial Sequence: Synthetic oligonucleotide
  Target: ATXN1; (+) strand; PAM type: NNAGAAW; PAM sequence: GCAGAAT
gatggtggcaccgtggacca

SEQ ID NO: 9899 - DNA, 20 bp, Artificial Sequence
  Description of Artificial Sequence: Synthetic oligonucleotide
  Target: ATXN1; (+) strand; PAM type: NNAGAAW; PAM sequence: GGAGAAA
tggaccagcagaattgtgta

SEQ ID NO: 9900 - DNA, 20 bp, Artificial Sequence
  Description of Artificial Sequence: Synthetic oligonucleotide
  Target: ATXN1; (+) strand; PAM type: NNAGAAW; PAM sequence: GTAGAAT
agtgggagaagcaggttggg

SEQ ID NO: 9901 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
gatatgcaagcctgaggttc

SEQ ID NO: 9902 - DNA, 20 bp, Artificial Sequence
  Description of Artificial Sequence: Synthetic oligonucleotide
  Target: ATXN1; (+) strand; PAM type: NNAGAAW; PAM sequence: ACAGAAA
ttttgttgtattattttcta

SEQ ID NO: 9903 - DNA, 20 bp, Artificial Sequence
  Description of Artificial Sequence: Synthetic oligonucleotide
  Target: ATXN1; (+) strand; PAM type: NNAGAAW; PAM sequence: ATAGAAA
tcaagaagcagcatcatgca

SEQ ID NO: 9904 - DNA, 20 bp, Artificial Sequence
  Description of Artificial Sequence: Synthetic oligonucleotide
  Target: ATXN1; (+) strand; PAM type: NNAGAAW; PAM sequence: TGAGAAA
cagtacggttcactttccta

SEQ ID NO: 9905 - DNA, 20 bp, Artificial Sequence
  Description of Artificial Sequence: Synthetic oligonucleotide
  Target: ATXN1; (+) strand; PAM type: NNAGAAW; PAM sequence: AAAGAAT
acggttcactttcctatgag

SEQ ID NO: 9906 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
atttctgccatctgaaaagc

SEQ ID NO: 9907 - DNA, 20 bp, Artificial Sequence
  Description of Artificial Sequence: Synthetic oligonucleotide
  Target: ATXN1; (+) strand; PAM type: NNAGAAW; PAM sequence: GCAGAAA
tggactctgttgacttttta

SEQ ID NO: 9908 - DNA, 20 bp, Artificial Sequence
  Description of Artificial Sequence: Synthetic oligonucleotide
  Target: ATXN1; (+) strand; PAM type: NNAGAAW; PAM sequence: AGAGAAA
gtcaggtttcattgctgtca

SEQ ID NO: 9909 - DNA, 20 bp, Artificial Sequence
  Description of Artificial Sequence: Synthetic oligonucleotide
  Target: ATXN1; (+) strand; PAM type: NNAGAAW; PAM sequence: TTAGAAA
taaattttaattagttttaa

SEQ ID NO: 9910 - DNA, 20 bp, Artificial Sequence
  Description of Artificial Sequence: Synthetic oligonucleotide
  Target: ATXN1; (+) strand; PAM type: NNAGAAW; PAM sequence: CAAGAAT
tttatattgtatattttatc

SEQ ID NO: 9911 - DNA, 20 bp, Artificial Sequence
  Description of Artificial Sequence: Synthetic oligonucleotide
  Target: ATXN1; (+) strand; PAM type: NNAGAAW; PAM sequence: TCAGAAT
taaatccagccaggaggatc

SEQ ID NO: 9912 - DNA, 20 bp, Artificial Sequence
  Description of Artificial Sequence: Synthetic oligonucleotide
  Target: ATXN1; (+) strand; PAM type: NNAGAAW; PAM sequence: CAAGAAA
ttcttaagtagatggactat

SEQ ID NO: 9913 - DNA, 20 bp, Artificial Sequence
  Description of Artificial Sequence: Synthetic oligonucleotide
  Target: ATXN1; (+) strand; PAM type: NNAGAAW; PAM sequence: ACAGAAT
atcaagaaactcttaaaata

SEQ ID NO: 9914 - DNA, 20 bp, Artificial Sequence
  Description of Artificial Sequence: Synthetic oligonucleotide
  Target: ATXN1; (+) strand; PAM type: NNAGAAW; PAM sequence: ATAGAAT
caagtctaacagagtcatta

SEQ ID NO: 9915 - DNA, 20 bp, Artificial Sequence
  Description of Artificial Sequence: Synthetic oligonucleotide
  Target: ATXN1; (+) strand; PAM type: NNAGAAW; PAM sequence: CAAGAAT
tccatgttatgaagggcctc

SEQ ID NO: 9916 - DNA, 20 bp, Artificial Sequence
  Description of Artificial Sequence: Synthetic oligonucleotide
  Target: ATXN1; (+) strand; PAM type: NNAGAAW; PAM sequence: ATAGAAA
aagaatttaaaaaggacaaa

SEQ ID NO: 9917 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
atctagctactaaaagccaa

SEQ ID NO: 9918 - DNA, 20 bp, Artificial Sequence
  Description of Artificial Sequence: Synthetic oligonucleotide
  Target: ATXN1; (+) strand; PAM type: NNAGAAW; PAM sequence: TCAGAAT
gtggggtggggatgctgaca

SEQ ID NO: 9919 - DNA, 20 bp, Artificial Sequence
  Description of Artificial Sequence: Synthetic oligonucleotide
  Target: ATXN1; (+) strand; PAM type: NNAGAAW; PAM sequence: GCAGAAA
atccagaggcatagtattta

SEQ ID NO: 9920 - DNA, 20 bp, Artificial Sequence
  Description of Artificial Sequence: Synthetic oligonucleotide
  Target: ATXN1; (+) strand; PAM type: NNAGAAW; PAM sequence: GGAGAAT
ctactcgggaggctgaggca

SEQ ID NO: 9921 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
ttgatatttcaaaagagcta

SEQ ID NO: 9922 - DNA, 20 bp, Artificial Sequence
  Description of Artificial Sequence: Synthetic oligonucleotide
  Target: ATXN1; (+) strand; PAM type: NNAGAAW; PAM sequence: TCAGAAA
actaatcccaataaaaacat

SEQ ID NO: 9923 - DNA, 20 bp, Artificial Sequence
  Description of Artificial Sequence: Synthetic oligonucleotide
  Target: ATXN1; (+) strand; PAM type: NNAGAAW; PAM sequence: GGAGAAA
cattcagaaatgaagtgatt

SEQ ID NO: 9924 - DNA, 20 bp, Artificial Sequence
  Description of Artificial Sequence: Synthetic oligonucleotide
  Target: ATXN1; (+) strand; PAM type: NNAGAAW; PAM sequence: AAAGAAT
gagaggcaaaagaacgtggg

SEQ ID NO: 9925 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
gtgggaaagaatttgaagta

SEQ ID NO: 9926 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
gaccctgtcttaaaaaaaaa

SEQ ID NO: 9927 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
tgtcttaaaaaaaaaaaaga

SEQ ID NO: 9928 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
taaaaaaaaaaaagaaaaga

SEQ ID NO: 9929 - DNA, 20 bp, Artificial Sequence
  Description of Artificial Sequence: Synthetic oligonucleotide
  Target: ATXN1; (+) strand; PAM type: NNAGAAW; PAM sequence: TCAGAAT
gcacagtttaaaaaaatttt

SEQ ID NO: 9930 - DNA, 20 bp, Artificial Sequence
  Description of Artificial Sequence: Synthetic oligonucleotide
  Target: ATXN1; (+) strand; PAM type: NNAGAAW; PAM sequence: AGAGAAA
gcaatgataacaacaaaaac

SEQ ID NO: 9931 - DNA, 20 bp, Artificial Sequence
  Description of Artificial Sequence: Synthetic oligonucleotide
  Target: ATXN1; (+) strand; PAM type: NNAGAAW; PAM sequence: AGAGAAA
gcagaagcaatatctgtgca

SEQ ID NO: 9932 - DNA, 20 bp, Artificial Sequence
  Description of Artificial Sequence: Synthetic oligonucleotide
  Target: ATXN1; (+) strand; PAM type: NNAGAAW; PAM sequence: GCAGAAT
catcattggcaaggggtcct

SEQ ID NO: 9933 - DNA, 20 bp, Artificial Sequence
  Description of Artificial Sequence: Synthetic oligonucleotide
  Target: ATXN1; (+) strand; PAM type: NNAGAAW; PAM sequence: GAAGAAA
ccacgaccaaatcaccttga

SEQ ID NO: 9934 - DNA, 20 bp, Artificial Sequence
  Description of Artificial Sequence: Synthetic oligonucleotide
  Target: ATXN1; (+) strand; PAM type: NNAGAAW; PAM sequence: GCAGAAT
ttgagaagaaacttttgaga

SEQ ID NO: 9935 - DNA, 20 bp, Artificial Sequence
  Description of Artificial Sequence: Synthetic oligonucleotide
  Target: ATXN1; (+) strand; PAM type: NNAGAAW; PAM sequence: TAAGAAA
ggaggcagagaagacgaagc

SEQ ID NO: 9936 - DNA, 20 bp, Artificial Sequence
  Description of Artificial Sequence: Synthetic oligonucleotide
  Target: ATXN1; (+) strand; PAM type: NNAGAAW; PAM sequence: CTAGAAA
ggagttctatggcctagaca

SEQ ID NO: 9937 - DNA, 20 bp, Artificial Sequence
  Description of Artificial Sequence: Synthetic oligonucleotide
  Target: ATXN1; (+) strand; PAM type: NNAGAAW; PAM sequence: CAAGAAA
atcccttatccctaaaaata

SEQ ID NO: 9938 - DNA, 20 bp, Artificial Sequence
  Description of Artificial Sequence: Synthetic oligonucleotide
  Target: ATXN1; (+) strand; PAM type: NNAGAAW; PAM sequence: GAAGAAA
acagtgcacagttattataa

SEQ ID NO: 9939 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
ttaatatttcaaaagagcta

SEQ ID NO: 9940 - DNA, 20 bp, Artificial Sequence
  Description of Artificial Sequence: Synthetic oligonucleotide
  Target: ATXN1; (+) strand; PAM type: NNAGAAW; PAM sequence: TCAGAAA
actaatcccaataaaaacat

SEQ ID NO: 9941 - DNA, 20 bp, Artificial Sequence
  Description of Artificial Sequence: Synthetic oligonucleotide
  Target: ATXN1; (+) strand; PAM type: NNAGAAW; PAM sequence: GGAGAAA
cattcagaaatgaagtgatt

SEQ ID NO: 9942 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
agaaatgaagtgattggaga

SEQ ID NO: 9943 - DNA, 20 bp, Artificial Sequence
  Description of Artificial Sequence: Synthetic oligonucleotide
  Target: ATXN1; (+) strand; PAM type: NNAGAAW; PAM sequence: AAAGAAT
gagaggcaaaagaacgtggg

SEQ ID NO: 9944 - DNA, 20 bp, Artificial Sequence
  Description of Artificial Sequence: Synthetic oligonucleotide
  Target: ATXN1; (+) strand; PAM type: NNAGAAW; PAM sequence: GAAGAAA
aagaacgtgggaaagaattt

SEQ ID NO: 9945 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
agaatttgaagaaaacgaaa

SEQ ID NO: 9946 - DNA, 20 bp, Artificial Sequence
  Description of Artificial Sequence: Synthetic oligonucleotide
  Target: ATXN1; (+) strand; PAM type: NNAGAAW; PAM sequence: ATAGAAA
tctttgaggagtgctaaaaa

SEQ ID NO: 9947 - DNA, 20 bp, Artificial Sequence
  Description of Artificial Sequence: Synthetic oligonucleotide
  Target: ATXN1; (+) strand; PAM type: NNAGAAW; PAM sequence: GGAGAAA
ggagtgctaaaaaatagaaa

SEQ ID NO: 9948 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
gagaaagtgttaaacatcaa

SEQ ID NO: 9949 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
aacatcaaaaagaaatgagg

SEQ ID NO: 9950 - DNA, 20 bp, Artificial Sequence
  Description of Artificial Sequence: Synthetic oligonucleotide
  Target: ATXN1; (+) strand; PAM type: NNAGAAW; PAM sequence: ATAGAAT
aaaaagaaatgaggaaagaa

SEQ ID NO: 9951 - DNA, 20 bp, Artificial Sequence
  Description of Artificial Sequence: Synthetic oligonucleotide
  Target: ATXN1; (+) strand; PAM type: NNAGAAW; PAM sequence: AGAGAAA
gaggaaagaaatagaattca

SEQ ID NO: 9952 - DNA, 20 bp, Artificial Sequence
  Description of Artificial Sequence: Synthetic oligonucleotide
  Target: ATXN1; (+) strand; PAM type: NNAGAAW; PAM sequence: TCAGAAA
atagaattcaagagaaagac

SEQ ID NO: 9953 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
ctcagaaaaggaacatgagc

SEQ ID NO: 9954 - DNA, 20 bp, Artificial Sequence
  Description of Artificial Sequence: Synthetic oligonucleotide
  Target: ATXN1; (+) strand; PAM type: NNAGAAW; PAM sequence: GAAGAAA
ctgtaataagagcctttgaa

SEQ ID NO: 9955 - DNA, 20 bp, Artificial Sequence
  Description of Artificial Sequence: Synthetic oligonucleotide
  Target: ATXN1; (+) strand; PAM type: NNAGAAW; PAM sequence: GTAGAAA
ctgaagcacaaattctagaa

SEQ ID NO: 9956 - DNA, 20 bp, Artificial Sequence
  Description of Artificial Sequence: Synthetic oligonucleotide
  Target: ATXN1; (+) strand; PAM type: NNAGAAW; PAM sequence: ACAGAAT
agatttgaaactatatattg

SEQ ID NO: 9957 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
cctggaaaaactgacctagg

SEQ ID NO: 9958 - DNA, 20 bp, Artificial Sequence
  Description of Artificial Sequence: Synthetic oligonucleotide
  Target: ATXN1; (+) strand; PAM type: NNAGAAW; PAM sequence: ACAGAAA
gactgagttacctataaggg

SEQ ID NO: 9959 - DNA, 20 bp, Artificial Sequence
  Description of Artificial Sequence: Synthetic oligonucleotide
  Target: ATXN1; (+) strand; PAM type: NNAGAAW; PAM sequence: GCAGAAA
ggacccaaggaatattgttc

SEQ ID NO: 9960 - DNA, 20 bp, Artificial Sequence
  Description of Artificial Sequence: Synthetic oligonucleotide
  Target: ATXN1; (+) strand; PAM type: NNAGAAW; PAM sequence: GAAGAAT
gattaaaaaaaaacacgcgg

SEQ ID NO: 9961 - DNA, 20 bp, Artificial Sequence
  Description of Artificial Sequence: Synthetic oligonucleotide
  Target: ATXN1; (+) strand; PAM type: NNAGAAW; PAM sequence: GAAGAAA
taaatcaaattatagccaga

SEQ ID NO: 9962 - DNA, 20 bp, Artificial Sequence
  Description of Artificial Sequence: Synthetic oligonucleotide
  Target: ATXN1; (+) strand; PAM type: NNAGAAW; PAM sequence: TAAGAAA
attatagccagagaagaaaa

SEQ ID NO: 9963 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
tagccagagaagaaaataag

SEQ ID NO: 9964 - DNA, 20 bp, Artificial Sequence
  Description of Artificial Sequence: Synthetic oligonucleotide
  Target: ATXN1; (+) strand; PAM type: NNAGAAW; PAM sequence: TAAGAAT
aaataagaaagaaagggtac

SEQ ID NO: 9965 - DNA, 20 bp, Artificial Sequence
  Description of Artificial Sequence: Synthetic oligonucleotide
  Target: ATXN1; (+) strand; PAM type: NNAGAAW; PAM sequence: TAAGAAA
ggaaaccaataaacaacagc

SEQ ID NO: 9966 - DNA, 20 bp, Artificial Sequence
  Description of Artificial Sequence: Synthetic oligonucleotide
  Target: ATXN1; (+) strand; PAM type: NNAGAAW; PAM sequence: CGAGAAT
ctactcaggaggctgaggca

SEQ ID NO: 9967 - DNA, 20 bp, Artificial Sequence
  Description of Artificial Sequence: Synthetic oligonucleotide
  Target: ATXN1; (+) strand; PAM type: NNAGAAW; PAM sequence: GGAGAAA
atgcctaaaaatggtaaaaa

SEQ ID NO: 9968 - DNA, 20 bp, Artificial Sequence
  Description of Artificial Sequence: Synthetic oligonucleotide
  Target: ATXN1; (+) strand; PAM type: NNAGAAW; PAM sequence: CAAGAAT
atttttatataattattgaa

SEQ ID NO: 9969 - DNA, 20 bp, Artificial Sequence
  Description of Artificial Sequence: Synthetic oligonucleotide
  Target: ATXN1; (+) strand; PAM type: NNAGAAW; PAM sequence: GGAGAAA
attattgcaagtgtagtgtg

SEQ ID NO: 9970 - DNA, 20 bp, Artificial Sequence
  Description of Artificial Sequence: Synthetic oligonucleotide
  Target: ATXN1; (+) strand; PAM type: NNAGAAW; PAM sequence: AGAGAAA
gaactgctattttcagtttg

SEQ ID NO: 9971 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
tgctattttcagtttgagag

SEQ ID NO: 9972 - DNA, 20 bp, Artificial Sequence
  Description of Artificial Sequence: Synthetic oligonucleotide
  Target: ATXN1; (+) strand; PAM type: NNAGAAW; PAM sequence: ACAGAAA
aaaccccgtctctactaaaa

SEQ ID NO: 9973 - DNA, 20 bp, Artificial Sequence
  Description of Artificial Sequence: Synthetic oligonucleotide
  Target: ATXN1; (+) strand; PAM type: NNAGAAW; PAM sequence: GGAGAAT
ctactcgggaggctgaggca

SEQ ID NO: 9974 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
ccaaatatcatttctcactg

SEQ ID NO: 9975 - DNA, 20 bp, Artificial Sequence
  Description of Artificial Sequence: Synthetic oligonucleotide
  Target: ATXN1; (+) strand; PAM type: NNAGAAW; PAM sequence: CAAGAAA
agctgatcccagagctaagg

SEQ ID NO: 9976 - DNA, 20 bp, Artificial Sequence
  Description of Artificial Sequence: Synthetic oligonucleotide
  Target: ATXN1; (+) strand; PAM type: NNAGAAW; PAM sequence: CTAGAAA
gcctggaacatagtgttata

SEQ ID NO: 9977 - DNA, 20 bp, Artificial Sequence
  Description of Artificial Sequence: Synthetic oligonucleotide
  Target: ATXN1; (+) strand; PAM type: NNAGAAW; PAM sequence: CAAGAAA
catagtgttatactagaaag

SEQ ID NO: 9978 - DNA, 20 bp, Artificial Sequence
  Description of Artificial Sequence: Synthetic oligonucleotide
  Target: ATXN1; (+) strand; PAM type: NNAGAAW; PAM sequence: ACAGAAT
tcgtgcaaattggtaaatag

SEQ ID NO: 9979 - DNA, 20 bp, Artificial Sequence
  Description of Artificial Sequence: Synthetic oligonucleotide
  Target: ATXN1; (+) strand; PAM type: NNAGAAW; PAM sequence: ATAGAAT
taacaaatgaacaaataata

SEQ ID NO: 9980 - DNA, 20 bp, Artificial Sequence
  Description of Artificial Sequence: Synthetic oligonucleotide
  Target: ATXN1; (+) strand; PAM type: NNAGAAW; PAM sequence: CAAGAAA
tagaacttcctagcaattcc

SEQ ID NO: 9981 - DNA, 20 bp, Artificial Sequence
  Description of Artificial Sequence: Synthetic oligonucleotide
  Target: ATXN1; (+) strand; PAM type: NNAGAAW; PAM sequence: ACAGAAA
acaaatggtctggtttctca

SEQ ID NO: 9982 - DNA, 20 bp, Artificial Sequence
  Description of Artificial Sequence: Synthetic oligonucleotide
  Target: ATXN1; (+) strand; PAM type: NNAGAAW; PAM sequence: TGAGAAA
gacgggatatttgatgatat

SEQ ID NO: 9983 - DNA, 20 bp, Artificial Sequence
  Description of Artificial Sequence: Synthetic oligonucleotide
  Target: ATXN1; (+) strand; PAM type: NNAGAAW; PAM sequence: GAAGAAT
gttgtagttgtgtatgagaa

SEQ ID NO: 9984 - DNA, 20 bp, Artificial Sequence
  Description of Artificial Sequence: Synthetic oligonucleotide
  Target: ATXN1; (+) strand; PAM type: NNAGAAW; PAM sequence: ATAGAAA
aagaagaatcctaatcattt

SEQ ID NO: 9985 - DNA, 20 bp, Artificial Sequence
  Description of Artificial Sequence: Synthetic oligonucleotide
  Target: ATXN1; (+) strand; PAM type: NNAGAAW; PAM sequence: AGAGAAA
tccaggtgcagaggtggagt

SEQ ID NO: 9986 - DNA, 20 bp, Artificial Sequence
  Description of Artificial Sequence: Synthetic oligonucleotide
  Target: ATXN1; (+) strand; PAM type: NNAGAAW; PAM sequence: TGAGAAT
ttgtccttgtgatagtttac

SEQ ID NO: 9987 - DNA, 20 bp, Artificial Sequence
  Description of Artificial Sequence: Synthetic oligonucleotide
  Target: ATXN1; (+) strand; PAM type: NNAGAAW; PAM sequence: TCAGAAT
cccaaccccagatttgtgaa

SEQ ID NO: 9988 - DNA, 20 bp, Artificial Sequence
  Description of Artificial Sequence: Synthetic oligonucleotide
  Target: ATXN1; (+) strand; PAM type: NNAGAAW; PAM sequence: CCAGAAA
agaattcctgggagtgaagc

SEQ ID NO: 9989 - DNA, 20 bp, Artificial Sequence
  Description of Artificial Sequence: Synthetic oligonucleotide
  Target: ATXN1; (+) strand; PAM type: NNAGAAW; PAM sequence: GGAGAAA
gtcttaaaatttttattatg

SEQ ID NO: 9990 - DNA, 20 bp, Artificial Sequence
  Description of Artificial Sequence: Synthetic oligonucleotide
  Target: ATXN1; (+) strand; PAM type: NNAGAAW; PAM sequence: ACAGAAA
agagtaacatggatgaagct

SEQ ID NO: 9991 - DNA, 20 bp, Artificial Sequence
  Description of Artificial Sequence: Synthetic oligonucleotide
  Target: ATXN1; (+) strand; PAM type: NNAGAAW; PAM sequence: AAAGAAT
tcacaagcactattttccaa

SEQ ID NO: 9992 - DNA, 20 bp, Artificial Sequence
  Description of Artificial Sequence: Synthetic oligonucleotide
  Target: ATXN1; (+) strand; PAM type: NNAGAAW; PAM sequence: TCAGAAA
tgtaccgggatgacagacaa

SEQ ID NO: 9993 - DNA, 20 bp, Artificial Sequence
  Description of Artificial Sequence: Synthetic oligonucleotide
  Target: ATXN1; (+) strand; PAM type: NNAGAAW; PAM sequence: GCAGAAT
tatttttattttttatcaag

SEQ ID NO: 9994 - DNA, 20 bp, Artificial Sequence
  Description of Artificial Sequence: Synthetic oligonucleotide
  Target: ATXN1; (+) strand; PAM type: NNAGAAW; PAM sequence: GCAGAAA
ctgataaaaaaaataggaga

SEQ ID NO: 9995 - DNA, 20 bp, Artificial Sequence
  Description of Artificial Sequence: Synthetic oligonucleotide
  Target: ATXN1; (+) strand; PAM type: NNAGAAW; PAM sequence: TCAGAAA
attattaagtaactgtagtt

SEQ ID NO: 9996 - DNA, 20 bp, Artificial Sequence
  Description of Artificial Sequence: Synthetic oligonucleotide
  Target: ATXN1; (+) strand; PAM type: NNAGAAW; PAM sequence: GTAGAAT
agctctccatgtgccatata

SEQ ID NO: 9997 - DNA, 20 bp, Artificial Sequence
  Description of Artificial Sequence: Synthetic oligonucleotide
  Target: ATXN1; (+) strand; PAM type: NNAGAAW; PAM sequence: CTAGAAT
aggcacaatcctggtcctac

SEQ ID NO: 9998 - DNA, 20 bp, Artificial Sequence
  Description of Artificial Sequence: Synthetic oligonucleotide
  Target: ATXN1; (+) strand; PAM type: NNAGAAW; PAM sequence: CTAGAAT
ttgttggtttgtttcctgcg

SEQ ID NO: 9999 - DNA, 20 bp, Artificial Sequence
  Description of Artificial Sequence: Synthetic oligonucleotide
  Target: ATXN1; (+) strand; PAM type: NNAGAAW; PAM sequence: GTAGAAA
agtgacatcctgtttctcag

SEQ ID NO: 10000 - DNA, 20 bp, Artificial Sequence
  Description of Artificial Sequence: Synthetic oligonucleotide
  Target: ATXN1; (+) strand; PAM type: NNAGAAW; PAM sequence: ACAGAAT
aagtaaaggcaatgaatgat

SEQ ID NO: 10001 - DNA, 20 bp, Artificial Sequence
  Description of Artificial Sequence: Synthetic oligonucleotide
  Target: ATXN1; (+) strand; PAM type: NNAGAAW; PAM sequence: AGAGAAT
tacacacatgcatggttctt

SEQ ID NO: 10002 - DNA, 20 bp, Artificial Sequence
  Description of Artificial Sequence: Synthetic oligonucleotide
  Target: ATXN1; (+) strand; PAM type: NNAGAAW; PAM sequence: GTAGAAA
tcctcccttctggggacctt

SEQ ID NO: 10003 - DNA, 20 bp, Artificial Sequence
  Description of Artificial Sequence: Synthetic oligonucleotide
  Target: ATXN1; (+) strand; PAM type: NNAGAAW; PAM sequence: TCAGAAA
aacatcatggagaggtcctc

SEQ ID NO: 10004 - DNA, 20 bp, Artificial Sequence
  Description of Artificial Sequence: Synthetic oligonucleotide
  Target: ATXN1; (+) strand; PAM type: NNAGAAW; PAM sequence: TGAGAAT
agagccacatggccattcct

SEQ ID NO: 10005 - DNA, 20 bp, Artificial Sequence
  Description of Artificial Sequence: Synthetic oligonucleotide
  Target: ATXN1; (+) strand; PAM type: NNAGAAW; PAM sequence: GAAGAAT
ctactcaggaggctgaggca

SEQ ID NO: 10006 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
actccgtctcaaaaaaaaaa

SEQ ID NO: 10007 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
cgtctcaaaaaaaaaaaaag

SEQ ID NO: 10008 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
gaaagaaaatagtatagttg

SEQ ID NO: 10009 - DNA, 20 bp, Artificial Sequence
  Description of Artificial Sequence: Synthetic oligonucleotide
  Target: ATXN1; (+) strand; PAM type: NNAGAAW; PAM sequence: ACAGAAA
ttcccccattctcaaagcaa

SEQ ID NO: 10010 - DNA, 20 bp, Artificial Sequence
  Description of Artificial Sequence: Synthetic oligonucleotide
  Target: ATXN1; (+) strand; PAM type: NNAGAAW; PAM sequence: ATAGAAA
cagagaagtttcctctgcat

SEQ ID NO: 10011 - DNA, 20 bp, Artificial Sequence
  Description of Artificial Sequence: Synthetic oligonucleotide
  Target: ATXN1; (+) strand; PAM type: NNAGAAW; PAM sequence: GTAGAAT
acagatgcctactatagcaa

SEQ ID NO: 10012 - DNA, 20 bp, Artificial Sequence
  Description of Artificial Sequence: Synthetic oligonucleotide
  Target: ATXN1; (+) strand; PAM type: NNAGAAW; PAM sequence: GTAGAAA
gagagaagacctgcaactcg

SEQ ID NO: 10013 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
aagacctgcaactcggtaga

SEQ ID NO: 10014 - DNA, 20 bp, Artificial Sequence
  Description of Artificial Sequence: Synthetic oligonucleotide
  Target: ATXN1; (+) strand; PAM type: NNAGAAW; PAM sequence: TCAGAAT
gaacaggttacaaatacggt

SEQ ID NO: 10015 - DNA, 20 bp, Artificial Sequence
  Description of Artificial Sequence: Synthetic oligonucleotide
  Target: ATXN1; (+) strand; PAM type: NNAGAAW; PAM sequence: TGAGAAA
ataactagtaatgaatgata

SEQ ID NO: 10016 - DNA, 20 bp, Artificial Sequence
  Description of Artificial Sequence: Synthetic oligonucleotide
  Target: ATXN1; (+) strand; PAM type: NNAGAAW; PAM sequence: GCAGAAA
ccaatgaaagggtaaaaaaa

SEQ ID NO: 10017 - DNA, 20 bp, Artificial Sequence
  Description of Artificial Sequence: Synthetic oligonucleotide
  Target: ATXN1; (+) strand; PAM type: NNAGAAW; PAM sequence: TTAGAAT
ctgatttaaaagttcaagat

SEQ ID NO: 10018 - DNA, 20 bp, Artificial Sequence
  Description of Artificial Sequence: Synthetic oligonucleotide
  Target: ATXN1; (+) strand; PAM type: NNAGAAW; PAM sequence: TGAGAAA
gtgtggaggaaaagttgacg

SEQ ID NO: 10019 - DNA, 20 bp, Artificial Sequence
  Description of Artificial Sequence: Synthetic oligonucleotide
  Target: ATXN1; (+) strand; PAM type: NNAGAAW; PAM sequence: GGAGAAT
ctactcaggaggctgaggca

SEQ ID NO: 10020 - DNA, 20 bp, Artificial Sequence
  Description of Artificial Sequence: Synthetic oligonucleotide
  Target: ATXN1; (+) strand; PAM type: NNAGAAW; PAM sequence: TAAGAAT
ggtaaaaaaccataattgtc

SEQ ID NO: 10021 - DNA, 20 bp, Artificial Sequence
  Description of Artificial Sequence: Synthetic oligonucleotide
  Target: ATXN1; (+) strand; PAM type: NNAGAAW; PAM sequence: TAAGAAA
aaacttcaaatgaaagaggg

SEQ ID NO: 10022 - DNA, 20 bp, Artificial Sequence
  Description of Artificial Sequence: Synthetic oligonucleotide
  Target: ATXN1; (+) strand; PAM type: NNAGAAW; PAM sequence: GAAGAAT
aaaaaaaaaaaaaaaaaaca

SEQ ID NO: 10023 - DNA, 20 bp, Artificial Sequence
  Description of Artificial Sequence: Synthetic oligonucleotide
  Target: ATXN1; (+) strand; PAM type: NNAGAAW; PAM sequence: ATAGAAA
tctctaaaggaactacttgt

SEQ ID NO: 10024 - DNA, 20 bp, Artificial Sequence
  Description of Artificial Sequence: Synthetic oligonucleotide
  Target: ATXN1; (+) strand; PAM type: NNAGAAW; PAM sequence: TCAGAAA
cagacaaaactaaacagcca

SEQ ID NO: 10025 - DNA, 20 bp, Artificial Sequence
  Description of Artificial Sequence: Synthetic oligonucleotide
  Target: ATXN1; (+) strand; PAM type: NNAGAAW; PAM sequence: CAAGAAA
attatagtagacagcaaaac

SEQ ID NO: 10026 - DNA, 20 bp, Artificial Sequence
  Description of Artificial Sequence: Synthetic oligonucleotide
  Target: ATXN1; (+) strand; PAM type: NNAGAAW; PAM sequence: TCAGAAA
atcttatcaccagttcagat

SEQ ID NO: 10027 - DNA, 20 bp, Artificial Sequence
  Description of Artificial Sequence: Synthetic oligonucleotide
  Target: ATXN1; (+) strand; PAM type: NNAGAAW; PAM sequence: GTAGAAA
agtaaccacacaacagagct

SEQ ID NO: 10028 - DNA, 20 bp, Artificial Sequence
  Description of Artificial Sequence: Synthetic oligonucleotide
  Target: ATXN1; (+) strand; PAM type: NNAGAAW; PAM sequence: TTAGAAA
agctgtagaaaacttcacta

SEQ ID NO: 10029 - DNA, 20 bp, Artificial Sequence
  Description of Artificial Sequence: Synthetic oligonucleotide
  Target: ATXN1; (+) strand; PAM type: NNAGAAW; PAM sequence: ATAGAAT
aactgtggtacatccataca

SEQ ID NO: 10030 - DNA, 20 bp, Artificial Sequence
  Description of Artificial Sequence: Synthetic oligonucleotide
  Target: ATXN1; (+) strand; PAM type: NNAGAAW; PAM sequence: ACAGAAA
aaaaatggcactctgatagg

SEQ ID NO: 10031 - DNA, 20 bp, Artificial Sequence
  Description of Artificial Sequence: Synthetic oligonucleotide
  Target: ATXN1; (+) strand; PAM type: NNAGAAW; PAM sequence: ACAGAAT
ggcactctgataggacagaa

SEQ ID NO: 10032 - DNA, 20 bp, Artificial Sequence
  Description of Artificial Sequence: Synthetic oligonucleotide
  Target: ATXN1; (+) strand; PAM type: NNAGAAW; PAM sequence: TTAGAAT
ctattctgtcctatttttcc

SEQ ID NO: 10033 - DNA, 20 bp, Artificial Sequence
  Description of Artificial Sequence: Synthetic oligonucleotide
  Target: ATXN1; (+) strand; PAM type: NNAGAAW; PAM sequence: TCAGAAA
taggcacccaggctcaccaa

SEQ ID NO: 10034 - DNA, 20 bp, Artificial Sequence
  Description of Artificial Sequence: Synthetic oligonucleotide
  Target: ATXN1; (+) strand; PAM type: NNAGAAW; PAM sequence: TCAGAAA
aagctaggataggaggagac

SEQ ID NO: 10035 - DNA, 20 bp, Artificial Sequence
  Description of Artificial Sequence: Synthetic oligonucleotide
  Target: ATXN1; (+) strand; PAM type: NNAGAAW; PAM sequence: GGAGAAA
gtaaggtcctaataacaaca

SEQ ID NO: 10036 - DNA, 20 bp, Artificial Sequence
  Description of Artificial Sequence: Synthetic oligonucleotide
  Target: ATXN1; (+) strand; PAM type: NNAGAAW; PAM sequence: CAAGAAT
ttaggactctaacaggtttt

SEQ ID NO: 10037 - DNA, 20 bp, Artificial Sequence
  Description of Artificial Sequence: Synthetic oligonucleotide
  Target: ATXN1; (+) strand; PAM type: NNAGAAW; PAM sequence: TGAGAAT
aaggcaagggtgcaggtttt

SEQ ID NO: 10038 - DNA, 20 bp, Artificial Sequence
  Description of Artificial Sequence: Synthetic oligonucleotide
  Target: ATXN1; (+) strand; PAM type: NNAGAAW; PAM sequence: AGAGAAA
tgggttcttgggcagggaga

SEQ ID NO: 10039 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
ccatccagaaggaaacaagc

SEQ ID NO: 10040 - DNA, 20 bp, Artificial Sequence
  Description of Artificial Sequence: Synthetic oligonucleotide
  Target: ATXN1; (+) strand; PAM type: NNAGAAW; PAM sequence: AAAGAAT
caaaccctggcctttaatga

SEQ ID NO: 10041 - DNA, 20 bp, Artificial Sequence
  Description of Artificial Sequence: Synthetic oligonucleotide
  Target: ATXN1; (+) strand; PAM type: NNAGAAW; PAM sequence: CGAGAAT
atgcagctttagctgcagcc

SEQ ID NO: 10042 - DNA, 20 bp, Artificial Sequence
  Description of Artificial Sequence: Synthetic oligonucleotide
  Target: ATXN1; (+) strand; PAM type: NNAGAAW; PAM sequence: GAAGAAA
taaatgacaaaatgacagcc

SEQ ID NO: 10043 - DNA, 20 bp, Artificial Sequence
  Description of Artificial Sequence: Synthetic oligonucleotide
  Target: ATXN1; (+) strand; PAM type: NNAGAAW; PAM sequence: GGAGAAT
ctgtattccagaaggactaa

SEQ ID NO: 10044 - DNA, 20 bp, Artificial Sequence
  Description of Artificial Sequence: Synthetic oligonucleotide
  Target: ATXN1; (+) strand; PAM type: NNAGAAW; PAM sequence: GAAGAAA
ccaccataactcagggaaag

SEQ ID NO: 10045 - DNA, 20 bp, Artificial Sequence
  Description of Artificial Sequence: Synthetic oligonucleotide
  Target: ATXN1; (+) strand; PAM type: NNAGAAW; PAM sequence: TAAGAAA
caagcagctatgggaggcct

SEQ ID NO: 10046 - DNA, 20 bp, Artificial Sequence
  Description of Artificial Sequence: Synthetic oligonucleotide
  Target: ATXN1; (+) strand; PAM type: NNAGAAW; PAM sequence: GGAGAAA
cccaatcagctgagatatca

SEQ ID NO: 10047 - DNA, 20 bp, Artificial Sequence
  Description of Artificial Sequence: Synthetic oligonucleotide
  Target: ATXN1; (+) strand; PAM type: NNAGAAW; PAM sequence: GCAGAAA
ataggaaccaagaggaacag

SEQ ID NO: 10048 - DNA, 20 bp, Artificial Sequence
  Description of Artificial Sequence: Synthetic oligonucleotide
  Target: ATXN1; (+) strand; PAM type: NNAGAAW; PAM sequence: AGAGAAA
agaaaaggaaaagcgagata

SEQ ID NO: 10049 - DNA, 20 bp, Artificial Sequence
  Description of Artificial Sequence: Synthetic oligonucleotide
  Target: ATXN1; (+) strand; PAM type: NNAGAAW; PAM sequence: ACAGAAA
accttggtggttcagagagg

SEQ ID NO: 10050 - DNA, 20 bp, Artificial Sequence
  Description of Artificial Sequence: Synthetic oligonucleotide
  Target: ATXN1; (+) strand; PAM type: NNAGAAW; PAM sequence: CAAGAAA
ccttaaaaaagactgtccaa

SEQ ID NO: 10051 - DNA, 20 bp, Artificial Sequence
  Description of Artificial Sequence: Synthetic oligonucleotide
  Target: ATXN1; (+) strand; PAM type: NNAGAAW; PAM sequence: TAAGAAA
tttaaaagttcgaggcttag

SEQ ID NO: 10052 - DNA, 20 bp, Artificial Sequence
  Description of Artificial Sequence: Synthetic oligonucleotide
  Target: ATXN1; (+) strand; PAM type: NNAGAAW; PAM sequence: GCAGAAT
tctctcaaataccaaaggaa

SEQ ID NO: 10053 - DNA, 20 bp, Artificial Sequence
  Description of Artificial Sequence: Synthetic oligonucleotide
  Target: ATXN1; (+) strand; PAM type: NNAGAAW; PAM sequence: GTAGAAT
agagggcaaatattcatcta

SEQ ID NO: 10054 - DNA, 20 bp, Artificial Sequence
  Description of Artificial Sequence: Synthetic oligonucleotide
  Target: ATXN1; (+) strand; PAM type: NNAGAAW; PAM sequence: GCAGAAA
tagtagaatgggaaccagag

SEQ ID NO: 10055 - DNA, 20 bp, Artificial Sequence
  Description of Artificial Sequence: Synthetic oligonucleotide
  Target: ATXN1; (+) strand; PAM type: NNAGAAW; PAM sequence: TCAGAAA
ccaaaggaaatttatggcta

SEQ ID NO: 10056 - DNA, 20 bp, Artificial Sequence
  Description of Artificial Sequence: Synthetic oligonucleotide
  Target: ATXN1; (+) strand; PAM type: NNAGAAW; PAM sequence: GGAGAAT
accgatggaagttcatttgt

SEQ ID NO: 10057 - DNA, 20 bp, Artificial Sequence
  Description of Artificial Sequence: Synthetic oligonucleotide
  Target: ATXN1; (+) strand; PAM type: NNAGAAW; PAM sequence: AAAGAAT
cttagaaccgggaaaggaaa

SEQ ID NO: 10058 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
atgcccatgctgcaatatgg

SEQ ID NO: 10059 - DNA, 20 bp, Artificial Sequence
  Description of Artificial Sequence: Synthetic oligonucleotide
  Target: ATXN1; (+) strand; PAM type: NNAGAAW; PAM sequence: GGAGAAA
gaagccatcaaaaaggtgaa

SEQ ID NO: 10060 - DNA, 20 bp, Artificial Sequence
  Description of Artificial Sequence: Synthetic oligonucleotide
  Target: ATXN1; (+) strand; PAM type: NNAGAAW; PAM sequence: TTAGAAA
ctgccaggcagaacctccca

SEQ ID NO: 10061 - DNA, 20 bp, Artificial Sequence
  Description of Artificial Sequence: Synthetic oligonucleotide
  Target: ATXN1; (+) strand; PAM type: NNAGAAW; PAM sequence: ACAGAAT
cccagtactccctgatcgaa

SEQ ID NO: 10062 - DNA, 20 bp, Artificial Sequence
  Description of Artificial Sequence: Synthetic oligonucleotide
  Target: ATXN1; (+) strand; PAM type: NNAGAAW; PAM sequence: AAAGAAT
taaggccccttttggggaac

SEQ ID NO: 10063 - DNA, 20 bp, Artificial Sequence
  Description of Artificial Sequence: Synthetic oligonucleotide
  Target: ATXN1; (+) strand; PAM type: NNAGAAW; PAM sequence: CAAGAAA
ggcacttaaggaaacgaaca

SEQ ID NO: 10064 - DNA, 20 bp, Artificial Sequence
  Description of Artificial Sequence: Synthetic oligonucleotide
  Target: ATXN1; (+) strand; PAM type: NNAGAAW; PAM sequence: TGAGAAT
tctcttgcccatggccttgt

SEQ ID NO: 10065 - DNA, 20 bp, Artificial Sequence
  Description of Artificial Sequence: Synthetic oligonucleotide
  Target: ATXN1; (+) strand; PAM type: NNAGAAW; PAM sequence: TAAGAAT
aatacccctacttatacggt

SEQ ID NO: 10066 - DNA, 20 bp, Artificial Sequence
  Description of Artificial Sequence: Synthetic oligonucleotide
  Target: ATXN1; (+) strand; PAM type: NNAGAAW; PAM sequence: CCAGAAT
aatagccactgctacaggaa

SEQ ID NO: 10067 - DNA, 20 bp, Artificial Sequence
  Description of Artificial Sequence: Synthetic oligonucleotide
  Target: ATXN1; (+) strand; PAM type: NNAGAAW; PAM sequence: CAAGAAA
ggatttctcaagacagtttg

SEQ ID NO: 10068 - DNA, 20 bp, Artificial Sequence
  Description of Artificial Sequence: Synthetic oligonucleotide
  Target: ATXN1; (+) strand; PAM type: NNAGAAW; PAM sequence: TGAGAAA
ggcctagacctcctcactgc

SEQ ID NO: 10069 - DNA, 20 bp, Artificial Sequence
  Description of Artificial Sequence: Synthetic oligonucleotide
  Target: ATXN1; (+) strand; PAM type: NNAGAAW; PAM sequence: ACAGAAA
aaaaagggcactctgacaga

SEQ ID NO: 10070 - DNA, 20 bp, Artificial Sequence
  Description of Artificial Sequence: Synthetic oligonucleotide
  Target: ATXN1; (+) strand; PAM type: NNAGAAW; PAM sequence: ACAGAAT
atgtcatctatttgtcaaac

SEQ ID NO: 10071 - DNA, 20 bp, Artificial Sequence
  Description of Artificial Sequence: Synthetic oligonucleotide
  Target: ATXN1; (+) strand; PAM type: NNAGAAW; PAM sequence: GAAGAAT
aaacacagaatgtacaacag

SEQ ID NO: 10072 - DNA, 20 bp, Artificial Sequence
  Description of Artificial Sequence: Synthetic oligonucleotide
  Target: ATXN1; (+) strand; PAM type: NNAGAAW; PAM sequence: ATAGAAA
aaaccccgtctctactaaaa

SEQ ID NO: 10073 - DNA, 20 bp, Artificial Sequence
  Description of Artificial Sequence: Synthetic oligonucleotide
  Target: ATXN1; (+) strand; PAM type: NNAGAAW; PAM sequence: GGAGAAT
ctacttgggaggctgaggca

SEQ ID NO: 10074 - DNA, 20 bp, Artificial Sequence
  Description of Artificial Sequence: Synthetic oligonucleotide
  Target: ATXN1; (+) strand; PAM type: NNAGAAW; PAM sequence: ACAGAAA
cttgctttgagggaaagtaa

SEQ ID NO: 10075 - DNA, 20 bp, Artificial Sequence
  Description of Artificial Sequence: Synthetic oligonucleotide
  Target: ATXN1; (+) strand; PAM type: NNAGAAW; PAM sequence: CAAGAAA
ctaagggaatgcataatttc

SEQ ID NO: 10076 - DNA, 20 bp, Artificial Sequence
  Description of Artificial Sequence: Synthetic oligonucleotide
  Target: ATXN1; (+) strand; PAM type: NNAGAAW; PAM sequence: GGAGAAT
ctactagggaggctgaggca

SEQ ID NO: 10077 - DNA, 20 bp, Artificial Sequence
  Description of Artificial Sequence: Synthetic oligonucleotide
  Target: ATXN1; (+) strand; PAM type: NNAGAAW; PAM sequence: TCAGAAT
gttcctagatttcttctctt

SEQ ID NO: 10078 - DNA, 20 bp, Artificial Sequence
  Description of Artificial Sequence: Synthetic oligonucleotide
  Target: ATXN1; (+) strand; PAM type: NNAGAAW; PAM sequence: GCAGAAA
gggcagtacaattgatattg

SEQ ID NO: 10079 - DNA, 20 bp, Artificial Sequence
  Description of Artificial Sequence: Synthetic oligonucleotide
  Target: ATXN1; (+) strand; PAM type: NNAGAAW; PAM sequence: AGAGAAA
acaattgatattggcagaaa

SEQ ID NO: 10080 - DNA, 20 bp, Artificial Sequence
  Description of Artificial Sequence: Synthetic oligonucleotide
  Target: ATXN1; (+) strand; PAM type: NNAGAAW; PAM sequence: CCAGAAA
tatactggaaaagtcagtag

SEQ ID NO: 10081 - DNA, 20 bp, Artificial Sequence
  Description of Artificial Sequence: Synthetic oligonucleotide
  Target: ATXN1; (+) strand; PAM type: NNAGAAW; PAM sequence: GAAGAAA
acaacttttgcaatgtgaga

SEQ ID NO: 10082 - DNA, 20 bp, Artificial Sequence
  Description of Artificial Sequence: Synthetic oligonucleotide
  Target: ATXN1; (+) strand; PAM type: NNAGAAW; PAM sequence: ATAGAAA
atttgtatatatatatatcc

SEQ ID NO: 10083 - DNA, 20 bp, Artificial Sequence
  Description of Artificial Sequence: Synthetic oligonucleotide
  Target: ATXN1; (+) strand; PAM type: NNAGAAW; PAM sequence: GAAGAAA
tatccatagaaaatcttctg

SEQ ID NO: 10084 - DNA, 20 bp, Artificial Sequence
  Description of Artificial Sequence: Synthetic oligonucleotide
  Target: ATXN1; (+) strand; PAM type: NNAGAAW; PAM sequence: AGAGAAT
atttctcttcaagctattac

SEQ ID NO: 10085 - DNA, 20 bp, Artificial Sequence
  Description of Artificial Sequence: Synthetic oligonucleotide
  Target: ATXN1; (+) strand; PAM type: NNAGAAW; PAM sequence: GTAGAAT
taacgtcttcctcgctgagg

SEQ ID NO: 10086 - DNA, 20 bp, Artificial Sequence
  Description of Artificial Sequence: Synthetic oligonucleotide
  Target: ATXN1; (+) strand; PAM type: NNAGAAW; PAM sequence: GCAGAAA
catcaaaatgcacaacatat

SEQ ID NO: 10087 - DNA, 20 bp, Artificial Sequence
  Description of Artificial Sequence: Synthetic oligonucleotide
  Target: ATXN1; (+) strand; PAM type: NNAGAAW; PAM sequence: TCAGAAA
aatgtaggagtatgaaaaag

SEQ ID NO: 10088 - DNA, 20 bp, Artificial Sequence
  Description of Artificial Sequence: Synthetic oligonucleotide
  Target: ATXN1; (+) strand; PAM type: NNAGAAW; PAM sequence: CCAGAAT
agtggcagtaacaataaaaa

SEQ ID NO: 10089 - DNA, 20 bp, Artificial Sequence
  Description of Artificial Sequence: Synthetic oligonucleotide
  Target: ATXN1; (+) strand; PAM type: NNAGAAW; PAM sequence: TAAGAAT
tctgaggctagagactaaag

SEQ ID NO: 10090 - DNA, 20 bp, Artificial Sequence
  Description of Artificial Sequence: Synthetic oligonucleotide
  Target: ATXN1; (+) strand; PAM type: NNAGAAW; PAM sequence: AGAGAAT
agattgttaacaatgtccta

SEQ ID NO: 10091 - DNA, 20 bp, Artificial Sequence
  Description of Artificial Sequence: Synthetic oligonucleotide
  Target: ATXN1; (+) strand; PAM type: NNAGAAW; PAM sequence: TGAGAAT
tagagaagttttcagatgct

SEQ ID NO: 10092 - DNA, 20 bp, Artificial Sequence
  Description of Artificial Sequence: Synthetic oligonucleotide
  Target: ATXN1; (+) strand; PAM type: NNAGAAW; PAM sequence: GCAGAAA
gatgcttcttctgaatagaa

SEQ ID NO: 10093 - DNA, 20 bp, Artificial Sequence
  Description of Artificial Sequence: Synthetic oligonucleotide
  Target: ATXN1; (+) strand; PAM type: NNAGAAW; PAM sequence: ATAGAAA
aaaaaaaaggtaggactgtg

SEQ ID NO: 10094 - DNA, 20 bp, Artificial Sequence
  Description of Artificial Sequence: Synthetic oligonucleotide
  Target: ATXN1; (+) strand; PAM type: NNAGAAW; PAM sequence: CTAGAAA
cccttggctgtccaaacctt

SEQ ID NO: 10095 - DNA, 20 bp, Artificial Sequence
  Description of Artificial Sequence: Synthetic oligonucleotide
  Target: ATXN1; (+) strand; PAM type: NNAGAAW; PAM sequence: AAAGAAT
aatgaatgaatgaatgcatg

SEQ ID NO: 10096 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
gaagaactaggcaaggggtt

SEQ ID NO: 10097 - DNA, 20 bp, Artificial Sequence
  Description of Artificial Sequence: Synthetic oligonucleotide
  Target: ATXN1; (+) strand; PAM type: NNAGAAW; PAM sequence: ATAGAAA
ccaggatcatttgcatttta

SEQ ID NO: 10098 - DNA, 20 bp, Artificial Sequence
  Description of Artificial Sequence: Synthetic oligonucleotide
  Target: ATXN1; (+) strand; PAM type: NNAGAAW; PAM sequence: GCAGAAA
aggcctcaggaaagaggtca

SEQ ID NO: 10099 - DNA, 20 bp, Artificial Sequence
  Description of Artificial Sequence: Synthetic oligonucleotide
  Target: ATXN1; (+) strand; PAM type: NNAGAAW; PAM sequence: GCAGAAA
gcttcaaataacactactag

SEQ ID NO: 10100 - DNA, 20 bp, Artificial Sequence
  Description of Artificial Sequence: Synthetic oligonucleotide
  Target: ATXN1; (+) strand; PAM type: NNAGAAW; PAM sequence: ACAGAAT
ctacttgggaggctgaggca

SEQ ID NO: 10101 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
ctctgtctcaaaaaaaaaaa

SEQ ID NO: 10102 - DNA, 20 bp, Artificial Sequence
  Description of Artificial Sequence: Synthetic oligonucleotide
  Target: ATXN1; (+) strand; PAM type: NNAGAAW; PAM sequence: ACAGAAT
aaatgtggtctacacataca

SEQ ID NO: 10103 - DNA, 20 bp, Artificial Sequence
  Description of Artificial Sequence: Synthetic oligonucleotide
  Target: ATXN1; (+) strand; PAM type: NNAGAAW; PAM sequence: GTAGAAT
gtcaaaataatagacagcaa

SEQ ID NO: 10104 - DNA, 20 bp, Artificial Sequence
  Description of Artificial Sequence: Synthetic oligonucleotide
  Target: ATXN1; (+) strand; PAM type: NNAGAAW; PAM sequence: CCAGAAA
tgggtctagattcagttttg

SEQ ID NO: 10105 - DNA, 20 bp, Artificial Sequence
  Description of Artificial Sequence: Synthetic oligonucleotide
  Target: ATXN1; (+) strand; PAM type: NNAGAAW; PAM sequence: TCAGAAT
ggaaagttattggacagaag

SEQ ID NO: 10106 - DNA, 20 bp, Artificial Sequence
  Description of Artificial Sequence: Synthetic oligonucleotide
  Target: ATXN1; (+) strand; PAM type: NNAGAAW; PAM sequence: AGAGAAA
atctctataaaaaataatta

SEQ ID NO: 10107 - DNA, 20 bp, Artificial Sequence
  Description of Artificial Sequence: Synthetic oligonucleotide
  Target: ATXN1; (+) strand; PAM type: NNAGAAW; PAM sequence: GAAGAAT
tgcaatgagtagttaagttt

SEQ ID NO: 10108 - DNA, 20 bp, Artificial Sequence
  Description of Artificial Sequence: Synthetic oligonucleotide
  Target: ATXN1; (+) strand; PAM type: NNAGAAW; PAM sequence: ACAGAAA
tgtgtgtgtgtgtgtgtgag

SEQ ID NO: 10109 - DNA, 20 bp, Artificial Sequence
  Description of Artificial Sequence: Synthetic oligonucleotide
  Target: ATXN1; (+) strand; PAM type: NNAGAAW; PAM sequence: TGAGAAA
ggcaaccaagtgtgtagctt

SEQ ID NO: 10110 - DNA, 20 bp, Artificial Sequence
  Description of Artificial Sequence: Synthetic oligonucleotide
  Target: ATXN1; (+) strand; PAM type: NNAGAAW; PAM sequence: TTAGAAT
atacccatgtccctggcagc

SEQ ID NO: 10111 - DNA, 20 bp, Artificial Sequence
  Description of Artificial Sequence: Synthetic oligonucleotide
  Target: ATXN1; (+) strand; PAM type: NNAGAAW; PAM sequence: TAAGAAA
acatacaaagtgcagatgag

SEQ ID NO: 10112 - DNA, 20 bp, Artificial Sequence
  Description of Artificial Sequence: Synthetic oligonucleotide
  Target: ATXN1; (+) strand; PAM type: NNAGAAW; PAM sequence: AGAGAAA
gattacatacatatttataa

SEQ ID NO: 10113 - DNA, 20 bp, Artificial Sequence
  Description of Artificial Sequence: Synthetic oligonucleotide
  Target: ATXN1; (+) strand; PAM type: NNAGAAW; PAM sequence: ATAGAAT
aaccatatcttcctttcagt

SEQ ID NO: 10114 - DNA, 20 bp, Artificial Sequence
  Description of Artificial Sequence: Synthetic oligonucleotide
  Target: ATXN1; (+) strand; PAM type: NNAGAAW; PAM sequence: GCAGAAT
tctgctattaaagcaaataa

SEQ ID NO: 10115 - DNA, 20 bp, Artificial Sequence
  Description of Artificial Sequence: Synthetic oligonucleotide
  Target: ATXN1; (+) strand; PAM type: NNAGAAW; PAM sequence: GGAGAAA
tctgttcgaactctttgatt

SEQ ID NO: 10116 - DNA, 20 bp, Artificial Sequence
  Description of Artificial Sequence: Synthetic oligonucleotide
  Target: ATXN1; (+) strand; PAM type: NNAGAAW; PAM sequence: TCAGAAT
ctctttgattggagaaaagg

SEQ ID NO: 10117 - DNA, 20 bp, Artificial Sequence
  Description of Artificial Sequence: Synthetic oligonucleotide
  Target: ATXN1; (+) strand; PAM type: NNAGAAW; PAM sequence: TTAGAAA
ttcttttttaatgaaaaaaa

SEQ ID NO: 10118 - DNA, 20 bp, Artificial Sequence
  Description of Artificial Sequence: Synthetic oligonucleotide
  Target: ATXN1; (+) strand; PAM type: NNAGAAW; PAM sequence: CAAGAAT
atatttgctgaaagaagata

SEQ ID NO: 10119 - DNA, 20 bp, Artificial Sequence
  Description of Artificial Sequence: Synthetic oligonucleotide
  Target: ATXN1; (+) strand; PAM type: NNAGAAW; PAM sequence: AAAGAAT
tttcttctatcctaaatttc

SEQ ID NO: 10120 - DNA, 20 bp, Artificial Sequence
  Description of Artificial Sequence: Synthetic oligonucleotide
  Target: ATXN1; (+) strand; PAM type: NNAGAAW; PAM sequence: GCAGAAA
taatgacaactcctattata

SEQ ID NO: 10121 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
tgtatctagctaggttgtga

SEQ ID NO: 10122 - DNA, 20 bp, Artificial Sequence
  Description of Artificial Sequence: Synthetic oligonucleotide
  Target: ATXN1; (+) strand; PAM type: NNAGAAW; PAM sequence: AAAGAAT
ctagctaggttgtgaaaaga

SEQ ID NO: 10123 - DNA, 20 bp, Artificial Sequence
  Description of Artificial Sequence: Synthetic oligonucleotide
  Target: ATXN1; (+) strand; PAM type: NNAGAAW; PAM sequence: GAAGAAT
aagcaaccatcaaacccaga

SEQ ID NO: 10124 - DNA, 20 bp, Artificial Sequence
  Description of Artificial Sequence: Synthetic oligonucleotide
  Target: ATXN1; (+) strand; PAM type: NNAGAAW; PAM sequence: AAAGAAT
ctttatgacctgtgcactat

SEQ ID NO: 10125 - DNA, 20 bp, Artificial Sequence
  Description of Artificial Sequence: Synthetic oligonucleotide
  Target: ATXN1; (+) strand; PAM type: NNAGAAW; PAM sequence: CTAGAAA
tgttgagtatacaaaacgtg

SEQ ID NO: 10126 - DNA, 20 bp, Artificial Sequence
  Description of Artificial Sequence: Synthetic oligonucleotide
  Target: ATXN1; (+) strand; PAM type: NNAGAAW; PAM sequence: GGAGAAA
acacagacgaagcactctca

SEQ ID NO: 10127 - DNA, 20 bp, Artificial Sequence
  Description of Artificial Sequence: Synthetic oligonucleotide
  Target: ATXN1; (+) strand; PAM type: NNAGAAW; PAM sequence: GCAGAAA
tggatccaaatcggaaaatg

SEQ ID NO: 10128 - DNA, 20 bp, Artificial Sequence
  Description of Artificial Sequence: Synthetic oligonucleotide
  Target: ATXN1; (+) strand; PAM type: NNAGAAW; PAM sequence: CAAGAAA
caaaacattaacctaattca

SEQ ID NO: 10129 - DNA, 20 bp, Artificial Sequence
  Description of Artificial Sequence: Synthetic oligonucleotide
  Target: ATXN1; (+) strand; PAM type: NNAGAAW; PAM sequence: CCAGAAA
tccgtgggattctatctgta

SEQ ID NO: 10130 - DNA, 20 bp, Artificial Sequence
  Description of Artificial Sequence: Synthetic oligonucleotide
  Target: ATXN1; (+) strand; PAM type: NNAGAAW; PAM sequence: ACAGAAA
actggcgtcactgcggaggc

SEQ ID NO: 10131 - DNA, 20 bp, Artificial Sequence
  Description of Artificial Sequence: Synthetic oligonucleotide
  Target: ATXN1; (+) strand; PAM type: NNAGAAW; PAM sequence: CCAGAAA
cacaagccgaagtatgacag

SEQ ID NO: 10132 - DNA, 20 bp, Artificial Sequence
  Description of Artificial Sequence: Synthetic oligonucleotide
  Target: ATXN1; (+) strand; PAM type: NNAGAAW; PAM sequence: AGAGAAT
gggcttgccatggttgaaga

SEQ ID NO: 10133 - DNA, 20 bp, Artificial Sequence
  Description of Artificial Sequence: Synthetic oligonucleotide
  Target: ATXN1; (+) strand; PAM type: NNAGAAW; PAM sequence: GGAGAAA
aagtcttggattttagccct

SEQ ID NO: 10134 - DNA, 20 bp, Artificial Sequence
  Description of Artificial Sequence: Synthetic oligonucleotide
  Target: ATXN1; (+) strand; PAM type: NNAGAAW; PAM sequence: GAAGAAA
aagccacaaaggcttgggaa

SEQ ID NO: 10135 - DNA, 20 bp, Artificial Sequence
  Description of Artificial Sequence: Synthetic oligonucleotide
  Target: ATXN1; (+) strand; PAM type: NNAGAAW; PAM sequence: TTAGAAA
agagcaacctaatggaaact

SEQ ID NO: 10136 - DNA, 20 bp, Artificial Sequence
  Description of Artificial Sequence: Synthetic oligonucleotide
  Target: ATXN1; (+) strand; PAM type: NNAGAAW; PAM sequence: TGAGAAA
gatgctgtttaaaaatgtat

SEQ ID NO: 10137 - DNA, 20 bp, Artificial Sequence
  Description of Artificial Sequence: Synthetic oligonucleotide
  Target: ATXN1; (+) strand; PAM type: NNAGAAW; PAM sequence: GTAGAAT
aaaaatgtattgagaaagaa

SEQ ID NO: 10138 - DNA, 20 bp, Artificial Sequence
  Description of Artificial Sequence: Synthetic oligonucleotide
  Target: ATXN1; (+) strand; PAM type: NNAGAAW; PAM sequence: GGAGAAT
ctacttgggaggctgaggca

SEQ ID NO: 10139 - DNA, 20 bp, Artificial Sequence
  Description of Artificial Sequence: Synthetic oligonucleotide
  Target: ATXN1; (+) strand; PAM type: NNAGAAW; PAM sequence: GAAGAAA
aaaatatctaaaatgatcct

SEQ ID NO: 10140 - DNA, 20 bp, Artificial Sequence
  Description of Artificial Sequence: Synthetic oligonucleotide
  Target: ATXN1; (+) strand; PAM type: NNAGAAW; PAM sequence: AGAGAAA
caaggaagtctgaggaagag

SEQ ID NO: 10141 - DNA, 20 bp, Artificial Sequence
  Description of Artificial Sequence: Synthetic oligonucleotide
  Target: ATXN1; (+) strand; PAM type: NNAGAAW; PAM sequence: AGAGAAA
aagagagagaaatgggtgaa

SEQ ID NO: 10142 - DNA, 20 bp, Artificial Sequence
  Description of Artificial Sequence: Synthetic oligonucleotide
  Target: ATXN1; (+) strand; PAM type: NNAGAAW; PAM sequence: TAAGAAA
gagcattacaagcaaggatt

SEQ ID NO: 10143 - DNA, 20 bp, Artificial Sequence
  Description of Artificial Sequence: Synthetic oligonucleotide
  Target: ATXN1; (+) strand; PAM type: NNAGAAW; PAM sequence: GGAGAAT
gattttttttttgtaacgct

SEQ ID NO: 10144 - DNA, 20 bp, Artificial Sequence
  Description of Artificial Sequence: Synthetic oligonucleotide
  Target: ATXN1; (+) strand; PAM type: NNAGAAW; PAM sequence: AGAGAAA
tagtctggagattcagagta

SEQ ID NO: 10145 - DNA, 20 bp, Artificial Sequence
  Description of Artificial Sequence: Synthetic oligonucleotide
  Target: ATXN1; (+) strand; PAM type: NNAGAAW; PAM sequence: CCAGAAA
gtccatagacacacaaaatt

SEQ ID NO: 10146 - DNA, 20 bp, Artificial Sequence
  Description of Artificial Sequence: Synthetic oligonucleotide
  Target: ATXN1; (+) strand; PAM type: NNAGAAW; PAM sequence: TAAGAAA
taactagcacaatgcctccc

SEQ ID NO: 10147 - DNA, 20 bp, Artificial Sequence
  Description of Artificial Sequence: Synthetic oligonucleotide
  Target: ATXN1; (+) strand; PAM type: NNAGAAW; PAM sequence: CTAGAAT
ttttcattctaaggtgtgca

SEQ ID NO: 10148 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
caggcccatccctactttga

SEQ ID NO: 10149 - DNA, 20 bp, Artificial Sequence
  Description of Artificial Sequence: Synthetic oligonucleotide
  Target: ATXN1; (+) strand; PAM type: NNAGAAW; PAM sequence: ACAGAAA
agacaaaaccaccgccgttc

SEQ ID NO: 10150 - DNA, 20 bp, Artificial Sequence
  Description of Artificial Sequence: Synthetic oligonucleotide
  Target: ATXN1; (+) strand; PAM type: NNAGAAW; PAM sequence: TTAGAAA
gcagacttttaaaaaaagta

SEQ ID NO: 10151 - DNA, 20 bp, Artificial Sequence
  Description of Artificial Sequence: Synthetic oligonucleotide
  Target: ATXN1; (+) strand; PAM type: NNAGAAW; PAM sequence: CTAGAAT
cccaaactctactgataggt

SEQ ID NO: 10152 - DNA, 20 bp, Artificial Sequence
  Description of Artificial Sequence: Synthetic oligonucleotide
  Target: ATXN1; (+) strand; PAM type: NNAGAAW; PAM sequence: GAAGAAT
ggtactattcattcaccagg

SEQ ID NO: 10153 - DNA, 20 bp, Artificial Sequence
  Description of Artificial Sequence: Synthetic oligonucleotide
  Target: ATXN1; (+) strand; PAM type: NNAGAAW; PAM sequence: TAAGAAT
attcattcaccagggaagaa

SEQ ID NO: 10154 - DNA, 20 bp, Artificial Sequence
  Description of Artificial Sequence: Synthetic oligonucleotide
  Target: ATXN1; (+) strand; PAM type: NNAGAAW; PAM sequence: TGAGAAT
tcaccagggaagaataagaa

SEQ ID NO: 10155 - DNA, 20 bp, Artificial Sequence
  Description of Artificial Sequence: Synthetic oligonucleotide
  Target: ATXN1; (+) strand; PAM type: NNAGAAW; PAM sequence: TAAGAAT
aataagaatgagaataagga

SEQ ID NO: 10156 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
tataatatgtaaggtgctta

SEQ ID NO: 10157 - DNA, 20 bp, Artificial Sequence
  Description of Artificial Sequence: Synthetic oligonucleotide
  Target: ATXN1; (+) strand; PAM type: NNAGAAW; PAM sequence: CAAGAAT
gctgctttgataaggtaact

SEQ ID NO: 10158 - DNA, 20 bp, Artificial Sequence
  Description of Artificial Sequence: Synthetic oligonucleotide
  Target: ATXN1; (+) strand; PAM type: NNAGAAW; PAM sequence: TTAGAAA
atttgagcacagaggtggtt

SEQ ID NO: 10159 - DNA, 20 bp, Artificial Sequence
  Description of Artificial Sequence: Synthetic oligonucleotide
  Target: ATXN1; (+) strand; PAM type: NNAGAAW; PAM sequence: ACAGAAA
aggacactaaacccaggaag

SEQ ID NO: 10160 - DNA, 20 bp, Artificial Sequence
  Description of Artificial Sequence: Synthetic oligonucleotide
  Target: ATXN1; (+) strand; PAM type: NNAGAAW; PAM sequence: TAAGAAA
ttaccaacatcacagtttac

SEQ ID NO: 10161 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
ccaagcaaatgcggttttga

SEQ ID NO: 10162 - DNA, 20 bp, Artificial Sequence
  Description of Artificial Sequence: Synthetic oligonucleotide
  Target: ATXN1; (+) strand; PAM type: NNAGAAW; PAM sequence: CTAGAAT
tagcatgcacaaagagttca

SEQ ID NO: 10163 - DNA, 20 bp, Artificial Sequence
  Description of Artificial Sequence: Synthetic oligonucleotide
  Target: ATXN1; (+) strand; PAM type: NNAGAAW; PAM sequence: ACAGAAA
acaattattccttgatagtg

SEQ ID NO: 10164 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
taaggcaccacctcaattaa

SEQ ID NO: 10165 - DNA, 20 bp, Artificial Sequence
  Description of Artificial Sequence: Synthetic oligonucleotide
  Target: ATXN1; (+) strand; PAM type: NNAGAAW; PAM sequence: ACAGAAT
ttccactagacccaacgtgt

SEQ ID NO: 10166 - DNA, 20 bp, Artificial Sequence
  Description of Artificial Sequence: Synthetic oligonucleotide
  Target: ATXN1; (+) strand; PAM type: NNAGAAW; PAM sequence: TTAGAAA
gcatattttaatacaaatgt

SEQ ID NO: 10167 - DNA, 20 bp, Artificial Sequence
  Description of Artificial Sequence: Synthetic oligonucleotide
  Target: ATXN1; (+) strand; PAM type: NNAGAAW; PAM sequence: ACAGAAA
caagagtatacatatatatt

SEQ ID NO: 10168 - DNA, 20 bp, Artificial Sequence
  Description of Artificial Sequence: Synthetic oligonucleotide
  Target: ATXN1; (+) strand; PAM type: NNAGAAW; PAM sequence: GAAGAAA
aaaacaacaacaaaaaccta

SEQ ID NO: 10169 - DNA, 20 bp, Artificial Sequence
  Description of Artificial Sequence: Synthetic oligonucleotide
  Target: ATXN1; (+) strand; PAM type: NNAGAAW; PAM sequence: CTAGAAA
ccagcaacaaggtaaattct

SEQ ID NO: 10170 - DNA, 20 bp, Artificial Sequence
  Description of Artificial Sequence: Synthetic oligonucleotide
  Target: ATXN1; (+) strand; PAM type: NNAGAAW; PAM sequence: AGAGAAA
ctcaagattttacaagccag

SEQ ID NO: 10171 - DNA, 20 bp, Artificial Sequence
  Description of Artificial Sequence: Synthetic oligonucleotide
  Target: ATXN1; (+) strand; PAM type: NNAGAAW; PAM sequence: GAAGAAT
tttcatcaactgcacataca

SEQ ID NO: 10172 - DNA, 20 bp, Artificial Sequence
  Description of Artificial Sequence: Synthetic oligonucleotide
  Target: ATXN1; (+) strand; PAM type: NNAGAAW; PAM sequence: GGAGAAT
tgattgctaatccttagcct

SEQ ID NO: 10173 - DNA, 20 bp, Artificial Sequence
  Description of Artificial Sequence: Synthetic oligonucleotide
  Target: ATXN1; (+) strand; PAM type: NNAGAAW; PAM sequence: GTAGAAA
gatactatttgactgtacca

SEQ ID NO: 10174 - DNA, 20 bp, Artificial Sequence
  Description of Artificial Sequence: Synthetic oligonucleotide
  Target: ATXN1; (+) strand; PAM type: NNAGAAW; PAM sequence: AAAGAAT
gaaaaggtgttcctacaatg

SEQ ID NO: 10175 - DNA, 20 bp, Artificial Sequence
  Description of Artificial Sequence: Synthetic oligonucleotide
  Target: ATXN1; (+) strand; PAM type: NNAGAAW; PAM sequence: AGAGAAA
gcagcatgccatagaagccg

SEQ ID NO: 10176 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
aaattcccttccaattaaaa

SEQ ID NO: 10177 - DNA, 20 bp, Artificial Sequence
  Description of Artificial Sequence: Synthetic oligonucleotide
  Target: ATXN1; (+) strand; PAM type: NNAGAAW; PAM sequence: TGAGAAA
ttcttcctttcacagagaag

SEQ ID NO: 10178 - DNA, 20 bp, Artificial Sequence
  Description of Artificial Sequence: Synthetic oligonucleotide
  Target: ATXN1; (+) strand; PAM type: NNAGAAW; PAM sequence: GAAGAAA
cctagcatggaaatagaaca

SEQ ID NO: 10179 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
atggaaatagaacagaagaa

SEQ ID NO: 10180 - DNA, 20 bp, Artificial Sequence
  Description of Artificial Sequence: Synthetic oligonucleotide
  Target: ATXN1; (+) strand; PAM type: NNAGAAW; PAM sequence: GAAGAAA
aaagcacacacagttcccga

SEQ ID NO: 10181 - DNA, 20 bp, Artificial Sequence
  Description of Artificial Sequence: Synthetic oligonucleotide
  Target: ATXN1; (+) strand; PAM type: NNAGAAW; PAM sequence: CCAGAAT
cctgttcctgagctctggag

SEQ ID NO: 10182 - DNA, 20 bp, Artificial Sequence
  Description of Artificial Sequence: Synthetic oligonucleotide
  Target: ATXN1; (+) strand; PAM type: NNAGAAW; PAM sequence: AAAGAAT
ctactgtgctgagtttcagg

SEQ ID NO: 10183 - DNA, 20 bp, Artificial Sequence
  Description of Artificial Sequence: Synthetic oligonucleotide
  Target: ATXN1; (+) strand; PAM type: NNAGAAW; PAM sequence: ACAGAAA
agtttcaggaaagaatagga

SEQ ID NO: 10184 - DNA, 20 bp, Artificial Sequence
  Description of Artificial Sequence: Synthetic oligonucleotide
  Target: ATXN1; (+) strand; PAM type: NNAGAAW; PAM sequence: GAAGAAT
gaaagaataggaacagaaac

SEQ ID NO: 10185 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
gaatctggaatctccgggaa

SEQ ID NO: 10186 - DNA, 20 bp, Artificial Sequence
  Description of Artificial Sequence: Synthetic oligonucleotide
  Target: ATXN1; (+) strand; PAM type: NNAGAAW; PAM sequence: GGAGAAA
aggcatcacgcaggaagcta

SEQ ID NO: 10187 - DNA, 20 bp, Artificial Sequence
  Description of Artificial Sequence: Synthetic oligonucleotide
  Target: ATXN1; (+) strand; PAM type: NNAGAAW; PAM sequence: CAAGAAA
attagcagctttgaggatga

SEQ ID NO: 10188 - DNA, 20 bp, Artificial Sequence
  Description of Artificial Sequence: Synthetic oligonucleotide
  Target: ATXN1; (+) strand; PAM type: NNAGAAW; PAM sequence: ACAGAAT
agctttgaggatgacaagaa

SEQ ID NO: 10189 - DNA, 20 bp, Artificial Sequence
  Description of Artificial Sequence: Synthetic oligonucleotide
  Target: ATXN1; (+) strand; PAM type: NNAGAAW; PAM sequence: CTAGAAT
aacagaatttaagtgctaca

SEQ ID NO: 10190 - DNA, 20 bp, Artificial Sequence
  Description of Artificial Sequence: Synthetic oligonucleotide
  Target: ATXN1; (+) strand; PAM type: NNAGAAW; PAM sequence: ACAGAAA
ctttcaaatcatgagcatgc

SEQ ID NO: 10191 - DNA, 20 bp, Artificial Sequence
  Description of Artificial Sequence: Synthetic oligonucleotide
  Target: ATXN1; (+) strand; PAM type: NNAGAAW; PAM sequence: CAAGAAT
cctttatctctaaaaaaagg

SEQ ID NO: 10192 - DNA, 20 bp, Artificial Sequence
  Description of Artificial Sequence: Synthetic oligonucleotide
  Target: ATXN1; (+) strand; PAM type: NNAGAAW; PAM sequence: AGAGAAA
agacaaaattgggacagaag

SEQ ID NO: 10193 - DNA, 20 bp, Artificial Sequence
  Description of Artificial Sequence: Synthetic oligonucleotide
  Target: ATXN1; (+) strand; PAM type: NNAGAAW; PAM sequence: ACAGAAT
agctcactgcctcaagaggg

SEQ ID NO: 10194 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
ttcaactgagtctccttgaa

SEQ ID NO: 10195 - DNA, 20 bp, Artificial Sequence
  Description of Artificial Sequence: Synthetic oligonucleotide
  Target: ATXN1; (+) strand; PAM type: NNAGAAW; PAM sequence: TAAGAAA
ctgcatgccacagctgaagt

SEQ ID NO: 10196 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
atgagccgcaagcaaggtgc

SEQ ID NO: 10197 - DNA, 20 bp, Artificial Sequence
  Description of Artificial Sequence: Synthetic oligonucleotide
  Target: ATXN1; (+) strand; PAM type: NNAGAAW; PAM sequence: TCAGAAA
acctggcaactttgacacac

SEQ ID NO: 10198 - DNA, 20 bp, Artificial Sequence
  Description of Artificial Sequence: Synthetic oligonucleotide
  Target: ATXN1; (+) strand; PAM type: NNAGAAW; PAM sequence: CAAGAAA
ctcagaaaggagagagagaa

SEQ ID NO: 10199 - DNA, 20 bp, Artificial Sequence
  Description of Artificial Sequence: Synthetic oligonucleotide
  Target: ATXN1; (+) strand; PAM type: NNAGAAW; PAM sequence: GGAGAAA
agtttcatcctctgcctaga

SEQ ID NO: 10200 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
agtttctaagctctctgatg

SEQ ID NO: 10201 - DNA, 20 bp, Artificial Sequence
  Description of Artificial Sequence: Synthetic oligonucleotide
  Target: ATXN1; (+) strand; PAM type: NNAGAAW; PAM sequence: AAAGAAT
aggacttaacccttactcca

SEQ ID NO: 10202 - DNA, 20 bp, Artificial Sequence
  Description of Artificial Sequence: Synthetic oligonucleotide
  Target: ATXN1; (+) strand; PAM type: NNAGAAW; PAM sequence: TCAGAAA
tattcaaacttgaagcagca

SEQ ID NO: 10203 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
gactccgactcaaaaaaagg

SEQ ID NO: 10204 - DNA, 20 bp, Artificial Sequence
  Description of Artificial Sequence: Synthetic oligonucleotide
  Target: ATXN1; (+) strand; PAM type: NNAGAAW; PAM sequence: ATAGAAA
caaaaaaaggaaagaaacga

SEQ ID NO: 10205 - DNA, 20 bp, Artificial Sequence
  Description of Artificial Sequence: Synthetic oligonucleotide
  Target: ATXN1; (+) strand; PAM type: NNAGAAW; PAM sequence: AGAGAAT
ctagagggtcttgttaaatc

SEQ ID NO: 10206 - DNA, 20 bp, Artificial Sequence
  Description of Artificial Sequence: Synthetic oligonucleotide
  Target: ATXN1; (+) strand; PAM type: NNAGAAW; PAM sequence: GTAGAAT
gagaatgctaagacccatct

SEQ ID NO: 10207 - DNA, 20 bp, Artificial Sequence
  Description of Artificial Sequence: Synthetic oligonucleotide
  Target: ATXN1; (+) strand; PAM type: NNAGAAW; PAM sequence: AAAGAAT
ctcagtcactgctattccta

SEQ ID NO: 10208 - DNA, 20 bp, Artificial Sequence
  Description of Artificial Sequence: Synthetic oligonucleotide
  Target: ATXN1; (+) strand; PAM type: NNAGAAW; PAM sequence: CAAGAAT
cttccttctcctccaaaggt

SEQ ID NO: 10209 - DNA, 20 bp, Artificial Sequence
  Description of Artificial Sequence: Synthetic oligonucleotide
  Target: ATXN1; (+) strand; PAM type: NNAGAAW; PAM sequence: ACAGAAA
ggtttctttagccacctctt

SEQ ID NO: 10210 - DNA, 20 bp, Artificial Sequence
  Description of Artificial Sequence: Synthetic oligonucleotide
  Target: ATXN1; (+) strand; PAM type: NNAGAAW; PAM sequence: AGAGAAA
agaaggaagcttcccagtac

SEQ ID NO: 10211 - DNA, 20 bp, Artificial Sequence
  Description of Artificial Sequence: Synthetic oligonucleotide
  Target: ATXN1; (+) strand; PAM type: NNAGAAW; PAM sequence: ACAGAAA
gtacagagaaaagctgaaag

SEQ ID NO: 10212 - DNA, 20 bp, Artificial Sequence
  Description of Artificial Sequence: Synthetic oligonucleotide
  Target: ATXN1; (+) strand; PAM type: NNAGAAW; PAM sequence: CAAGAAA
ggaccttggtcctacgacca

SEQ ID NO: 10213 - DNA, 20 bp, Artificial Sequence
  Description of Artificial Sequence: Synthetic oligonucleotide
  Target: ATXN1; (+) strand; PAM type: NNAGAAW; PAM sequence: CCAGAAA
catgcctggacttcgcacct

SEQ ID NO: 10214 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
taataacataaaaaataaaa

SEQ ID NO: 10215 - DNA, 20 bp, Artificial Sequence
  Description of Artificial Sequence: Synthetic oligonucleotide
  Target: ATXN1; (+) strand; PAM type: NNAGAAW; PAM sequence: ATAGAAA
ttgtagtttgtcatacagca

SEQ ID NO: 10216 - DNA, 20 bp, Artificial Sequence
  Description of Artificial Sequence: Synthetic oligonucleotide
  Target: ATXN1; (+) strand; PAM type: NNAGAAW; PAM sequence: GGAGAAA
aacacccttttgggtgactt

SEQ ID NO: 10217 - DNA, 20 bp, Artificial Sequence
  Description of Artificial Sequence: Synthetic oligonucleotide
  Target: ATXN1; (+) strand; PAM type: NNAGAAW; PAM sequence: TCAGAAA
gctgctggcaattgcagagt

SEQ ID NO: 10218 - DNA, 20 bp, Artificial Sequence
  Description of Artificial Sequence: Synthetic oligonucleotide
  Target: ATXN1; (+) strand; PAM type: NNAGAAW; PAM sequence: GAAGAAT
gccaaaactcaaggtattct

SEQ ID NO: 10219 - DNA, 20 bp, Artificial Sequence
  Description of Artificial Sequence: Synthetic oligonucleotide
  Target: ATXN1; (+) strand; PAM type: NNAGAAW; PAM sequence: TCAGAAT
cttggatacctagcatgcac

SEQ ID NO: 10220 - DNA, 20 bp, Artificial Sequence
  Description of Artificial Sequence: Synthetic oligonucleotide
  Target: ATXN1; (+) strand; PAM type: NNAGAAW; PAM sequence: GGAGAAA
atgaaatataattatacatt

SEQ ID NO: 10221 - DNA, 20 bp, Artificial Sequence
  Description of Artificial Sequence: Synthetic oligonucleotide
  Target: ATXN1; (+) strand; PAM type: NNAGAAW; PAM sequence: CAAGAAT
agaaaagtatgtctgcatat

SEQ ID NO: 10222 - DNA, 20 bp, Artificial Sequence
  Description of Artificial Sequence: Synthetic oligonucleotide
  Target: ATXN1; (+) strand; PAM type: NNAGAAW; PAM sequence: ACAGAAA
tcaggtattgctgtagcaca

SEQ ID NO: 10223 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
caattagtaaaaatcctaaa

SEQ ID NO: 10224 - DNA, 20 bp, Artificial Sequence
  Description of Artificial Sequence: Synthetic oligonucleotide
  Target: ATXN1; (+) strand; PAM type: NNAGAAW; PAM sequence: ACAGAAT
agtgaagataaaatgaagag

SEQ ID NO: 10225 - DNA, 20 bp, Artificial Sequence
  Description of Artificial Sequence: Synthetic oligonucleotide
  Target: ATXN1; (+) strand; PAM type: NNAGAAW; PAM sequence: ACAGAAT
cttttgaacagacacaagta

SEQ ID NO: 10226 - DNA, 20 bp, Artificial Sequence
  Description of Artificial Sequence: Synthetic oligonucleotide
  Target: ATXN1; (+) strand; PAM type: NNAGAAW; PAM sequence: GGAGAAT
ctactcacgaggctgaggca

SEQ ID NO: 10227 - DNA, 20 bp, Artificial Sequence
  Description of Artificial Sequence: Synthetic oligonucleotide
  Target: ATXN1; (+) strand; PAM type: NNAGAAW; PAM sequence: ACAGAAT
ccattcaaagctcaaaaaca

SEQ ID NO: 10228 - DNA, 20 bp, Artificial Sequence
  Description of Artificial Sequence: Synthetic oligonucleotide
  Target: ATXN1; (+) strand; PAM type: NNAGAAW; PAM sequence: GCAGAAA
ttaactgtgaataccatgta

SEQ ID NO: 10229 - DNA, 20 bp, Artificial Sequence
  Description of Artificial Sequence: Synthetic oligonucleotide
  Target: ATXN1; (+) strand; PAM type: NNAGAAW; PAM sequence: CAAGAAA
acgcagggccgggtaagtaa

SEQ ID NO: 10230 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
gctgcaatttcaatgcaaat

SEQ ID NO: 10231 - DNA, 20 bp, Artificial Sequence
  Description of Artificial Sequence: Synthetic oligonucleotide
  Target: ATXN1; (+) strand; PAM type: NNAGAAW; PAM sequence: TTAGAAT
gactaaatatttaaaactct

SEQ ID NO: 10232 - DNA, 20 bp, Artificial Sequence
  Description of Artificial Sequence: Synthetic oligonucleotide
  Target: ATXN1; (+) strand; PAM type: NNAGAAW; PAM sequence: GGAGAAA
gcatatccccatttctatta

SEQ ID NO: 10233 - DNA, 20 bp, Artificial Sequence
  Description of Artificial Sequence: Synthetic oligonucleotide
  Target: ATXN1; (+) strand; PAM type: NNAGAAW; PAM sequence: AAAGAAT
atccccatttctattaggag

SEQ ID NO: 10234 - DNA, 20 bp, Artificial Sequence
  Description of Artificial Sequence: Synthetic oligonucleotide
  Target: ATXN1; (+) strand; PAM type: NNAGAAW; PAM sequence: GGAGAAA
actcctaatatatcaaaaaa

SEQ ID NO: 10235 - DNA, 20 bp, Artificial Sequence
  Description of Artificial Sequence: Synthetic oligonucleotide
  Target: ATXN1; (+) strand; PAM type: NNAGAAW; PAM sequence: GCAGAAA
agcttcttttatctagccag

SEQ ID NO: 10236 - DNA, 20 bp, Artificial Sequence
  Description of Artificial Sequence: Synthetic oligonucleotide
  Target: ATXN1; (+) strand; PAM type: NNAGAAW; PAM sequence: ACAGAAA
caagtgttgtgtgtgggagg

SEQ ID NO: 10237 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
tcataataagactgatgtaa

SEQ ID NO: 10238 - DNA, 20 bp, Artificial Sequence
  Description of Artificial Sequence: Synthetic oligonucleotide
  Target: ATXN1; (+) strand; PAM type: NNAGAAW; PAM sequence: GCAGAAA
tcccattcctgctgacccca

SEQ ID NO: 10239 - DNA, 20 bp, Artificial Sequence
  Description of Artificial Sequence: Synthetic oligonucleotide
  Target: ATXN1; (+) strand; PAM type: NNAGAAW; PAM sequence: AGAGAAA
gctgaccccagcagaaaaag

SEQ ID NO: 10240 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
accccagcagaaaaagagag

SEQ ID NO: 10241 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
cagcagaaaaagagagaaag

SEQ ID NO: 10242 - DNA, 20 bp, Artificial Sequence
  Description of Artificial Sequence: Synthetic oligonucleotide
  Target: ATXN1; (+) strand; PAM type: NNAGAAW; PAM sequence: GTAGAAT
cagacctttccaggtcaggt

SEQ ID NO: 10243 - DNA, 20 bp, Artificial Sequence
  Description of Artificial Sequence: Synthetic oligonucleotide
  Target: ATXN1; (+) strand; PAM type: NNAGAAW; PAM sequence: ACAGAAT
gttgaacattagaggaaaaa

SEQ ID NO: 10244 - DNA, 20 bp, Artificial Sequence
  Description of Artificial Sequence: Synthetic oligonucleotide
  Target: ATXN1; (+) strand; PAM type: NNAGAAW; PAM sequence: GGAGAAA
gctatttatatatcttcttt

SEQ ID NO: 10245 - DNA, 20 bp, Artificial Sequence
  Description of Artificial Sequence: Synthetic oligonucleotide
  Target: ATXN1; (+) strand; PAM type: NNAGAAW; PAM sequence: CCAGAAA
gtaagagttctttatatatt

SEQ ID NO: 10246 - DNA, 20 bp, Artificial Sequence
  Description of Artificial Sequence: Synthetic oligonucleotide
  Target: ATXN1; (+) strand; PAM type: NNAGAAW; PAM sequence: TAAGAAT
tgtgcttttggtgtcacatc

SEQ ID NO: 10247 - DNA, 20 bp, Artificial Sequence
  Description of Artificial Sequence: Synthetic oligonucleotide
  Target: ATXN1; (+) strand; PAM type: NNAGAAW; PAM sequence: GGAGAAA
cccattaagattggctcttt

SEQ ID NO: 10248 - DNA, 20 bp, Artificial Sequence
  Description of Artificial Sequence: Synthetic oligonucleotide
  Target: ATXN1; (+) strand; PAM type: NNAGAAW; PAM sequence: AGAGAAA
tgccaaatcgtgtataacca

SEQ ID NO: 10249 - DNA, 20 bp, Artificial Sequence
  Description of Artificial Sequence: Synthetic oligonucleotide
  Target: ATXN1; (+) strand; PAM type: NNAGAAW; PAM sequence: AAAGAAT
actctgtttatcttaagcaa

SEQ ID NO: 10250 - DNA, 20 bp, Artificial Sequence
  Description of Artificial Sequence: Synthetic oligonucleotide
  Target: ATXN1; (+) strand; PAM type: NNAGAAW; PAM sequence: GTAGAAT
aaaagaatacagtgtaggtt

SEQ ID NO: 10251 - DNA, 20 bp, Artificial Sequence
  Description of Artificial Sequence: Synthetic oligonucleotide
  Target: ATXN1; (+) strand; PAM type: NNAGAAW; PAM sequence: TTAGAAA
ttgtgaccacccagagagat

SEQ ID NO: 10252 - DNA, 20 bp, Artificial Sequence
  Description of Artificial Sequence: Synthetic oligonucleotide
  Target: ATXN1; (+) strand; PAM type: NNAGAAW; PAM sequence: ATAGAAT
tctggggtatggctcaggca

SEQ ID NO: 10253 - DNA, 20 bp, Artificial Sequence
  Description of Artificial Sequence: Synthetic oligonucleotide
  Target: ATXN1; (+) strand; PAM type: NNAGAAW; PAM sequence: GCAGAAA
gatcacagaacttggaagtg

SEQ ID NO: 10254 - DNA, 20 bp, Artificial Sequence
  Description of Artificial Sequence: Synthetic oligonucleotide
  Target: ATXN1; (+) strand; PAM type: NNAGAAW; PAM sequence: AGAGAAT
aggggataacaactcgctga

SEQ ID NO: 10255 - DNA, 20 bp, Artificial Sequence
  Description of Artificial Sequence: Synthetic oligonucleotide
  Target: ATXN1; (+) strand; PAM type: NNAGAAW; PAM sequence: TGAGAAA
cctcaagggtatatctgaat

SEQ ID NO: 10256 - DNA, 20 bp, Artificial Sequence
  Description of Artificial Sequence: Synthetic oligonucleotide
  Target: ATXN1; (+) strand; PAM type: NNAGAAW; PAM sequence: GAAGAAT
cagtagtgagtgacaagact

SEQ ID NO: 10257 - DNA, 20 bp, Artificial Sequence
  Description of Artificial Sequence: Synthetic oligonucleotide
  Target: ATXN1; (+) strand; PAM type: NNAGAAW; PAM sequence: TCAGAAT
tgacacaatagtagaacaaa

SEQ ID NO: 10258 - DNA, 20 bp, Artificial Sequence
  Description of Artificial Sequence: Synthetic oligonucleotide
  Target: ATXN1; (+) strand; PAM type: NNAGAAW; PAM sequence: GTAGAAA
aaaatgtattattaatgatg

SEQ ID NO: 10259 - DNA, 20 bp, Artificial Sequence
  Description of Artificial Sequence: Synthetic oligonucleotide
  Target: ATXN1; (+) strand; PAM type: NNAGAAW; PAM sequence: GAAGAAT
attatgccataaggaaactg

SEQ ID NO: 10260 - DNA, 20 bp, Artificial Sequence
  Description of Artificial Sequence: Synthetic oligonucleotide
  Target: ATXN1; (+) strand; PAM type: NNAGAAW; PAM sequence: TGAGAAT
ctgttcctgtgttagtttgc

SEQ ID NO: 10261 - DNA, 20 bp, Artificial Sequence
  Description of Artificial Sequence: Synthetic oligonucleotide
  Target: ATXN1; (+) strand; PAM type: NNAGAAW; PAM sequence: ACAGAAT
tgtgtgcatgtgtctttata

SEQ ID NO: 10262 - DNA, 20 bp, Artificial Sequence
  Description of Artificial Sequence: Synthetic oligonucleotide
  Target: ATXN1; (+) strand; PAM type: NNAGAAW; PAM sequence: GAAGAAT
cagcatctattaggaaactg

SEQ ID NO: 10263 - DNA, 20 bp, Artificial Sequence
  Description of Artificial Sequence: Synthetic oligonucleotide
  Target: ATXN1; (+) strand; PAM type: NNAGAAW; PAM sequence: TGAGAAA
agtattagaagttggttaga

SEQ ID NO: 10264 - DNA, 20 bp, Artificial Sequence
  Description of Artificial Sequence: Synthetic oligonucleotide
  Target: ATXN1; (+) strand; PAM type: NNAGAAW; PAM sequence: TTAGAAT
tcttcaaccacatttcaggc

SEQ ID NO: 10265 - DNA, 20 bp, Artificial Sequence
  Description of Artificial Sequence: Synthetic oligonucleotide
  Target: ATXN1; (+) strand; PAM type: NNAGAAW; PAM sequence: GCAGAAA
atctcttgaaaatgatttgt

SEQ ID NO: 10266 - DNA, 20 bp, Artificial Sequence
  Description of Artificial Sequence: Synthetic oligonucleotide
  Target: ATXN1; (+) strand; PAM type: NNAGAAW; PAM sequence: AGAGAAA
actttatatcaagacattta

SEQ ID NO: 10267 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
ggattctggctatagaccgt

SEQ ID NO: 10268 - DNA, 20 bp, Artificial Sequence
  Description of Artificial Sequence: Synthetic oligonucleotide
  Target: ATXN1; (+) strand; PAM type: NNAGAAW; PAM sequence: CCAGAAT
cgtaaagaaacaaaacttgc

SEQ ID NO: 10269 - DNA, 20 bp, Artificial Sequence
  Description of Artificial Sequence: Synthetic oligonucleotide
  Target: ATXN1; (+) strand; PAM type: NNAGAAW; PAM sequence: ACAGAAT
cacaaagttcaatcctacat

SEQ ID NO: 10270 - DNA, 20 bp, Artificial Sequence
  Description of Artificial Sequence: Synthetic oligonucleotide
  Target: ATXN1; (+) strand; PAM type: NNAGAAW; PAM sequence: TCAGAAA
aaattataaaacctgatgtc

SEQ ID NO: 10271 - DNA, 20 bp, Artificial Sequence
  Description of Artificial Sequence: Synthetic oligonucleotide
  Target: ATXN1; (+) strand; PAM type: NNAGAAW; PAM sequence: CAAGAAA
cctgatgtctcagaaataga

SEQ ID NO: 10272 - DNA, 20 bp, Artificial Sequence
  Description of Artificial Sequence: Synthetic oligonucleotide
  Target: ATXN1; (+) strand; PAM type: NNAGAAW; PAM sequence: TCAGAAA
tcagaaatagacaagaaaac

SEQ ID NO: 10273 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
attacagtccaatcgcacac

SEQ ID NO: 10274 - DNA, 20 bp, Artificial Sequence
  Description of Artificial Sequence: Synthetic oligonucleotide
  Target: ATXN1; (+) strand; PAM type: NNAGAAW; PAM sequence: TGAGAAT
caatcgcacacaaagaaaag

SEQ ID NO: 10275 - DNA, 20 bp, Artificial Sequence
  Description of Artificial Sequence: Synthetic oligonucleotide
  Target: ATXN1; (+) strand; PAM type: NNAGAAW; PAM sequence: TCAGAAA
aaagtactgtgaggtgaggt

SEQ ID NO: 10276 - DNA, 20 bp, Artificial Sequence
  Description of Artificial Sequence: Synthetic oligonucleotide
  Target: ATXN1; (+) strand; PAM type: NNAGAAW; PAM sequence: GGAGAAA
gtgaggtgaggttcagaaat

SEQ ID NO: 10277 - DNA, 20 bp, Artificial Sequence
  Description of Artificial Sequence: Synthetic oligonucleotide
  Target: ATXN1; (+) strand; PAM type: NNAGAAW; PAM sequence: GCAGAAT
gaaggtttattgctttgaat

SEQ ID NO: 10278 - DNA, 20 bp, Artificial Sequence
  Description of Artificial Sequence: Synthetic oligonucleotide
  Target: ATXN1; (+) strand; PAM type: NNAGAAW; PAM sequence: ATAGAAA
gccttcaaacaaaatcttat

SEQ ID NO: 10279 - DNA, 20 bp, Artificial Sequence
  Description of Artificial Sequence: Synthetic oligonucleotide
  Target: ATXN1; (+) strand; PAM type: NNAGAAW; PAM sequence: TGAGAAA
cagggcagaggttgggagac

SEQ ID NO: 10280 - DNA, 20 bp, Artificial Sequence
  Description of Artificial Sequence: Synthetic oligonucleotide
  Target: ATXN1; (+) strand; PAM type: NNAGAAW; PAM sequence: GGAGAAT
tgagaaatcctcaggctact

SEQ ID NO: 10281 - DNA, 20 bp, Artificial Sequence
  Description of Artificial Sequence: Synthetic oligonucleotide
  Target: ATXN1; (+) strand; PAM type: NNAGAAW; PAM sequence: ACAGAAA
aacctcagagtaacacaagc

SEQ ID NO: 10282 - DNA, 20 bp, Artificial Sequence
  Description of Artificial Sequence: Synthetic oligonucleotide
  Target: ATXN1; (+) strand; PAM type: NNAGAAW; PAM sequence: CAAGAAA
cccacttagggcatctttag

SEQ ID NO: 10283 - DNA, 20 bp, Artificial Sequence
  Description of Artificial Sequence: Synthetic oligonucleotide
  Target: ATXN1; (+) strand; PAM type: NNAGAAW; PAM sequence: CCAGAAA
cctgggactggtttgggctt

SEQ ID NO: 10284 - DNA, 20 bp, Artificial Sequence
  Description of Artificial Sequence: Synthetic oligonucleotide
  Target: ATXN1; (+) strand; PAM type: NNAGAAW; PAM sequence: CCAGAAA
gagtggtagcacccccaccc

SEQ ID NO: 10285 - DNA, 20 bp, Artificial Sequence
  Description of Artificial Sequence: Synthetic oligonucleotide
  Target: ATXN1; (+) strand; PAM type: NNAGAAW; PAM sequence: ACAGAAA
atattatcatcagtgacact

SEQ ID NO: 10286 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
tcagtgacactacagaaatc

SEQ ID NO: 10287 - DNA, 20 bp, Artificial Sequence
  Description of Artificial Sequence: Synthetic oligonucleotide
  Target: ATXN1; (+) strand; PAM type: NNAGAAW; PAM sequence: ACAGAAT
ggtatctatttcatatttgc

SEQ ID NO: 10288 - DNA, 20 bp, Artificial Sequence
  Description of Artificial Sequence: Synthetic oligonucleotide
  Target: ATXN1; (+) strand; PAM type: NNAGAAW; PAM sequence: CTAGAAA
ttgcatggttggttcaggct

SEQ ID NO: 10289 - DNA, 20 bp, Artificial Sequence
  Description of Artificial Sequence: Synthetic oligonucleotide
  Target: ATXN1; (+) strand; PAM type: NNAGAAW; PAM sequence: GAAGAAA
cactcagtccttgcctgaaa

SEQ ID NO: 10290 - DNA, 20 bp, Artificial Sequence
  Description of Artificial Sequence: Synthetic oligonucleotide
  Target: ATXN1; (+) strand; PAM type: NNAGAAW; PAM sequence: TCAGAAA
accatcagactttctgttac

SEQ ID NO: 10291 - DNA, 20 bp, Artificial Sequence
  Description of Artificial Sequence: Synthetic oligonucleotide
  Target: ATXN1; (+) strand; PAM type: NNAGAAW; PAM sequence: ATAGAAA
tgcactggcagcctactaaa

SEQ ID NO: 10292 - DNA, 20 bp, Artificial Sequence
  Description of Artificial Sequence: Synthetic oligonucleotide
  Target: ATXN1; (+) strand; PAM type: NNAGAAW; PAM sequence: TCAGAAA
tcatggttttggcagggaac

SEQ ID NO: 10293 - DNA, 20 bp, Artificial Sequence
  Description of Artificial Sequence: Synthetic oligonucleotide
  Target: ATXN1; (+) strand; PAM type: NNAGAAW; PAM sequence: ATAGAAA
tcattggaagccctggaaaa

SEQ ID NO: 10294 - DNA, 20 bp, Artificial Sequence
  Description of Artificial Sequence: Synthetic oligonucleotide
  Target: ATXN1; (+) strand; PAM type: NNAGAAW; PAM sequence: GAAGAAA
tattaagcaatgagtcaaat

SEQ ID NO: 10295 - DNA, 20 bp, Artificial Sequence
  Description of Artificial Sequence: Synthetic oligonucleotide
  Target: ATXN1; (+) strand; PAM type: NNAGAAW; PAM sequence: CCAGAAA
acctcccccttttaaaattt

SEQ ID NO: 10296 - DNA, 20 bp, Artificial Sequence
  Description of Artificial Sequence: Synthetic oligonucleotide
  Target: ATXN1; (+) strand; PAM type: NNAGAAW; PAM sequence: TCAGAAA
tcaggccacaagacagtagt

SEQ ID NO: 10297 - DNA, 20 bp, Artificial Sequence
  Description of Artificial Sequence: Synthetic oligonucleotide
  Target: ATXN1; (+) strand; PAM type: NNAGAAW; PAM sequence: ACAGAAT
attgaaattctctggaaaac

SEQ ID NO: 10298 - DNA, 20 bp, Artificial Sequence
  Description of Artificial Sequence: Synthetic oligonucleotide
  Target: ATXN1; (+) strand; PAM type: NNAGAAW; PAM sequence: GGAGAAT
tgtcttgttcagaagtgtta

SEQ ID NO: 10299 - DNA, 20 bp, Artificial Sequence
  Description of Artificial Sequence: Synthetic oligonucleotide
  Target: ATXN1; (+) strand; PAM type: NNAGAAW; PAM sequence: TTAGAAT
agatcatcatgctttaagcc

SEQ ID NO: 10300 - DNA, 20 bp, Artificial Sequence
  Description of Artificial Sequence: Synthetic oligonucleotide
  Target: ATXN1; (+) strand; PAM type: NNAGAAW; PAM sequence: TTAGAAA
gattttctaatatatggtat

SEQ ID NO: 10301 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
atataaggtaatttttctcc

SEQ ID NO: 10302 - DNA, 20 bp, Artificial Sequence
  Description of Artificial Sequence: Synthetic oligonucleotide
  Target: ATXN1; (+) strand; PAM type: NNAGAAW; PAM sequence: TCAGAAA
tttttctccaaagaaagccc

SEQ ID NO: 10303 - DNA, 20 bp, Artificial Sequence
  Description of Artificial Sequence: Synthetic oligonucleotide
  Target: ATXN1; (+) strand; PAM type: NNAGAAW; PAM sequence: GAAGAAA
tttccttttgttttttaatg

SEQ ID NO: 10304 - DNA, 20 bp, Artificial Sequence
  Description of Artificial Sequence: Synthetic oligonucleotide
  Target: ATXN1; (+) strand; PAM type: NNAGAAW; PAM sequence: GAAGAAT
tcatcaaaatacactcacag

SEQ ID NO: 10305 - DNA, 20 bp, Artificial Sequence
  Description of Artificial Sequence: Synthetic oligonucleotide
  Target: ATXN1; (+) strand; PAM type: NNAGAAW; PAM sequence: GAAGAAA
aatacactcacaggaagaat

SEQ ID NO: 10306 - DNA, 20 bp, Artificial Sequence
  Description of Artificial Sequence: Synthetic oligonucleotide
  Target: ATXN1; (+) strand; PAM type: NNAGAAW; PAM sequence: GAAGAAA
tttcatataatatgaaagtg

SEQ ID NO: 10307 - DNA, 20 bp, Artificial Sequence
  Description of Artificial Sequence: Synthetic oligonucleotide
  Target: ATXN1; (+) strand; PAM type: NNAGAAW; PAM sequence: ATAGAAA
agcacaaatctgatggttta

SEQ ID NO: 10308 - DNA, 20 bp, Artificial Sequence
  Description of Artificial Sequence: Synthetic oligonucleotide
  Target: ATXN1; (+) strand; PAM type: NNAGAAW; PAM sequence: CCAGAAA
tatcaaatacatttttttaa

SEQ ID NO: 10309 - DNA, 20 bp, Artificial Sequence
  Description of Artificial Sequence: Synthetic oligonucleotide
  Target: ATXN1; (+) strand; PAM type: NNAGAAW; PAM sequence: AGAGAAA
acaactgttggtgaggacat

SEQ ID NO: 10310 - DNA, 20 bp, Artificial Sequence
  Description of Artificial Sequence: Synthetic oligonucleotide
  Target: ATXN1; (+) strand; PAM type: NNAGAAW; PAM sequence: GTAGAAA
ggaacccttgtgcactgttg

SEQ ID NO: 10311 - DNA, 20 bp, Artificial Sequence
  Description of Artificial Sequence: Synthetic oligonucleotide
  Target: ATXN1; (+) strand; PAM type: NNAGAAW; PAM sequence: ATAGAAT
agttcataaaaaatttaaaa

SEQ ID NO: 10312 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
aatattcatcagccttaaaa

SEQ ID NO: 10313 - DNA, 20 bp, Artificial Sequence
  Description of Artificial Sequence: Synthetic oligonucleotide
  Target: ATXN1; (+) strand; PAM type: NNAGAAW; PAM sequence: GCAGAAA
gagcagtcaaattcatagag

SEQ ID NO: 10314 - DNA, 20 bp, Artificial Sequence
  Description of Artificial Sequence: Synthetic oligonucleotide
  Target: ATXN1; (+) strand; PAM type: NNAGAAW; PAM sequence: GTAGAAT
caaattcatagaggcagaaa

SEQ ID NO: 10315 - DNA, 20 bp, Artificial Sequence
  Description of Artificial Sequence: Synthetic oligonucleotide
  Target: ATXN1; (+) strand; PAM type: NNAGAAW; PAM sequence: CGAGAAT
agctgagactggatgcacaa

SEQ ID NO: 10316 - DNA, 20 bp, Artificial Sequence
  Description of Artificial Sequence: Synthetic oligonucleotide
  Target: ATXN1; (+) strand; PAM type: NNAGAAW; PAM sequence: CCAGAAT
cagaacgtactcttcacttt

SEQ ID NO: 10317 - DNA, 20 bp, Artificial Sequence
  Description of Artificial Sequence: Synthetic oligonucleotide
  Target: ATXN1; (+) strand; PAM type: NNAGAAW; PAM sequence: GGAGAAA
ctgactaggaaaacaaagta

SEQ ID NO: 10318 - DNA, 20 bp, Artificial Sequence
  Description of Artificial Sequence: Synthetic oligonucleotide
  Target: ATXN1; (+) strand; PAM type: NNAGAAW; PAM sequence: GGAGAAT
cactgtgggaggcagaggtg

SEQ ID NO: 10319 - DNA, 20 bp, Artificial Sequence
  Description of Artificial Sequence: Synthetic oligonucleotide
  Target: ATXN1; (+) strand; PAM type: NNAGAAW; PAM sequence: ATAGAAA
tctcataaataaataaataa

SEQ ID NO: 10320 - DNA, 20 bp, Artificial Sequence
  Description of Artificial Sequence: Synthetic oligonucleotide
  Target: ATXN1; (+) strand; PAM type: NNAGAAW; PAM sequence: ACAGAAA
taaaaatacagtaaaggtat

SEQ ID NO: 10321 - DNA, 20 bp, Artificial Sequence
  Description of Artificial Sequence: Synthetic oligonucleotide
  Target: ATXN1; (+) strand; PAM type: NNAGAAW; PAM sequence: GCAGAAA
tatttaagggtgggaagtca

SEQ ID NO: 10322 - DNA, 20 bp, Artificial Sequence
  Description of Artificial Sequence: Synthetic oligonucleotide
  Target: ATXN1; (+) strand; PAM type: NNAGAAW; PAM sequence: TAAGAAA
acgtggtagatgaatcttag

SEQ ID NO: 10323 - DNA, 20 bp, Artificial Sequence
  Description of Artificial Sequence: Synthetic oligonucleotide
  Target: ATXN1; (+) strand; PAM type: NNAGAAW; PAM sequence: TCAGAAT
taacagaggtcttttctccc

SEQ ID NO: 10324 - DNA, 20 bp, Artificial Sequence
  Description of Artificial Sequence: Synthetic oligonucleotide
  Target: ATXN1; (+) strand; PAM type: NNAGAAW; PAM sequence: GGAGAAT
acaacagtcctcagttctga

SEQ ID NO: 10325 - DNA, 20 bp, Artificial Sequence
  Description of Artificial Sequence: Synthetic oligonucleotide
  Target: ATXN1; (+) strand; PAM type: NNAGAAW; PAM sequence: TCAGAAA
tcatacacagttcttcttcc

SEQ ID NO: 10326 - DNA, 20 bp, Artificial Sequence
  Description of Artificial Sequence: Synthetic oligonucleotide
  Target: ATXN1; (+) strand; PAM type: NNAGAAW; PAM sequence: AGAGAAA
cgcaatcggttaaaaagtga

SEQ ID NO: 10327 - DNA, 20 bp, Artificial Sequence
  Description of Artificial Sequence: Synthetic oligonucleotide
  Target: ATXN1; (+) strand; PAM type: NNAGAAW; PAM sequence: ATAGAAT
cggttaaaaagtgaagagaa

SEQ ID NO: 10328 - DNA, 20 bp, Artificial Sequence
  Description of Artificial Sequence: Synthetic oligonucleotide
  Target: ATXN1; (+) strand; PAM type: NNAGAAW; PAM sequence: GAAGAAT
tgccaggagctacagcaaca

SEQ ID NO: 10329 - DNA, 20 bp, Artificial Sequence
  Description of Artificial Sequence: Synthetic oligonucleotide
  Target: ATXN1; (+) strand; PAM type: NNAGAAW; PAM sequence: GGAGAAT
tgtactttaaaagagagaca

SEQ ID NO: 10330 - DNA, 20 bp, Artificial Sequence
  Description of Artificial Sequence: Synthetic oligonucleotide
  Target: ATXN1; (+) strand; PAM type: NNAGAAW; PAM sequence: CCAGAAA
ccatcaccatcacctcctaa

SEQ ID NO: 10331 - DNA, 20 bp, Artificial Sequence
  Description of Artificial Sequence: Synthetic oligonucleotide
  Target: ATXN1; (+) strand; PAM type: NNAGAAW; PAM sequence: GCAGAAT
taggaaaatgtttggggcac

SEQ ID NO: 10332 - DNA, 20 bp, Artificial Sequence
  Description of Artificial Sequence: Synthetic oligonucleotide
  Target: ATXN1; (+) strand; PAM type: NNAGAAW; PAM sequence: AAAGAAT
tttctacacaaagtacatca

SEQ ID NO: 10333 - DNA, 20 bp, Artificial Sequence
  Description of Artificial Sequence: Synthetic oligonucleotide
  Target: ATXN1; (+) strand; PAM type: NNAGAAW; PAM sequence: CAAGAAA
tttaaagtctctaggactag

SEQ ID NO: 10334 - DNA, 20 bp, Artificial Sequence
  Description of Artificial Sequence: Synthetic oligonucleotide
  Target: ATXN1; (+) strand; PAM type: NNAGAAW; PAM sequence: GGAGAAA
cttgctggtttgaagaagtg

SEQ ID NO: 10335 - DNA, 20 bp, Artificial Sequence
  Description of Artificial Sequence: Synthetic oligonucleotide
  Target: ATXN1; (+) strand; PAM type: NNAGAAW; PAM sequence: GCAGAAA
tggctgctccacagacccaa

SEQ ID NO: 10336 - DNA, 20 bp, Artificial Sequence
  Description of Artificial Sequence: Synthetic oligonucleotide
  Target: ATXN1; (+) strand; PAM type: NNAGAAW; PAM sequence: CAAGAAA
agacccaagcagaaagcaga

SEQ ID NO: 10337 - DNA, 20 bp, Artificial Sequence
  Description of Artificial Sequence: Synthetic oligonucleotide
  Target: ATXN1; (+) strand; PAM type: NNAGAAW; PAM sequence: CCAGAAA
agtgacatgaccagccagcc

SEQ ID NO: 10338 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
agccttgtggagcttaaaaa

SEQ ID NO: 10339 - DNA, 20 bp, Artificial Sequence
  Description of Artificial Sequence: Synthetic oligonucleotide
  Target: ATXN1; (+) strand; PAM type: NNAGAAW; PAM sequence: CAAGAAT
aaaaaaagactgtcagcttg

SEQ ID NO: 10340 - DNA, 20 bp, Artificial Sequence
  Description of Artificial Sequence: Synthetic oligonucleotide
  Target: ATXN1; (+) strand; PAM type: NNAGAAW; PAM sequence: TCAGAAA
ctcattcaggaggaacaagg

SEQ ID NO: 10341 - DNA, 20 bp, Artificial Sequence
  Description of Artificial Sequence: Synthetic oligonucleotide
  Target: ATXN1; (+) strand; PAM type: NNAGAAW; PAM sequence: TGAGAAA
cacagcggtcactgtatgaa

SEQ ID NO: 10342 - DNA, 20 bp, Artificial Sequence
  Description of Artificial Sequence: Synthetic oligonucleotide
  Target: ATXN1; (+) strand; PAM type: NNAGAAW; PAM sequence: AGAGAAA
gtcagtttctgagaggtagc

SEQ ID NO: 10343 - DNA, 20 bp, Artificial Sequence
  Description of Artificial Sequence: Synthetic oligonucleotide
  Target: ATXN1; (+) strand; PAM type: NNAGAAW; PAM sequence: TGAGAAT
tgtatcttgtaaggttgttg

SEQ ID NO: 10344 - DNA, 20 bp, Artificial Sequence
  Description of Artificial Sequence: Synthetic oligonucleotide
  Target: ATXN1; (+) strand; PAM type: NNAGAAW; PAM sequence: TTAGAAT
actgggcatgttgtaagtgc

SEQ ID NO: 10345 - DNA, 20 bp, Artificial Sequence
  Description of Artificial Sequence: Synthetic oligonucleotide
  Target: ATXN1; (+) strand; PAM type: NNAGAAW; PAM sequence: CAAGAAT
catggcagatattagaggaa

SEQ ID NO: 10346 - DNA, 20 bp, Artificial Sequence
  Description of Artificial Sequence: Synthetic oligonucleotide
  Target: ATXN1; (+) strand; PAM type: NNAGAAW; PAM sequence: GAAGAAA
tgcagaagcccaagcgccac

SEQ ID NO: 10347 - DNA, 20 bp, Artificial Sequence
  Description of Artificial Sequence: Synthetic oligonucleotide
  Target: ATXN1; (+) strand; PAM type: NNAGAAW; PAM sequence: GCAGAAA
ggcctgatggggtgcaggga

SEQ ID NO: 10348 - DNA, 20 bp, Artificial Sequence
  Description of Artificial Sequence: Synthetic oligonucleotide
  Target: ATXN1; (+) strand; PAM type: NNAGAAW; PAM sequence: CCAGAAA
gtatatgctatggtcagtag

SEQ ID NO: 10349 - DNA, 20 bp, Artificial Sequence
  Description of Artificial Sequence: Synthetic oligonucleotide
  Target: ATXN1; (+) strand; PAM type: NNAGAAW; PAM sequence: TGAGAAT
aatttccttgggagatggag

SEQ ID NO: 10350 - DNA, 20 bp, Artificial Sequence
  Description of Artificial Sequence: Synthetic oligonucleotide
  Target: ATXN1; (+) strand; PAM type: NNAGAAW; PAM sequence: AGAGAAA
agaactcagttgtgagcatt

SEQ ID NO: 10351 - DNA, 20 bp, Artificial Sequence
  Description of Artificial Sequence: Synthetic oligonucleotide
  Target: ATXN1; (+) strand; PAM type: NNAGAAW; PAM sequence: CTAGAAA
ttgaagggcttagcctcgac

SEQ ID NO: 10352 - DNA, 20 bp, Artificial Sequence
  Description of Artificial Sequence: Synthetic oligonucleotide
  Target: ATXN1; (+) strand; PAM type: NNAGAAW; PAM sequence: AGAGAAA
tatatagatgaggaaacatt

SEQ ID NO: 10353 - DNA, 20 bp, Artificial Sequence
  Description of Artificial Sequence: Synthetic oligonucleotide
  Target: ATXN1; (+) strand; PAM type: NNAGAAW; PAM sequence: AGAGAAA
agccccaaccacacatcagt

SEQ ID NO: 10354 - DNA, 20 bp, Artificial Sequence
  Description of Artificial Sequence: Synthetic oligonucleotide
  Target: ATXN1; (+) strand; PAM type: NNAGAAW; PAM sequence: TTAGAAA
catcagtagagaaactgcaa

SEQ ID NO: 10355 - DNA, 20 bp, Artificial Sequence
  Description of Artificial Sequence: Synthetic oligonucleotide
  Target: ATXN1; (+) strand; PAM type: NNAGAAW; PAM sequence: TGAGAAA
tggtaagagctcccagaaga

SEQ ID NO: 10356 - DNA, 20 bp, Artificial Sequence
  Description of Artificial Sequence: Synthetic oligonucleotide
  Target: ATXN1; (+) strand; PAM type: NNAGAAW; PAM sequence: TTAGAAA
atggtgagtgctgtttgagc

SEQ ID NO: 10357 - DNA, 20 bp, Artificial Sequence
  Description of Artificial Sequence: Synthetic oligonucleotide
  Target: ATXN1; (+) strand; PAM type: NNAGAAW; PAM sequence: GGAGAAA
gcttctgagcttctttttag

SEQ ID NO: 10358 - DNA, 20 bp, Artificial Sequence
  Description of Artificial Sequence: Synthetic oligonucleotide
  Target: ATXN1; (+) strand; PAM type: NNAGAAW; PAM sequence: AAAGAAT
taccagtttattctttaccc

SEQ ID NO: 10359 - DNA, 20 bp, Artificial Sequence
  Description of Artificial Sequence: Synthetic oligonucleotide
  Target: ATXN1; (+) strand; PAM type: NNAGAAW; PAM sequence: TGAGAAT
cattgtactgtggtgtgctc

SEQ ID NO: 10360 - DNA, 20 bp, Artificial Sequence
  Description of Artificial Sequence: Synthetic oligonucleotide
  Target: ATXN1; (+) strand; PAM type: NNAGAAW; PAM sequence: TGAGAAT
ttaccttctgggattctaac

SEQ ID NO: 10361 - DNA, 20 bp, Artificial Sequence
  Description of Artificial Sequence: Synthetic oligonucleotide
  Target: ATXN1; (+) strand; PAM type: NNAGAAW; PAM sequence: GGAGAAT
ctactcaggaggctgaggca

SEQ ID NO: 10362 - DNA, 20 bp, Artificial Sequence
  Description of Artificial Sequence: Synthetic oligonucleotide
  Target: ATXN1; (+) strand; PAM type: NNAGAAW; PAM sequence: AAAGAAT
ataaataaacaaataaaata

SEQ ID NO: 10363 - DNA, 20 bp, Artificial Sequence
  Description of Artificial Sequence: Synthetic oligonucleotide
  Target: ATXN1; (+) strand; PAM type: NNAGAAW; PAM sequence: GAAGAAA
agtggtttggaaagggcgca

SEQ ID NO: 10364 - DNA, 20 bp, Artificial Sequence
  Description of Artificial Sequence: Synthetic oligonucleotide
  Target: ATXN1; (+) strand; PAM type: NNAGAAW; PAM sequence: TGAGAAA
ttagtagccaactaggatta

SEQ ID NO: 10365 - DNA, 20 bp, Artificial Sequence
  Description of Artificial Sequence: Synthetic oligonucleotide
  Target: ATXN1; (+) strand; PAM type: NNAGAAW; PAM sequence: AAAGAAT
ctataactctacagcctcaa

SEQ ID NO: 10366 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
tgtgcaccagttgctgaggg

SEQ ID NO: 10367 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
caaagcatgtgaacggcaaa

SEQ ID NO: 10368 - DNA, 20 bp, Artificial Sequence
  Description of Artificial Sequence: Synthetic oligonucleotide
  Target: ATXN1; (+) strand; PAM type: NNAGAAW; PAM sequence: GCAGAAA
tgaacggcaaaaaagaaatc

SEQ ID NO: 10369 - DNA, 20 bp, Artificial Sequence
  Description of Artificial Sequence: Synthetic oligonucleotide
  Target: ATXN1; (+) strand; PAM type: NNAGAAW; PAM sequence: AAAGAAT
acccagtgatgaggagagtc

SEQ ID NO: 10370 - DNA, 20 bp, Artificial Sequence
  Description of Artificial Sequence: Synthetic oligonucleotide
  Target: ATXN1; (+) strand; PAM type: NNAGAAW; PAM sequence: GGAGAAA
aaataccttggttccaagca

SEQ ID NO: 10371 - DNA, 20 bp, Artificial Sequence
  Description of Artificial Sequence: Synthetic oligonucleotide
  Target: ATXN1; (+) strand; PAM type: NNAGAAW; PAM sequence: GAAGAAA
cacgtcgatttctttctcac

SEQ ID NO: 10372 - DNA, 20 bp, Artificial Sequence
  Description of Artificial Sequence: Synthetic oligonucleotide
  Target: ATXN1; (+) strand; PAM type: NNAGAAW; PAM sequence: ATAGAAA
aatttctttggaaaactgga

SEQ ID NO: 10373 - DNA, 20 bp, Artificial Sequence
  Description of Artificial Sequence: Synthetic oligonucleotide
  Target: ATXN1; (+) strand; PAM type: NNAGAAW; PAM sequence: TAAGAAA
atgagcaggcctagaggtga

SEQ ID NO: 10374 - DNA, 20 bp, Artificial Sequence
  Description of Artificial Sequence: Synthetic oligonucleotide
  Target: ATXN1; (+) strand; PAM type: NNAGAAW; PAM sequence: CAAGAAA
ggagtccatattgtggtgcc

SEQ ID NO: 10375 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
tgttggacagaggaagcctg

SEQ ID NO: 10376 - DNA, 20 bp, Artificial Sequence
  Description of Artificial Sequence: Synthetic oligonucleotide
  Target: ATXN1; (+) strand; PAM type: NNAGAAW; PAM sequence: TCAGAAT
agattcccagactcagttcc

SEQ ID NO: 10377 - DNA, 20 bp, Artificial Sequence
  Description of Artificial Sequence: Synthetic oligonucleotide
  Target: ATXN1; (+) strand; PAM type: NNAGAAW; PAM sequence: CCAGAAA
gctccaattgaaaaaaactg

SEQ ID NO: 10378 - DNA, 20 bp, Artificial Sequence
  Description of Artificial Sequence: Synthetic oligonucleotide
  Target: ATXN1; (+) strand; PAM type: NNAGAAW; PAM sequence: ATAGAAT
gcaataacaatatcgacttc

SEQ ID NO: 10379 - DNA, 20 bp, Artificial Sequence
  Description of Artificial Sequence: Synthetic oligonucleotide
  Target: ATXN1; (+) strand; PAM type: NNAGAAW; PAM sequence: CCAGAAT
tttggtgacttaataatttg

SEQ ID NO: 10380 - DNA, 20 bp, Artificial Sequence
  Description of Artificial Sequence: Synthetic oligonucleotide
  Target: ATXN1; (+) strand; PAM type: NNAGAAW; PAM sequence: CCAGAAT
aacaacaacaacaaaaatta

SEQ ID NO: 10381 - DNA, 20 bp, Artificial Sequence
  Description of Artificial Sequence: Synthetic oligonucleotide
  Target: ATXN1; (+) strand; PAM type: NNAGAAW; PAM sequence: CCAGAAA
gagacaagttgccatatgat

SEQ ID NO: 10382 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
cacgactgggtatatactca

SEQ ID NO: 10383 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
ctaccaacagatgaatggat

SEQ ID NO: 10384 - DNA, 20 bp, Artificial Sequence
  Description of Artificial Sequence: Synthetic oligonucleotide
  Target: ATXN1; (+) strand; PAM type: NNAGAAW; PAM sequence: AAAGAAT
gaatattattcagccataaa

SEQ ID NO: 10385 - DNA, 20 bp, Artificial Sequence
  Description of Artificial Sequence: Synthetic oligonucleotide
  Target: ATXN1; (+) strand; PAM type: NNAGAAW; PAM sequence: ACAGAAA
ttaagtgaaaaaagccaggc

SEQ ID NO: 10386 - DNA, 20 bp, Artificial Sequence
  Description of Artificial Sequence: Synthetic oligonucleotide
  Target: ATXN1; (+) strand; PAM type: NNAGAAW; PAM sequence: TTAGAAT
aatgggtacaaaaaaagtag

SEQ ID NO: 10387 - DNA, 20 bp, Artificial Sequence
  Description of Artificial Sequence: Synthetic oligonucleotide
  Target: ATXN1; (+) strand; PAM type: NNAGAAW; PAM sequence: ATAGAAA
actgtataataattagataa

SEQ ID NO: 10388 - DNA, 20 bp, Artificial Sequence
  Description of Artificial Sequence: Synthetic oligonucleotide
  Target: ATXN1; (+) strand; PAM type: NNAGAAW; PAM sequence: ATAGAAA
agtatattgtacacatacat

SEQ ID NO: 10389 - DNA, 20 bp, Artificial Sequence
  Description of Artificial Sequence: Synthetic oligonucleotide
  Target: ATXN1; (+) strand; PAM type: NNAGAAW; PAM sequence: TGAGAAA
tcttctacatttttcaagat

SEQ ID NO: 10390 - DNA, 20 bp, Artificial Sequence
  Description of Artificial Sequence: Synthetic oligonucleotide
  Target: ATXN1; (+) strand; PAM type: NNAGAAW; PAM sequence: ATAGAAT
taacacatataccacaggga

SEQ ID NO: 10391 - DNA, 20 bp, Artificial Sequence
  Description of Artificial Sequence: Synthetic oligonucleotide
  Target: ATXN1; (+) strand; PAM type: NNAGAAW; PAM sequence: TTAGAAT
acagggaatagaatcacaca

SEQ ID NO: 10392 - DNA, 20 bp, Artificial Sequence
  Description of Artificial Sequence: Synthetic oligonucleotide
  Target: ATXN1; (+) strand; PAM type: NNAGAAW; PAM sequence: CGAGAAT
aggtggaagctgcagtgagt

SEQ ID NO: 10393 - DNA, 20 bp, Artificial Sequence
  Description of Artificial Sequence: Synthetic oligonucleotide
  Target: ATXN1; (+) strand; PAM type: NNAGAAW; PAM sequence: AAAGAAT
tcatctcaaaaaaaaaaaaa

SEQ ID NO: 10394 - DNA, 20 bp, Artificial Sequence
  Description of Artificial Sequence: Synthetic oligonucleotide
  Target: ATXN1; (+) strand; PAM type: NNAGAAW; PAM sequence: CTAGAAA
ctgtatgatcttgagtgatc

SEQ ID NO: 10395 - DNA, 20 bp, Artificial Sequence
  Description of Artificial Sequence: Synthetic oligonucleotide
  Target: ATXN1; (+) strand; PAM type: NNAGAAW; PAM sequence: AGAGAAT
taatctaagttccttctcaa

SEQ ID NO: 10396 - DNA, 20 bp, Artificial Sequence
  Description of Artificial Sequence: Synthetic oligonucleotide
  Target: ATXN1; (+) strand; PAM type: NNAGAAW; PAM sequence: GGAGAAA
gctggcagagagcagcagag

SEQ ID NO: 10397 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
aaagaacacatagcagcagc

SEQ ID NO: 10398 - DNA, 20 bp, Artificial Sequence
  Description of Artificial Sequence: Synthetic oligonucleotide
  Target: ATXN1; (+) strand; PAM type: NNAGAAW; PAM sequence: TTAGAAA
ttgtggtgggggtcatgctc

SEQ ID NO: 10399 - DNA, 20 bp, Artificial Sequence
  Description of Artificial Sequence: Synthetic oligonucleotide
  Target: ATXN1; (+) strand; PAM type: NNAGAAW; PAM sequence: ATAGAAT
ttacattttgaccatgtgaa

SEQ ID NO: 10400 - DNA, 20 bp, Artificial Sequence
  Description of Artificial Sequence: Synthetic oligonucleotide
  Target: ATXN1; (+) strand; PAM type: NNAGAAW; PAM sequence: GCAGAAT
ctactcgggaggctgaggca

SEQ ID NO: 10401 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
cctctcaaaaaaaaaaaaaa

SEQ ID NO: 10402 - DNA, 20 bp, Artificial Sequence
  Description of Artificial Sequence: Synthetic oligonucleotide
  Target: ATXN1; (+) strand; PAM type: NNAGAAW; PAM sequence: CAAGAAA
cagatgaggaaaataaggct

SEQ ID NO: 10403 - DNA, 20 bp, Artificial Sequence
  Description of Artificial Sequence: Synthetic oligonucleotide
  Target: ATXN1; (+) strand; PAM type: NNAGAAW; PAM sequence: AGAGAAA
tgtctgggtttcacggtcaa

SEQ ID NO: 10404 - DNA, 20 bp, Artificial Sequence
  Description of Artificial Sequence: Synthetic oligonucleotide
  Target: ATXN1; (+) strand; PAM type: NNAGAAW; PAM sequence: ACAGAAA
accccatctctactaaaaat

SEQ ID NO: 10405 - DNA, 20 bp, Artificial Sequence
  Description of Artificial Sequence: Synthetic oligonucleotide
  Target: ATXN1; (+) strand; PAM type: NNAGAAW; PAM sequence: GGAGAAT
ctacttgggaggctgaggca

SEQ ID NO: 10406 - DNA, 20 bp, Artificial Sequence
  Description of Artificial Sequence: Synthetic oligonucleotide
  Target: ATXN1; (+) strand; PAM type: NNAGAAW; PAM sequence: AAAGAAT
aatgttaataacccaaacac

SEQ ID NO: 10407 - DNA, 20 bp, Artificial Sequence
  Description of Artificial Sequence: Synthetic oligonucleotide
  Target: ATXN1; (+) strand; PAM type: NNAGAAW; PAM sequence: GCAGAAA
gtagcagacattcaaaatat

SEQ ID NO: 10408 - DNA, 20 bp, Artificial Sequence
  Description of Artificial Sequence: Synthetic oligonucleotide
  Target: ATXN1; (+) strand; PAM type: NNAGAAW; PAM sequence: AGAGAAT
gcagaaatgaatgaatcctc

SEQ ID NO: 10409 - DNA, 20 bp, Artificial Sequence
  Description of Artificial Sequence: Synthetic oligonucleotide
  Target: ATXN1; (+) strand; PAM type: NNAGAAW; PAM sequence: GAAGAAA
atactcctctgatattggct

SEQ ID NO: 10410 - DNA, 20 bp, Artificial Sequence
  Description of Artificial Sequence: Synthetic oligonucleotide
  Target: ATXN1; (+) strand; PAM type: NNAGAAW; PAM sequence: TGAGAAT
gtaaggggcagagagtattt

SEQ ID NO: 10411 - DNA, 20 bp, Artificial Sequence
  Description of Artificial Sequence: Synthetic oligonucleotide
  Target: ATXN1; (+) strand; PAM type: NNAGAAW; PAM sequence: AGAGAAA
gttgtagaaccagatccaga

SEQ ID NO: 10412 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
aggtcaaattgtcaaaaagt

SEQ ID NO: 10413 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
tataagttaaatgaataaaa

SEQ ID NO: 10414 - DNA, 20 bp, Artificial Sequence
  Description of Artificial Sequence: Synthetic oligonucleotide
  Target: ATXN1; (+) strand; PAM type: NNAGAAW; PAM sequence: AGAGAAT
atacatggtcaaggtattga

SEQ ID NO: 10415 - DNA, 20 bp, Artificial Sequence
  Description of Artificial Sequence: Synthetic oligonucleotide
  Target: ATXN1; (+) strand; PAM type: NNAGAAW; PAM sequence: GCAGAAT
ggaaatatcacagaggaaag

SEQ ID NO: 10416 - DNA, 20 bp, Artificial Sequence
  Description of Artificial Sequence: Synthetic oligonucleotide
  Target: ATXN1; (+) strand; PAM type: NNAGAAW; PAM sequence: GGAGAAT
ctactcaggaggctgaggca

SEQ ID NO: 10417 - DNA, 20 bp, Artificial Sequence
  Description of Artificial Sequence: Synthetic oligonucleotide
  Target: ATXN1; (+) strand; PAM type: NNAGAAW; PAM sequence: TTAGAAA
aaaaaaaagtgctacccatg

SEQ ID NO: 10418 - DNA, 20 bp, Artificial Sequence
  Description of Artificial Sequence: Synthetic oligonucleotide
  Target: ATXN1; (+) strand; PAM type: NNAGAAW; PAM sequence: ACAGAAA
gttccaataaaacttaattt

SEQ ID NO: 10419 - DNA, 20 bp, Artificial Sequence
  Description of Artificial Sequence: Synthetic oligonucleotide
  Target: ATXN1; (+) strand; PAM type: NNAGAAW; PAM sequence: CTAGAAT
ccagtttgtcaatacctggt

SEQ ID NO: 10420 - DNA, 20 bp, Artificial Sequence
  Description of Artificial Sequence: Synthetic oligonucleotide
  Target: ATXN1; (+) strand; PAM type: NNAGAAW; PAM sequence: TGAGAAT
taagcagatatgggcaaatc

SEQ ID NO: 10421 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
acttgaattgacatttcttc

SEQ ID NO: 10422 - DNA, 20 bp, Artificial Sequence
  Description of Artificial Sequence: Synthetic oligonucleotide
  Target: ATXN1; (+) strand; PAM type: NNAGAAW; PAM sequence: CAAGAAA
aaaaaaaacaacccccaaaa

SEQ ID NO: 10423 - DNA, 20 bp, Artificial Sequence
  Description of Artificial Sequence: Synthetic oligonucleotide
  Target: ATXN1; (+) strand; PAM type: NNAGAAW; PAM sequence: ATAGAAA
gaactctgtgtacattactg

SEQ ID NO: 10424 - DNA, 20 bp, Artificial Sequence
  Description of Artificial Sequence: Synthetic oligonucleotide
  Target: ATXN1; (+) strand; PAM type: NNAGAAW; PAM sequence: AAAGAAT
taggaatcacttggactaaa

SEQ ID NO: 10425 - DNA, 20 bp, Artificial Sequence
  Description of Artificial Sequence: Synthetic oligonucleotide
  Target: ATXN1; (+) strand; PAM type: NNAGAAW; PAM sequence: CCAGAAT
acatgagatttgtaatatgg

SEQ ID NO: 10426 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
taggaaagggcaaagaggta

SEQ ID NO: 10427 - DNA, 20 bp, Artificial Sequence
  Description of Artificial Sequence: Synthetic oligonucleotide
  Target: ATXN1; (+) strand; PAM type: NNAGAAW; PAM sequence: GCAGAAT
ggttgcattgcctactacaa

SEQ ID NO: 10428 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
gagtcatggtttctcagctg

SEQ ID NO: 10429 - DNA, 20 bp, Artificial Sequence
  Description of Artificial Sequence: Synthetic oligonucleotide
  Target: ATXN1; (+) strand; PAM type: NNAGAAW; PAM sequence: TAAGAAT
gttttttcctatattcttgg

SEQ ID NO: 10430 - DNA, 20 bp, Artificial Sequence
  Description of Artificial Sequence: Synthetic oligonucleotide
  Target: ATXN1; (+) strand; PAM type: NNAGAAW; PAM sequence: TGAGAAT
cacttttccaactcagttat

SEQ ID NO: 10431 - DNA, 20 bp, Artificial Sequence
  Description of Artificial Sequence: Synthetic oligonucleotide
  Target: ATXN1; (+) strand; PAM type: NNAGAAW; PAM sequence: AGAGAAT
cattttttgacagttttgtt

SEQ ID NO: 10432 - DNA, 20 bp, Artificial Sequence
  Description of Artificial Sequence: Synthetic oligonucleotide
  Target: ATXN1; (+) strand; PAM type: NNAGAAW; PAM sequence: GCAGAAA
agctgaagccagtggtgtgt

SEQ ID NO: 10433 - DNA, 20 bp, Artificial Sequence
  Description of Artificial Sequence: Synthetic oligonucleotide
  Target: ATXN1; (+) strand; PAM type: NNAGAAW; PAM sequence: GGAGAAA
aaaacaaaccaggggtcttt

SEQ ID NO: 10434 - DNA, 20 bp, Artificial Sequence
  Description of Artificial Sequence: Synthetic oligonucleotide
  Target: ATXN1; (+) strand; PAM type: NNAGAAW; PAM sequence: TCAGAAA
gcatggagcatcttgtagta

SEQ ID NO: 10435 - DNA, 20 bp, Artificial Sequence
  Description of Artificial Sequence: Synthetic oligonucleotide
  Target: ATXN1; (+) strand; PAM type: NNAGAAW; PAM sequence: AAAGAAT
atagtactggattagaacct

SEQ ID NO: 10436 - DNA, 20 bp, Artificial Sequence
  Description of Artificial Sequence: Synthetic oligonucleotide
  Target: ATXN1; (+) strand; PAM type: NNAGAAW; PAM sequence: GAAGAAA
ataaataaattttaaaagag

SEQ ID NO: 10437 - DNA, 20 bp, Artificial Sequence
  Description of Artificial Sequence: Synthetic oligonucleotide
  Target: ATXN1; (+) strand; PAM type: NNAGAAW; PAM sequence: ACAGAAA
ttctccttttaacctctttt

SEQ ID NO: 10438 - DNA, 20 bp, Artificial Sequence
  Description of Artificial Sequence: Synthetic oligonucleotide
  Target: ATXN1; (+) strand; PAM type: NNAGAAW; PAM sequence: GGAGAAT
ctagtcggcaggctggggca

SEQ ID NO: 10439 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
gtgaaactctgtctcaaaaa

SEQ ID NO: 10440 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
ctgtctcaaaaaaaagaaaa

SEQ ID NO: 10441 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
aaaaaaagaaaaaaagaaaa

SEQ ID NO: 10442 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
aaagaaaaaaagaaaaaaaa

SEQ ID NO: 10443 - DNA, 20 bp, Artificial Sequence
  Description of Artificial Sequence: Synthetic oligonucleotide
  Target: ATXN1; (+) strand; PAM type: NNAGAAW; PAM sequence: GGAGAAT
ctacttgggaggtcaaagca

SEQ ID NO: 10444 - DNA, 20 bp, Artificial Sequence
  Description of Artificial Sequence: Synthetic oligonucleotide
  Target: ATXN1; (+) strand; PAM type: NNAGAAW; PAM sequence: CAAGAAA
ttaaattccttccaccggca

SEQ ID NO: 10445 - DNA, 20 bp, Artificial Sequence
  Description of Artificial Sequence: Synthetic oligonucleotide
  Target: ATXN1; (+) strand; PAM type: NNAGAAW; PAM sequence: GCAGAAA
agacttctacccattcccat

SEQ ID NO: 10446 - DNA, 20 bp, Artificial Sequence
  Description of Artificial Sequence: Synthetic oligonucleotide
  Target: ATXN1; (+) strand; PAM type: NNAGAAW; PAM sequence: TTAGAAA
gggatgctggcaggtaggtt

SEQ ID NO: 10447 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
ccactgctgaattttttaaa

SEQ ID NO: 10448 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
tgaattttttaaaaaagaaa

SEQ ID NO: 10449 - DNA, 20 bp, Artificial Sequence
  Description of Artificial Sequence: Synthetic oligonucleotide
  Target: ATXN1; (+) strand; PAM type: NNAGAAW; PAM sequence: GGAGAAT
tacacggtcatggaagttat

SEQ ID NO: 10450 - DNA, 20 bp, Artificial Sequence
  Description of Artificial Sequence: Synthetic oligonucleotide
  Target: ATXN1; (+) strand; PAM type: NNAGAAW; PAM sequence: TCAGAAA
aagggggcaccctgcatgca

SEQ ID NO: 10451 - DNA, 20 bp, Artificial Sequence
  Description of Artificial Sequence: Synthetic oligonucleotide
  Target: ATXN1; (+) strand; PAM type: NNAGAAW; PAM sequence: GCAGAAA
aggcagatgacacaccgaag

SEQ ID NO: 10452 - DNA, 20 bp, Artificial Sequence
  Description of Artificial Sequence: Synthetic oligonucleotide
  Target: ATXN1; (+) strand; PAM type: NNAGAAW; PAM sequence: GGAGAAA
ccaatccaacctcaaaaaaa

SEQ ID NO: 10453 - DNA, 20 bp, Artificial Sequence
  Description of Artificial Sequence: Synthetic oligonucleotide
  Target: ATXN1; (+) strand; PAM type: NNAGAAW; PAM sequence: ACAGAAA
gaggaaagaggatccatgcc

SEQ ID NO: 10454 - DNA, 20 bp, Artificial Sequence
  Description of Artificial Sequence: Synthetic oligonucleotide
  Target: ATXN1; (+) strand; PAM type: NNAGAAW; PAM sequence: AGAGAAA
cgggatgcatcttctgggga

SEQ ID NO: 10455 - DNA, 20 bp, Artificial Sequence
  Description of Artificial Sequence: Synthetic oligonucleotide
  Target: ATXN1; (+) strand; PAM type: NNAGAAW; PAM sequence: TGAGAAT
atgacaggggactgcaatgc

SEQ ID NO: 10456 - DNA, 20 bp, Artificial Sequence
  Description of Artificial Sequence: Synthetic oligonucleotide
  Target: ATXN1; (+) strand; PAM type: NNAGAAW; PAM sequence: CAAGAAA
gggactgcaatgctgagaat

SEQ ID NO: 10457 - DNA, 20 bp, Artificial Sequence
  Description of Artificial Sequence: Synthetic oligonucleotide
  Target: ATXN1; (+) strand; PAM type: NNAGAAW; PAM sequence: ACAGAAT
gcaatgctgagaatcaagaa

SEQ ID NO: 10458 - DNA, 20 bp, Artificial Sequence
  Description of Artificial Sequence: Synthetic oligonucleotide
  Target: ATXN1; (+) strand; PAM type: NNAGAAW; PAM sequence: TGAGAAT
aattgctgtgggagacaggc

SEQ ID NO: 10459 - DNA, 20 bp, Artificial Sequence
  Description of Artificial Sequence: Synthetic oligonucleotide
  Target: ATXN1; (+) strand; PAM type: NNAGAAW; PAM sequence: TAAGAAA
ttttaaccacaggacctttc

SEQ ID NO: 10460 - DNA, 20 bp, Artificial Sequence
  Description of Artificial Sequence: Synthetic oligonucleotide
  Target: ATXN1; (+) strand; PAM type: NNAGAAW; PAM sequence: TCAGAAT
gaaaactattttacatagcc

SEQ ID NO: 10461 - DNA, 20 bp, Artificial Sequence
  Description of Artificial Sequence: Synthetic oligonucleotide
  Target: ATXN1; (+) strand; PAM type: NNAGAAW; PAM sequence: GCAGAAT
tggggagcctctggggcttt

SEQ ID NO: 10462 - DNA, 20 bp, Artificial Sequence
  Description of Artificial Sequence: Synthetic oligonucleotide
  Target: ATXN1; (+) strand; PAM type: NNAGAAW; PAM sequence: TGAGAAA
tccctagaactggacgcctt

SEQ ID NO: 10463 - DNA, 20 bp, Artificial Sequence
  Description of Artificial Sequence: Synthetic oligonucleotide
  Target: ATXN1; (+) strand; PAM type: NNAGAAW; PAM sequence: GCAGAAA
acaccgccaaatcagaggag

SEQ ID NO: 10464 - DNA, 20 bp, Artificial Sequence
  Description of Artificial Sequence: Synthetic oligonucleotide
  Target: ATXN1; (+) strand; PAM type: NNAGAAW; PAM sequence: ACAGAAA
gagcacccaaaactcaaagg

SEQ ID NO: 10465 - DNA, 20 bp, Artificial Sequence
  Description of Artificial Sequence: Synthetic oligonucleotide
  Target: ATXN1; (+) strand; PAM type: NNAGAAW; PAM sequence: CAAGAAT
ctgggggaaaacgccaccac

SEQ ID NO: 10466 - DNA, 20 bp, Artificial Sequence
  Description of Artificial Sequence: Synthetic oligonucleotide
  Target: ATXN1; (+) strand; PAM type: NNAGAAW; PAM sequence: AGAGAAA
ctatgcttcagtaaggggaa

SEQ ID NO: 10467 - DNA, 20 bp, Artificial Sequence
  Description of Artificial Sequence: Synthetic oligonucleotide
  Target: ATXN1; (+) strand; PAM type: NNAGAAW; PAM sequence: TAAGAAA
aacgagtaggaaaaagacac

SEQ ID NO: 10468 - DNA, 20 bp, Artificial Sequence
  Description of Artificial Sequence: Synthetic oligonucleotide
  Target: ATXN1; (+) strand; PAM type: NNAGAAW; PAM sequence: GCAGAAA
gactgtgggtaattgaaaca

SEQ ID NO: 10469 - DNA, 20 bp, Artificial Sequence
  Description of Artificial Sequence: Synthetic oligonucleotide
  Target: ATXN1; (+) strand; PAM type: NNAGAAW; PAM sequence: AGAGAAA
tcttacaggaaagtatgcca

SEQ ID NO: 10470 - DNA, 20 bp, Artificial Sequence
  Description of Artificial Sequence: Synthetic oligonucleotide
  Target: ATXN1; (+) strand; PAM type: NNAGAAW; PAM sequence: AAAGAAT
ggaaagtatgccaagagaaa

SEQ ID NO: 10471 - DNA, 20 bp, Artificial Sequence
  Description of Artificial Sequence: Synthetic oligonucleotide
  Target: ATXN1; (+) strand; PAM type: NNAGAAW; PAM sequence: CAAGAAT
acaaaatataataatgttat

SEQ ID NO: 10472 - DNA, 20 bp, Artificial Sequence
  Description of Artificial Sequence: Synthetic oligonucleotide
  Target: ATXN1; (+) strand; PAM type: NNAGAAW; PAM sequence: AGAGAAA
atcagggtattggaccatga

SEQ ID NO: 10473 - DNA, 20 bp, Artificial Sequence
  Description of Artificial Sequence: Synthetic oligonucleotide
  Target: ATXN1; (+) strand; PAM type: NNAGAAW; PAM sequence: CAAGAAT
tcgggaccctcctaagaaca

SEQ ID NO: 10474 - DNA, 20 bp, Artificial Sequence
  Description of Artificial Sequence: Synthetic oligonucleotide
  Target: ATXN1; (+) strand; PAM type: NNAGAAW; PAM sequence: GTAGAAA
ggaaggaggcgagaagatga

SEQ ID NO: 10475 - DNA, 20 bp, Artificial Sequence
  Description of Artificial Sequence: Synthetic oligonucleotide
  Target: ATXN1; (+) strand; PAM type: NNAGAAW; PAM sequence: ATAGAAA
tgtcttttttttttttggca

SEQ ID NO: 10476 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
agcaggtggcacttggtagc

SEQ ID NO: 10477 - DNA, 20 bp, Artificial Sequence
  Description of Artificial Sequence: Synthetic oligonucleotide
  Target: ATXN1; (+) strand; PAM type: NNAGAAW; PAM sequence: TGAGAAA
ttttctacaattcaaactgg

SEQ ID NO: 10478 - DNA, 20 bp, Artificial Sequence
  Description of Artificial Sequence: Synthetic oligonucleotide
  Target: ATXN1; (+) strand; PAM type: NNAGAAW; PAM sequence: TAAGAAA
acagctatcgtattagctgt

SEQ ID NO: 10479 - DNA, 20 bp, Artificial Sequence
  Description of Artificial Sequence: Synthetic oligonucleotide
  Target: ATXN1; (+) strand; PAM type: NNAGAAW; PAM sequence: TGAGAAA
agtgagtctgctgctgttcc

SEQ ID NO: 10480 - DNA, 20 bp, Artificial Sequence
  Description of Artificial Sequence: Synthetic oligonucleotide
  Target: ATXN1; (+) strand; PAM type: NNAGAAW; PAM sequence: GAAGAAT
agccagtaggagggcgatgg

SEQ ID NO: 10481 - DNA, 20 bp, Artificial Sequence
  Description of Artificial Sequence: Synthetic oligonucleotide
  Target: ATXN1; (+) strand; PAM type: NNAGAAW; PAM sequence: ATAGAAT
taagtatttcattaggaacc

SEQ ID NO: 10482 - DNA, 20 bp, Artificial Sequence
  Description of Artificial Sequence: Synthetic oligonucleotide
  Target: ATXN1; (+) strand; PAM type: NNAGAAW; PAM sequence: ACAGAAA
ccctgagccataaaattaac

SEQ ID NO: 10483 - DNA, 20 bp, Artificial Sequence
  Description of Artificial Sequence: Synthetic oligonucleotide
  Target: ATXN1; (+) strand; PAM type: NNAGAAW; PAM sequence: CTAGAAA
gaaaatgagcatgacattgg

SEQ ID NO: 10484 - DNA, 20 bp, Artificial Sequence
  Description of Artificial Sequence: Synthetic oligonucleotide
  Target: ATXN1; (+) strand; PAM type: NNAGAAW; PAM sequence: TCAGAAA
agcatgacattggctagaaa

SEQ ID NO: 10485 - DNA, 20 bp, Artificial Sequence
  Description of Artificial Sequence: Synthetic oligonucleotide
  Target: ATXN1; (+) strand; PAM type: NNAGAAW; PAM sequence: AGAGAAA
gggaagttctagcatctttc

SEQ ID NO: 10486 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
aaggaaagtgggaaaaggga

SEQ ID NO: 10487 - DNA, 20 bp, Artificial Sequence
  Description of Artificial Sequence: Synthetic oligonucleotide
  Target: ATXN1; (+) strand; PAM type: NNAGAAW; PAM sequence: TTAGAAT
aggtgatggcaatgagacaa

SEQ ID NO: 10488 - DNA, 20 bp, Artificial Sequence
  Description of Artificial Sequence: Synthetic oligonucleotide
  Target: ATXN1; (+) strand; PAM type: NNAGAAW; PAM sequence: TCAGAAA
aatgagacaattagaatgtt

SEQ ID NO: 10489 - DNA, 20 bp, Artificial Sequence
  Description of Artificial Sequence: Synthetic oligonucleotide
  Target: ATXN1; (+) strand; PAM type: NNAGAAW; PAM sequence: ATAGAAA
cagactggggggcttcaaca

SEQ ID NO: 10490 - DNA, 20 bp, Artificial Sequence
  Description of Artificial Sequence: Synthetic oligonucleotide
  Target: ATXN1; (+) strand; PAM type: NNAGAAW; PAM sequence: CTAGAAA
ttgtcttacagtcctggagg

SEQ ID NO: 10491 - DNA, 20 bp, Artificial Sequence
  Description of Artificial Sequence: Synthetic oligonucleotide
  Target: ATXN1; (+) strand; PAM type: NNAGAAW; PAM sequence: GGAGAAT
ttccttccaggaggtgcaaa

SEQ ID NO: 10492 - DNA, 20 bp, Artificial Sequence
  Description of Artificial Sequence: Synthetic oligonucleotide
  Target: ATXN1; (+) strand; PAM type: NNAGAAW; PAM sequence: TGAGAAA
ggtagcggtgggctatgctc

SEQ ID NO: 10493 - DNA, 20 bp, Artificial Sequence
  Description of Artificial Sequence: Synthetic oligonucleotide
  Target: ATXN1; (+) strand; PAM type: NNAGAAW; PAM sequence: ATAGAAA
gcattcaaacatacctaaat

SEQ ID NO: 10494 - DNA, 20 bp, Artificial Sequence
  Description of Artificial Sequence: Synthetic oligonucleotide
  Target: ATXN1; (+) strand; PAM type: NNAGAAW; PAM sequence: GCAGAAA
aaagatacagtcaaaatgaa

SEQ ID NO: 10495 - DNA, 20 bp, Artificial Sequence
  Description of Artificial Sequence: Synthetic oligonucleotide
  Target: ATXN1; (+) strand; PAM type: NNAGAAW; PAM sequence: GGAGAAT
ctactcaggaggctgaggca

SEQ ID NO: 10496 - DNA, 20 bp, Artificial Sequence
  Description of Artificial Sequence: Synthetic oligonucleotide
  Target: ATXN1; (+) strand; PAM type: NNAGAAW; PAM sequence: TAAGAAA
tagcaaacaaaataaaatac

SEQ ID NO: 10497 - DNA, 20 bp, Artificial Sequence
  Description of Artificial Sequence: Synthetic oligonucleotide
  Target: ATXN1; (+) strand; PAM type: NNAGAAW; PAM sequence: GAAGAAA
tttttttttttaaataagta

SEQ ID NO: 10498 - DNA, 20 bp, Artificial Sequence
  Description of Artificial Sequence: Synthetic oligonucleotide
  Target: ATXN1; (+) strand; PAM type: NNAGAAW; PAM sequence: CAAGAAT
tactgcttaaagggcacatt

SEQ ID NO: 10499 - DNA, 20 bp, Artificial Sequence
  Description of Artificial Sequence: Synthetic oligonucleotide
  Target: ATXN1; (+) strand; PAM type: NNAGAAW; PAM sequence: GTAGAAT
ctactcaggaggctcaggca

SEQ ID NO: 10500 - DNA, 20 bp, Artificial Sequence
  Description of Artificial Sequence: Synthetic oligonucleotide
  Target: ATXN1; (+) strand; PAM type: NNAGAAW; PAM sequence: AAAGAAT
atacaaaaaaaaaaaaaaaa

SEQ ID NO: 10501 - DNA, 20 bp, Artificial Sequence
  Description of Artificial Sequence: Synthetic oligonucleotide
  Target: ATXN1; (+) strand; PAM type: NNAGAAW; PAM sequence: CTAGAAA
ggacaatctgagagggtatc

SEQ ID NO: 10502 - DNA, 20 bp, Artificial Sequence
  Description of Artificial Sequence: Synthetic oligonucleotide
  Target: ATXN1; (+) strand; PAM type: NNAGAAW; PAM sequence: GCAGAAT
gcctttcatgcataatagtt

SEQ ID NO: 10503 - DNA, 20 bp, Artificial Sequence
  Description of Artificial Sequence: Synthetic oligonucleotide
  Target: ATXN1; (+) strand; PAM type: NNAGAAW; PAM sequence: ATAGAAA
aacataattattcccaattt

SEQ ID NO: 10504 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
aattattcccaatttataga

SEQ ID NO: 10505 - DNA, 20 bp, Artificial Sequence
  Description of Artificial Sequence: Synthetic oligonucleotide
  Target: ATXN1; (+) strand; PAM type: NNAGAAW; PAM sequence: TTAGAAT
agttgacagtggacctgaag

SEQ ID NO: 10506 - DNA, 20 bp, Artificial Sequence
  Description of Artificial Sequence: Synthetic oligonucleotide
  Target: ATXN1; (+) strand; PAM type: NNAGAAW; PAM sequence: GAAGAAT
ggagataaaataacataaat

SEQ ID NO: 10507 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
ataacataaatgaagaataa

SEQ ID NO: 10508 - DNA, 20 bp, Artificial Sequence
  Description of Artificial Sequence: Synthetic oligonucleotide
  Target: ATXN1; (+) strand; PAM type: NNAGAAW; PAM sequence: AGAGAAT
gacttgtgattggtgaaaac

SEQ ID NO: 10509 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
tttcacgatctgaattcatg

SEQ ID NO: 10510 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
gtggaatctgagctaatgct

SEQ ID NO: 10511 - DNA, 20 bp, Artificial Sequence
  Description of Artificial Sequence: Synthetic oligonucleotide
  Target: ATXN1; (+) strand; PAM type: NNAGAAW; PAM sequence: TGAGAAA
gctaaagaaataaaacagct

SEQ ID NO: 10512 - DNA, 20 bp, Artificial Sequence
  Description of Artificial Sequence: Synthetic oligonucleotide
  Target: ATXN1; (+) strand; PAM type: NNAGAAW; PAM sequence: GAAGAAA
aacagcttgagaaaaagtgg

SEQ ID NO: 10513 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
gaaaacactgaaaataagga

SEQ ID NO: 10514 - DNA, 20 bp, Artificial Sequence
  Description of Artificial Sequence: Synthetic oligonucleotide
  Target: ATXN1; (+) strand; PAM type: NNAGAAW; PAM sequence: CCAGAAT
cacatgctctcaatgacaac

SEQ ID NO: 10515 - DNA, 20 bp, Artificial Sequence
  Description of Artificial Sequence: Synthetic oligonucleotide
  Target: ATXN1; (+) strand; PAM type: NNAGAAW; PAM sequence: CTAGAAA
cacacgtggagaggctggct

SEQ ID NO: 10516 - DNA, 20 bp, Artificial Sequence
  Description of Artificial Sequence: Synthetic oligonucleotide
  Target: ATXN1; (+) strand; PAM type: NNAGAAW; PAM sequence: CCAGAAT
gctctagaaacaattaaagt

SEQ ID NO: 10517 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
aatgtccttctgctgcttca

SEQ ID NO: 10518 - DNA, 20 bp, Artificial Sequence
  Description of Artificial Sequence: Synthetic oligonucleotide
  Target: ATXN1; (+) strand; PAM type: NNAGAAW; PAM sequence: AGAGAAA
taaggtgtaatttatcaggt

SEQ ID NO: 10519 - DNA, 20 bp, Artificial Sequence
  Description of Artificial Sequence: Synthetic oligonucleotide
  Target: ATXN1; (+) strand; PAM type: NNAGAAW; PAM sequence: ACAGAAA
cagcatctatcttcgctgtg

SEQ ID NO: 10520 - DNA, 20 bp, Artificial Sequence
  Description of Artificial Sequence: Synthetic oligonucleotide
  Target: ATXN1; (+) strand; PAM type: NNAGAAW; PAM sequence: ACAGAAT
tgctccacgtatttccgatg

SEQ ID NO: 10521 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
gcagcgccaggacacagcat

SEQ ID NO: 10522 - DNA, 20 bp, Artificial Sequence
  Description of Artificial Sequence: Synthetic oligonucleotide
  Target: ATXN1; (+) strand; PAM type: NNAGAAW; PAM sequence: ATAGAAT
agttgacagactgattgaaa

SEQ ID NO: 10523 - DNA, 20 bp, Artificial Sequence
  Description of Artificial Sequence: Synthetic oligonucleotide
  Target: ATXN1; (+) strand; PAM type: NNAGAAW; PAM sequence: TCAGAAA
ttttctctgcttaaagacaa

SEQ ID NO: 10524 - DNA, 20 bp, Artificial Sequence
  Description of Artificial Sequence: Synthetic oligonucleotide
  Target: ATXN1; (+) strand; PAM type: NNAGAAW; PAM sequence: CAAGAAT
ctaaaatgatcaactccaca

SEQ ID NO: 10525 - DNA, 20 bp, Artificial Sequence
  Description of Artificial Sequence: Synthetic oligonucleotide
  Target: ATXN1; (+) strand; PAM type: NNAGAAW; PAM sequence: GAAGAAA
taagatttgtggaaaatatg

SEQ ID NO: 10526 - DNA, 20 bp, Artificial Sequence
  Description of Artificial Sequence: Synthetic oligonucleotide
  Target: ATXN1; (+) strand; PAM type: NNAGAAW; PAM sequence: TCAGAAA
ttgcagatgacaaactaggc

SEQ ID NO: 10527 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
tacaatcggaaaatcacata

SEQ ID NO: 10528 - DNA, 20 bp, Artificial Sequence
  Description of Artificial Sequence: Synthetic oligonucleotide
  Target: ATXN1; (+) strand; PAM type: NNAGAAW; PAM sequence: AAAGAAT
ttctttaatggcaccatcaa

SEQ ID NO: 10529 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
gtctttttacttcgttggca

SEQ ID NO: 10530 - DNA, 20 bp, Artificial Sequence
  Description of Artificial Sequence: Synthetic oligonucleotide
  Target: ATXN1; (+) strand; PAM type: NNAGAAW; PAM sequence: TAAGAAA
taaactcctgtcaatgctgg

SEQ ID NO: 10531 - DNA, 20 bp, Artificial Sequence
  Description of Artificial Sequence: Synthetic oligonucleotide
  Target: ATXN1; (+) strand; PAM type: NNAGAAW; PAM sequence: AGAGAAA
ttagccaatttaactgcata

SEQ ID NO: 10532 - DNA, 20 bp, Artificial Sequence
  Description of Artificial Sequence: Synthetic oligonucleotide
  Target: ATXN1; (+) strand; PAM type: NNAGAAW; PAM sequence: GCAGAAA
ggatataaaaattataacag

SEQ ID NO: 10533 - DNA, 20 bp, Artificial Sequence
  Description of Artificial Sequence: Synthetic oligonucleotide
  Target: ATXN1; (+) strand; PAM type: NNAGAAW; PAM sequence: AGAGAAT
aattgaacaacttattaatt

SEQ ID NO: 10534 - DNA, 20 bp, Artificial Sequence
  Description of Artificial Sequence: Synthetic oligonucleotide
  Target: ATXN1; (+) strand; PAM type: NNAGAAW; PAM sequence: AAAGAAT
tctgtagggtaactgaaaca

SEQ ID NO: 10535 - DNA, 20 bp, Artificial Sequence
  Description of Artificial Sequence: Synthetic oligonucleotide
  Target: ATXN1; (+) strand; PAM type: NNAGAAW; PAM sequence: CAAGAAT
ttactggggaggctaaggca

SEQ ID NO: 10536 - DNA, 20 bp, Artificial Sequence
  Description of Artificial Sequence: Synthetic oligonucleotide
  Target: ATXN1; (+) strand; PAM type: NNAGAAW; PAM sequence: GAAGAAT
aaaaaacaaatctacataaa

SEQ ID NO: 10537 - DNA, 20 bp, Artificial Sequence
  Description of Artificial Sequence: Synthetic oligonucleotide
  Target: ATXN1; (+) strand; PAM type: NNAGAAW; PAM sequence: ATAGAAA
aaggtctatcttcttcttga

SEQ ID NO: 10538 - DNA, 20 bp, Artificial Sequence
  Description of Artificial Sequence: Synthetic oligonucleotide
  Target: ATXN1; (+) strand; PAM type: NNAGAAW; PAM sequence: AGAGAAT
tgaatagaaagtcaatatca

SEQ ID NO: 10539 - DNA, 20 bp, Artificial Sequence
  Description of Artificial Sequence: Synthetic oligonucleotide
  Target: ATXN1; (+) strand; PAM type: NNAGAAW; PAM sequence: TTAGAAA
tatgatgtcaaaaatacaaa

SEQ ID NO: 10540 - DNA, 20 bp, Artificial Sequence
  Description of Artificial Sequence: Synthetic oligonucleotide
  Target: ATXN1; (+) strand; PAM type: NNAGAAW; PAM sequence: AAAGAAT
cctatggaaaaataaacagg

SEQ ID NO: 10541 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
tggccataacaatgatataa

SEQ ID NO: 10542 - DNA, 20 bp, Artificial Sequence
  Description of Artificial Sequence: Synthetic oligonucleotide
  Target: ATXN1; (+) strand; PAM type: NNAGAAW; PAM sequence: TAAGAAA
aacaatgatataaaaagaaa

SEQ ID NO: 10543 - DNA, 20 bp, Artificial Sequence
  Description of Artificial Sequence: Synthetic oligonucleotide
  Target: ATXN1; (+) strand; PAM type: NNAGAAW; PAM sequence: AAAGAAT
tgatataaaaagaaataaga

SEQ ID NO: 10544 - DNA, 20 bp, Artificial Sequence
  Description of Artificial Sequence: Synthetic oligonucleotide
  Target: ATXN1; (+) strand; PAM type: NNAGAAW; PAM sequence: TTAGAAA
attaaaaatattataaagcc

SEQ ID NO: 10545 - DNA, 20 bp, Artificial Sequence
  Description of Artificial Sequence: Synthetic oligonucleotide
  Target: ATXN1; (+) strand; PAM type: NNAGAAW; PAM sequence: ACAGAAA
aggaatacttagcaaggtca

SEQ ID NO: 10546 - DNA, 20 bp, Artificial Sequence
  Description of Artificial Sequence: Synthetic oligonucleotide
  Target: ATXN1; (+) strand; PAM type: NNAGAAW; PAM sequence: TGAGAAA
aaaatgaaagcataaaaata

SEQ ID NO: 10547 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
gtgtcaaaaaaaaaaaaaaa

SEQ ID NO: 10548 - DNA, 20 bp, Artificial Sequence
  Description of Artificial Sequence: Synthetic oligonucleotide
  Target: ATXN1; (+) strand; PAM type: NNAGAAW; PAM sequence: GAAGAAA
aattttttaaaaccctgcat

SEQ ID NO: 10549 - DNA, 20 bp, Artificial Sequence
  Description of Artificial Sequence: Synthetic oligonucleotide
  Target: ATXN1; (+) strand; PAM type: NNAGAAW; PAM sequence: GTAGAAA
caggataaaccaaaaacgta

SEQ ID NO: 10550 - DNA, 20 bp, Artificial Sequence
  Description of Artificial Sequence: Synthetic oligonucleotide
  Target: ATXN1; (+) strand; PAM type: NNAGAAW; PAM sequence: CCAGAAA
cgaggatgaatatacatttc

SEQ ID NO: 10551 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
atgaatatacatttcccaga

SEQ ID NO: 10552 - DNA, 20 bp, Artificial Sequence
  Description of Artificial Sequence: Synthetic oligonucleotide
  Target: ATXN1; (+) strand; PAM type: NNAGAAW; PAM sequence: ACAGAAA
attcaaccaccactataata

SEQ ID NO: 10553 - DNA, 20 bp, Artificial Sequence
  Description of Artificial Sequence: Synthetic oligonucleotide
  Target: ATXN1; (+) strand; PAM type: NNAGAAW; PAM sequence: CTAGAAT
agaaacccatattaaagcta

SEQ ID NO: 10554 - DNA, 20 bp, Artificial Sequence
  Description of Artificial Sequence: Synthetic oligonucleotide
  Target: ATXN1; (+) strand; PAM type: NNAGAAW; PAM sequence: GGAGAAA
agtttaaaaacatcgtctgt

SEQ ID NO: 10555 - DNA, 20 bp, Artificial Sequence
  Description of Artificial Sequence: Synthetic oligonucleotide
  Target: ATXN1; (+) strand; PAM type: NNAGAAW; PAM sequence: AAAGAAT
aatactatttagatactaaa

SEQ ID NO: 10556 - DNA, 20 bp, Artificial Sequence
  Description of Artificial Sequence: Synthetic oligonucleotide
  Target: ATXN1; (+) strand; PAM type: NNAGAAW; PAM sequence: TAAGAAA
aaggctgttctatgttccga

SEQ ID NO: 10557 - DNA, 20 bp, Artificial Sequence
  Description of Artificial Sequence: Synthetic oligonucleotide
  Target: ATXN1; (+) strand; PAM type: NNAGAAW; PAM sequence: GCAGAAT
taggtgaaaagaggtaaagg

SEQ ID NO: 10558 - DNA, 20 bp, Artificial Sequence
  Description of Artificial Sequence: Synthetic oligonucleotide
  Target: ATXN1; (+) strand; PAM type: NNAGAAW; PAM sequence: CAAGAAA
aatatccttaaaaggactca

SEQ ID NO: 10559 - DNA, 20 bp, Artificial Sequence
  Description of Artificial Sequence: Synthetic oligonucleotide
  Target: ATXN1; (+) strand; PAM type: NNAGAAW; PAM sequence: TGAGAAT
taatggtacttgcttctagg

SEQ ID NO: 10560 - DNA, 20 bp, Artificial Sequence
  Description of Artificial Sequence: Synthetic oligonucleotide
  Target: ATXN1; (+) strand; PAM type: NNAGAAW; PAM sequence: ACAGAAA
agaattcaagtgacttagac

SEQ ID NO: 10561 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
aaacaatattaatgcttcaa

SEQ ID NO: 10562 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
aatattaatgcttcaaaaag

SEQ ID NO: 10563 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
taatgcttcaaaaagaaaga

SEQ ID NO: 10564 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
tagatttatcctcaggatgc

SEQ ID NO: 10565 - DNA, 20 bp, Artificial Sequence
  Description of Artificial Sequence: Synthetic oligonucleotide
  Target: ATXN1; (+) strand; PAM type: NNAGAAW; PAM sequence: GGAGAAT
ctactcgggaggctgaggca

SEQ ID NO: 10566 - DNA, 20 bp, Artificial Sequence
  Description of Artificial Sequence: Synthetic oligonucleotide
  Target: ATXN1; (+) strand; PAM type: NNAGAAW; PAM sequence: CTAGAAT
gcaggggtggagagagaaga

SEQ ID NO: 10567 - DNA, 20 bp, Artificial Sequence
  Description of Artificial Sequence: Synthetic oligonucleotide
  Target: ATXN1; (+) strand; PAM type: NNAGAAW; PAM sequence: AGAGAAA
gtgtgctttgtatacaatgt

SEQ ID NO: 10568 - DNA, 20 bp, Artificial Sequence
  Description of Artificial Sequence: Synthetic oligonucleotide
  Target: ATXN1; (+) strand; PAM type: NNAGAAW; PAM sequence: AAAGAAT
actattgaaaaataaaataa

SEQ ID NO: 10569 - DNA, 20 bp, Artificial Sequence
  Description of Artificial Sequence: Synthetic oligonucleotide
  Target: ATXN1; (+) strand; PAM type: NNAGAAW; PAM sequence: TGAGAAT
tcattgctattttccaagct

SEQ ID NO: 10570 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
tctcatgagtacatagttta

SEQ ID NO: 10571 - DNA, 20 bp, Artificial Sequence
  Description of Artificial Sequence: Synthetic oligonucleotide
  Target: ATXN1; (+) strand; PAM type: NNAGAAW; PAM sequence: TAAGAAA
atttgaaaaccaagtaaaag

SEQ ID NO: 10572 - DNA, 20 bp, Artificial Sequence
  Description of Artificial Sequence: Synthetic oligonucleotide
  Target: ATXN1; (+) strand; PAM type: NNAGAAW; PAM sequence: ACAGAAT
gattatgtcataaggagaac

SEQ ID NO: 10573 - DNA, 20 bp, Artificial Sequence
  Description of Artificial Sequence: Synthetic oligonucleotide
  Target: ATXN1; (+) strand; PAM type: NNAGAAW; PAM sequence: AAAGAAT
gaatttgatgtggtcctgga

SEQ ID NO: 10574 - DNA, 20 bp, Artificial Sequence
  Description of Artificial Sequence: Synthetic oligonucleotide
  Target: ATXN1; (+) strand; PAM type: NNAGAAW; PAM sequence: ATAGAAA
gtggtcctggaaaagaatat

SEQ ID NO: 10575 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
caggaggatgatcctaggtg

SEQ ID NO: 10576 - DNA, 20 bp, Artificial Sequence
  Description of Artificial Sequence: Synthetic oligonucleotide
  Target: ATXN1; (+) strand; PAM type: NNAGAAW; PAM sequence: GCAGAAA
aaaccagagatgcaacagaa

SEQ ID NO: 10577 - DNA, 20 bp, Artificial Sequence
  Description of Artificial Sequence: Synthetic oligonucleotide
  Target: ATXN1; (+) strand; PAM type: NNAGAAW; PAM sequence: GAAGAAA
acctggaagatgtaaacaag

SEQ ID NO: 10578 - DNA, 20 bp, Artificial Sequence
  Description of Artificial Sequence: Synthetic oligonucleotide
  Target: ATXN1; (+) strand; PAM type: NNAGAAW; PAM sequence: GCAGAAT
aagtggttatacacacttag

SEQ ID NO: 10579 - DNA, 20 bp, Artificial Sequence
  Description of Artificial Sequence: Synthetic oligonucleotide
  Target: ATXN1; (+) strand; PAM type: NNAGAAW; PAM sequence: TAAGAAT
acttaggcagaatctacttt

SEQ ID NO: 10580 - DNA, 20 bp, Artificial Sequence
  Description of Artificial Sequence: Synthetic oligonucleotide
  Target: ATXN1; (+) strand; PAM type: NNAGAAW; PAM sequence: GAAGAAA
caaaagaaggaagacataaa

SEQ ID NO: 10581 - DNA, 20 bp, Artificial Sequence
  Description of Artificial Sequence: Synthetic oligonucleotide
  Target: ATXN1; (+) strand; PAM type: NNAGAAW; PAM sequence: AGAGAAA
gatcagagcagtagagggta

SEQ ID NO: 10582 - DNA, 20 bp, Artificial Sequence
  Description of Artificial Sequence: Synthetic oligonucleotide
  Target: ATXN1; (+) strand; PAM type: NNAGAAW; PAM sequence: TCAGAAA
aaggcagataaagagtgttt

SEQ ID NO: 10583 - DNA, 20 bp, Artificial Sequence
  Description of Artificial Sequence: Synthetic oligonucleotide
  Target: ATXN1; (+) strand; PAM type: NNAGAAW; PAM sequence: GAAGAAA
aaaaaaaaaaaaaagaagaa

SEQ ID NO: 10584 - DNA, 20 bp, Artificial Sequence
  Description of Artificial Sequence: Synthetic oligonucleotide
  Target: ATXN1; (+) strand; PAM type: NNAGAAW; PAM sequence: GAAGAAA
aaaaaaagaagaagaagaaa

SEQ ID NO: 10585 - DNA, 20 bp, Artificial Sequence
  Description of Artificial Sequence: Synthetic oligonucleotide
  Target: ATXN1; (+) strand; PAM type: NNAGAAW; PAM sequence: GAAGAAA
ggaatggggaaggggaagga

SEQ ID NO: 10586 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
ggggaaggggaaggagaaga

SEQ ID NO: 10587 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
aggggaaggagaagaaaaga

SEQ ID NO: 10588 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
gaaggagaagaaaagaaaag

SEQ ID NO: 10589 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
aggaaaggaaaggaaaggaa

SEQ ID NO: 10590 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
aggaaaggaaaggaaaaaga

SEQ ID NO: 10591 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
aggaaaggaaaaagaaaaga

SEQ ID NO: 10592 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
aaaagaaaagaaaagaaaca

SEQ ID NO: 10593 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
aaagaaaagaaacaaaagaa

SEQ ID NO: 10594 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
aaagaaacaaaagaaaaaga

SEQ ID NO: 10595 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
aacaaaagaaaaagaaaaga

SEQ ID NO: 10596 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
tttcaaaacatgttgaggtt

SEQ ID NO: 10597 - DNA, 20 bp, Artificial Sequence
  Description of Artificial Sequence: Synthetic oligonucleotide
  Target: ATXN1; (+) strand; PAM type: NNAGAAW; PAM sequence: AAAGAAT
aaaacatgttgaggttaaag

SEQ ID NO: 10598 - DNA, 20 bp, Artificial Sequence
  Description of Artificial Sequence: Synthetic oligonucleotide
  Target: ATXN1; (+) strand; PAM type: NNAGAAW; PAM sequence: AGAGAAA
gttgaggttaaagaaagaat

SEQ ID NO: 10599 - DNA, 20 bp, Artificial Sequence
  Description of Artificial Sequence: Synthetic oligonucleotide
  Target: ATXN1; (+) strand; PAM type: NNAGAAW; PAM sequence: CCAGAAA
aagtcagggtagagagggat

SEQ ID NO: 10600 - DNA, 20 bp, Artificial Sequence
  Description of Artificial Sequence: Synthetic oligonucleotide
  Target: ATXN1; (+) strand; PAM type: NNAGAAW; PAM sequence: ACAGAAT
ctgtgagacaggagcaacgg

SEQ ID NO: 10601 - DNA, 20 bp, Artificial Sequence
  Description of Artificial Sequence: Synthetic oligonucleotide
  Target: ATXN1; (+) strand; PAM type: NNAGAAW; PAM sequence: TAAGAAA
aaagtttggaatagatccca

SEQ ID NO: 10602 - DNA, 20 bp, Artificial Sequence
  Description of Artificial Sequence: Synthetic oligonucleotide
  Target: ATXN1; (+) strand; PAM type: NNAGAAW; PAM sequence: CTAGAAA
gaaatgtgactatgagccca

SEQ ID NO: 10603 - DNA, 20 bp, Artificial Sequence
  Description of Artificial Sequence: Synthetic oligonucleotide
  Target: ATXN1; (+) strand; PAM type: NNAGAAW; PAM sequence: TAAGAAT
gactctcctcagattaacag

SEQ ID NO: 10604 - DNA, 20 bp, Artificial Sequence
  Description of Artificial Sequence: Synthetic oligonucleotide
  Target: ATXN1; (+) strand; PAM type: NNAGAAW; PAM sequence: GAAGAAA
ggggcaggaatacggagcct

SEQ ID NO: 10605 - DNA, 20 bp, Artificial Sequence
  Description of Artificial Sequence: Synthetic oligonucleotide
  Target: ATXN1; (+) strand; PAM type: NNAGAAW; PAM sequence: TTAGAAA
agagtctgagattttaagat

SEQ ID NO: 10606 - DNA, 20 bp, Artificial Sequence
  Description of Artificial Sequence: Synthetic oligonucleotide
  Target: ATXN1; (+) strand; PAM type: NNAGAAW; PAM sequence: ATAGAAA
caattgggagaagctcacga

SEQ ID NO: 10607 - DNA, 20 bp, Artificial Sequence
  Description of Artificial Sequence: Synthetic oligonucleotide
  Target: ATXN1; (+) strand; PAM type: NNAGAAW; PAM sequence: AGAGAAT
ggagaagctcacgaatagaa

SEQ ID NO: 10608 - DNA, 20 bp, Artificial Sequence
  Description of Artificial Sequence: Synthetic oligonucleotide
  Target: ATXN1; (+) strand; PAM type: NNAGAAW; PAM sequence: TGAGAAA
ctcagcccccgtctataaag

SEQ ID NO: 10609 - DNA, 20 bp, Artificial Sequence
  Description of Artificial Sequence: Synthetic oligonucleotide
  Target: ATXN1; (+) strand; PAM type: NNAGAAW; PAM sequence: CAAGAAA
cccttctacaactatgttct

SEQ ID NO: 10610 - DNA, 20 bp, Artificial Sequence
  Description of Artificial Sequence: Synthetic oligonucleotide
  Target: ATXN1; (+) strand; PAM type: NNAGAAW; PAM sequence: AGAGAAA
tacctaaaagtaggctgcac

SEQ ID NO: 10611 - DNA, 20 bp, Artificial Sequence
  Description of Artificial Sequence: Synthetic oligonucleotide
  Target: ATXN1; (+) strand; PAM type: NNAGAAW; PAM sequence: CAAGAAA
gttacattattccatcataa

SEQ ID NO: 10612 - DNA, 20 bp, Artificial Sequence
  Description of Artificial Sequence: Synthetic oligonucleotide
  Target: ATXN1; (+) strand; PAM type: NNAGAAW; PAM sequence: AGAGAAA
gaacaagcaaatctatatat

SEQ ID NO: 10613 - DNA, 20 bp, Artificial Sequence
  Description of Artificial Sequence: Synthetic oligonucleotide
  Target: ATXN1; (+) strand; PAM type: NNAGAAW; PAM sequence: GTAGAAT
ctgggtgagggtcttgatag

SEQ ID NO: 10614 - DNA, 20 bp, Artificial Sequence
  Description of Artificial Sequence: Synthetic oligonucleotide
  Target: ATXN1; (+) strand; PAM type: NNAGAAW; PAM sequence: ACAGAAT
tagaatactgtacacggaat

SEQ ID NO: 10615 - DNA, 20 bp, Artificial Sequence
  Description of Artificial Sequence: Synthetic oligonucleotide
  Target: ATXN1; (+) strand; PAM type: NNAGAAW; PAM sequence: AAAGAAT
cctagtttgaagtttatgaa

SEQ ID NO: 10616 - DNA, 20 bp, Artificial Sequence
  Description of Artificial Sequence: Synthetic oligonucleotide
  Target: ATXN1; (+) strand; PAM type: NNAGAAW; PAM sequence: GAAGAAA
gccacatcattttgtttagg

SEQ ID NO: 10617 - DNA, 20 bp, Artificial Sequence
  Description of Artificial Sequence: Synthetic oligonucleotide
  Target: ATXN1; (+) strand; PAM type: NNAGAAW; PAM sequence: TCAGAAT
gaacgttgaggttaaaaaaa

SEQ ID NO: 10618 - DNA, 20 bp, Artificial Sequence
  Description of Artificial Sequence: Synthetic oligonucleotide
  Target: ATXN1; (+) strand; PAM type: NNAGAAW; PAM sequence: ACAGAAA
aaacacacacatgcacacca

SEQ ID NO: 10619 - DNA, 20 bp, Artificial Sequence
  Description of Artificial Sequence: Synthetic oligonucleotide
  Target: ATXN1; (+) strand; PAM type: NNAGAAW; PAM sequence: AGAGAAA
agggaagggtctcaaaaaag

SEQ ID NO: 10620 - DNA, 20 bp, Artificial Sequence
  Description of Artificial Sequence: Synthetic oligonucleotide
  Target: ATXN1; (+) strand; PAM type: NNAGAAW; PAM sequence: CAAGAAT
aaaagatttacgttgaataa

SEQ ID NO: 10621 - DNA, 20 bp, Artificial Sequence
  Description of Artificial Sequence: Synthetic oligonucleotide
  Target: ATXN1; (+) strand; PAM type: NNAGAAW; PAM sequence: CTAGAAA
ctctatgtgaaaaaaatagc

SEQ ID NO: 10622 - DNA, 20 bp, Artificial Sequence
  Description of Artificial Sequence: Synthetic oligonucleotide
  Target: ATXN1; (+) strand; PAM type: NNAGAAW; PAM sequence: TAAGAAA
catgtttttgcatccagata

SEQ ID NO: 10623 - DNA, 20 bp, Artificial Sequence
  Description of Artificial Sequence: Synthetic oligonucleotide
  Target: ATXN1; (+) strand; PAM type: NNAGAAW; PAM sequence: GGAGAAT
ctactcgggaggctgaggca

SEQ ID NO: 10624 - DNA, 20 bp, Artificial Sequence
  Description of Artificial Sequence: Synthetic oligonucleotide
  Target: ATXN1; (+) strand; PAM type: NNAGAAW; PAM sequence: GCAGAAA
atgactgccaactgaagatg

SEQ ID NO: 10625 - DNA, 20 bp, Artificial Sequence
  Description of Artificial Sequence: Synthetic oligonucleotide
  Target: ATXN1; (+) strand; PAM type: NNAGAAW; PAM sequence: AGAGAAA
attctcacagttttgacagt

SEQ ID NO: 10626 - DNA, 20 bp, Artificial Sequence
  Description of Artificial Sequence: Synthetic oligonucleotide
  Target: ATXN1; (+) strand; PAM type: NNAGAAW; PAM sequence: TCAGAAT
tctgagcctgtgagtgcaag

SEQ ID NO: 10627 - DNA, 20 bp, Artificial Sequence
  Description of Artificial Sequence: Synthetic oligonucleotide
  Target: ATXN1; (+) strand; PAM type: NNAGAAW; PAM sequence: TGAGAAA
gtcagctgctctgctaacaa

SEQ ID NO: 10628 - DNA, 20 bp, Artificial Sequence
  Description of Artificial Sequence: Synthetic oligonucleotide
  Target: ATXN1; (+) strand; PAM type: NNAGAAW; PAM sequence: TTAGAAA
acattacccatgcacacagc

SEQ ID NO: 10629 - DNA, 20 bp, Artificial Sequence
  Description of Artificial Sequence: Synthetic oligonucleotide
  Target: ATXN1; (+) strand; PAM type: NNAGAAW; PAM sequence: AGAGAAT
gtgtagaacacacacacaaa

SEQ ID NO: 10630 - DNA, 20 bp, Artificial Sequence
  Description of Artificial Sequence: Synthetic oligonucleotide
  Target: ATXN1; (+) strand; PAM type: NNAGAAW; PAM sequence: CTAGAAA
tctgacaacccagagtaata

SEQ ID NO: 10631 - DNA, 20 bp, Artificial Sequence
  Description of Artificial Sequence: Synthetic oligonucleotide
  Target: ATXN1; (+) strand; PAM type: NNAGAAW; PAM sequence: CAAGAAT
aaaatcactattccaattcg

SEQ ID NO: 10632 - DNA, 20 bp, Artificial Sequence
  Description of Artificial Sequence: Synthetic oligonucleotide
  Target: ATXN1; (+) strand; PAM type: NNAGAAW; PAM sequence: ACAGAAA
aatgtatgaatgagttgtat

SEQ ID NO: 10633 - DNA, 20 bp, Artificial Sequence
  Description of Artificial Sequence: Synthetic oligonucleotide
  Target: ATXN1; (+) strand; PAM type: NNAGAAW; PAM sequence: AGAGAAA
aactccaaacacattttctc

SEQ ID NO: 10634 - DNA, 20 bp, Artificial Sequence
  Description of Artificial Sequence: Synthetic oligonucleotide
  Target: ATXN1; (+) strand; PAM type: NNAGAAW; PAM sequence: GAAGAAA
atgagcaggggacaggaggt

SEQ ID NO: 10635 - DNA, 20 bp, Artificial Sequence
  Description of Artificial Sequence: Synthetic oligonucleotide
  Target: ATXN1; (+) strand; PAM type: NNAGAAW; PAM sequence: AAAGAAT
caagctctgggtatacacac

SEQ ID NO: 10636 - DNA, 20 bp, Artificial Sequence
  Description of Artificial Sequence: Synthetic oligonucleotide
  Target: ATXN1; (+) strand; PAM type: NNAGAAW; PAM sequence: GGAGAAT
ctactggggaggctaagaca

SEQ ID NO: 10637 - DNA, 20 bp, Artificial Sequence
  Description of Artificial Sequence: Synthetic oligonucleotide
  Target: ATXN1; (+) strand; PAM type: NNAGAAW; PAM sequence: TCAGAAA
cgacagagtgagactccgtc

SEQ ID NO: 10638 - DNA, 20 bp, Artificial Sequence
  Description of Artificial Sequence: Synthetic oligonucleotide
  Target: ATXN1; (+) strand; PAM type: NNAGAAW; PAM sequence: GCAGAAA
caggaaggtatccagttgtg

SEQ ID NO: 10639 - DNA, 20 bp, Artificial Sequence
  Description of Artificial Sequence: Synthetic oligonucleotide
  Target: ATXN1; (+) strand; PAM type: NNAGAAW; PAM sequence: CAAGAAA
tgtggttagtaagtttaacc

SEQ ID NO: 10640 - DNA, 20 bp, Artificial Sequence
  Description of Artificial Sequence: Synthetic oligonucleotide
  Target: ATXN1; (+) strand; PAM type: NNAGAAW; PAM sequence: TCAGAAT
gcttcatctataagtataat

SEQ ID NO: 10641 - DNA, 20 bp, Artificial Sequence
  Description of Artificial Sequence: Synthetic oligonucleotide
  Target: ATXN1; (+) strand; PAM type: NNAGAAW; PAM sequence: ACAGAAA
gacccacgtagattagggtc

SEQ ID NO: 10642 - DNA, 20 bp, Artificial Sequence
  Description of Artificial Sequence: Synthetic oligonucleotide
  Target: ATXN1; (+) strand; PAM type: NNAGAAW; PAM sequence: GAAGAAA
ggaagaggggagaagagact

SEQ ID NO: 10643 - DNA, 20 bp, Artificial Sequence
  Description of Artificial Sequence: Synthetic oligonucleotide
  Target: ATXN1; (+) strand; PAM type: NNAGAAW; PAM sequence: AGAGAAA
aagacagatgaaagtgaaga

SEQ ID NO: 10644 - DNA, 20 bp, Artificial Sequence
  Description of Artificial Sequence: Synthetic oligonucleotide
  Target: ATXN1; (+) strand; PAM type: NNAGAAW; PAM sequence: CTAGAAA
ctcatcactttgttgcatct

SEQ ID NO: 10645 - DNA, 20 bp, Artificial Sequence
  Description of Artificial Sequence: Synthetic oligonucleotide
  Target: ATXN1; (+) strand; PAM type: NNAGAAW; PAM sequence: TAAGAAT
gtgcttcctgtgtggtggcc

SEQ ID NO: 10646 - DNA, 20 bp, Artificial Sequence
  Description of Artificial Sequence: Synthetic oligonucleotide
  Target: ATXN1; (+) strand; PAM type: NNAGAAW; PAM sequence: TGAGAAT
cctttaccttgcaattgcta

SEQ ID NO: 10647 - DNA, 20 bp, Artificial Sequence
  Description of Artificial Sequence: Synthetic oligonucleotide
  Target: ATXN1; (+) strand; PAM type: NNAGAAW; PAM sequence: TGAGAAT
actctactcatcaggcactc

SEQ ID NO: 10648 - DNA, 20 bp, Artificial Sequence
  Description of Artificial Sequence: Synthetic oligonucleotide
  Target: ATXN1; (+) strand; PAM type: NNAGAAW; PAM sequence: TAAGAAT
cttccacaatttcatatttt

SEQ ID NO: 10649 - DNA, 20 bp, Artificial Sequence
  Description of Artificial Sequence: Synthetic oligonucleotide
  Target: ATXN1; (+) strand; PAM type: NNAGAAW; PAM sequence: TAAGAAA
aggtataaggactcaactgt

SEQ ID NO: 10650 - DNA, 20 bp, Artificial Sequence
  Description of Artificial Sequence: Synthetic oligonucleotide
  Target: ATXN1; (+) strand; PAM type: NNAGAAW; PAM sequence: TGAGAAA
caatgatgtataatgttgac

SEQ ID NO: 10651 - DNA, 20 bp, Artificial Sequence
  Description of Artificial Sequence: Synthetic oligonucleotide
  Target: ATXN1; (+) strand; PAM type: NNAGAAW; PAM sequence: ACAGAAA
aaaacaagggtataaaggct

SEQ ID NO: 10652 - DNA, 20 bp, Artificial Sequence
  Description of Artificial Sequence: Synthetic oligonucleotide
  Target: ATXN1; (+) strand; PAM type: NNAGAAW; PAM sequence: AGAGAAA
cagagtgagacacaagccca

SEQ ID NO: 10653 - DNA, 20 bp, Artificial Sequence
  Description of Artificial Sequence: Synthetic oligonucleotide
  Target: ATXN1; (+) strand; PAM type: NNAGAAW; PAM sequence: GTAGAAT
catgaatggccttttcctaa

SEQ ID NO: 10654 - DNA, 20 bp, Artificial Sequence
  Description of Artificial Sequence: Synthetic oligonucleotide
  Target: ATXN1; (+) strand; PAM type: NNAGAAW; PAM sequence: CTAGAAT
ttttaatcctccttcctcac

SEQ ID NO: 10655 - DNA, 20 bp, Artificial Sequence
  Description of Artificial Sequence: Synthetic oligonucleotide
  Target: ATXN1; (+) strand; PAM type: NNAGAAW; PAM sequence: CCAGAAA
acctgtccagtaaatatgac

SEQ ID NO: 10656 - DNA, 20 bp, Artificial Sequence
  Description of Artificial Sequence: Synthetic oligonucleotide
  Target: ATXN1; (+) strand; PAM type: NNAGAAW; PAM sequence: GTAGAAA
taattttatttgtattttta

SEQ ID NO: 10657 - DNA, 20 bp, Artificial Sequence
  Description of Artificial Sequence: Synthetic oligonucleotide
  Target: ATXN1; (+) strand; PAM type: NNAGAAW; PAM sequence: ACAGAAA
ttgaagataattttagattt

SEQ ID NO: 10658 - DNA, 20 bp, Artificial Sequence
  Description of Artificial Sequence: Synthetic oligonucleotide
  Target: ATXN1; (+) strand; PAM type: NNAGAAW; PAM sequence: CTAGAAA
ccatagaaccacgatcaaaa

SEQ ID NO: 10659 - DNA, 20 bp, Artificial Sequence
  Description of Artificial Sequence: Synthetic oligonucleotide
  Target: ATXN1; (+) strand; PAM type: NNAGAAW; PAM sequence: TTAGAAT
ttcctgtttcaggatcatac

SEQ ID NO: 10660 - DNA, 20 bp, Artificial Sequence
  Description of Artificial Sequence: Synthetic oligonucleotide
  Target: ATXN1; (+) strand; PAM type: NNAGAAW; PAM sequence: CAAGAAA
tgtgttaggtgttagagtta

SEQ ID NO: 10661 - DNA, 20 bp, Artificial Sequence
  Description of Artificial Sequence: Synthetic oligonucleotide
  Target: ATXN1; (+) strand; PAM type: NNAGAAW; PAM sequence: GAAGAAA
gcaagtacagcaatggccca

SEQ ID NO: 10662 - DNA, 20 bp, Artificial Sequence
  Description of Artificial Sequence: Synthetic oligonucleotide
  Target: ATXN1; (+) strand; PAM type: NNAGAAW; PAM sequence: GGAGAAA
aaacatagtcaactctacct

SEQ ID NO: 10663 - DNA, 20 bp, Artificial Sequence
  Description of Artificial Sequence: Synthetic oligonucleotide
  Target: ATXN1; (+) strand; PAM type: NNAGAAW; PAM sequence: AGAGAAA
agcaaataaggaatatcatc

SEQ ID NO: 10664 - DNA, 20 bp, Artificial Sequence
  Description of Artificial Sequence: Synthetic oligonucleotide
  Target: ATXN1; (+) strand; PAM type: NNAGAAW; PAM sequence: AGAGAAT
ttacaagaactgcacacaat

SEQ ID NO: 10665 - DNA, 20 bp, Artificial Sequence
  Description of Artificial Sequence: Synthetic oligonucleotide
  Target: ATXN1; (+) strand; PAM type: NNAGAAW; PAM sequence: CCAGAAT
caattctgttacagggctta

SEQ ID NO: 10666 - DNA, 20 bp, Artificial Sequence
  Description of Artificial Sequence: Synthetic oligonucleotide
  Target: ATXN1; (+) strand; PAM type: NNAGAAW; PAM sequence: GAAGAAT
ggaaaaattctgtaaacata

SEQ ID NO: 10667 - DNA, 20 bp, Artificial Sequence
  Description of Artificial Sequence: Synthetic oligonucleotide
  Target: ATXN1; (+) strand; PAM type: NNAGAAW; PAM sequence: CCAGAAA
aacatagaagaatttctgag

SEQ ID NO: 10668 - DNA, 20 bp, Artificial Sequence
  Description of Artificial Sequence: Synthetic oligonucleotide
  Target: ATXN1; (+) strand; PAM type: NNAGAAW; PAM sequence: GCAGAAA
ctgagccagaaaaatgagaa

SEQ ID NO: 10669 - DNA, 20 bp, Artificial Sequence
  Description of Artificial Sequence: Synthetic oligonucleotide
  Target: ATXN1; (+) strand; PAM type: NNAGAAW; PAM sequence: TAAGAAA
tgagagctcactccatgcca

SEQ ID NO: 10670 - DNA, 20 bp, Artificial Sequence
  Description of Artificial Sequence: Synthetic oligonucleotide
  Target: ATXN1; (+) strand; PAM type: NNAGAAW; PAM sequence: ATAGAAA
ccataagaaattgcagagtt

SEQ ID NO: 10671 - DNA, 20 bp, Artificial Sequence
  Description of Artificial Sequence: Synthetic oligonucleotide
  Target: ATXN1; (+) strand; PAM type: NNAGAAW; PAM sequence: CTAGAAT
tgcagaactgagattcaaaa

SEQ ID NO: 10672 - DNA, 20 bp, Artificial Sequence
  Description of Artificial Sequence: Synthetic oligonucleotide
  Target: ATXN1; (+) strand; PAM type: NNAGAAW; PAM sequence: CCAGAAA
atcacaatggctaccccatt

SEQ ID NO: 10673 - DNA, 20 bp, Artificial Sequence
  Description of Artificial Sequence: Synthetic oligonucleotide
  Target: ATXN1; (+) strand; PAM type: NNAGAAW; PAM sequence: AGAGAAA
taactagagtagcaggaaaa

SEQ ID NO: 10674 - DNA, 20 bp, Artificial Sequence
  Description of Artificial Sequence: Synthetic oligonucleotide
  Target: ATXN1; (+) strand; PAM type: NNAGAAW; PAM sequence: ACAGAAA
cactaaaatgcacggggaaa

SEQ ID NO: 10675 - DNA, 20 bp, Artificial Sequence
  Description of Artificial Sequence: Synthetic oligonucleotide
  Target: ATXN1; (+) strand; PAM type: NNAGAAW; PAM sequence: GAAGAAA
gatggtaatttttagaggtg

SEQ ID NO: 10676 - DNA, 20 bp, Artificial Sequence
  Description of Artificial Sequence: Synthetic oligonucleotide
  Target: ATXN1; (+) strand; PAM type: NNAGAAW; PAM sequence: CAAGAAA
gaacacagtagatacagtag

SEQ ID NO: 10677 - DNA, 20 bp, Artificial Sequence
  Description of Artificial Sequence: Synthetic oligonucleotide
  Target: ATXN1; (+) strand; PAM type: NNAGAAW; PAM sequence: GAAGAAT
tttagagagagagagagaga

SEQ ID NO: 10678 - DNA, 20 bp, Artificial Sequence
  Description of Artificial Sequence: Synthetic oligonucleotide
  Target: ATXN1; (+) strand; PAM type: NNAGAAW; PAM sequence: AGAGAAA
agaagaatgattattttgga

SEQ ID NO: 10679 - DNA, 20 bp, Artificial Sequence
  Description of Artificial Sequence: Synthetic oligonucleotide
  Target: ATXN1; (+) strand; PAM type: NNAGAAW; PAM sequence: GGAGAAA
gagcacagatcttgagttag

SEQ ID NO: 10680 - DNA, 20 bp, Artificial Sequence
  Description of Artificial Sequence: Synthetic oligonucleotide
  Target: ATXN1; (+) strand; PAM type: NNAGAAW; PAM sequence: TTAGAAA
cctatctcacattcctgaat

SEQ ID NO: 10681 - DNA, 20 bp, Artificial Sequence
  Description of Artificial Sequence: Synthetic oligonucleotide
  Target: ATXN1; (+) strand; PAM type: NNAGAAW; PAM sequence: AGAGAAA
atttcatttgataacctcta

SEQ ID NO: 10682 - DNA, 20 bp, Artificial Sequence
  Description of Artificial Sequence: Synthetic oligonucleotide
  Target: ATXN1; (+) strand; PAM type: NNAGAAW; PAM sequence: ATAGAAT
atagtgatttgaaaagtacc

SEQ ID NO: 10683 - DNA, 20 bp, Artificial Sequence
  Description of Artificial Sequence: Synthetic oligonucleotide
  Target: ATXN1; (+) strand; PAM type: NNAGAAW; PAM sequence: TAAGAAA
agtctgctttagggtagcaa

SEQ ID NO: 10684 - DNA, 20 bp, Artificial Sequence
  Description of Artificial Sequence: Synthetic oligonucleotide
  Target: ATXN1; (+) strand; PAM type: NNAGAAW; PAM sequence: CCAGAAA
tgaatgtttccatactgaca

SEQ ID NO: 10685 - DNA, 20 bp, Artificial Sequence
  Description of Artificial Sequence: Synthetic oligonucleotide
  Target: ATXN1; (+) strand; PAM type: NNAGAAW; PAM sequence: AAAGAAT
atattatttataaaactttc

SEQ ID NO: 10686 - DNA, 20 bp, Artificial Sequence
  Description of Artificial Sequence: Synthetic oligonucleotide
  Target: ATXN1; (+) strand; PAM type: NNAGAAW; PAM sequence: GGAGAAA
tacagattgaaggaagggtg

SEQ ID NO: 10687 - DNA, 20 bp, Artificial Sequence
  Description of Artificial Sequence: Synthetic oligonucleotide
  Target: ATXN1; (+) strand; PAM type: NNAGAAW; PAM sequence: TTAGAAA
tcagtaggattttcttaacc

SEQ ID NO: 10688 - DNA, 20 bp, Artificial Sequence
  Description of Artificial Sequence: Synthetic oligonucleotide
  Target: ATXN1; (+) strand; PAM type: NNAGAAW; PAM sequence: CGAGAAT
aggggaaaagaccccatgtt

SEQ ID NO: 10689 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
gcaactcaactggacatgtt

SEQ ID NO: 10690 - DNA, 20 bp, Artificial Sequence
  Description of Artificial Sequence: Synthetic oligonucleotide
  Target: ATXN1; (+) strand; PAM type: NNAGAAW; PAM sequence: GAAGAAA
aactggacatgttaaagaaa

SEQ ID NO: 10691 - DNA, 20 bp, Artificial Sequence
  Description of Artificial Sequence: Synthetic oligonucleotide
  Target: ATXN1; (+) strand; PAM type: NNAGAAW; PAM sequence: AGAGAAA
tgaccagggagggatacaat

SEQ ID NO: 10692 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
ggtcaaggcctaaggagata

SEQ ID NO: 10693 - DNA, 20 bp, Artificial Sequence
  Description of Artificial Sequence: Synthetic oligonucleotide
  Target: ATXN1; (+) strand; PAM type: NNAGAAW; PAM sequence: TAAGAAA
gtgaattatagtgggtaaag

SEQ ID NO: 10694 - DNA, 20 bp, Artificial Sequence
  Description of Artificial Sequence: Synthetic oligonucleotide
  Target: ATXN1; (+) strand; PAM type: NNAGAAW; PAM sequence: TAAGAAA
cgattcttcctttgggtggt

SEQ ID NO: 10695 - DNA, 20 bp, Artificial Sequence
  Description of Artificial Sequence: Synthetic oligonucleotide
  Target: ATXN1; (+) strand; PAM type: NNAGAAW; PAM sequence: TTAGAAT
gatgcacctcttgcctcctt

SEQ ID NO: 10696 - DNA, 20 bp, Artificial Sequence
  Description of Artificial Sequence: Synthetic oligonucleotide
  Target: ATXN1; (+) strand; PAM type: NNAGAAW; PAM sequence: AGAGAAA
tcccactctcctgtctccct

SEQ ID NO: 10697 - DNA, 20 bp, Artificial Sequence
  Description of Artificial Sequence: Synthetic oligonucleotide
  Target: ATXN1; (+) strand; PAM type: NNAGAAW; PAM sequence: AGAGAAT
ccagccagtgatccacagca

SEQ ID NO: 10698 - DNA, 20 bp, Artificial Sequence
  Description of Artificial Sequence: Synthetic oligonucleotide
  Target: ATXN1; (+) strand; PAM type: NNAGAAW; PAM sequence: TCAGAAT
tacactcatgaggtgcctca

SEQ ID NO: 10699 - DNA, 20 bp, Artificial Sequence
  Description of Artificial Sequence: Synthetic oligonucleotide
  Target: ATXN1; (+) strand; PAM type: NNAGAAW; PAM sequence: TGAGAAA
ttcagatattcctcttctgc

SEQ ID NO: 10700 - DNA, 20 bp, Artificial Sequence
  Description of Artificial Sequence: Synthetic oligonucleotide
  Target: ATXN1; (+) strand; PAM type: NNAGAAW; PAM sequence: CCAGAAA
acagagctgttcaaattaga

SEQ ID NO: 10701 - DNA, 20 bp, Artificial Sequence
  Description of Artificial Sequence: Synthetic oligonucleotide
  Target: ATXN1; (+) strand; PAM type: NNAGAAW; PAM sequence: CAAGAAA
acttgcccaatgtcacactt

SEQ ID NO: 10702 - DNA, 20 bp, Artificial Sequence
  Description of Artificial Sequence: Synthetic oligonucleotide
  Target: ATXN1; (+) strand; PAM type: NNAGAAW; PAM sequence: TAAGAAA
aaatacctttttgctctttt

SEQ ID NO: 10703 - DNA, 20 bp, Artificial Sequence
  Description of Artificial Sequence: Synthetic oligonucleotide
  Target: ATXN1; (+) strand; PAM type: NNAGAAW; PAM sequence: CCAGAAA
agttgtctaaaaatacttgg

SEQ ID NO: 10704 - DNA, 20 bp, Artificial Sequence
  Description of Artificial Sequence: Synthetic oligonucleotide
  Target: ATXN1; (+) strand; PAM type: NNAGAAW; PAM sequence: TAAGAAA
tacatttaccagtatgctgc

SEQ ID NO: 10705 - DNA, 20 bp, Artificial Sequence
  Description of Artificial Sequence: Synthetic oligonucleotide
  Target: ATXN1; (+) strand; PAM type: NNAGAAW; PAM sequence: TAAGAAT
tgggaactaatacagagcta

SEQ ID NO: 10706 - DNA, 20 bp, Artificial Sequence
  Description of Artificial Sequence: Synthetic oligonucleotide
  Target: ATXN1; (+) strand; PAM type: NNAGAAW; PAM sequence: CAAGAAA
gacagagtgagaccctatct

SEQ ID NO: 10707 - DNA, 20 bp, Artificial Sequence
  Description of Artificial Sequence: Synthetic oligonucleotide
  Target: ATXN1; (+) strand; PAM type: NNAGAAW; PAM sequence: TTAGAAA
aaaataaaaaggcaaaaaaa

SEQ ID NO: 10708 - DNA, 20 bp, Artificial Sequence
  Description of Artificial Sequence: Synthetic oligonucleotide
  Target: ATXN1; (+) strand; PAM type: NNAGAAW; PAM sequence: TTAGAAT
ggatataaattaaataaatt

SEQ ID NO: 10709 - DNA, 20 bp, Artificial Sequence
  Description of Artificial Sequence: Synthetic oligonucleotide
  Target: ATXN1; (+) strand; PAM type: NNAGAAW; PAM sequence: GTAGAAA
taatcattaataactatacg

SEQ ID NO: 10710 - DNA, 20 bp, Artificial Sequence
  Description of Artificial Sequence: Synthetic oligonucleotide
  Target: ATXN1; (+) strand; PAM type: NNAGAAW; PAM sequence: TCAGAAT
tctgttgctatgaaagatgt

SEQ ID NO: 10711 - DNA, 20 bp, Artificial Sequence
  Description of Artificial Sequence: Synthetic oligonucleotide
  Target: ATXN1; (+) strand; PAM type: NNAGAAW; PAM sequence: TCAGAAT
ctataaatttataaatgcct

SEQ ID NO: 10712 - DNA, 20 bp, Artificial Sequence
  Description of Artificial Sequence: Synthetic oligonucleotide
  Target: ATXN1; (+) strand; PAM type: NNAGAAW; PAM sequence: GTAGAAA
ttcacgaagattttgcttga

SEQ ID NO: 10713 - DNA, 20 bp, Artificial Sequence
  Description of Artificial Sequence: Synthetic oligonucleotide
  Target: ATXN1; (+) strand; PAM type: NNAGAAW; PAM sequence: GGAGAAT
tgagtagaaagggtggcagt

SEQ ID NO: 10714 - DNA, 20 bp, Artificial Sequence
  Description of Artificial Sequence: Synthetic oligonucleotide
  Target: ATXN1; (+) strand; PAM type: NNAGAAW; PAM sequence: ACAGAAA
cattcacattcgctgaagtc

SEQ ID NO: 10715 - DNA, 20 bp, Artificial Sequence
  Description of Artificial Sequence: Synthetic oligonucleotide
  Target: ATXN1; (+) strand; PAM type: NNAGAAW; PAM sequence: TCAGAAT
acacacacaaggtttttaaa

SEQ ID NO: 10716 - DNA, 20 bp, Artificial Sequence
  Description of Artificial Sequence: Synthetic oligonucleotide
  Target: ATXN1; (+) strand; PAM type: NNAGAAW; PAM sequence: TAAGAAA
ctcaatgattctaagatttc

SEQ ID NO: 10717 - DNA, 20 bp, Artificial Sequence
  Description of Artificial Sequence: Synthetic oligonucleotide
  Target: ATXN1; (+) strand; PAM type: NNAGAAW; PAM sequence: ATAGAAA
taacaagcagtcagttcttc

SEQ ID NO: 10718 - DNA, 20 bp, Artificial Sequence
  Description of Artificial Sequence: Synthetic oligonucleotide
  Target: ATXN1; (+) strand; PAM type: NNAGAAW; PAM sequence: TCAGAAA
tcagttcttcatagaaaatg

SEQ ID NO: 10719 - DNA, 20 bp, Artificial Sequence
  Description of Artificial Sequence: Synthetic oligonucleotide
  Target: ATXN1; (+) strand; PAM type: NNAGAAW; PAM sequence: CAAGAAA
gtttacctctgcattattga

SEQ ID NO: 10720 - DNA, 20 bp, Artificial Sequence
  Description of Artificial Sequence: Synthetic oligonucleotide
  Target: ATXN1; (+) strand; PAM type: NNAGAAW; PAM sequence: GGAGAAT
ctactcaggaagctgaggca

SEQ ID NO: 10721 - DNA, 20 bp, Artificial Sequence
  Description of Artificial Sequence: Synthetic oligonucleotide
  Target: ATXN1; (+) strand; PAM type: NNAGAAW; PAM sequence: GCAGAAA
tccagatgccaaaacactaa

SEQ ID NO: 10722 - DNA, 20 bp, Artificial Sequence
  Description of Artificial Sequence: Synthetic oligonucleotide
  Target: ATXN1; (+) strand; PAM type: NNAGAAW; PAM sequence: TTAGAAA
gcctaagcggctaaatttca

SEQ ID NO: 10723 - DNA, 20 bp, Artificial Sequence
  Description of Artificial Sequence: Synthetic oligonucleotide
  Target: ATXN1; (+) strand; PAM type: NNAGAAW; PAM sequence: TTAGAAT
tctacatactaatacagatc

SEQ ID NO: 10724 - DNA, 20 bp, Artificial Sequence
  Description of Artificial Sequence: Synthetic oligonucleotide
  Target: ATXN1; (+) strand; PAM type: NNAGAAW; PAM sequence: CAAGAAA
caaaatggatatgagcatat

SEQ ID NO: 10725 - DNA, 20 bp, Artificial Sequence
  Description of Artificial Sequence: Synthetic oligonucleotide
  Target: ATXN1; (+) strand; PAM type: NNAGAAW; PAM sequence: TTAGAAA
gctttgcctctccttgccat

SEQ ID NO: 10726 - DNA, 20 bp, Artificial Sequence
  Description of Artificial Sequence: Synthetic oligonucleotide
  Target: ATXN1; (+) strand; PAM type: NNAGAAW; PAM sequence: GGAGAAT
tgacccgggaggctgaggca

SEQ ID NO: 10727 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
ctctgtctaaaaaaaaaaaa

SEQ ID NO: 10728 - DNA, 20 bp, Artificial Sequence
  Description of Artificial Sequence: Synthetic oligonucleotide
  Target: ATXN1; (+) strand; PAM type: NNAGAAW; PAM sequence: GCAGAAT
aatgttttctggaaatctaa

SEQ ID NO: 10729 - DNA, 20 bp, Artificial Sequence
  Description of Artificial Sequence: Synthetic oligonucleotide
  Target: ATXN1; (+) strand; PAM type: NNAGAAW; PAM sequence: ATAGAAT
acctcctaggacacacttgt

SEQ ID NO: 10730 - DNA, 20 bp, Artificial Sequence
  Description of Artificial Sequence: Synthetic oligonucleotide
  Target: ATXN1; (+) strand; PAM type: NNAGAAW; PAM sequence: CCAGAAA
cccccacgaatcaataaact

SEQ ID NO: 10731 - DNA, 20 bp, Artificial Sequence
  Description of Artificial Sequence: Synthetic oligonucleotide
  Target: ATXN1; (+) strand; PAM type: NNAGAAW; PAM sequence: GAAGAAA
gaagggagggaggaaggtag

SEQ ID NO: 10732 - DNA, 20 bp, Artificial Sequence
  Description of Artificial Sequence: Synthetic oligonucleotide
  Target: ATXN1; (+) strand; PAM type: NNAGAAW; PAM sequence: CAAGAAA
caacctaagtcccttaaagg

SEQ ID NO: 10733 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
taaattaacaacaacaaaaa

SEQ ID NO: 10734 - DNA, 20 bp, Artificial Sequence
  Description of Artificial Sequence: Synthetic oligonucleotide
  Target: ATXN1; (+) strand; PAM type: NNAGAAW; PAM sequence: AGAGAAT
atctgaaatatacgattaat

SEQ ID NO: 10735 - DNA, 20 bp, Artificial Sequence
  Description of Artificial Sequence: Synthetic oligonucleotide
  Target: ATXN1; (+) strand; PAM type: NNAGAAW; PAM sequence: CTAGAAA
tgtgtaagaacataaaatgc

SEQ ID NO: 10736 - DNA, 20 bp, Artificial Sequence
  Description of Artificial Sequence: Synthetic oligonucleotide
  Target: ATXN1; (+) strand; PAM type: NNAGAAW; PAM sequence: TCAGAAA
taaaatgcctagaaaggagc

SEQ ID NO: 10737 - DNA, 20 bp, Artificial Sequence
  Description of Artificial Sequence: Synthetic oligonucleotide
  Target: ATXN1; (+) strand; PAM type: NNAGAAW; PAM sequence: ACAGAAA
ttatctatgaagtctaaatg

SEQ ID NO: 10738 - DNA, 20 bp, Artificial Sequence
  Description of Artificial Sequence: Synthetic oligonucleotide
  Target: ATXN1; (+) strand; PAM type: NNAGAAW; PAM sequence: TTAGAAT
ctattagatgctattctaat

SEQ ID NO: 10739 - DNA, 20 bp, Artificial Sequence
  Description of Artificial Sequence: Synthetic oligonucleotide
  Target: ATXN1; (+) strand; PAM type: NNAGAAW; PAM sequence: GCAGAAA
tgctattctaatttagaatt

SEQ ID NO: 10740 - DNA, 20 bp, Artificial Sequence
  Description of Artificial Sequence: Synthetic oligonucleotide
  Target: ATXN1; (+) strand; PAM type: NNAGAAW; PAM sequence: TAAGAAT
aatgcactttggaaaaaaaa

SEQ ID NO: 10741 - DNA, 20 bp, Artificial Sequence
  Description of Artificial Sequence: Synthetic oligonucleotide
  Target: ATXN1; (+) strand; PAM type: NNAGAAW; PAM sequence: ACAGAAT
tgctaccagtacatagttga

SEQ ID NO: 10742 - DNA, 20 bp, Artificial Sequence
  Description of Artificial Sequence: Synthetic oligonucleotide
  Target: ATXN1; (+) strand; PAM type: NNAGAAW; PAM sequence: GTAGAAT
aacataattaaaatgagaag

SEQ ID NO: 10743 - DNA, 20 bp, Artificial Sequence
  Description of Artificial Sequence: Synthetic oligonucleotide
  Target: ATXN1; (+) strand; PAM type: NNAGAAW; PAM sequence: ACAGAAT
caaactgcacaattctttgc

SEQ ID NO: 10744 - DNA, 20 bp, Artificial Sequence
  Description of Artificial Sequence: Synthetic oligonucleotide
  Target: ATXN1; (+) strand; PAM type: NNAGAAW; PAM sequence: TGAGAAT
atgctgcgcattttcctgtc

SEQ ID NO: 10745 - DNA, 20 bp, Artificial Sequence
  Description of Artificial Sequence: Synthetic oligonucleotide
  Target: ATXN1; (+) strand; PAM type: NNAGAAW; PAM sequence: TCAGAAT
cattattctgctcagctgtt

SEQ ID NO: 10746 - DNA, 20 bp, Artificial Sequence
  Description of Artificial Sequence: Synthetic oligonucleotide
  Target: ATXN1; (+) strand; PAM type: NNAGAAW; PAM sequence: AGAGAAT
tgatgatgaatccgagcagc

SEQ ID NO: 10747 - DNA, 20 bp, Artificial Sequence
  Description of Artificial Sequence: Synthetic oligonucleotide
  Target: ATXN1; (+) strand; PAM type: NNAGAAW; PAM sequence: TCAGAAA
ctcagaagaccacgtgttgc

SEQ ID NO: 10748 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
aagaccacgtgttgctcaga

SEQ ID NO: 10749 - DNA, 20 bp, Artificial Sequence
  Description of Artificial Sequence: Synthetic oligonucleotide
  Target: ATXN1; (+) strand; PAM type: NNAGAAW; PAM sequence: ACAGAAA
cttttggtaggaagcactat

SEQ ID NO: 10750 - DNA, 20 bp, Artificial Sequence
  Description of Artificial Sequence: Synthetic oligonucleotide
  Target: ATXN1; (+) strand; PAM type: NNAGAAW; PAM sequence: CAAGAAT
gttcgtggtctcgctgactt

SEQ ID NO: 10751 - DNA, 20 bp, Artificial Sequence
  Description of Artificial Sequence: Synthetic oligonucleotide
  Target: ATXN1; (+) strand; PAM type: NNAGAAW; PAM sequence: AAAGAAT
acaaagcttccacagctgga

SEQ ID NO: 10752 - DNA, 20 bp, Artificial Sequence
  Description of Artificial Sequence: Synthetic oligonucleotide
  Target: ATXN1; (+) strand; PAM type: NNAGAAW; PAM sequence: ACAGAAA
ttttataatacccttggaag

SEQ ID NO: 10753 - DNA, 20 bp, Artificial Sequence
  Description of Artificial Sequence: Synthetic oligonucleotide
  Target: ATXN1; (+) strand; PAM type: NNAGAAW; PAM sequence: AGAGAAT
cctccctggggactatggaa

SEQ ID NO: 10754 - DNA, 20 bp, Artificial Sequence
  Description of Artificial Sequence: Synthetic oligonucleotide
  Target: ATXN1; (+) strand; PAM type: NNAGAAW; PAM sequence: AAAGAAT
tgcaatgtttgtaacccaca

SEQ ID NO: 10755 - DNA, 20 bp, Artificial Sequence
  Description of Artificial Sequence: Synthetic oligonucleotide
  Target: ATXN1; (+) strand; PAM type: NNAGAAW; PAM sequence: TAAGAAT
tgtacgtaacctgtgaagca

SEQ ID NO: 10756 - DNA, 20 bp, Artificial Sequence
  Description of Artificial Sequence: Synthetic oligonucleotide
  Target: ATXN1; (+) strand; PAM type: NNAGAAW; PAM sequence: TTAGAAA
cagcttcgtttttttttcta

SEQ ID NO: 10757 - DNA, 20 bp, Artificial Sequence
  Description of Artificial Sequence: Synthetic oligonucleotide
  Target: ATXN1; (+) strand; PAM type: NNAGAAW; PAM sequence: TCAGAAT
tttaaaactgataaatcatt

SEQ ID NO: 10758 - DNA, 20 bp, Artificial Sequence
  Description of Artificial Sequence: Synthetic oligonucleotide
  Target: ATXN1; (+) strand; PAM type: NNAGAAW; PAM sequence: CAAGAAA
ctgataaatcatttcagaat

SEQ ID NO: 10759 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
ctcaaattctaaatatccat

SEQ ID NO: 10760 - DNA, 20 bp, Artificial Sequence
  Description of Artificial Sequence: Synthetic oligonucleotide
  Target: ATXN1; (+) strand; PAM type: NNAGAAW; PAM sequence: AAAGAAT
aaatgattctttcctctcca

SEQ ID NO: 10761 - DNA, 20 bp, Artificial Sequence
  Description of Artificial Sequence: Synthetic oligonucleotide
  Target: ATXN1; (+) strand; PAM type: NNAGAAW; PAM sequence: ACAGAAT
agatctgtctgggcatgagt

SEQ ID NO: 10762 - DNA, 20 bp, Artificial Sequence
  Description of Artificial Sequence: Synthetic oligonucleotide
  Target: ATXN1; (+) strand; PAM type: NNAGAAW; PAM sequence: ACAGAAT
aagagacaacgataaaacgg

SEQ ID NO: 10763 - DNA, 20 bp, Artificial Sequence
  Description of Artificial Sequence: Synthetic oligonucleotide
  Target: ATXN1; (+) strand; PAM type: NNAGAAW; PAM sequence: GGAGAAA
tgacttagattatcctttca

SEQ ID NO: 10764 - DNA, 20 bp, Artificial Sequence
  Description of Artificial Sequence: Synthetic oligonucleotide
  Target: ATXN1; (+) strand; PAM type: NNAGAAW; PAM sequence: TCAGAAT
aattcctctgggaaatgagg

SEQ ID NO: 10765 - DNA, 20 bp, Artificial Sequence
  Description of Artificial Sequence: Synthetic oligonucleotide
  Target: ATXN1; (+) strand; PAM type: NNAGAAW; PAM sequence: GGAGAAA
caaaggcaagatgggtagaa

SEQ ID NO: 10766 - DNA, 20 bp, Artificial Sequence
  Description of Artificial Sequence: Synthetic oligonucleotide
  Target: ATXN1; (+) strand; PAM type: NNAGAAW; PAM sequence: GGAGAAT
aaacacctccggtggaagga

SEQ ID NO: 10767 - DNA, 20 bp, Artificial Sequence
  Description of Artificial Sequence: Synthetic oligonucleotide
  Target: ATXN1; (+) strand; PAM type: NNAGAAW; PAM sequence: CAAGAAT
taagggaacctcgtcagccg

SEQ ID NO: 10768 - DNA, 20 bp, Artificial Sequence
  Description of Artificial Sequence: Synthetic oligonucleotide
  Target: ATXN1; (+) strand; PAM type: NNAGAAW; PAM sequence: GCAGAAA
tttttctgcccacaattatg

SEQ ID NO: 10769 - DNA, 20 bp, Artificial Sequence
  Description of Artificial Sequence: Synthetic oligonucleotide
  Target: ATXN1; (+) strand; PAM type: NNAGAAW; PAM sequence: GAAGAAT
aaatgctgcttcacatgttc

SEQ ID NO: 10770 - DNA, 20 bp, Artificial Sequence
  Description of Artificial Sequence: Synthetic oligonucleotide
  Target: ATXN1; (+) strand; PAM type: NNAGAAW; PAM sequence: TGAGAAT
cgaagaatgcctcacatggt

SEQ ID NO: 10771 - DNA, 20 bp, Artificial Sequence
  Description of Artificial Sequence: Synthetic oligonucleotide
  Target: ATXN1; (+) strand; PAM type: NNAGAAW; PAM sequence: GGAGAAA
taaaactattcttgatgtaa

SEQ ID NO: 10772 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
catctctggccagggacagc

SEQ ID NO: 10773 - DNA, 20 bp, Artificial Sequence
  Description of Artificial Sequence: Synthetic oligonucleotide
  Target: ATXN1; (+) strand; PAM type: NNAGAAW; PAM sequence: TAAGAAT
aaagaagctgagtctgccat

SEQ ID NO: 10774 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
aaaagttaaaacaaaaaatt

SEQ ID NO: 10775 - DNA, 20 bp, Artificial Sequence
  Description of Artificial Sequence: Synthetic oligonucleotide
  Target: ATXN1; (+) strand; PAM type: NNAGAAW; PAM sequence: GGAGAAA
aagctggagtgggggtggca

SEQ ID NO: 10776 - DNA, 20 bp, Artificial Sequence
  Description of Artificial Sequence: Synthetic oligonucleotide
  Target: ATXN1; (+) strand; PAM type: NNAGAAW; PAM sequence: ATAGAAA
tcactggcaaggctgctgac

SEQ ID NO: 10777 - DNA, 20 bp, Artificial Sequence
  Description of Artificial Sequence: Synthetic oligonucleotide
  Target: ATXN1; (+) strand; PAM type: NNAGAAW; PAM sequence: CAAGAAA
ttgccttccaaggtatgaac

SEQ ID NO: 10778 - DNA, 20 bp, Artificial Sequence
  Description of Artificial Sequence: Synthetic oligonucleotide
  Target: ATXN1; (+) strand; PAM type: NNAGAAW; PAM sequence: CTAGAAA
acacctaaaggtgacattat

SEQ ID NO: 10779 - DNA, 20 bp, Artificial Sequence
  Description of Artificial Sequence: Synthetic oligonucleotide
  Target: ATXN1; (+) strand; PAM type: NNAGAAW; PAM sequence: ACAGAAT
gcctaaaaggaatgctttga

SEQ ID NO: 10780 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
ttgtttggaataaatgaatg

SEQ ID NO: 10781 - DNA, 20 bp, Artificial Sequence
  Description of Artificial Sequence: Synthetic oligonucleotide
  Target: ATXN1; (+) strand; PAM type: NNAGAAW; PAM sequence: CTAGAAA
ctggcaagccaaagccagaa

SEQ ID NO: 10782 - DNA, 20 bp, Artificial Sequence
  Description of Artificial Sequence: Synthetic oligonucleotide
  Target: ATXN1; (+) strand; PAM type: NNAGAAW; PAM sequence: TTAGAAA
tcaagtaattcctttgattc

SEQ ID NO: 10783 - DNA, 20 bp, Artificial Sequence
  Description of Artificial Sequence: Synthetic oligonucleotide
  Target: ATXN1; (+) strand; PAM type: NNAGAAW; PAM sequence: TTAGAAA
aagttatttcataggtaact

SEQ ID NO: 10784 - DNA, 20 bp, Artificial Sequence
  Description of Artificial Sequence: Synthetic oligonucleotide
  Target: ATXN1; (+) strand; PAM type: NNAGAAW; PAM sequence: CTAGAAT
cgtggaacaaattactgggg

SEQ ID NO: 10785 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
gagtgagactttgtctcaaa

SEQ ID NO: 10786 - DNA, 20 bp, Artificial Sequence
  Description of Artificial Sequence: Synthetic oligonucleotide
  Target: ATXN1; (+) strand; PAM type: NNAGAAW; PAM sequence: GTAGAAA
atttgtttcaacaatccaga

SEQ ID NO: 10787 - DNA, 20 bp, Artificial Sequence
  Description of Artificial Sequence: Synthetic oligonucleotide
  Target: ATXN1; (+) strand; PAM type: NNAGAAW; PAM sequence: GCAGAAA
aagcgtaatctattttgcaa

SEQ ID NO: 10788 - DNA, 20 bp, Artificial Sequence
  Description of Artificial Sequence: Synthetic oligonucleotide
  Target: ATXN1; (+) strand; PAM type: NNAGAAW; PAM sequence: TCAGAAT
aatcataaatcttaaagttt

SEQ ID NO: 10789 - DNA, 20 bp, Artificial Sequence
  Description of Artificial Sequence: Synthetic oligonucleotide
  Target: ATXN1; (+) strand; PAM type: NNAGAAW; PAM sequence: TAAGAAA
agaatccatgccaagggact

SEQ ID NO: 10790 - DNA, 20 bp, Artificial Sequence
  Description of Artificial Sequence: Synthetic oligonucleotide
  Target: ATXN1; (+) strand; PAM type: NNAGAAW; PAM sequence: CCAGAAT
atggggtttcaccgtgttgg

SEQ ID NO: 10791 - DNA, 20 bp, Artificial Sequence
  Description of Artificial Sequence: Synthetic oligonucleotide
  Target: ATXN1; (+) strand; PAM type: NNAGAAW; PAM sequence: ATAGAAA
tatgaaggcttgccataaag

SEQ ID NO: 10792 - DNA, 20 bp, Artificial Sequence
  Description of Artificial Sequence: Synthetic oligonucleotide
  Target: ATXN1; (+) strand; PAM type: NNAGAAW; PAM sequence: TGAGAAT
gcctcaactcacccagagac

SEQ ID NO: 10793 - DNA, 20 bp, Artificial Sequence
  Description of Artificial Sequence: Synthetic oligonucleotide
  Target: ATXN1; (+) strand; PAM type: NNAGAAW; PAM sequence: GCAGAAA
actggcagaagtttagagag

SEQ ID NO: 10794 - DNA, 20 bp, Artificial Sequence
  Description of Artificial Sequence: Synthetic oligonucleotide
  Target: ATXN1; (+) strand; PAM type: NNAGAAW; PAM sequence: CAAGAAA
ggcagaaaagagcattacca

SEQ ID NO: 10795 - DNA, 20 bp, Artificial Sequence
  Description of Artificial Sequence: Synthetic oligonucleotide
  Target: ATXN1; (+) strand; PAM type: NNAGAAW; PAM sequence: GGAGAAA
tttaaccaagtctgcacatg

SEQ ID NO: 10796 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
agagaccctgtatctaaaaa

SEQ ID NO: 10797 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
aaaaaaagaaaacaaaatta

SEQ ID NO: 10798 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
aaaacaaaattaaaagaaat

SEQ ID NO: 10799 - DNA, 20 bp, Artificial Sequence
  Description of Artificial Sequence: Synthetic oligonucleotide
  Target: ATXN1; (+) strand; PAM type: NNAGAAW; PAM sequence: AGAGAAA
gtatggtgcatatcataaca

SEQ ID NO: 10800 - DNA, 20 bp, Artificial Sequence
  Description of Artificial Sequence: Synthetic oligonucleotide
  Target: ATXN1; (+) strand; PAM type: NNAGAAW; PAM sequence: TTAGAAA
tgttaaacacactagagaca

SEQ ID NO: 10801 - DNA, 20 bp, Artificial Sequence
  Description of Artificial Sequence: Synthetic oligonucleotide
  Target: ATXN1; (+) strand; PAM type: NNAGAAW; PAM sequence: CTAGAAT
gtaattgcagaacttgggag

SEQ ID NO: 10802 - DNA, 20 bp, Artificial Sequence
  Description of Artificial Sequence: Synthetic oligonucleotide
  Target: ATXN1; (+) strand; PAM type: NNAGAAW; PAM sequence: AGAGAAT
cacaattcaaaattattcaa

SEQ ID NO: 10803 - DNA, 20 bp, Artificial Sequence
  Description of Artificial Sequence: Synthetic oligonucleotide
  Target: ATXN1; (+) strand; PAM type: NNAGAAW; PAM sequence: GGAGAAT
tctcagtaagaagattagca

SEQ ID NO: 10804 - DNA, 20 bp, Artificial Sequence
  Description of Artificial Sequence: Synthetic oligonucleotide
  Target: ATXN1; (+) strand; PAM type: NNAGAAW; PAM sequence: GTAGAAA
aggagaatacatatggtaca

SEQ ID NO: 10805 - DNA, 20 bp, Artificial Sequence
  Description of Artificial Sequence: Synthetic oligonucleotide
  Target: ATXN1; (+) strand; PAM type: NNAGAAW; PAM sequence: ATAGAAA
tatgtggtctggaacaagct

SEQ ID NO: 10806 - DNA, 20 bp, Artificial Sequence
  Description of Artificial Sequence: Synthetic oligonucleotide
  Target: ATXN1; (+) strand; PAM type: NNAGAAW; PAM sequence: AAAGAAT
tctcaaaaacaaacaaacaa

SEQ ID NO: 10807 - DNA, 20 bp, Artificial Sequence
  Description of Artificial Sequence: Synthetic oligonucleotide
  Target: ATXN1; (+) strand; PAM type: NNAGAAW; PAM sequence: TAAGAAA
gtctccttacatagtgctgc

SEQ ID NO: 10808 - DNA, 20 bp, Artificial Sequence
  Description of Artificial Sequence: Synthetic oligonucleotide
  Target: ATXN1; (+) strand; PAM type: NNAGAAW; PAM sequence: TAAGAAT
atccaaagtgcagaggatct

SEQ ID NO: 10809 - DNA, 20 bp, Artificial Sequence
  Description of Artificial Sequence: Synthetic oligonucleotide
  Target: ATXN1; (+) strand; PAM type: NNAGAAW; PAM sequence: GGAGAAT
aggaaacctggacatataag

SEQ ID NO: 10810 - DNA, 20 bp, Artificial Sequence
  Description of Artificial Sequence: Synthetic oligonucleotide
  Target: ATXN1; (+) strand; PAM type: NNAGAAW; PAM sequence: GTAGAAA
ctttacatcaaaatgtgtta

SEQ ID NO: 10811 - DNA, 20 bp, Artificial Sequence
  Description of Artificial Sequence: Synthetic oligonucleotide
  Target: ATXN1; (+) strand; PAM type: NNAGAAW; PAM sequence: TAAGAAA
ttttttatgcccaaaatctc

SEQ ID NO: 10812 - DNA, 20 bp, Artificial Sequence
  Description of Artificial Sequence: Synthetic oligonucleotide
  Target: ATXN1; (+) strand; PAM type: NNAGAAW; PAM sequence: GGAGAAA
atgaaacattaaagtctcat

SEQ ID NO: 10813 - DNA, 20 bp, Artificial Sequence
  Description of Artificial Sequence: Synthetic oligonucleotide
  Target: ATXN1; (+) strand; PAM type: NNAGAAW; PAM sequence: AGAGAAA
gacattttgttagatagacc

SEQ ID NO: 10814 - DNA, 20 bp, Artificial Sequence
  Description of Artificial Sequence: Synthetic oligonucleotide
  Target: ATXN1; (+) strand; PAM type: NNAGAAW; PAM sequence: TCAGAAA
gcatcacataaaaggctgaa

SEQ ID NO: 10815 - DNA, 20 bp, Artificial Sequence
  Description of Artificial Sequence: Synthetic oligonucleotide
  Target: ATXN1; (+) strand; PAM type: NNAGAAW; PAM sequence: GAAGAAA
aaggtggcacagcactgtga

SEQ ID NO: 10816 - DNA, 20 bp, Artificial Sequence
  Description of Artificial Sequence: Synthetic oligonucleotide
  Target: ATXN1; (+) strand; PAM type: NNAGAAW; PAM sequence: TTAGAAA
agattctgacagagcactgg

SEQ ID NO: 10817 - DNA, 20 bp, Artificial Sequence
  Description of Artificial Sequence: Synthetic oligonucleotide
  Target: ATXN1; (+) strand; PAM type: NNAGAAW; PAM sequence: CCAGAAA
tacatagcaggactctgatg

SEQ ID NO: 10818 - DNA, 20 bp, Artificial Sequence
  Description of Artificial Sequence: Synthetic oligonucleotide
  Target: ATXN1; (+) strand; PAM type: NNAGAAW; PAM sequence: TCAGAAT
agctagggtcagggagaagt

SEQ ID NO: 10819 - DNA, 20 bp, Artificial Sequence
  Description of Artificial Sequence: Synthetic oligonucleotide
  Target: ATXN1; (+) strand; PAM type: NNAGAAW; PAM sequence: CAAGAAA
taaggacttggttaacaaaa

SEQ ID NO: 10820 - DNA, 20 bp, Artificial Sequence
  Description of Artificial Sequence: Synthetic oligonucleotide
  Target: ATXN1; (+) strand; PAM type: NNAGAAW; PAM sequence: CAAGAAA
ttaacaaaacaagaaacatc

SEQ ID NO: 10821 - DNA, 20 bp, Artificial Sequence
  Description of Artificial Sequence: Synthetic oligonucleotide
  Target: ATXN1; (+) strand; PAM type: NNAGAAW; PAM sequence: ATAGAAA
aaaaatatttactactggaa

SEQ ID NO: 10822 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
tgacaagtaaatgaaaacaa

SEQ ID NO: 10823 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
ataccacagaagcaattatt

SEQ ID NO: 10824 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
caattattaaagaaataatg

SEQ ID NO: 10825 - DNA, 20 bp, Artificial Sequence
  Description of Artificial Sequence: Synthetic oligonucleotide
  Target: ATXN1; (+) strand; PAM type: NNAGAAW; PAM sequence: GAAGAAA
aaagaaaatttttctaaact

SEQ ID NO: 10826 - DNA, 20 bp, Artificial Sequence
  Description of Artificial Sequence: Synthetic oligonucleotide
  Target: ATXN1; (+) strand; PAM type: NNAGAAW; PAM sequence: GAAGAAA
caaaaactcactctatacaa

SEQ ID NO: 10827 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
ttaatataaattaataaatt

SEQ ID NO: 10828 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
taagcattcagtgaggagga

SEQ ID NO: 10829 - DNA, 20 bp, Artificial Sequence
  Description of Artificial Sequence: Synthetic oligonucleotide
  Target: ATXN1; (+) strand; PAM type: NNAGAAW; PAM sequence: GAAGAAA
aaatcagatttctgacaata

SEQ ID NO: 10830 - DNA, 20 bp, Artificial Sequence
  Description of Artificial Sequence: Synthetic oligonucleotide
  Target: ATXN1; (+) strand; PAM type: NNAGAAW; PAM sequence: ATAGAAT
acaaaaacacaatgtatttc

SEQ ID NO: 10831 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
aaaatttaattttaaacaat

SEQ ID NO: 10832 - DNA, 20 bp, Artificial Sequence
  Description of Artificial Sequence: Synthetic oligonucleotide
  Target: ATXN1; (+) strand; PAM type: NNAGAAW; PAM sequence: AGAGAAA
cagagcaagaccctgtctct

SEQ ID NO: 10833 - DNA, 20 bp, Artificial Sequence
  Description of Artificial Sequence: Synthetic oligonucleotide
  Target: ATXN1; (+) strand; PAM type: NNAGAAW; PAM sequence: TAAGAAA
cagatatagataatccttat

SEQ ID NO: 10834 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
tgtctatatctaactttaaa

SEQ ID NO: 10835 - DNA, 20 bp, Artificial Sequence
  Description of Artificial Sequence: Synthetic oligonucleotide
  Target: ATXN1; (+) strand; PAM type: NNAGAAW; PAM sequence: GGAGAAT
tctaactttaaaaaagaaaa

SEQ ID NO: 10836 - DNA, 20 bp, Artificial Sequence
  Description of Artificial Sequence: Synthetic oligonucleotide
  Target: ATXN1; (+) strand; PAM type: NNAGAAW; PAM sequence: GGAGAAT
aagaaaaggagaattccaaa

SEQ ID NO: 10837 - DNA, 20 bp, Artificial Sequence
  Description of Artificial Sequence: Synthetic oligonucleotide
  Target: ATXN1; (+) strand; PAM type: NNAGAAW; PAM sequence: ACAGAAA
agcttcctcactttgctcat

SEQ ID NO: 10838 - DNA, 20 bp, Artificial Sequence
  Description of Artificial Sequence: Synthetic oligonucleotide
  Target: ATXN1; (+) strand; PAM type: NNAGAAW; PAM sequence: AAAGAAT
atcaaggaatcataaaacca

SEQ ID NO: 10839 - DNA, 20 bp, Artificial Sequence
  Description of Artificial Sequence: Synthetic oligonucleotide
  Target: ATXN1; (+) strand; PAM type: NNAGAAW; PAM sequence: TTAGAAT
gaataaaaagatgacaaaaa

SEQ ID NO: 10840 - DNA, 20 bp, Artificial Sequence
  Description of Artificial Sequence: Synthetic oligonucleotide
  Target: ATXN1; (+) strand; PAM type: NNAGAAW; PAM sequence: AAAGAAT
ttaattcgttttgaaaagca

SEQ ID NO: 10841 - DNA, 20 bp, Artificial Sequence
  Description of Artificial Sequence: Synthetic oligonucleotide
  Target: ATXN1; (+) strand; PAM type: NNAGAAW; PAM sequence: TAAGAAT
tctcagatggtgtcataaat

SEQ ID NO: 10842 - DNA, 20 bp, Artificial Sequence
  Description of Artificial Sequence: Synthetic oligonucleotide
  Target: ATXN1; (+) strand; PAM type: NNAGAAW; PAM sequence: CAAGAAA
gaatgcccttagactatctg

SEQ ID NO: 10843 - DNA, 20 bp, Artificial Sequence
  Description of Artificial Sequence: Synthetic oligonucleotide
  Target: ATXN1; (+) strand; PAM type: NNAGAAW; PAM sequence: AAAGAAT
actgacaagagatacattcc

SEQ ID NO: 10844 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
agtagagcatggaaatatat

SEQ ID NO: 10845 - DNA, 20 bp, Artificial Sequence
  Description of Artificial Sequence: Synthetic oligonucleotide
  Target: ATXN1; (+) strand; PAM type: NNAGAAW; PAM sequence: AAAGAAT
aaattaacttgtacattcaa

SEQ ID NO: 10846 - DNA, 20 bp, Artificial Sequence
  Description of Artificial Sequence: Synthetic oligonucleotide
  Target: ATXN1; (+) strand; PAM type: NNAGAAW; PAM sequence: TGAGAAA
gactgagacaataaagataa

SEQ ID NO: 10847 - DNA, 20 bp, Artificial Sequence
  Description of Artificial Sequence: Synthetic oligonucleotide
  Target: ATXN1; (+) strand; PAM type: NNAGAAW; PAM sequence: TAAGAAA
atctttagtatttttatcat

SEQ ID NO: 10848 - DNA, 20 bp, Artificial Sequence
  Description of Artificial Sequence: Synthetic oligonucleotide
  Target: ATXN1; (+) strand; PAM type: NNAGAAW; PAM sequence: TTAGAAA
taaaagatcaactcaataaa

SEQ ID NO: 10849 - DNA, 20 bp, Artificial Sequence
  Description of Artificial Sequence: Synthetic oligonucleotide
  Target: ATXN1; (+) strand; PAM type: NNAGAAW; PAM sequence: GGAGAAT
ctacttgggaggctgaggca

SEQ ID NO: 10850 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
tctgtcttaaaaaaaaaaaa

SEQ ID NO: 10851 - DNA, 20 bp, Artificial Sequence
  Description of Artificial Sequence: Synthetic oligonucleotide
  Target: ATXN1; (+) strand; PAM type: NNAGAAW; PAM sequence: TAAGAAA
aaaagaaagggaaataaacc

SEQ ID NO: 10852 - DNA, 20 bp, Artificial Sequence
  Description of Artificial Sequence: Synthetic oligonucleotide
  Target: ATXN1; (+) strand; PAM type: NNAGAAW; PAM sequence: GGAGAAT
ccactcgggaggctgaggca

SEQ ID NO: 10853 - DNA, 20 bp, Artificial Sequence
  Description of Artificial Sequence: Synthetic oligonucleotide
  Target: ATXN1; (+) strand; PAM type: NNAGAAW; PAM sequence: TGAGAAT
tggaataaattcacaaatat

SEQ ID NO: 10854 - DNA, 20 bp, Artificial Sequence
  Description of Artificial Sequence: Synthetic oligonucleotide
  Target: ATXN1; (+) strand; PAM type: NNAGAAW; PAM sequence: ATAGAAA
gtgttaacaaaattttgaat

SEQ ID NO: 10855 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
atctctacaaaaaagttaaa

SEQ ID NO: 10856 - DNA, 20 bp, Artificial Sequence
  Description of Artificial Sequence: Synthetic oligonucleotide
  Target: ATXN1; (+) strand; PAM type: NNAGAAW; PAM sequence: ATAGAAA
gataaaataaaataatataa

SEQ ID NO: 10857 - DNA, 20 bp, Artificial Sequence
  Description of Artificial Sequence: Synthetic oligonucleotide
  Target: ATXN1; (+) strand; PAM type: NNAGAAW; PAM sequence: CTAGAAA
aaatagaaatgacaaatttt

SEQ ID NO: 10858 - DNA, 20 bp, Artificial Sequence
  Description of Artificial Sequence: Synthetic oligonucleotide
  Target: ATXN1; (+) strand; PAM type: NNAGAAW; PAM sequence: TAAGAAT
gatggtacatgactctttct

SEQ ID NO: 10859 - DNA, 20 bp, Artificial Sequence
  Description of Artificial Sequence: Synthetic oligonucleotide
  Target: ATXN1; (+) strand; PAM type: NNAGAAW; PAM sequence: TTAGAAT
gtgggaaagagggttgaaaa

SEQ ID NO: 10860 - DNA, 20 bp, Artificial Sequence
  Description of Artificial Sequence: Synthetic oligonucleotide
  Target: ATXN1; (+) strand; PAM type: NNAGAAW; PAM sequence: ATAGAAT
aaagagggttgaaaattaga

SEQ ID NO: 10861 - DNA, 20 bp, Artificial Sequence
  Description of Artificial Sequence: Synthetic oligonucleotide
  Target: ATXN1; (+) strand; PAM type: NNAGAAW; PAM sequence: GGAGAAT
atacttgggagtctgaggcc

SEQ ID NO: 10862 - DNA, 20 bp, Artificial Sequence
  Description of Artificial Sequence: Synthetic oligonucleotide
  Target: ATXN1; (+) strand; PAM type: NNAGAAW; PAM sequence: CTAGAAA
aaatacaaatgacaaatttt

SEQ ID NO: 10863 - DNA, 20 bp, Artificial Sequence
  Description of Artificial Sequence: Synthetic oligonucleotide
  Target: ATXN1; (+) strand; PAM type: NNAGAAW; PAM sequence: TAAGAAT
gatggtacatgactctttct

SEQ ID NO: 10864 - DNA, 20 bp, Artificial Sequence
  Description of Artificial Sequence: Synthetic oligonucleotide
  Target: ATXN1; (+) strand; PAM type: NNAGAAW; PAM sequence: TTAGAAT
gtgggaaagagggttgaaaa

SEQ ID NO: 10865 - DNA, 20 bp, Artificial Sequence
  Description of Artificial Sequence: Synthetic oligonucleotide
  Target: ATXN1; (+) strand; PAM type: NNAGAAW; PAM sequence: ATAGAAT
aaagagggttgaaaattaga

SEQ ID NO: 10866 - DNA, 20 bp, Artificial Sequence
  Description of Artificial Sequence: Synthetic oligonucleotide
  Target: ATXN1; (+) strand; PAM type: NNAGAAW; PAM sequence: GGAGAAT
atatttgggagtctgtggcc

SEQ ID NO: 10867 - DNA, 20 bp, Artificial Sequence
  Description of Artificial Sequence: Synthetic oligonucleotide
  Target: ATXN1; (+) strand; PAM type: NNAGAAW; PAM sequence: CAAGAAA
gacagagcaagactctgtct

SEQ ID NO: 10868 - DNA, 20 bp, Artificial Sequence
  Description of Artificial Sequence: Synthetic oligonucleotide
  Target: ATXN1; (+) strand; PAM type: NNAGAAW; PAM sequence: GAAGAAA
cataccatcaggatgctgta

SEQ ID NO: 10869 - DNA, 20 bp, Artificial Sequence
  Description of Artificial Sequence: Synthetic oligonucleotide
  Target: ATXN1; (+) strand; PAM type: NNAGAAW; PAM sequence: TTAGAAT
ttggaaatgttattgtctac

SEQ ID NO: 10870 - DNA, 20 bp, Artificial Sequence
  Description of Artificial Sequence: Synthetic oligonucleotide
  Target: ATXN1; (+) strand; PAM type: NNAGAAW; PAM sequence: GAAGAAT
atacttgggaggctgagaca

SEQ ID NO: 10871 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
accaacactgtaaaatctct

SEQ ID NO: 10872 - DNA, 20 bp, Artificial Sequence
  Description of Artificial Sequence: Synthetic oligonucleotide
  Target: ATXN1; (+) strand; PAM type: NNAGAAW; PAM sequence: ACAGAAA
actgctcagattctataaaa

SEQ ID NO: 10873 - DNA, 20 bp, Artificial Sequence
  Description of Artificial Sequence: Synthetic oligonucleotide
  Target: ATXN1; (+) strand; PAM type: NNAGAAW; PAM sequence: AAAGAAT
aattagtctatgtacacatg

SEQ ID NO: 10874 - DNA, 20 bp, Artificial Sequence
  Description of Artificial Sequence: Synthetic oligonucleotide
  Target: ATXN1; (+) strand; PAM type: NNAGAAW; PAM sequence: AAAGAAT
atgctgaaaaaaaatatatg

SEQ ID NO: 10875 - DNA, 20 bp, Artificial Sequence
  Description of Artificial Sequence: Synthetic oligonucleotide
  Target: ATXN1; (+) strand; PAM type: NNAGAAW; PAM sequence: ATAGAAT
tattaaaatcttctaaactc

SEQ ID NO: 10876 - DNA, 20 bp, Artificial Sequence
  Description of Artificial Sequence: Synthetic oligonucleotide
  Target: ATXN1; (+) strand; PAM type: NNAGAAW; PAM sequence: ATAGAAA
ctcatagaatcaaaagcaaa

SEQ ID NO: 10877 - DNA, 20 bp, Artificial Sequence
  Description of Artificial Sequence: Synthetic oligonucleotide
  Target: ATXN1; (+) strand; PAM type: NNAGAAW; PAM sequence: ACAGAAT
aaaaaacaaatatcaagata

SEQ ID NO: 10878 - DNA, 20 bp, Artificial Sequence
  Description of Artificial Sequence: Synthetic oligonucleotide
  Target: ATXN1; (+) strand; PAM type: NNAGAAW; PAM sequence: TTAGAAA
aagataacagaatataaggc

SEQ ID NO: 10879 - DNA, 20 bp, Artificial Sequence
  Description of Artificial Sequence: Synthetic oligonucleotide
  Target: ATXN1; (+) strand; PAM type: NNAGAAW; PAM sequence: GGAGAAT
ctactcgggaggctgaggca

SEQ ID NO: 10880 - DNA, 20 bp, Artificial Sequence
  Description of Artificial Sequence: Synthetic oligonucleotide
  Target: ATXN1; (+) strand; PAM type: NNAGAAW; PAM sequence: AGAGAAA
cactcctgcctgggcaatag

SEQ ID NO: 10881 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
ctgtctcaaaaaaaaaaaaa

SEQ ID NO: 10882 - DNA, 20 bp, Artificial Sequence
  Description of Artificial Sequence: Synthetic oligonucleotide
  Target: ATXN1; (+) strand; PAM type: NNAGAAW; PAM sequence: AAAGAAT
aaaaaaattgcagccataaa

SEQ ID NO: 10883 - DNA, 20 bp, Artificial Sequence
  Description of Artificial Sequence: Synthetic oligonucleotide
  Target: ATXN1; (+) strand; PAM type: NNAGAAW; PAM sequence: ACAGAAA
ctcagcaaactaacccagga

SEQ ID NO: 10884 - DNA, 20 bp, Artificial Sequence
  Description of Artificial Sequence: Synthetic oligonucleotide
  Target: ATXN1; (+) strand; PAM type: NNAGAAW; PAM sequence: AAAGAAT
aaagtaaaacaaacaaaaca

SEQ ID NO: 10885 - DNA, 20 bp, Artificial Sequence
  Description of Artificial Sequence: Synthetic oligonucleotide
  Target: ATXN1; (+) strand; PAM type: NNAGAAW; PAM sequence: CAAGAAA
ccccatctctactaaaaata

SEQ ID NO: 10886 - DNA, 20 bp, Artificial Sequence
  Description of Artificial Sequence: Synthetic oligonucleotide
  Target: ATXN1; (+) strand; PAM type: NNAGAAW; PAM sequence: GGAGAAT
gtagtctggaggctgaagca

SEQ ID NO: 10887 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
acacgaatggccaatttaaa

SEQ ID NO: 10888 - DNA, 20 bp, Artificial Sequence
  Description of Artificial Sequence: Synthetic oligonucleotide
  Target: ATXN1; (+) strand; PAM type: NNAGAAW; PAM sequence: AGAGAAA
aaaaaagaaatgtaaaaaac

SEQ ID NO: 10889 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
cgtctctaagggaaaaaaaa

SEQ ID NO: 10890 - DNA, 20 bp, Artificial Sequence
  Description of Artificial Sequence: Synthetic oligonucleotide
  Target: ATXN1; (+) strand; PAM type: NNAGAAW; PAM sequence: GGAGAAA
tcaaccaaacttttacagta

SEQ ID NO: 10891 - DNA, 20 bp, Artificial Sequence
  Description of Artificial Sequence: Synthetic oligonucleotide
  Target: ATXN1; (+) strand; PAM type: NNAGAAW; PAM sequence: ACAGAAT
acacacacacacacacacac

SEQ ID NO: 10892 - DNA, 20 bp, Artificial Sequence
  Description of Artificial Sequence: Synthetic oligonucleotide
  Target: ATXN1; (+) strand; PAM type: NNAGAAW; PAM sequence: TAAGAAA
attctcatatcctaggatcc

SEQ ID NO: 10893 - DNA, 20 bp, Artificial Sequence
  Description of Artificial Sequence: Synthetic oligonucleotide
  Target: ATXN1; (+) strand; PAM type: NNAGAAW; PAM sequence: TAAGAAA
tataaagaagctagatgatc

SEQ ID NO: 10894 - DNA, 20 bp, Artificial Sequence
  Description of Artificial Sequence: Synthetic oligonucleotide
  Target: ATXN1; (+) strand; PAM type: NNAGAAW; PAM sequence: CCAGAAA
actgggtttcagaaggagcc

SEQ ID NO: 10895 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
tctacatcccgaaacaaatg

SEQ ID NO: 10896 - DNA, 20 bp, Artificial Sequence
  Description of Artificial Sequence: Synthetic oligonucleotide
  Target: ATXN1; (+) strand; PAM type: NNAGAAW; PAM sequence: GTAGAAA
atttcagtaaatctagcagt

SEQ ID NO: 10897 - DNA, 20 bp, Artificial Sequence
  Description of Artificial Sequence: Synthetic oligonucleotide
  Target: ATXN1; (+) strand; PAM type: NNAGAAW; PAM sequence: ACAGAAA
aaagtctttgtatatgcaaa

SEQ ID NO: 10898 - DNA, 20 bp, Artificial Sequence
  Description of Artificial Sequence: Synthetic oligonucleotide
  Target: ATXN1; (+) strand; PAM type: NNAGAAW; PAM sequence: AGAGAAT
tttatcaaaaaggtgcatac

SEQ ID NO: 10899 - DNA, 20 bp, Artificial Sequence
  Description of Artificial Sequence: Synthetic oligonucleotide
  Target: ATXN1; (+) strand; PAM type: NNAGAAW; PAM sequence: GGAGAAT
aagaccaccctggccaacat

SEQ ID NO: 10900 - DNA, 20 bp, Artificial Sequence
  Description of Artificial Sequence: Synthetic oligonucleotide
  Target: ATXN1; (+) strand; PAM type: NNAGAAW; PAM sequence: AAAGAAT
ccatctcaaaaacaaaaaac

SEQ ID NO: 10901 - DNA, 20 bp, Artificial Sequence
  Description of Artificial Sequence: Synthetic oligonucleotide
  Target: ATXN1; (+) strand; PAM type: NNAGAAW; PAM sequence: GAAGAAA
atgagttgatagcccgaaaa

SEQ ID NO: 10902 - DNA, 20 bp, Artificial Sequence
  Description of Artificial Sequence: Synthetic oligonucleotide
  Target: ATXN1; (+) strand; PAM type: NNAGAAW; PAM sequence: GCAGAAA
gaactagcagcagatgatag

SEQ ID NO: 10903 - DNA, 20 bp, Artificial Sequence
  Description of Artificial Sequence: Synthetic oligonucleotide
  Target: ATXN1; (+) strand; PAM type: NNAGAAW; PAM sequence: GTAGAAT
gccaccatttttaaaaatct

SEQ ID NO: 10904 - DNA, 20 bp, Artificial Sequence
  Description of Artificial Sequence: Synthetic oligonucleotide
  Target: ATXN1; (+) strand; PAM type: NNAGAAW; PAM sequence: TGAGAAA
actctcaaattttagtgaaa

SEQ ID NO: 10905 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
aggtacagcccacattaagt

SEQ ID NO: 10906 - DNA, 20 bp, Artificial Sequence
  Description of Artificial Sequence: Synthetic oligonucleotide
  Target: ATXN1; (+) strand; PAM type: NNAGAAW; PAM sequence: TTAGAAT
tcgaacacaggaagtactaa

SEQ ID NO: 10907 - DNA, 20 bp, Artificial Sequence
  Description of Artificial Sequence: Synthetic oligonucleotide
  Target: ATXN1; (+) strand; PAM type: NNAGAAW; PAM sequence: CAAGAAA
tccttcaatctaacatcatt

SEQ ID NO: 10908 - DNA, 20 bp, Artificial Sequence
  Description of Artificial Sequence: Synthetic oligonucleotide
  Target: ATXN1; (+) strand; PAM type: NNAGAAW; PAM sequence: TTAGAAA
agacttactatgcagggtac

SEQ ID NO: 10909 - DNA, 20 bp, Artificial Sequence
  Description of Artificial Sequence: Synthetic oligonucleotide
  Target: ATXN1; (+) strand; PAM type: NNAGAAW; PAM sequence: GCAGAAA
tcatatgagcatttaaaatg

SEQ ID NO: 10910 - DNA, 20 bp, Artificial Sequence
  Description of Artificial Sequence: Synthetic oligonucleotide
  Target: ATXN1; (+) strand; PAM type: NNAGAAW; PAM sequence: AGAGAAA
tccacatgtactctcagaac

SEQ ID NO: 10911 - DNA, 20 bp, Artificial Sequence
  Description of Artificial Sequence: Synthetic oligonucleotide
  Target: ATXN1; (+) strand; PAM type: NNAGAAW; PAM sequence: GAAGAAA
ctttgaacaaatccagactt

SEQ ID NO: 10912 - DNA, 20 bp, Artificial Sequence
  Description of Artificial Sequence: Synthetic oligonucleotide
  Target: ATXN1; (+) strand; PAM type: NNAGAAW; PAM sequence: TAAGAAT
tcaattaatctgaaccaaac

SEQ ID NO: 10913 - DNA, 20 bp, Artificial Sequence
  Description of Artificial Sequence: Synthetic oligonucleotide
  Target: ATXN1; (+) strand; PAM type: NNAGAAW; PAM sequence: CCAGAAA
gcagtttgtgaattatatcc

SEQ ID NO: 10914 - DNA, 20 bp, Artificial Sequence
  Description of Artificial Sequence: Synthetic oligonucleotide
  Target: ATXN1; (+) strand; PAM type: NNAGAAW; PAM sequence: ATAGAAA
tatctagagtagacattgtc

SEQ ID NO: 10915 - DNA, 20 bp, Artificial Sequence
  Description of Artificial Sequence: Synthetic oligonucleotide
  Target: ATXN1; (+) strand; PAM type: NNAGAAW; PAM sequence: GTAGAAT
gaagagttgctatttaatgg

SEQ ID NO: 10916 - DNA, 20 bp, Artificial Sequence
  Description of Artificial Sequence: Synthetic oligonucleotide
  Target: ATXN1; (+) strand; PAM type: NNAGAAW; PAM sequence: ACAGAAA
accctgtctctactaaaaat

SEQ ID NO: 10917 - DNA, 20 bp, Artificial Sequence
  Description of Artificial Sequence: Synthetic oligonucleotide
  Target: ATXN1; (+) strand; PAM type: NNAGAAW; PAM sequence: CAAGAAA
atgagagcgagactttgtct

SEQ ID NO: 10918 - DNA, 20 bp, Artificial Sequence
  Description of Artificial Sequence: Synthetic oligonucleotide
  Target: ATXN1; (+) strand; PAM type: NNAGAAW; PAM sequence: TGAGAAT
ataacagcacatactgtggg

SEQ ID NO: 10919 - DNA, 20 bp, Artificial Sequence
  Description of Artificial Sequence: Synthetic oligonucleotide
  Target: ATXN1; (+) strand; PAM type: NNAGAAW; PAM sequence: TCAGAAA
ttaactgaatatgccacaat

SEQ ID NO: 10920 - DNA, 20 bp, Artificial Sequence
  Description of Artificial Sequence: Synthetic oligonucleotide
  Target: ATXN1; (+) strand; PAM type: NNAGAAW; PAM sequence: GCAGAAT
ctttgtttctgccactgatc

SEQ ID NO: 10921 - DNA, 20 bp, Artificial Sequence
  Description of Artificial Sequence: Synthetic oligonucleotide
  Target: ATXN1; (+) strand; PAM type: NNAGAAW; PAM sequence: CTAGAAA
ctttgatgccatccttatgc

SEQ ID NO: 10922 - DNA, 20 bp, Artificial Sequence
  Description of Artificial Sequence: Synthetic oligonucleotide
  Target: ATXN1; (+) strand; PAM type: NNAGAAW; PAM sequence: TAAGAAT
gtatatgatttttccatcat

SEQ ID NO: 10923 - DNA, 20 bp, Artificial Sequence
  Description of Artificial Sequence: Synthetic oligonucleotide
  Target: ATXN1; (+) strand; PAM type: NNAGAAW; PAM sequence: AGAGAAA
gactaagatgtggtcccagc

SEQ ID NO: 10924 - DNA, 20 bp, Artificial Sequence
  Description of Artificial Sequence: Synthetic oligonucleotide
  Target: ATXN1; (+) strand; PAM type: NNAGAAW; PAM sequence: TCAGAAT
accatgttatcaaggagtca

SEQ ID NO: 10925 - DNA, 20 bp, Artificial Sequence
  Description of Artificial Sequence: Synthetic oligonucleotide
  Target: ATXN1; (+) strand; PAM type: NNAGAAW; PAM sequence: TGAGAAT
atgaaaaaacatatttggaa

SEQ ID NO: 10926 - DNA, 20 bp, Artificial Sequence
  Description of Artificial Sequence: Synthetic oligonucleotide
  Target: ATXN1; (+) strand; PAM type: NNAGAAW; PAM sequence: ATAGAAA
acgagtgattgtactaaggt

SEQ ID NO: 10927 - DNA, 20 bp, Artificial Sequence
  Description of Artificial Sequence: Synthetic oligonucleotide
  Target: ATXN1; (+) strand; PAM type: NNAGAAW; PAM sequence: CTAGAAT
aattaaaaacatttatggca

SEQ ID NO: 10928 - DNA, 20 bp, Artificial Sequence
  Description of Artificial Sequence: Synthetic oligonucleotide
  Target: ATXN1; (+) strand; PAM type: NNAGAAW; PAM sequence: TCAGAAT
aagccctaacttccagtttc

SEQ ID NO: 10929 - DNA, 20 bp, Artificial Sequence
  Description of Artificial Sequence: Synthetic oligonucleotide
  Target: ATXN1; (+) strand; PAM type: NNAGAAW; PAM sequence: CTAGAAT
tcatttcaaacttactgtct

SEQ ID NO: 10930 - DNA, 20 bp, Artificial Sequence
  Description of Artificial Sequence: Synthetic oligonucleotide
  Target: ATXN1; (+) strand; PAM type: NNAGAAW; PAM sequence: TAAGAAA
acttactgtctctagaatca

SEQ ID NO: 10931 - DNA, 20 bp, Artificial Sequence
  Description of Artificial Sequence: Synthetic oligonucleotide
  Target: ATXN1; (+) strand; PAM type: NNAGAAW; PAM sequence: TTAGAAA
tggccctataaatggctatt

SEQ ID NO: 10932 - DNA, 20 bp, Artificial Sequence
  Description of Artificial Sequence: Synthetic oligonucleotide
  Target: ATXN1; (+) strand; PAM type: NNAGAAW; PAM sequence: GGAGAAT
ctactcgggaggctgaggca

SEQ ID NO: 10933 - DNA, 20 bp, Artificial Sequence
  Description of Artificial Sequence: Synthetic oligonucleotide
  Target: ATXN1; (+) strand; PAM type: NNAGAAW; PAM sequence: GAAGAAA
ataagtcgaagcaacatgaa

SEQ ID NO: 10934 - DNA, 20 bp, Artificial Sequence
  Description of Artificial Sequence: Synthetic oligonucleotide
  Target: ATXN1; (+) strand; PAM type: NNAGAAW; PAM sequence: GAAGAAT
agaagaaacaaggacaaggt

SEQ ID NO: 10935 - DNA, 20 bp, Artificial Sequence
  Description of Artificial Sequence: Synthetic oligonucleotide
  Target: ATXN1; (+) strand; PAM type: NNAGAAW; PAM sequence: CCAGAAA
ataattttcatctattccaa

SEQ ID NO: 10936 - DNA, 20 bp, Artificial Sequence
  Description of Artificial Sequence: Synthetic oligonucleotide
  Target: ATXN1; (+) strand; PAM type: NNAGAAW; PAM sequence: ACAGAAA
gatgttaatgagccctgcaa

SEQ ID NO: 10937 - DNA, 20 bp, Artificial Sequence
  Description of Artificial Sequence: Synthetic oligonucleotide
  Target: ATXN1; (+) strand; PAM type: NNAGAAW; PAM sequence: TTAGAAA
tgcaatattagcactaatga

SEQ ID NO: 10938 - DNA, 20 bp, Artificial Sequence
  Description of Artificial Sequence: Synthetic oligonucleotide
  Target: ATXN1; (+) strand; PAM type: NNAGAAW; PAM sequence: AAAGAAT
gagttacttttactggcaat

SEQ ID NO: 10939 - DNA, 20 bp, Artificial Sequence
  Description of Artificial Sequence: Synthetic oligonucleotide
  Target: ATXN1; (+) strand; PAM type: NNAGAAW; PAM sequence: GTAGAAT
tgcatgtgtctaaatttatg

SEQ ID NO: 10940 - DNA, 20 bp, Artificial Sequence
  Description of Artificial Sequence: Synthetic oligonucleotide
  Target: ATXN1; (+) strand; PAM type: NNAGAAW; PAM sequence: GCAGAAT
agttctgcttttagctcttt

SEQ ID NO: 10941 - DNA, 20 bp, Artificial Sequence
  Description of Artificial Sequence: Synthetic oligonucleotide
  Target: ATXN1; (+) strand; PAM type: NNAGAAW; PAM sequence: GGAGAAT
ctacttgggaggctgaggca

SEQ ID NO: 10942 - DNA, 20 bp, Artificial Sequence
  Description of Artificial Sequence: Synthetic oligonucleotide
  Target: ATXN1; (+) strand; PAM type: NNAGAAW; PAM sequence: GCAGAAT
tataaatcatgtctgtacgg

SEQ ID NO: 10943 - DNA, 20 bp, Artificial Sequence
  Description of Artificial Sequence: Synthetic oligonucleotide
  Target: ATXN1; (+) strand; PAM type: NNAGAAW; PAM sequence: CTAGAAT
gtacgggcagaatcacaaag

SEQ ID NO: 10944 - DNA, 20 bp, Artificial Sequence
  Description of Artificial Sequence: Synthetic oligonucleotide
  Target: ATXN1; (+) strand; PAM type: NNAGAAW; PAM sequence: TGAGAAA
ctcaactgtgaatcggcatc

SEQ ID NO: 10945 - DNA, 20 bp, Artificial Sequence
  Description of Artificial Sequence: Synthetic oligonucleotide
  Target: ATXN1; (+) strand; PAM type: NNAGAAW; PAM sequence: TTAGAAT
aactcatgcaatcataaaca

SEQ ID NO: 10946 - DNA, 20 bp, Artificial Sequence
  Description of Artificial Sequence: Synthetic oligonucleotide
  Target: ATXN1; (+) strand; PAM type: NNAGAAW; PAM sequence: AGAGAAT
taaaaggaatctgttcacag

SEQ ID NO: 10947 - DNA, 20 bp, Artificial Sequence
  Description of Artificial Sequence: Synthetic oligonucleotide
  Target: ATXN1; (+) strand; PAM type: NNAGAAW; PAM sequence: ATAGAAA
actcagaagtattgctatta

SEQ ID NO: 10948 - DNA, 20 bp, Artificial Sequence
  Description of Artificial Sequence: Synthetic oligonucleotide
  Target: ATXN1; (+) strand; PAM type: NNAGAAW; PAM sequence: CCAGAAA
gtaaatggctcatgtgtctg

SEQ ID NO: 10949 - DNA, 20 bp, Artificial Sequence
  Description of Artificial Sequence: Synthetic oligonucleotide
  Target: ATXN1; (+) strand; PAM type: NNAGAAW; PAM sequence: TGAGAAA
tattattcatgttttaaagc

SEQ ID NO: 10950 - DNA, 20 bp, Artificial Sequence
  Description of Artificial Sequence: Synthetic oligonucleotide
  Target: ATXN1; (+) strand; PAM type: NNAGAAW; PAM sequence: GTAGAAA
ggtatgcagtgatcttataa

SEQ ID NO: 10951 - DNA, 20 bp, Artificial Sequence
  Description of Artificial Sequence: Synthetic oligonucleotide
  Target: ATXN1; (+) strand; PAM type: NNAGAAW; PAM sequence: CTAGAAA
tcttataagtagaaatgggt

SEQ ID NO: 10952 - DNA, 20 bp, Artificial Sequence
  Description of Artificial Sequence: Synthetic oligonucleotide
  Target: ATXN1; (+) strand; PAM type: NNAGAAW; PAM sequence: TTAGAAT
atctcagccacaaatcttca

SEQ ID NO: 10953 - DNA, 20 bp, Artificial Sequence
  Description of Artificial Sequence: Synthetic oligonucleotide
  Target: ATXN1; (+) strand; PAM type: NNAGAAW; PAM sequence: GAAGAAT
atttcctctgtatgtttttt

SEQ ID NO: 10954 - DNA, 20 bp, Artificial Sequence
  Description of Artificial Sequence: Synthetic oligonucleotide
  Target: ATXN1; (+) strand; PAM type: NNAGAAW; PAM sequence: TCAGAAA
ggaaagaggaagagaagagc

SEQ ID NO: 10955 - DNA, 20 bp, Artificial Sequence
  Description of Artificial Sequence: Synthetic oligonucleotide
  Target: ATXN1; (+) strand; PAM type: NNAGAAW; PAM sequence: TTAGAAT
catgtgatgttagagctggt

SEQ ID NO: 10956 - DNA, 20 bp, Artificial Sequence
  Description of Artificial Sequence: Synthetic oligonucleotide
  Target: ATXN1; (+) strand; PAM type: NNAGAAW; PAM sequence: CCAGAAT
gcaagattcttgtcaatgac

SEQ ID NO: 10957 - DNA, 20 bp, Artificial Sequence
  Description of Artificial Sequence: Synthetic oligonucleotide
  Target: ATXN1; (+) strand; PAM type: NNAGAAW; PAM sequence: TAAGAAA
ccaaaagccaggaggggggt

SEQ ID NO: 10958 - DNA, 20 bp, Artificial Sequence
  Description of Artificial Sequence: Synthetic oligonucleotide
  Target: ATXN1; (+) strand; PAM type: NNAGAAW; PAM sequence: CAAGAAT
gaaaaaaaaaatgcaaaaaa

SEQ ID NO: 10959 - DNA, 20 bp, Artificial Sequence
  Description of Artificial Sequence: Synthetic oligonucleotide
  Target: ATXN1; (+) strand; PAM type: NNAGAAW; PAM sequence: CTAGAAA
aacatgaacctctacagaac

SEQ ID NO: 10960 - DNA, 20 bp, Artificial Sequence
  Description of Artificial Sequence: Synthetic oligonucleotide
  Target: ATXN1; (+) strand; PAM type: NNAGAAW; PAM sequence: GGAGAAT
ctacttgggaggctgagaca

SEQ ID NO: 10961 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
ctccgcctcaaaaaaaaaaa

SEQ ID NO: 10962 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
cctcaaaaaaaaaaaaaaga

SEQ ID NO: 10963 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
aaaaaaaaaaaaaagaaaag

SEQ ID NO: 10964 - DNA, 20 bp, Artificial Sequence
  Description of Artificial Sequence: Synthetic oligonucleotide
  Target: ATXN1; (+) strand; PAM type: NNAGAAW; PAM sequence: TGAGAAA
ttttgaaagtggaaaataga

SEQ ID NO: 10965 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
atatatggtcattttgttat

SEQ ID NO: 10966 - DNA, 20 bp, Artificial Sequence
  Description of Artificial Sequence: Synthetic oligonucleotide
  Target: ATXN1; (+) strand; PAM type: NNAGAAW; PAM sequence: CTAGAAA
caagtcacccattgacaagc

SEQ ID NO: 10967 - DNA, 20 bp, Artificial Sequence
  Description of Artificial Sequence: Synthetic oligonucleotide
  Target: ATXN1; (+) strand; PAM type: NNAGAAW; PAM sequence: ATAGAAA
ccaaggctccgagctaatta

SEQ ID NO: 10968 - DNA, 20 bp, Artificial Sequence
  Description of Artificial Sequence: Synthetic oligonucleotide
  Target: ATXN1; (+) strand; PAM type: NNAGAAW; PAM sequence: TTAGAAA
tgcagactaacacatttctg

SEQ ID NO: 10969 - DNA, 20 bp, Artificial Sequence
  Description of Artificial Sequence: Synthetic oligonucleotide
  Target: ATXN1; (+) strand; PAM type: NNAGAAW; PAM sequence: TTAGAAA
acaatcactactctttcttc

SEQ ID NO: 10970 - DNA, 20 bp, Artificial Sequence
  Description of Artificial Sequence: Synthetic oligonucleotide
  Target: ATXN1; (+) strand; PAM type: NNAGAAW; PAM sequence: TGAGAAT
ctacctcatagggttgtttc

SEQ ID NO: 10971 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
tttagattttcttctccaaa

SEQ ID NO: 10972 - DNA, 20 bp, Artificial Sequence
  Description of Artificial Sequence: Synthetic oligonucleotide
  Target: ATXN1; (+) strand; PAM type: NNAGAAW; PAM sequence: TGAGAAT
tgtaggttgcaccctcttta

SEQ ID NO: 10973 - DNA, 20 bp, Artificial Sequence
  Description of Artificial Sequence: Synthetic oligonucleotide
  Target: ATXN1; (+) strand; PAM type: NNAGAAW; PAM sequence: CCAGAAA
gagctcttcttacacactgc

SEQ ID NO: 10974 - DNA, 20 bp, Artificial Sequence
  Description of Artificial Sequence: Synthetic oligonucleotide
  Target: ATXN1; (+) strand; PAM type: NNAGAAW; PAM sequence: AGAGAAA
ataaatatgtctgaatctgc

SEQ ID NO: 10975 - DNA, 20 bp, Artificial Sequence
  Description of Artificial Sequence: Synthetic oligonucleotide
  Target: ATXN1; (+) strand; PAM type: NNAGAAW; PAM sequence: GAAGAAA
aaaggaactctttgaaaaag

SEQ ID NO: 10976 - DNA, 20 bp, Artificial Sequence
  Description of Artificial Sequence: Synthetic oligonucleotide
  Target: ATXN1; (+) strand; PAM type: NNAGAAW; PAM sequence: GGAGAAA
ctttgaaaaaggaagaaagt

SEQ ID NO: 10977 - DNA, 20 bp, Artificial Sequence
  Description of Artificial Sequence: Synthetic oligonucleotide
  Target: ATXN1; (+) strand; PAM type: NNAGAAW; PAM sequence: CTAGAAA
gattcctcaaggatctagaa

SEQ ID NO: 10978 - DNA, 20 bp, Artificial Sequence
  Description of Artificial Sequence: Synthetic oligonucleotide
  Target: ATXN1; (+) strand; PAM type: NNAGAAW; PAM sequence: TAAGAAA
ccatcaatgatagactggat

SEQ ID NO: 10979 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
ataaataaaataaaataaaa

SEQ ID NO: 10980 - DNA, 20 bp, Artificial Sequence
  Description of Artificial Sequence: Synthetic oligonucleotide
  Target: ATXN1; (+) strand; PAM type: NNAGAAW; PAM sequence: GAAGAAA
taaaataaaaaaagaaaaag

SEQ ID NO: 10981 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
ataaaaaaagaaaaaggaag

SEQ ID NO: 10982 - DNA, 20 bp, Artificial Sequence
  Description of Artificial Sequence: Synthetic oligonucleotide
  Target: ATXN1; (+) strand; PAM type: NNAGAAW; PAM sequence: CCAGAAA
aagttgttggggggcgattc

SEQ ID NO: 10983 - DNA, 20 bp, Artificial Sequence
  Description of Artificial Sequence: Synthetic oligonucleotide
  Target: ATXN1; (+) strand; PAM type: NNAGAAW; PAM sequence: AGAGAAA
atttcacatactagtatgaa

SEQ ID NO: 10984 - DNA, 20 bp, Artificial Sequence
  Description of Artificial Sequence: Synthetic oligonucleotide
  Target: ATXN1; (+) strand; PAM type: NNAGAAW; PAM sequence: TAAGAAA
gtatggggtgttagggtctt

SEQ ID NO: 10985 - DNA, 20 bp, Artificial Sequence
  Description of Artificial Sequence: Synthetic oligonucleotide
  Target: ATXN1; (+) strand; PAM type: NNAGAAW; PAM sequence: ATAGAAA
tgctgagtacacgtgactaa

SEQ ID NO: 10986 - DNA, 20 bp, Artificial Sequence
  Description of Artificial Sequence: Synthetic oligonucleotide
  Target: ATXN1; (+) strand; PAM type: NNAGAAW; PAM sequence: GTAGAAT
aatggaccaatcagtgctct

SEQ ID NO: 10987 - DNA, 20 bp, Artificial Sequence
  Description of Artificial Sequence: Synthetic oligonucleotide
  Target: ATXN1; (+) strand; PAM type: NNAGAAW; PAM sequence: ACAGAAA
cagcagcagccattgttcta

SEQ ID NO: 10988 - DNA, 20 bp, Artificial Sequence
  Description of Artificial Sequence: Synthetic oligonucleotide
  Target: ATXN1; (+) strand; PAM type: NNAGAAW; PAM sequence: GAAGAAT
gctcattaaagatgtaaata

SEQ ID NO: 10989 - DNA, 20 bp, Artificial Sequence
  Description of Artificial Sequence: Synthetic oligonucleotide
  Target: ATXN1; (+) strand; PAM type: NNAGAAW; PAM sequence: GCAGAAA
attacaatgtttccttctat

SEQ ID NO: 10990 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
caatgtttccttctatgcag

SEQ ID NO: 10991 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
acgttatttttttttaatga

SEQ ID NO: 10992 - DNA, 20 bp, Artificial Sequence
  Description of Artificial Sequence: Synthetic oligonucleotide
  Target: ATXN1; (+) strand; PAM type: NNAGAAW; PAM sequence: CAAGAAT
cctccttgtttcctcagaca

SEQ ID NO: 10993 - DNA, 20 bp, Artificial Sequence
  Description of Artificial Sequence: Synthetic oligonucleotide
  Target: ATXN1; (+) strand; PAM type: NNAGAAW; PAM sequence: GGAGAAT
ctattcgggaggctgaggca

SEQ ID NO: 10994 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
gagcgagactctgtctcaaa

SEQ ID NO: 10995 - DNA, 20 bp, Artificial Sequence
  Description of Artificial Sequence: Synthetic oligonucleotide
  Target: ATXN1; (+) strand; PAM type: NNAGAAW; PAM sequence: AAAGAAT
tctcaaaaaagaaaaaaaaa

SEQ ID NO: 10996 - DNA, 20 bp, Artificial Sequence
  Description of Artificial Sequence: Synthetic oligonucleotide
  Target: ATXN1; (+) strand; PAM type: NNAGAAW; PAM sequence: TAAGAAA
cacatacctctcaatttaaa

SEQ ID NO: 10997 - DNA, 20 bp, Artificial Sequence
  Description of Artificial Sequence: Synthetic oligonucleotide
  Target: ATXN1; (+) strand; PAM type: NNAGAAW; PAM sequence: CTAGAAA
tctcaatttaaataagaaaa

SEQ ID NO: 10998 - DNA, 20 bp, Artificial Sequence
  Description of Artificial Sequence: Synthetic oligonucleotide
  Target: ATXN1; (+) strand; PAM type: NNAGAAW; PAM sequence: GAAGAAA
aatgctaaggaaaagttctt

SEQ ID NO: 10999 - DNA, 20 bp, Artificial Sequence
  Description of Artificial Sequence: Synthetic oligonucleotide
  Target: ATXN1; (+) strand; PAM type: NNAGAAW; PAM sequence: TAAGAAA
tccagtgaactcatcaatgg

SEQ ID NO: 11000 - DNA, 20 bp, Artificial Sequence
  Description of Artificial Sequence: Synthetic oligonucleotide
  Target: ATXN1; (+) strand; PAM type: NNAGAAW; PAM sequence: ATAGAAA
acaaagttagagtggtctga

SEQ ID NO: 11001 - DNA, 20 bp, Artificial Sequence
  Description of Artificial Sequence: Synthetic oligonucleotide
  Target: ATXN1; (+) strand; PAM type: NNAGAAW; PAM sequence: GAAGAAA
agagaggtgaggaacttgga

SEQ ID NO: 11002 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
ttggttcgtgagatttaagg

SEQ ID NO: 11003 - DNA, 20 bp, Artificial Sequence
  Description of Artificial Sequence: Synthetic oligonucleotide
  Target: ATXN1; (+) strand; PAM type: NNAGAAW; PAM sequence: CCAGAAA
tagaagctgcagcaggttat

SEQ ID NO: 11004 - DNA, 20 bp, Artificial Sequence
  Description of Artificial Sequence: Synthetic oligonucleotide
  Target: ATXN1; (+) strand; PAM type: NNAGAAW; PAM sequence: GAAGAAA
ggcaaagcagccttctattg

SEQ ID NO: 11005 - DNA, 20 bp, Artificial Sequence
  Description of Artificial Sequence: Synthetic oligonucleotide
  Target: ATXN1; (+) strand; PAM type: NNAGAAW; PAM sequence: ATAGAAA
gaatctactctgccagtgct

SEQ ID NO: 11006 - DNA, 20 bp, Artificial Sequence
  Description of Artificial Sequence: Synthetic oligonucleotide
  Target: ATXN1; (+) strand; PAM type: NNAGAAW; PAM sequence: TCAGAAA
cactgttgagacttaattgc

SEQ ID NO: 11007 - DNA, 20 bp, Artificial Sequence
  Description of Artificial Sequence: Synthetic oligonucleotide
  Target: ATXN1; (+) strand; PAM type: NNAGAAW; PAM sequence: TAAGAAA
tattttcaagtcttcttatt

SEQ ID NO: 11008 - DNA, 20 bp, Artificial Sequence
  Description of Artificial Sequence: Synthetic oligonucleotide
  Target: ATXN1; (+) strand; PAM type: NNAGAAW; PAM sequence: ACAGAAA
tctgtaaggctatcattgcc

SEQ ID NO: 11009 - DNA, 20 bp, Artificial Sequence
  Description of Artificial Sequence: Synthetic oligonucleotide
  Target: ATXN1; (+) strand; PAM type: NNAGAAW; PAM sequence: CCAGAAT
aggtggaaacagcaagagaa

SEQ ID NO: 11010 - DNA, 20 bp, Artificial Sequence
  Description of Artificial Sequence: Synthetic oligonucleotide
  Target: ATXN1; (+) strand; PAM type: NNAGAAW; PAM sequence: TTAGAAA
aaacagcaagagaaccagaa

SEQ ID NO: 11011 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
agttgcctctatggaggagc

SEQ ID NO: 11012 - DNA, 20 bp, Artificial Sequence
  Description of Artificial Sequence: Synthetic oligonucleotide
  Target: ATXN1; (+) strand; PAM type: NNAGAAW; PAM sequence: GGAGAAT
ctactcaggaggctgaggca

SEQ ID NO: 11013 - DNA, 20 bp, Artificial Sequence
  Description of Artificial Sequence: Synthetic oligonucleotide
  Target: ATXN1; (+) strand; PAM type: NNAGAAW; PAM sequence: AGAGAAA
caaacaatggtgcatactac

SEQ ID NO: 11014 - DNA, 20 bp, Artificial Sequence
  Description of Artificial Sequence: Synthetic oligonucleotide
  Target: ATXN1; (+) strand; PAM type: NNAGAAW; PAM sequence: TAAGAAA
acgtcattgttgtctaattt

SEQ ID NO: 11015 - DNA, 20 bp, Artificial Sequence
  Description of Artificial Sequence: Synthetic oligonucleotide
  Target: ATXN1; (+) strand; PAM type: NNAGAAW; PAM sequence: ACAGAAA
aactcttcctaacaggcact

SEQ ID NO: 11016 - DNA, 20 bp, Artificial Sequence
  Description of Artificial Sequence: Synthetic oligonucleotide
  Target: ATXN1; (+) strand; PAM type: NNAGAAW; PAM sequence: GCAGAAA
gcaggactatgagcctgctt

SEQ ID NO: 11017 - DNA, 20 bp, Artificial Sequence
  Description of Artificial Sequence: Synthetic oligonucleotide
  Target: ATXN1; (+) strand; PAM type: NNAGAAW; PAM sequence: GAAGAAT
cctgcttgcagaaattctga

SEQ ID NO: 11018 - DNA, 20 bp, Artificial Sequence
  Description of Artificial Sequence: Synthetic oligonucleotide
  Target: ATXN1; (+) strand; PAM type: NNAGAAW; PAM sequence: TCAGAAA
gaggcacatgaaactatgtc

SEQ ID NO: 11019 - DNA, 20 bp, Artificial Sequence
  Description of Artificial Sequence: Synthetic oligonucleotide
  Target: ATXN1; (+) strand; PAM type: NNAGAAW; PAM sequence: GAAGAAA
ttattctcttcagttattaa

SEQ ID NO: 11020 - DNA, 20 bp, Artificial Sequence
  Description of Artificial Sequence: Synthetic oligonucleotide
  Target: ATXN1; (+) strand; PAM type: NNAGAAW; PAM sequence: TTAGAAT
atacaacccagtttctgaaa

SEQ ID NO: 11021 - DNA, 20 bp, Artificial Sequence
  Description of Artificial Sequence: Synthetic oligonucleotide
  Target: ATXN1; (+) strand; PAM type: NNAGAAW; PAM sequence: TAAGAAA
attccatgtggtccctaaaa

SEQ ID NO: 11022 - DNA, 20 bp, Artificial Sequence
  Description of Artificial Sequence: Synthetic oligonucleotide
  Target: ATXN1; (+) strand; PAM type: NNAGAAW; PAM sequence: AGAGAAT
ggttaccaggggctgggagg

SEQ ID NO: 11023 - DNA, 20 bp, Artificial Sequence
  Description of Artificial Sequence: Synthetic oligonucleotide
  Target: ATXN1; (+) strand; PAM type: NNAGAAW; PAM sequence: GGAGAAT
ctactcgggaggccgaggca

SEQ ID NO: 11024 - DNA, 20 bp, Artificial Sequence
  Description of Artificial Sequence: Synthetic oligonucleotide
  Target: ATXN1; (+) strand; PAM type: NNAGAAW; PAM sequence: GAAGAAT
gctgccagcagcatcattta

SEQ ID NO: 11025 - DNA, 20 bp, Artificial Sequence
  Description of Artificial Sequence: Synthetic oligonucleotide
  Target: ATXN1; (+) strand; PAM type: NNAGAAW; PAM sequence: GAAGAAA
aacgtggacttaaaccagtg

SEQ ID NO: 11026 - DNA, 20 bp, Artificial Sequence
  Description of Artificial Sequence: Synthetic oligonucleotide
  Target: ATXN1; (+) strand; PAM type: NNAGAAW; PAM sequence: GGAGAAT
cactctgagaggccaaagca

SEQ ID NO: 11027 - DNA, 20 bp, Artificial Sequence
  Description of Artificial Sequence: Synthetic oligonucleotide
  Target: ATXN1; (+) strand; PAM type: NNAGAAW; PAM sequence: CAAGAAT
gaacagcctgggtaacatag

SEQ ID NO: 11028 - DNA, 20 bp, Artificial Sequence
  Description of Artificial Sequence: Synthetic oligonucleotide
  Target: ATXN1; (+) strand; PAM type: NNAGAAW; PAM sequence: TAAGAAA
ttcagtggctctccgccact

SEQ ID NO: 11029 - DNA, 20 bp, Artificial Sequence
  Description of Artificial Sequence: Synthetic oligonucleotide
  Target: ATXN1; (+) strand; PAM type: NNAGAAW; PAM sequence: ACAGAAT
atttatgtaaagccccaacc

SEQ ID NO: 11030 - DNA, 20 bp, Artificial Sequence
  Description of Artificial Sequence: Synthetic oligonucleotide
  Target: ATXN1; (+) strand; PAM type: NNAGAAW; PAM sequence: GAAGAAT
ccaagtttgtaggaaggcat

SEQ ID NO: 11031 - DNA, 20 bp, Artificial Sequence
  Description of Artificial Sequence: Synthetic oligonucleotide
  Target: ATXN1; (+) strand; PAM type: NNAGAAW; PAM sequence: TAAGAAA
actatttattgtgaactacc

SEQ ID NO: 11032 - DNA, 20 bp, Artificial Sequence
  Description of Artificial Sequence: Synthetic oligonucleotide
  Target: ATXN1; (+) strand; PAM type: NNAGAAW; PAM sequence: CAAGAAA
tcttaaatgttctcaccatg

SEQ ID NO: 11033 - DNA, 20 bp, Artificial Sequence
  Description of Artificial Sequence: Synthetic oligonucleotide
  Target: ATXN1; (+) strand; PAM type: NNAGAAW; PAM sequence: ACAGAAT
gcaaccccatggctagtgca

SEQ ID NO: 11034 - DNA, 20 bp, Artificial Sequence
  Description of Artificial Sequence: Synthetic oligonucleotide
  Target: ATXN1; (+) strand; PAM type: NNAGAAW; PAM sequence: CAAGAAA
ttttggcatgactttataaa

SEQ ID NO: 11035 - DNA, 20 bp, Artificial Sequence
  Description of Artificial Sequence: Synthetic oligonucleotide
  Target: ATXN1; (+) strand; PAM type: NNAGAAW; PAM sequence: ACAGAAT
tcttttggtattttagccaa

SEQ ID NO: 11036 - DNA, 20 bp, Artificial Sequence
  Description of Artificial Sequence: Synthetic oligonucleotide
  Target: ATXN1; (+) strand; PAM type: NNAGAAW; PAM sequence: TTAGAAA
attttagccaaacagaattc

SEQ ID NO: 11037 - DNA, 20 bp, Artificial Sequence
  Description of Artificial Sequence: Synthetic oligonucleotide
  Target: ATXN1; (+) strand; PAM type: NNAGAAW; PAM sequence: TCAGAAT
tcctagagcagagtagcctt

SEQ ID NO: 11038 - DNA, 20 bp, Artificial Sequence
  Description of Artificial Sequence: Synthetic oligonucleotide
  Target: ATXN1; (+) strand; PAM type: NNAGAAW; PAM sequence: TAAGAAA
ccagtctttttaaattccct

SEQ ID NO: 11039 - DNA, 20 bp, Artificial Sequence
  Description of Artificial Sequence: Synthetic oligonucleotide
  Target: ATXN1; (+) strand; PAM type: NNAGAAW; PAM sequence: TTAGAAT
tgaagcaattctatctgatg

SEQ ID NO: 11040 - DNA, 20 bp, Artificial Sequence
  Description of Artificial Sequence: Synthetic oligonucleotide
  Target: ATXN1; (+) strand; PAM type: NNAGAAW; PAM sequence: GCAGAAA
ttaccaagatagctatatga

SEQ ID NO: 11041 - DNA, 20 bp, Artificial Sequence
  Description of Artificial Sequence: Synthetic oligonucleotide
  Target: ATXN1; (+) strand; PAM type: NNAGAAW; PAM sequence: CAAGAAA
cagtctaaactttctgggct

SEQ ID NO: 11042 - DNA, 20 bp, Artificial Sequence
  Description of Artificial Sequence: Synthetic oligonucleotide
  Target: ATXN1; (+) strand; PAM type: NNAGAAW; PAM sequence: GAAGAAA
agaacaagagtctcatgcga

SEQ ID NO: 11043 - DNA, 20 bp, Artificial Sequence
  Description of Artificial Sequence: Synthetic oligonucleotide
  Target: ATXN1; (+) strand; PAM type: NNAGAAW; PAM sequence: GAAGAAA
tatatacatagtatgtttaa

SEQ ID NO: 11044 - DNA, 20 bp, Artificial Sequence
  Description of Artificial Sequence: Synthetic oligonucleotide
  Target: ATXN1; (+) strand; PAM type: NNAGAAW; PAM sequence: GCAGAAA
cacattttaccttatcagga

SEQ ID NO: 11045 - DNA, 20 bp, Artificial Sequence
  Description of Artificial Sequence: Synthetic oligonucleotide
  Target: ATXN1; (+) strand; PAM type: NNAGAAW; PAM sequence: TCAGAAA
tccaaccacacaacagcatg

SEQ ID NO: 11046 - DNA, 20 bp, Artificial Sequence
  Description of Artificial Sequence: Synthetic oligonucleotide
  Target: ATXN1; (+) strand; PAM type: NNAGAAW; PAM sequence: TGAGAAT
atcagaccctttctttcata

SEQ ID NO: 11047 - DNA, 20 bp, Artificial Sequence
  Description of Artificial Sequence: Synthetic oligonucleotide
  Target: ATXN1; (+) strand; PAM type: NNAGAAW; PAM sequence: GTAGAAT
atatgagaattctcaaaaga

SEQ ID NO: 11048 - DNA, 20 bp, Artificial Sequence
  Description of Artificial Sequence: Synthetic oligonucleotide
  Target: ATXN1; (+) strand; PAM type: NNAGAAW; PAM sequence: ACAGAAA
aagagtagaataaatggaac

SEQ ID NO: 11049 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
gtagaataaatggaacacag

SEQ ID NO: 11050 - DNA, 20 bp, Artificial Sequence
  Description of Artificial Sequence: Synthetic oligonucleotide
  Target: ATXN1; (+) strand; PAM type: NNAGAAW; PAM sequence: GGAGAAT
ctactcaggaggctgaggca

SEQ ID NO: 11051 - DNA, 20 bp, Artificial Sequence
  Description of Artificial Sequence: Synthetic oligonucleotide
  Target: ATXN1; (+) strand; PAM type: NNAGAAW; PAM sequence: AGAGAAA
tcattgagcttaaactctga

SEQ ID NO: 11052 - DNA, 20 bp, Artificial Sequence
  Description of Artificial Sequence: Synthetic oligonucleotide
  Target: ATXN1; (+) strand; PAM type: NNAGAAW; PAM sequence: ACAGAAA
taaactctgaagagaaagag

SEQ ID NO: 11053 - DNA, 20 bp, Artificial Sequence
  Description of Artificial Sequence: Synthetic oligonucleotide
  Target: ATXN1; (+) strand; PAM type: NNAGAAW; PAM sequence: GAAGAAA
tgttttgatgatgcctgtta

SEQ ID NO: 11054 - DNA, 20 bp, Artificial Sequence
  Description of Artificial Sequence: Synthetic oligonucleotide
  Target: ATXN1; (+) strand; PAM type: NNAGAAW; PAM sequence: TTAGAAT
ctaactagacaaatgctctt

SEQ ID NO: 11055 - DNA, 20 bp, Artificial Sequence
  Description of Artificial Sequence: Synthetic oligonucleotide
  Target: ATXN1; (+) strand; PAM type: NNAGAAW; PAM sequence: ACAGAAA
gaccactaaagacctccaaa

SEQ ID NO: 11056 - DNA, 20 bp, Artificial Sequence
  Description of Artificial Sequence: Synthetic oligonucleotide
  Target: ATXN1; (+) strand; PAM type: NNAGAAW; PAM sequence: TGAGAAT
gcttttttccttcacttaga

SEQ ID NO: 11057 - DNA, 20 bp, Artificial Sequence
  Description of Artificial Sequence: Synthetic oligonucleotide
  Target: ATXN1; (+) strand; PAM type: NNAGAAW; PAM sequence: GAAGAAT
tcacttagatgagaatttga

SEQ ID NO: 11058 - DNA, 20 bp, Artificial Sequence
  Description of Artificial Sequence: Synthetic oligonucleotide
  Target: ATXN1; (+) strand; PAM type: NNAGAAW; PAM sequence: AGAGAAA
ctaagcaacagccaaataaa

SEQ ID NO: 11059 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
cctgcgaggcctaacagctg

SEQ ID NO: 11060 - DNA, 20 bp, Artificial Sequence
  Description of Artificial Sequence: Synthetic oligonucleotide
  Target: ATXN1; (+) strand; PAM type: NNAGAAW; PAM sequence: TCAGAAT
acagctgaaagaaataccac

SEQ ID NO: 11061 - DNA, 20 bp, Artificial Sequence
  Description of Artificial Sequence: Synthetic oligonucleotide
  Target: ATXN1; (+) strand; PAM type: NNAGAAW; PAM sequence: GAAGAAA
gggaacactttacgtatttg

SEQ ID NO: 11062 - DNA, 20 bp, Artificial Sequence
  Description of Artificial Sequence: Synthetic oligonucleotide
  Target: ATXN1; (+) strand; PAM type: NNAGAAW; PAM sequence: AGAGAAT
aagtgggtttctaaaggttc

SEQ ID NO: 11063 - DNA, 20 bp, Artificial Sequence
  Description of Artificial Sequence: Synthetic oligonucleotide
  Target: ATXN1; (+) strand; PAM type: NNAGAAW; PAM sequence: ATAGAAA
aaaccccatttctactaaaa

SEQ ID NO: 11064 - DNA, 20 bp, Artificial Sequence
  Description of Artificial Sequence: Synthetic oligonucleotide
  Target: ATXN1; (+) strand; PAM type: NNAGAAW; PAM sequence: AGAGAAT
ctactcaggaggctgaggca

SEQ ID NO: 11065 - DNA, 20 bp, Artificial Sequence
  Description of Artificial Sequence: Synthetic oligonucleotide
  Target: ATXN1; (+) strand; PAM type: NNAGAAW; PAM sequence: ATAGAAA
aatggagaggaagatacagg

SEQ ID NO: 11066 - DNA, 20 bp, Artificial Sequence
  Description of Artificial Sequence: Synthetic oligonucleotide
  Target: ATXN1; (+) strand; PAM type: NNAGAAW; PAM sequence: GGAGAAT
caggaaggatactgtcacca

SEQ ID NO: 11067 - DNA, 20 bp, Artificial Sequence
  Description of Artificial Sequence: Synthetic oligonucleotide
  Target: ATXN1; (+) strand; PAM type: NNAGAAW; PAM sequence: AGAGAAA
ttcataatttaatatttgta

SEQ ID NO: 11068 - DNA, 20 bp, Artificial Sequence
  Description of Artificial Sequence: Synthetic oligonucleotide
  Target: ATXN1; (+) strand; PAM type: NNAGAAW; PAM sequence: GCAGAAA
caataatgcatcacttgaag

SEQ ID NO: 11069 - DNA, 20 bp, Artificial Sequence
  Description of Artificial Sequence: Synthetic oligonucleotide
  Target: ATXN1; (+) strand; PAM type: NNAGAAW; PAM sequence: TCAGAAA
atcatttctgaagctctgct

SEQ ID NO: 11070 - DNA, 20 bp, Artificial Sequence
  Description of Artificial Sequence: Synthetic oligonucleotide
  Target: ATXN1; (+) strand; PAM type: NNAGAAW; PAM sequence: TAAGAAA
ttcagaaaggggatgtttag

SEQ ID NO: 11071 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
aggaaaaagtcagatcccct

SEQ ID NO: 11072 - DNA, 20 bp, Artificial Sequence
  Description of Artificial Sequence: Synthetic oligonucleotide
  Target: ATXN1; (+) strand; PAM type: NNAGAAW; PAM sequence: AGAGAAA
cagtccagcctgggcaacaa

SEQ ID NO: 11073 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
ccagcctgggcaacaaagag

SEQ ID NO: 11074 - DNA, 20 bp, Artificial Sequence
  Description of Artificial Sequence: Synthetic oligonucleotide
  Target: ATXN1; (+) strand; PAM type: NNAGAAW; PAM sequence: GGAGAAT
ctactcgggaggttgaggca

SEQ ID NO: 11075 - DNA, 20 bp, Artificial Sequence
  Description of Artificial Sequence: Synthetic oligonucleotide
  Target: ATXN1; (+) strand; PAM type: NNAGAAW; PAM sequence: ACAGAAA
caaatgaccaccaagcctac

SEQ ID NO: 11076 - DNA, 20 bp, Artificial Sequence
  Description of Artificial Sequence: Synthetic oligonucleotide
  Target: ATXN1; (+) strand; PAM type: NNAGAAW; PAM sequence: TGAGAAA
ttaatgacagggatatgctc

SEQ ID NO: 11077 - DNA, 20 bp, Artificial Sequence
  Description of Artificial Sequence: Synthetic oligonucleotide
  Target: ATXN1; (+) strand; PAM type: NNAGAAW; PAM sequence: ATAGAAA
gcctctaaacacatctaaac

SEQ ID NO: 11078 - DNA, 20 bp, Artificial Sequence
  Description of Artificial Sequence: Synthetic oligonucleotide
  Target: ATXN1; (+) strand; PAM type: NNAGAAW; PAM sequence: TCAGAAA
atcatactattctgcaagtt

SEQ ID NO: 11079 - DNA, 20 bp, Artificial Sequence
  Description of Artificial Sequence: Synthetic oligonucleotide
  Target: ATXN1; (+) strand; PAM type: NNAGAAW; PAM sequence: AGAGAAA
tgtcctgttatttaggatgt

SEQ ID NO: 11080 - DNA, 20 bp, Artificial Sequence
  Description of Artificial Sequence: Synthetic oligonucleotide
  Target: ATXN1; (+) strand; PAM type: NNAGAAW; PAM sequence: TCAGAAT
aaacaaaacaaaataccaag

SEQ ID NO: 11081 - DNA, 20 bp, Artificial Sequence
  Description of Artificial Sequence: Synthetic oligonucleotide
  Target: ATXN1; (+) strand; PAM type: NNAGAAW; PAM sequence: GAAGAAA
tggaggtggggtgtgggaag

SEQ ID NO: 11082 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
ggtggggtgtgggaaggaag

SEQ ID NO: 11083 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
gggtgtgggaaggaagaaag

SEQ ID NO: 11084 - DNA, 20 bp, Artificial Sequence
  Description of Artificial Sequence: Synthetic oligonucleotide
  Target: ATXN1; (+) strand; PAM type: NNAGAAW; PAM sequence: TCAGAAT
gaggtagcaggtcttgaaaa

SEQ ID NO: 11085 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
accgattgaaagatgtgaat

SEQ ID NO: 11086 - DNA, 20 bp, Artificial Sequence
  Description of Artificial Sequence: Synthetic oligonucleotide
  Target: ATXN1; (+) strand; PAM type: NNAGAAW; PAM sequence: GCAGAAA
actgatgtgcagtatcaagg

SEQ ID NO: 11087 - DNA, 20 bp, Artificial Sequence
  Description of Artificial Sequence: Synthetic oligonucleotide
  Target: ATXN1; (+) strand; PAM type: NNAGAAW; PAM sequence: GAAGAAA
cagtatcaagggcagaaagt

SEQ ID NO: 11088 - DNA, 20 bp, Artificial Sequence
  Description of Artificial Sequence: Synthetic oligonucleotide
  Target: ATXN1; (+) strand; PAM type: NNAGAAW; PAM sequence: CTAGAAA
gacaatggccatttgagagc

SEQ ID NO: 11089 - DNA, 20 bp, Artificial Sequence
  Description of Artificial Sequence: Synthetic oligonucleotide
  Target: ATXN1; (+) strand; PAM type: NNAGAAW; PAM sequence: TAAGAAA
tggatcaagtgaccaagttg

SEQ ID NO: 11090 - DNA, 20 bp, Artificial Sequence
  Description of Artificial Sequence: Synthetic oligonucleotide
  Target: ATXN1; (+) strand; PAM type: NNAGAAW; PAM sequence: GGAGAAA
acactaaaaacttttgagga

SEQ ID NO: 11091 - DNA, 20 bp, Artificial Sequence
  Description of Artificial Sequence: Synthetic oligonucleotide
  Target: ATXN1; (+) strand; PAM type: NNAGAAW; PAM sequence: ACAGAAA
tttggatgctatcagtaccc

SEQ ID NO: 11092 - DNA, 20 bp, Artificial Sequence
  Description of Artificial Sequence: Synthetic oligonucleotide
  Target: ATXN1; (+) strand; PAM type: NNAGAAW; PAM sequence: ATAGAAA
atgtgtaaggcaacatactg

SEQ ID NO: 11093 - DNA, 20 bp, Artificial Sequence
  Description of Artificial Sequence: Synthetic oligonucleotide
  Target: ATXN1; (+) strand; PAM type: NNAGAAW; PAM sequence: ACAGAAT
actttaccggcttggtaaaa

SEQ ID NO: 11094 - DNA, 20 bp, Artificial Sequence
  Description of Artificial Sequence: Synthetic oligonucleotide
  Target: ATXN1; (+) strand; PAM type: NNAGAAW; PAM sequence: ACAGAAA
atacctctttttaaagtcat

SEQ ID NO: 11095 - DNA, 20 bp, Artificial Sequence
  Description of Artificial Sequence: Synthetic oligonucleotide
  Target: ATXN1; (+) strand; PAM type: NNAGAAW; PAM sequence: TAAGAAA
tttctgttttgtttttgcca

SEQ ID NO: 11096 - DNA, 20 bp, Artificial Sequence
  Description of Artificial Sequence: Synthetic oligonucleotide
  Target: ATXN1; (+) strand; PAM type: NNAGAAW; PAM sequence: GCAGAAT
gcaaaatcgatctgggagag

SEQ ID NO: 11097 - DNA, 20 bp, Artificial Sequence
  Description of Artificial Sequence: Synthetic oligonucleotide
  Target: ATXN1; (+) strand; PAM type: NNAGAAW; PAM sequence: CCAGAAA
cagctgccaaagctaggtgt

SEQ ID NO: 11098 - DNA, 20 bp, Artificial Sequence
  Description of Artificial Sequence: Synthetic oligonucleotide
  Target: ATXN1; (+) strand; PAM type: NNAGAAW; PAM sequence: ACAGAAA
gtaaggtttatactattcat

SEQ ID NO: 11099 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
ctatgaggcaactcttatca

SEQ ID NO: 11100 - DNA, 20 bp, Artificial Sequence
  Description of Artificial Sequence: Synthetic oligonucleotide
  Target: ATXN1; (+) strand; PAM type: NNAGAAW; PAM sequence: AGAGAAA
ccaaaagcccaaaaagcaga

SEQ ID NO: 11101 - DNA, 20 bp, Artificial Sequence
  Description of Artificial Sequence: Synthetic oligonucleotide
  Target: ATXN1; (+) strand; PAM type: NNAGAAW; PAM sequence: GTAGAAT
aagagacaaacaggttctca

SEQ ID NO: 11102 - DNA, 20 bp, Artificial Sequence
  Description of Artificial Sequence: Synthetic oligonucleotide
  Target: ATXN1; (+) strand; PAM type: NNAGAAW; PAM sequence: ATAGAAA
tatatattattttacaaaat

SEQ ID NO: 11103 - DNA, 20 bp, Artificial Sequence
  Description of Artificial Sequence: Synthetic oligonucleotide
  Target: ATXN1; (+) strand; PAM type: NNAGAAW; PAM sequence: TTAGAAA
tgatatgcagtgattcacac

SEQ ID NO: 11104 - DNA, 20 bp, Artificial Sequence
  Description of Artificial Sequence: Synthetic oligonucleotide
  Target: ATXN1; (+) strand; PAM type: NNAGAAW; PAM sequence: GGAGAAA
ttacatgactttttacagtg

SEQ ID NO: 11105 - DNA, 20 bp, Artificial Sequence
  Description of Artificial Sequence: Synthetic oligonucleotide
  Target: ATXN1; (+) strand; PAM type: NNAGAAW; PAM sequence: CCAGAAA
caaactcaggccatctgact

SEQ ID NO: 11106 - DNA, 20 bp, Artificial Sequence
  Description of Artificial Sequence: Synthetic oligonucleotide
  Target: ATXN1; (+) strand; PAM type: NNAGAAW; PAM sequence: GTAGAAT
ctgaaatttgactttccact

SEQ ID NO: 11107 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
ataagctatattcagttgtc

SEQ ID NO: 11108 - DNA, 20 bp, Artificial Sequence
  Description of Artificial Sequence: Synthetic oligonucleotide
  Target: ATXN1; (+) strand; PAM type: NNAGAAW; PAM sequence: ACAGAAA
atattcagttgtcaaagaaa

SEQ ID NO: 11109 - DNA, 20 bp, Artificial Sequence
  Description of Artificial Sequence: Synthetic oligonucleotide
  Target: ATXN1; (+) strand; PAM type: NNAGAAW; PAM sequence: AGAGAAT
atttgcgtcatttaactatt

SEQ ID NO: 11110 - DNA, 20 bp, Artificial Sequence
  Description of Artificial Sequence: Synthetic oligonucleotide
  Target: ATXN1; (+) strand; PAM type: NNAGAAW; PAM sequence: ATAGAAA
aaatcaattttcagttggca

SEQ ID NO: 11111 - DNA, 20 bp, Artificial Sequence
  Description of Artificial Sequence: Synthetic oligonucleotide
  Target: ATXN1; (+) strand; PAM type: NNAGAAW; PAM sequence: GGAGAAA
tagacatgtgaaatacagaa

SEQ ID NO: 11112 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
catgtgaaatacagaaggag

SEQ ID NO: 11113 - DNA, 20 bp, Artificial Sequence
  Description of Artificial Sequence: Synthetic oligonucleotide
  Target: ATXN1; (+) strand; PAM type: NNAGAAW; PAM sequence: TTAGAAT
actcctgcctcaatacaaat

SEQ ID NO: 11114 - DNA, 20 bp, Artificial Sequence
  Description of Artificial Sequence: Synthetic oligonucleotide
  Target: ATXN1; (+) strand; PAM type: NNAGAAW; PAM sequence: GAAGAAA
ttagaatggcactgtgccgg

SEQ ID NO: 11115 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
aatggaaactaaagcactgg

SEQ ID NO: 11116 - DNA, 20 bp, Artificial Sequence
  Description of Artificial Sequence: Synthetic oligonucleotide
  Target: ATXN1; (+) strand; PAM type: NNAGAAW; PAM sequence: AAAGAAT
gaaactaaagcactggaaag

SEQ ID NO: 11117 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
ctggaaagaaagaatcataa

SEQ ID NO: 11118 - DNA, 20 bp, Artificial Sequence
  Description of Artificial Sequence: Synthetic oligonucleotide
  Target: ATXN1; (+) strand; PAM type: NNAGAAW; PAM sequence: GTAGAAA
atatgcatttggaaacagaa

SEQ ID NO: 11119 - DNA, 20 bp, Artificial Sequence
  Description of Artificial Sequence: Synthetic oligonucleotide
  Target: ATXN1; (+) strand; PAM type: NNAGAAW; PAM sequence: TAAGAAA
gaatgaagagtatgtttttt

SEQ ID NO: 11120 - DNA, 20 bp, Artificial Sequence
  Description of Artificial Sequence: Synthetic oligonucleotide
  Target: ATXN1; (+) strand; PAM type: NNAGAAW; PAM sequence: GGAGAAA
tgtattgtaaatctatgagg

SEQ ID NO: 11121 - DNA, 20 bp, Artificial Sequence
  Description of Artificial Sequence: Synthetic oligonucleotide
  Target: ATXN1; (+) strand; PAM type: NNAGAAW; PAM sequence: GAAGAAA
accacagaacactttttcca

SEQ ID NO: 11122 - DNA, 20 bp, Artificial Sequence
  Description of Artificial Sequence: Synthetic oligonucleotide
  Target: ATXN1; (+) strand; PAM type: NNAGAAW; PAM sequence: TGAGAAA
taccatattagaagcaaaat

SEQ ID NO: 11123 - DNA, 20 bp, Artificial Sequence
  Description of Artificial Sequence: Synthetic oligonucleotide
  Target: ATXN1; (+) strand; PAM type: NNAGAAW; PAM sequence: ATAGAAA
aatattcattagttcattta

SEQ ID NO: 11124 - DNA, 20 bp, Artificial Sequence
  Description of Artificial Sequence: Synthetic oligonucleotide
  Target: ATXN1; (+) strand; PAM type: NNAGAAW; PAM sequence: ATAGAAA
agcaccatggaatctgaagc

SEQ ID NO: 11125 - DNA, 20 bp, Artificial Sequence
  Description of Artificial Sequence: Synthetic oligonucleotide
  Target: ATXN1; (+) strand; PAM type: NNAGAAW; PAM sequence: AGAGAAT
aactccgctgtacacatgga

SEQ ID NO: 11126 - DNA, 20 bp, Artificial Sequence
  Description of Artificial Sequence: Synthetic oligonucleotide
  Target: ATXN1; (+) strand; PAM type: NNAGAAW; PAM sequence: CCAGAAA
ttgatcttacagatgtccct

SEQ ID NO: 11127 - DNA, 20 bp, Artificial Sequence
  Description of Artificial Sequence: Synthetic oligonucleotide
  Target: ATXN1; (+) strand; PAM type: NNAGAAW; PAM sequence: CAAGAAA
tttacttggattctactagg

SEQ ID NO: 11128 - DNA, 20 bp, Artificial Sequence
  Description of Artificial Sequence: Synthetic oligonucleotide
  Target: ATXN1; (+) strand; PAM type: NNAGAAW; PAM sequence: TGAGAAT
tcttagctccctcatatgag

SEQ ID NO: 11129 - DNA, 20 bp, Artificial Sequence
  Description of Artificial Sequence: Synthetic oligonucleotide
  Target: ATXN1; (+) strand; PAM type: NNAGAAW; PAM sequence: ACAGAAT
cagccatgttgttacaaatg

SEQ ID NO: 11130 - DNA, 20 bp, Artificial Sequence
  Description of Artificial Sequence: Synthetic oligonucleotide
  Target: ATXN1; (+) strand; PAM type: NNAGAAW; PAM sequence: TAAGAAT
ctttcttccaatctaggctt

SEQ ID NO: 11131 - DNA, 20 bp, Artificial Sequence
  Description of Artificial Sequence: Synthetic oligonucleotide
  Target: ATXN1; (+) strand; PAM type: NNAGAAW; PAM sequence: TCAGAAA
taaagtacatggaaagagat

SEQ ID NO: 11132 - DNA, 20 bp, Artificial Sequence
  Description of Artificial Sequence: Synthetic oligonucleotide
  Target: ATXN1; (+) strand; PAM type: NNAGAAW; PAM sequence: TTAGAAA
aattataaatcattatctat

SEQ ID NO: 11133 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
ataaatcattatctatttag

SEQ ID NO: 11134 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
ttacccgccttctaataaat

SEQ ID NO: 11135 - DNA, 20 bp, Artificial Sequence
  Description of Artificial Sequence: Synthetic oligonucleotide
  Target: ATXN1; (+) strand; PAM type: NNAGAAW; PAM sequence: AGAGAAA
agatgttcttaaaaccttct

SEQ ID NO: 11136 - DNA, 20 bp, Artificial Sequence
  Description of Artificial Sequence: Synthetic oligonucleotide
  Target: ATXN1; (+) strand; PAM type: NNAGAAW; PAM sequence: AGAGAAT
atttgtgactttctcaggga

SEQ ID NO: 11137 - DNA, 20 bp, Artificial Sequence
  Description of Artificial Sequence: Synthetic oligonucleotide
  Target: ATXN1; (+) strand; PAM type: NNAGAAW; PAM sequence: ATAGAAT
ctgtcctactgcaaactgaa

SEQ ID NO: 11138 - DNA, 20 bp, Artificial Sequence
  Description of Artificial Sequence: Synthetic oligonucleotide
  Target: ATXN1; (+) strand; PAM type: NNAGAAW; PAM sequence: CCAGAAT
gatgacagactgcaggaagc

SEQ ID NO: 11139 - DNA, 20 bp, Artificial Sequence
  Description of Artificial Sequence: Synthetic oligonucleotide
  Target: ATXN1; (+) strand; PAM type: NNAGAAW; PAM sequence: TGAGAAA
ttggcatcataattactctt

SEQ ID NO: 11140 - DNA, 20 bp, Artificial Sequence
  Description of Artificial Sequence: Synthetic oligonucleotide
  Target: ATXN1; (+) strand; PAM type: NNAGAAW; PAM sequence: TAAGAAA
tcaaacttctgtgcagaagt

SEQ ID NO: 11141 - DNA, 20 bp, Artificial Sequence
  Description of Artificial Sequence: Synthetic oligonucleotide
  Target: ATXN1; (+) strand; PAM type: NNAGAAW; PAM sequence: GGAGAAT
tctgtgcagaagttaagaaa

SEQ ID NO: 11142 - DNA, 20 bp, Artificial Sequence
  Description of Artificial Sequence: Synthetic oligonucleotide
  Target: ATXN1; (+) strand; PAM type: NNAGAAW; PAM sequence: ATAGAAT
tccatttgtaagctccattt

SEQ ID NO: 11143 - DNA, 20 bp, Artificial Sequence
  Description of Artificial Sequence: Synthetic oligonucleotide
  Target: ATXN1; (+) strand; PAM type: NNAGAAW; PAM sequence: AAAGAAT
aatcactgctattaatcagt

SEQ ID NO: 11144 - DNA, 20 bp, Artificial Sequence
  Description of Artificial Sequence: Synthetic oligonucleotide
  Target: ATXN1; (+) strand; PAM type: NNAGAAW; PAM sequence: CTAGAAT
atatattaaatttgtcagtt

SEQ ID NO: 11145 - DNA, 20 bp, Artificial Sequence
  Description of Artificial Sequence: Synthetic oligonucleotide
  Target: ATXN1; (+) strand; PAM type: NNAGAAW; PAM sequence: CAAGAAA
accaccccatgacccccaac

SEQ ID NO: 11146 - DNA, 20 bp, Artificial Sequence
  Description of Artificial Sequence: Synthetic oligonucleotide
  Target: ATXN1; (+) strand; PAM type: NNAGAAW; PAM sequence: TTAGAAA
atatcactaagtggcccaac

SEQ ID NO: 11147 - DNA, 20 bp, Artificial Sequence
  Description of Artificial Sequence: Synthetic oligonucleotide
  Target: ATXN1; (+) strand; PAM type: NNAGAAW; PAM sequence: CTAGAAT
agtggcccaacttagaaata

SEQ ID NO: 11148 - DNA, 20 bp, Artificial Sequence
  Description of Artificial Sequence: Synthetic oligonucleotide
  Target: ATXN1; (+) strand; PAM type: NNAGAAW; PAM sequence: CCAGAAT
atggttctccaatcacctct

SEQ ID NO: 11149 - DNA, 20 bp, Artificial Sequence
  Description of Artificial Sequence: Synthetic oligonucleotide
  Target: ATXN1; (+) strand; PAM type: NNAGAAW; PAM sequence: CTAGAAA
gaatgccacaaaagctggct

SEQ ID NO: 11150 - DNA, 20 bp, Artificial Sequence
  Description of Artificial Sequence: Synthetic oligonucleotide
  Target: ATXN1; (+) strand; PAM type: NNAGAAW; PAM sequence: CAAGAAA
tcctctgtgctatcaacaag

SEQ ID NO: 11151 - DNA, 20 bp, Artificial Sequence
  Description of Artificial Sequence: Synthetic oligonucleotide
  Target: ATXN1; (+) strand; PAM type: NNAGAAW; PAM sequence: GGAGAAA
aagcaagaaaaaagagatct

SEQ ID NO: 11152 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
acactactagaagtcaggct

SEQ ID NO: 11153 - DNA, 20 bp, Artificial Sequence
  Description of Artificial Sequence: Synthetic oligonucleotide
  Target: ATXN1; (+) strand; PAM type: NNAGAAW; PAM sequence: ACAGAAA
atttttaagcagttactaaa

SEQ ID NO: 11154 - DNA, 20 bp, Artificial Sequence
  Description of Artificial Sequence: Synthetic oligonucleotide
  Target: ATXN1; (+) strand; PAM type: NNAGAAW; PAM sequence: TTAGAAA
aggcttactgagtaggttct

SEQ ID NO: 11155 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
ttactgagtaggttctttag

SEQ ID NO: 11156 - DNA, 20 bp, Artificial Sequence
  Description of Artificial Sequence: Synthetic oligonucleotide
  Target: ATXN1; (+) strand; PAM type: NNAGAAW; PAM sequence: ACAGAAT
tttttttttgcagtaacgta

SEQ ID NO: 11157 - DNA, 20 bp, Artificial Sequence
  Description of Artificial Sequence: Synthetic oligonucleotide
  Target: ATXN1; (+) strand; PAM type: NNAGAAW; PAM sequence: TAAGAAA
ggtatcaggaaagattctgg

SEQ ID NO: 11158 - DNA, 20 bp, Artificial Sequence
  Description of Artificial Sequence: Synthetic oligonucleotide
  Target: ATXN1; (+) strand; PAM type: NNAGAAW; PAM sequence: ACAGAAA
tcaacacaagagttaatcac

SEQ ID NO: 11159 - DNA, 20 bp, Artificial Sequence
  Description of Artificial Sequence: Synthetic oligonucleotide
  Target: ATXN1; (+) strand; PAM type: NNAGAAW; PAM sequence: CAAGAAT
ctgacatgtaactgaaatga

SEQ ID NO: 11160 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
ttctgtgtcatactgcatta

SEQ ID NO: 11161 - DNA, 20 bp, Artificial Sequence
  Description of Artificial Sequence: Synthetic oligonucleotide
  Target: ATXN1; (+) strand; PAM type: NNAGAAW; PAM sequence: CCAGAAT
acatacccacgtcctaatcc

SEQ ID NO: 11162 - DNA, 20 bp, Artificial Sequence
  Description of Artificial Sequence: Synthetic oligonucleotide
  Target: ATXN1; (+) strand; PAM type: NNAGAAW; PAM sequence: CAAGAAA
taggggaaggggccaggagc

SEQ ID NO: 11163 - DNA, 20 bp, Artificial Sequence
  Description of Artificial Sequence: Synthetic oligonucleotide
  Target: ATXN1; (+) strand; PAM type: NNAGAAW; PAM sequence: GGAGAAA
gagaccagcctggccaacat

SEQ ID NO: 11164 - DNA, 20 bp, Artificial Sequence
  Description of Artificial Sequence: Synthetic oligonucleotide
  Target: ATXN1; (+) strand; PAM type: NNAGAAW; PAM sequence: GGAGAAT
ctacttgggaggctgaggca

SEQ ID NO: 11165 - DNA, 20 bp, Artificial Sequence
  Description of Artificial Sequence: Synthetic oligonucleotide
  Target: ATXN1; (+) strand; PAM type: NNAGAAW; PAM sequence: ACAGAAT
actgcactccagcctgggcg

SEQ ID NO: 11166 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
ccccgccaaaaaaaaaaaaa

SEQ ID NO: 11167 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
ccaaaaaaaaaaaaaaaaga

SEQ ID NO: 11168 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
aaaaaaaaaaaaagaaaaga

SEQ ID NO: 11169 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
aaaaaaaaagaaaagaaaag

SEQ ID NO: 11170 - DNA, 20 bp, Artificial Sequence
  Description of Artificial Sequence: Synthetic oligonucleotide
  Target: ATXN1; (+) strand; PAM type: NNAGAAW; PAM sequence: AGAGAAT
ttattctctagagtccctac

SEQ ID NO: 11171 - DNA, 20 bp, Artificial Sequence
  Description of Artificial Sequence: Synthetic oligonucleotide
  Target: ATXN1; (+) strand; PAM type: NNAGAAW; PAM sequence: GAAGAAA
aaaactaacacaggtgcttt

SEQ ID NO: 11172 - DNA, 20 bp, Artificial Sequence
  Description of Artificial Sequence: Synthetic oligonucleotide
  Target: ATXN1; (+) strand; PAM type: NNAGAAW; PAM sequence: ACAGAAT
gctttaccaaacacataaag

SEQ ID NO: 11173 - DNA, 20 bp, Artificial Sequence
  Description of Artificial Sequence: Synthetic oligonucleotide
  Target: ATXN1; (+) strand; PAM type: NNAGAAW; PAM sequence: TCAGAAT
cattttaaaacagctcaaac

SEQ ID NO: 11174 - DNA, 20 bp, Artificial Sequence
  Description of Artificial Sequence: Synthetic oligonucleotide
  Target: ATXN1; (+) strand; PAM type: NNAGAAW; PAM sequence: TAAGAAA
aaatggccactgtactggag

SEQ ID NO: 11175 - DNA, 20 bp, Artificial Sequence
  Description of Artificial Sequence: Synthetic oligonucleotide
  Target: ATXN1; (+) strand; PAM type: NNAGAAW; PAM sequence: AGAGAAA
agtaagaaatcaatgctcct

SEQ ID NO: 11176 - DNA, 20 bp, Artificial Sequence
  Description of Artificial Sequence: Synthetic oligonucleotide
  Target: ATXN1; (+) strand; PAM type: NNAGAAW; PAM sequence: GTAGAAA
agaggcacacaactcttttg

SEQ ID NO: 11177 - DNA, 20 bp, Artificial Sequence
  Description of Artificial Sequence: Synthetic oligonucleotide
  Target: ATXN1; (+) strand; PAM type: NNAGAAW; PAM sequence: ATAGAAT
tgttgtagattggtgacttt

SEQ ID NO: 11178 - DNA, 20 bp, Artificial Sequence
  Description of Artificial Sequence: Synthetic oligonucleotide
  Target: ATXN1; (+) strand; PAM type: NNAGAAW; PAM sequence: GGAGAAT
cgactcgggaggctgaggca

SEQ ID NO: 11179 - DNA, 20 bp, Artificial Sequence
  Description of Artificial Sequence: Synthetic oligonucleotide
  Target: ATXN1; (+) strand; PAM type: NNAGAAW; PAM sequence: ATAGAAA
tcatcatacatgtctccaat

SEQ ID NO: 11180 - DNA, 20 bp, Artificial Sequence
  Description of Artificial Sequence: Synthetic oligonucleotide
  Target: ATXN1; (+) strand; PAM type: NNAGAAW; PAM sequence: AAAGAAT
atggctagtcaagaagagca

SEQ ID NO: 11181 - DNA, 20 bp, Artificial Sequence
  Description of Artificial Sequence: Synthetic oligonucleotide
  Target: ATXN1; (+) strand; PAM type: NNAGAAW; PAM sequence: AAAGAAT
atggattcttcttcctataa

SEQ ID NO: 11182 - DNA, 20 bp, Artificial Sequence
  Description of Artificial Sequence: Synthetic oligonucleotide
  Target: ATXN1; (+) strand; PAM type: NNAGAAW; PAM sequence: CAAGAAA
ctctggaatgttcaactggc

SEQ ID NO: 11183 - DNA, 20 bp, Artificial Sequence
  Description of Artificial Sequence: Synthetic oligonucleotide
  Target: ATXN1; (+) strand; PAM type: NNAGAAW; PAM sequence: CCAGAAT
ctattttttgattcccctcc

SEQ ID NO: 11184 - DNA, 20 bp, Artificial Sequence
  Description of Artificial Sequence: Synthetic oligonucleotide
  Target: ATXN1; (+) strand; PAM type: NNAGAAW; PAM sequence: GTAGAAT
ggggatacaaaacttgtata

SEQ ID NO: 11185 - DNA, 20 bp, Artificial Sequence
  Description of Artificial Sequence: Synthetic oligonucleotide
  Target: ATXN1; (+) strand; PAM type: NNAGAAW; PAM sequence: CCAGAAA
tgtatcttgcttcattcaca

SEQ ID NO: 11186 - DNA, 20 bp, Artificial Sequence
  Description of Artificial Sequence: Synthetic oligonucleotide
  Target: ATXN1; (+) strand; PAM type: NNAGAAW; PAM sequence: GCAGAAA
attaacttaactcttctatg

SEQ ID NO: 11187 - DNA, 20 bp, Artificial Sequence
  Description of Artificial Sequence: Synthetic oligonucleotide
  Target: ATXN1; (+) strand; PAM type: NNAGAAW; PAM sequence: TGAGAAA
tattttaattcttttgattt

SEQ ID NO: 11188 - DNA, 20 bp, Artificial Sequence
  Description of Artificial Sequence: Synthetic oligonucleotide
  Target: ATXN1; (+) strand; PAM type: NNAGAAW; PAM sequence: TGAGAAA
gggatgttcccagctaaaaa

SEQ ID NO: 11189 - DNA, 20 bp, Artificial Sequence
  Description of Artificial Sequence: Synthetic oligonucleotide
  Target: ATXN1; (+) strand; PAM type: NNAGAAW; PAM sequence: ACAGAAA
ctaaaaatgagaaatcagag

SEQ ID NO: 11190 - DNA, 20 bp, Artificial Sequence
  Description of Artificial Sequence: Synthetic oligonucleotide
  Target: ATXN1; (+) strand; PAM type: NNAGAAW; PAM sequence: ATAGAAT
tggaattaagattgaccttt

SEQ ID NO: 11191 - DNA, 20 bp, Artificial Sequence
  Description of Artificial Sequence: Synthetic oligonucleotide
  Target: ATXN1; (+) strand; PAM type: NNAGAAW; PAM sequence: AGAGAAA
atcaaaaggaaggcagggaa

SEQ ID NO: 11192 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
aggaaggcagggaaagagaa

SEQ ID NO: 11193 - DNA, 20 bp, Artificial Sequence
  Description of Artificial Sequence: Synthetic oligonucleotide
  Target: ATXN1; (+) strand; PAM type: NNAGAAW; PAM sequence: GTAGAAT
ctacttgggaggctgaggca

SEQ ID NO: 11194 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
actccatctcaaaaaaaaaa

SEQ ID NO: 11195 - DNA, 20 bp, Artificial Sequence
  Description of Artificial Sequence: Synthetic oligonucleotide
  Target: ATXN1; (+) strand; PAM type: NNAGAAW; PAM sequence: GAAGAAA
aaaaaaagaaaggagtgatg

SEQ ID NO: 11196 - DNA, 20 bp, Artificial Sequence
  Description of Artificial Sequence: Synthetic oligonucleotide
  Target: ATXN1; (+) strand; PAM type: NNAGAAW; PAM sequence: GAAGAAT
gatggatggatggatggatg

SEQ ID NO: 11197 - DNA, 20 bp, Artificial Sequence
  Description of Artificial Sequence: Synthetic oligonucleotide
  Target: ATXN1; (+) strand; PAM type: NNAGAAW; PAM sequence: GGAGAAA
caagggaggaaggaaaaaag

SEQ ID NO: 11198 - DNA, 20 bp, Artificial Sequence
  Description of Artificial Sequence: Synthetic oligonucleotide
  Target: ATXN1; (+) strand; PAM type: NNAGAAW; PAM sequence: CAAGAAA
ataactattgggttagacta

SEQ ID NO: 11199 - DNA, 20 bp, Artificial Sequence
  Description of Artificial Sequence: Synthetic oligonucleotide
  Target: ATXN1; (+) strand; PAM type: NNAGAAW; PAM sequence: TCAGAAT
aatacagataataaattcta

SEQ ID NO: 11200 - DNA, 20 bp, Artificial Sequence
  Description of Artificial Sequence: Synthetic oligonucleotide
  Target: ATXN1; (+) strand; PAM type: NNAGAAW; PAM sequence: GCAGAAT
cttgtttttttctggtggga

SEQ ID NO: 11201 - DNA, 20 bp, Artificial Sequence
  Description of Artificial Sequence: Synthetic oligonucleotide
  Target: ATXN1; (+) strand; PAM type: NNAGAAW; PAM sequence: CCAGAAA
aacatttgctttcagaagcc

SEQ ID NO: 11202 - DNA, 20 bp, Artificial Sequence
  Description of Artificial Sequence: Synthetic oligonucleotide
  Target: ATXN1; (+) strand; PAM type: NNAGAAW; PAM sequence: CCAGAAA
gagagagcaaggggcaggtt

SEQ ID NO: 11203 - DNA, 20 bp, Artificial Sequence
  Description of Artificial Sequence: Synthetic oligonucleotide
  Target: ATXN1; (+) strand; PAM type: NNAGAAW; PAM sequence: CCAGAAA
gccacataattcttaaacaa

SEQ ID NO: 11204 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
gactaaacagctgtgggcat

SEQ ID NO: 11205 - DNA, 20 bp, Artificial Sequence
  Description of Artificial Sequence: Synthetic oligonucleotide
  Target: ATXN1; (+) strand; PAM type: NNAGAAW; PAM sequence: TTAGAAA
aaaaaataaattccattatt

SEQ ID NO: 11206 - DNA, 20 bp, Artificial Sequence
  Description of Artificial Sequence: Synthetic oligonucleotide
  Target: ATXN1; (+) strand; PAM type: NNAGAAW; PAM sequence: TGAGAAT
tccacccttcattatttctt

SEQ ID NO: 11207 - DNA, 20 bp, Artificial Sequence
  Description of Artificial Sequence: Synthetic oligonucleotide
  Target: ATXN1; (+) strand; PAM type: NNAGAAW; PAM sequence: GAAGAAA
ctctatctctgttcctcttg

SEQ ID NO: 11208 - DNA, 20 bp, Artificial Sequence
  Description of Artificial Sequence: Synthetic oligonucleotide
  Target: ATXN1; (+) strand; PAM type: NNAGAAW; PAM sequence: CAAGAAT
tgccactgaggacaagggaa

SEQ ID NO: 11209 - DNA, 20 bp, Artificial Sequence
  Description of Artificial Sequence: Synthetic oligonucleotide
  Target: ATXN1; (+) strand; PAM type: NNAGAAW; PAM sequence: CAAGAAA
tctcagctgtaattctatcc

SEQ ID NO: 11210 - DNA, 20 bp, Artificial Sequence
  Description of Artificial Sequence: Synthetic oligonucleotide
  Target: ATXN1; (+) strand; PAM type: NNAGAAW; PAM sequence: GAAGAAA
agtcctaaagaacactaata

SEQ ID NO: 11211 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
aaagaacactaatagaagaa

SEQ ID NO: 11212 - DNA, 20 bp, Artificial Sequence
  Description of Artificial Sequence: Synthetic oligonucleotide
  Target: ATXN1; (+) strand; PAM type: NNAGAAW; PAM sequence: CAAGAAA
gaaacctcccagcaggaaaa

SEQ ID NO: 11213 - DNA, 20 bp, Artificial Sequence
  Description of Artificial Sequence: Synthetic oligonucleotide
  Target: ATXN1; (+) strand; PAM type: NNAGAAW; PAM sequence: TCAGAAA
aacatgggtcaggaagaacc

SEQ ID NO: 11214 - DNA, 20 bp, Artificial Sequence
  Description of Artificial Sequence: Synthetic oligonucleotide
  Target: ATXN1; (+) strand; PAM type: NNAGAAW; PAM sequence: AGAGAAA
ttggactagaacaacctatg

SEQ ID NO: 11215 - DNA, 20 bp, Artificial Sequence
  Description of Artificial Sequence: Synthetic oligonucleotide
  Target: ATXN1; (+) strand; PAM type: NNAGAAW; PAM sequence: GCAGAAA
ccacctctgttaactacgct

SEQ ID NO: 11216 - DNA, 20 bp, Artificial Sequence
  Description of Artificial Sequence: Synthetic oligonucleotide
  Target: ATXN1; (+) strand; PAM type: NNAGAAW; PAM sequence: TTAGAAA
ccataagccagagatgttca

SEQ ID NO: 11217 - DNA, 20 bp, Artificial Sequence
  Description of Artificial Sequence: Synthetic oligonucleotide
  Target: ATXN1; (+) strand; PAM type: NNAGAAW; PAM sequence: ACAGAAA
tcccttggtctggcatgctg

SEQ ID NO: 11218 - DNA, 20 bp, Artificial Sequence
  Description of Artificial Sequence: Synthetic oligonucleotide
  Target: ATXN1; (+) strand; PAM type: NNAGAAW; PAM sequence: GAAGAAT
agggctggtttttttttttt

SEQ ID NO: 11219 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
aaattttctttaggacaacg

SEQ ID NO: 11220 - DNA, 20 bp, Artificial Sequence
  Description of Artificial Sequence: Synthetic oligonucleotide
  Target: ATXN1; (+) strand; PAM type: NNAGAAW; PAM sequence: CCAGAAA
acaccctcccacttctggct

SEQ ID NO: 11221 - DNA, 20 bp, Artificial Sequence
  Description of Artificial Sequence: Synthetic oligonucleotide
  Target: ATXN1; (+) strand; PAM type: NNAGAAW; PAM sequence: TCAGAAT
cacctccccgcccccattat

SEQ ID NO: 11222 - DNA, 20 bp, Artificial Sequence
  Description of Artificial Sequence: Synthetic oligonucleotide
  Target: ATXN1; (+) strand; PAM type: NNAGAAW; PAM sequence: CTAGAAT
aaagccagcagtactccctg

SEQ ID NO: 11223 - DNA, 20 bp, Artificial Sequence
  Description of Artificial Sequence: Synthetic oligonucleotide
  Target: ATXN1; (+) strand; PAM type: NNAGAAW; PAM sequence: GAAGAAA
agtactccctgctagaatct

SEQ ID NO: 11224 - DNA, 20 bp, Artificial Sequence
  Description of Artificial Sequence: Synthetic oligonucleotide
  Target: ATXN1; (+) strand; PAM type: NNAGAAW; PAM sequence: AAAGAAT
tccctgctagaatctgaaga

SEQ ID NO: 11225 - DNA, 20 bp, Artificial Sequence
  Description of Artificial Sequence: Synthetic oligonucleotide
  Target: ATXN1; (+) strand; PAM type: NNAGAAW; PAM sequence: GCAGAAA
ttcaataaattattttaaga

SEQ ID NO: 11226 - DNA, 20 bp, Artificial Sequence
  Description of Artificial Sequence: Synthetic oligonucleotide
  Target: ATXN1; (+) strand; PAM type: NNAGAAW; PAM sequence: TAAGAAA
actgtcctaattaagaccaa

SEQ ID NO: 11227 - DNA, 20 bp, Artificial Sequence
  Description of Artificial Sequence: Synthetic oligonucleotide
  Target: ATXN1; (+) strand; PAM type: NNAGAAW; PAM sequence: CTAGAAA
actcagtatttctctctagg

SEQ ID NO: 11228 - DNA, 20 bp, Artificial Sequence
  Description of Artificial Sequence: Synthetic oligonucleotide
  Target: ATXN1; (+) strand; PAM type: NNAGAAW; PAM sequence: ACAGAAA
tatttctctctaggctagaa

SEQ ID NO: 11229 - DNA, 20 bp, Artificial Sequence
  Description of Artificial Sequence: Synthetic oligonucleotide
  Target: ATXN1; (+) strand; PAM type: NNAGAAW; PAM sequence: CAAGAAA
atttttccatcaatgaaaag

SEQ ID NO: 11230 - DNA, 20 bp, Artificial Sequence
  Description of Artificial Sequence: Synthetic oligonucleotide
  Target: ATXN1; (+) strand; PAM type: NNAGAAW; PAM sequence: CAAGAAA
aggaaagtccatcaaataaa

SEQ ID NO: 11231 - DNA, 20 bp, Artificial Sequence
  Description of Artificial Sequence: Synthetic oligonucleotide
  Target: ATXN1; (+) strand; PAM type: NNAGAAW; PAM sequence: AGAGAAT
gtgcactactccatatgctc

SEQ ID NO: 11232 - DNA, 20 bp, Artificial Sequence
  Description of Artificial Sequence: Synthetic oligonucleotide
  Target: ATXN1; (+) strand; PAM type: NNAGAAW; PAM sequence: TGAGAAA
gctgtctgcttgctagtata

SEQ ID NO: 11233 - DNA, 20 bp, Artificial Sequence
  Description of Artificial Sequence: Synthetic oligonucleotide
  Target: ATXN1; (+) strand; PAM type: NNAGAAW; PAM sequence: TGAGAAA
taaactttcgactttcgtga

SEQ ID NO: 11234 - DNA, 20 bp, Artificial Sequence
  Description of Artificial Sequence: Synthetic oligonucleotide
  Target: ATXN1; (+) strand; PAM type: NNAGAAW; PAM sequence: TAAGAAT
tggatgctaccaataaaatc

SEQ ID NO: 11235 - DNA, 20 bp, Artificial Sequence
  Description of Artificial Sequence: Synthetic oligonucleotide
  Target: ATXN1; (+) strand; PAM type: NNAGAAW; PAM sequence: TAAGAAA
ctctgaaaagtacaatgtat

SEQ ID NO: 11236 - DNA, 20 bp, Artificial Sequence
  Description of Artificial Sequence: Synthetic oligonucleotide
  Target: ATXN1; (+) strand; PAM type: NNAGAAW; PAM sequence: GTAGAAA
gagagattaaactcagagtt

SEQ ID NO: 11237 - DNA, 20 bp, Artificial Sequence
  Description of Artificial Sequence: Synthetic oligonucleotide
  Target: ATXN1; (+) strand; PAM type: NNAGAAW; PAM sequence: TTAGAAA
ctcagagttgtagaaaaagt

SEQ ID NO: 11238 - DNA, 20 bp, Artificial Sequence
  Description of Artificial Sequence: Synthetic oligonucleotide
  Target: ATXN1; (+) strand; PAM type: NNAGAAW; PAM sequence: TTAGAAT
gaaaaagtttagaaacggat

SEQ ID NO: 11239 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
gatttagaatttcgcaggaa

SEQ ID NO: 11240 - DNA, 20 bp, Artificial Sequence
  Description of Artificial Sequence: Synthetic oligonucleotide
  Target: ATXN1; (+) strand; PAM type: NNAGAAW; PAM sequence: GAAGAAA
ataagcagcctggaatcaaa

SEQ ID NO: 11241 - DNA, 20 bp, Artificial Sequence
  Description of Artificial Sequence: Synthetic oligonucleotide
  Target: ATXN1; (+) strand; PAM type: NNAGAAW; PAM sequence: GAAGAAT
cacggaggatacagcaccgt

SEQ ID NO: 11242 - DNA, 20 bp, Artificial Sequence
  Description of Artificial Sequence: Synthetic oligonucleotide
  Target: ATXN1; (+) strand; PAM type: NNAGAAW; PAM sequence: TTAGAAT
tttagtctgtatatttatat

SEQ ID NO: 11243 - DNA, 20 bp, Artificial Sequence
  Description of Artificial Sequence: Synthetic oligonucleotide
  Target: ATXN1; (+) strand; PAM type: NNAGAAW; PAM sequence: CCAGAAA
gctgtataaaatcatagcaa

SEQ ID NO: 11244 - DNA, 20 bp, Artificial Sequence
  Description of Artificial Sequence: Synthetic oligonucleotide
  Target: ATXN1; (+) strand; PAM type: NNAGAAW; PAM sequence: GCAGAAA
aaaggaaacaaacacctctg

SEQ ID NO: 11245 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
ccaaacaaagtataaggcat

SEQ ID NO: 11246 - DNA, 20 bp, Artificial Sequence
  Description of Artificial Sequence: Synthetic oligonucleotide
  Target: ATXN1; (+) strand; PAM type: NNAGAAW; PAM sequence: TGAGAAT
acaatattgatgaatttcca

SEQ ID NO: 11247 - DNA, 20 bp, Artificial Sequence
  Description of Artificial Sequence: Synthetic oligonucleotide
  Target: ATXN1; (+) strand; PAM type: NNAGAAW; PAM sequence: TGAGAAA
ggtctcccatgcttatgaat

SEQ ID NO: 11248 - DNA, 20 bp, Artificial Sequence
  Description of Artificial Sequence: Synthetic oligonucleotide
  Target: ATXN1; (+) strand; PAM type: NNAGAAW; PAM sequence: GAAGAAA
cacacttgatataagtaaat

SEQ ID NO: 11249 - DNA, 20 bp, Artificial Sequence
  Description of Artificial Sequence: Synthetic oligonucleotide
  Target: ATXN1; (+) strand; PAM type: NNAGAAW; PAM sequence: ACAGAAA
gttgaaacagccctgaagtg

SEQ ID NO: 11250 - DNA, 20 bp, Artificial Sequence
  Description of Artificial Sequence: Synthetic oligonucleotide
  Target: ATXN1; (+) strand; PAM type: NNAGAAW; PAM sequence: ACAGAAT
aactccagaggcaaggtggt

SEQ ID NO: 11251 - DNA, 20 bp, Artificial Sequence
  Description of Artificial Sequence: Synthetic oligonucleotide
  Target: ATXN1; (+) strand; PAM type: NNAGAAW; PAM sequence: AGAGAAT
aacagggtaattgtgcaaag

SEQ ID NO: 11252 - DNA, 20 bp, Artificial Sequence
  Description of Artificial Sequence: Synthetic oligonucleotide
  Target: ATXN1; (+) strand; PAM type: NNAGAAW; PAM sequence: CCAGAAA
attttgtgtatgtccccttt

SEQ ID NO: 11253 - DNA, 20 bp, Artificial Sequence
  Description of Artificial Sequence: Synthetic oligonucleotide
  Target: ATXN1; (+) strand; PAM type: NNAGAAW; PAM sequence: TCAGAAA
ataatcctgtacaatgggtc

SEQ ID NO: 11254 - DNA, 20 bp, Artificial Sequence
  Description of Artificial Sequence: Synthetic oligonucleotide
  Target: ATXN1; (+) strand; PAM type: NNAGAAW; PAM sequence: CCAGAAT
agagaggaagatgacacaag

SEQ ID NO: 11255 - DNA, 20 bp, Artificial Sequence
  Description of Artificial Sequence: Synthetic oligonucleotide
  Target: ATXN1; (+) strand; PAM type: NNAGAAW; PAM sequence: TCAGAAT
agagtcatgatgagcttgat

SEQ ID NO: 11256 - DNA, 20 bp, Artificial Sequence
  Description of Artificial Sequence: Synthetic oligonucleotide
  Target: ATXN1; (+) strand; PAM type: NNAGAAW; PAM sequence: TGAGAAA
gaaaatatatttccatttat

SEQ ID NO: 11257 - DNA, 20 bp, Artificial Sequence
  Description of Artificial Sequence: Synthetic oligonucleotide
  Target: ATXN1; (+) strand; PAM type: NNAGAAW; PAM sequence: ACAGAAT
tgtttaggaacatatgaatc

SEQ ID NO: 11258 - DNA, 20 bp, Artificial Sequence
  Description of Artificial Sequence: Synthetic oligonucleotide
  Target: ATXN1; (+) strand; PAM type: NNAGAAW; PAM sequence: TTAGAAA
attgtagattggcagaggcc

SEQ ID NO: 11259 - DNA, 20 bp, Artificial Sequence
  Description of Artificial Sequence: Synthetic oligonucleotide
  Target: ATXN1; (+) strand; PAM type: NNAGAAW; PAM sequence: TGAGAAA
atttcgacttctactaataa

SEQ ID NO: 11260 - DNA, 20 bp, Artificial Sequence
  Description of Artificial Sequence: Synthetic oligonucleotide
  Target: ATXN1; (+) strand; PAM type: NNAGAAW; PAM sequence: GCAGAAT
agacctgaccatactgtggg

SEQ ID NO: 11261 - DNA, 20 bp, Artificial Sequence
  Description of Artificial Sequence: Synthetic oligonucleotide
  Target: ATXN1; (+) strand; PAM type: NNAGAAW; PAM sequence: TGAGAAT
aatgactaagctctgaaaac

SEQ ID NO: 11262 - DNA, 20 bp, Artificial Sequence
  Description of Artificial Sequence: Synthetic oligonucleotide
  Target: ATXN1; (+) strand; PAM type: NNAGAAW; PAM sequence: GAAGAAA
aaactgagaatgagacaaag

SEQ ID NO: 11263 - DNA, 20 bp, Artificial Sequence
  Description of Artificial Sequence: Synthetic oligonucleotide
  Target: ATXN1; (+) strand; PAM type: NNAGAAW; PAM sequence: GCAGAAA
ggaatttcattgtaagtgtc

SEQ ID NO: 11264 - DNA, 20 bp, Artificial Sequence
  Description of Artificial Sequence: Synthetic oligonucleotide
  Target: ATXN1; (+) strand; PAM type: NNAGAAW; PAM sequence: GAAGAAA
aaacttccacatggaatgaa

SEQ ID NO: 11265 - DNA, 20 bp, Artificial Sequence
  Description of Artificial Sequence: Synthetic oligonucleotide
  Target: ATXN1; (+) strand; PAM type: NNAGAAW; PAM sequence: CAAGAAA
tacaggctgaagtacaatgt

SEQ ID NO: 11266 - DNA, 20 bp, Artificial Sequence
  Description of Artificial Sequence: Synthetic oligonucleotide
  Target: ATXN1; (+) strand; PAM type: NNAGAAW; PAM sequence: TAAGAAA
agatactctgaacagataaa

SEQ ID NO: 11267 - DNA, 20 bp, Artificial Sequence
  Description of Artificial Sequence: Synthetic oligonucleotide
  Target: ATXN1; (+) strand; PAM type: NNAGAAW; PAM sequence: TTAGAAT
tgtgagccttagaacaagcc

SEQ ID NO: 11268 - DNA, 20 bp, Artificial Sequence
  Description of Artificial Sequence: Synthetic oligonucleotide
  Target: ATXN1; (+) strand; PAM type: NNAGAAW; PAM sequence: GTAGAAT
ctactcaggaggctgagaca

SEQ ID NO: 11269 - DNA, 20 bp, Artificial Sequence
  Description of Artificial Sequence: Synthetic oligonucleotide
  Target: ATXN1; (+) strand; PAM type: NNAGAAW; PAM sequence: CAAGAAA
atttgtctattttaaagact

SEQ ID NO: 11270 - DNA, 20 bp, Artificial Sequence
  Description of Artificial Sequence: Synthetic oligonucleotide
  Target: ATXN1; (+) strand; PAM type: NNAGAAW; PAM sequence: TGAGAAT
agtggcctcagctctgaaga

SEQ ID NO: 11271 - DNA, 20 bp, Artificial Sequence
  Description of Artificial Sequence: Synthetic oligonucleotide
  Target: ATXN1; (+) strand; PAM type: NNAGAAW; PAM sequence: CAAGAAA
gcttcctttccagaacatca

SEQ ID NO: 11272 - DNA, 20 bp, Artificial Sequence
  Description of Artificial Sequence: Synthetic oligonucleotide
  Target: ATXN1; (+) strand; PAM type: NNAGAAW; PAM sequence: TGAGAAT
ctattccattctctcctgcc

SEQ ID NO: 11273 - DNA, 20 bp, Artificial Sequence
  Description of Artificial Sequence: Synthetic oligonucleotide
  Target: ATXN1; (+) strand; PAM type: NNAGAAW; PAM sequence: GCAGAAA
tcttcaaggatcactaatgt

SEQ ID NO: 11274 - DNA, 20 bp, Artificial Sequence
  Description of Artificial Sequence: Synthetic oligonucleotide
  Target: ATXN1; (+) strand; PAM type: NNAGAAW; PAM sequence: TAAGAAT
aaatagacttttgttcttgc

SEQ ID NO: 11275 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
tcacaattgtcccttcttta

SEQ ID NO: 11276 - DNA, 20 bp, Artificial Sequence
  Description of Artificial Sequence: Synthetic oligonucleotide
  Target: ATXN1; (+) strand; PAM type: NNAGAAW; PAM sequence: TTAGAAA
gattatgttatcttttccga

SEQ ID NO: 11277 - DNA, 20 bp, Artificial Sequence
  Description of Artificial Sequence: Synthetic oligonucleotide
  Target: ATXN1; (+) strand; PAM type: NNAGAAW; PAM sequence: AGAGAAA
gactacatttcagagctgag

SEQ ID NO: 11278 - DNA, 20 bp, Artificial Sequence
  Description of Artificial Sequence: Synthetic oligonucleotide
  Target: ATXN1; (+) strand; PAM type: NNAGAAW; PAM sequence: GGAGAAT
ccaactcacatctcctctct

SEQ ID NO: 11279 - DNA, 20 bp, Artificial Sequence
  Description of Artificial Sequence: Synthetic oligonucleotide
  Target: ATXN1; (+) strand; PAM type: NNAGAAW; PAM sequence: CCAGAAT
tttttagacagtcctgattg

SEQ ID NO: 11280 - DNA, 20 bp, Artificial Sequence
  Description of Artificial Sequence: Synthetic oligonucleotide
  Target: ATXN1; (+) strand; PAM type: NNAGAAW; PAM sequence: TGAGAAA
catcacatacactgtttctc

SEQ ID NO: 11281 - DNA, 20 bp, Artificial Sequence
  Description of Artificial Sequence: Synthetic oligonucleotide
  Target: ATXN1; (+) strand; PAM type: NNAGAAW; PAM sequence: TGAGAAA
tttgggaaaaatctgtttca

SEQ ID NO: 11282 - DNA, 20 bp, Artificial Sequence
  Description of Artificial Sequence: Synthetic oligonucleotide
  Target: ATXN1; (+) strand; PAM type: NNAGAAW; PAM sequence: CTAGAAA
ctgtggttaacactgaagtt

SEQ ID NO: 11283 - DNA, 20 bp, Artificial Sequence
  Description of Artificial Sequence: Synthetic oligonucleotide
  Target: ATXN1; (+) strand; PAM type: NNAGAAW; PAM sequence: TGAGAAT
taggtggagagagctaggaa

SEQ ID NO: 11284 - DNA, 20 bp, Artificial Sequence
  Description of Artificial Sequence: Synthetic oligonucleotide
  Target: ATXN1; (+) strand; PAM type: NNAGAAW; PAM sequence: GAAGAAT
gacagaggctgtggcatcga

SEQ ID NO: 11285 - DNA, 20 bp, Artificial Sequence
  Description of Artificial Sequence: Synthetic oligonucleotide
  Target: ATXN1; (+) strand; PAM type: NNAGAAW; PAM sequence: ACAGAAA
tatgtcgaggtaataacttc

SEQ ID NO: 11286 - DNA, 20 bp, Artificial Sequence
  Description of Artificial Sequence: Synthetic oligonucleotide
  Target: ATXN1; (+) strand; PAM type: NNAGAAW; PAM sequence: CAAGAAA
cagaaatgacaataagtctc

SEQ ID NO: 11287 - DNA, 20 bp, Artificial Sequence
  Description of Artificial Sequence: Synthetic oligonucleotide
  Target: ATXN1; (+) strand; PAM type: NNAGAAW; PAM sequence: AGAGAAA
taaatatttaaatctttact

SEQ ID NO: 11288 - DNA, 20 bp, Artificial Sequence
  Description of Artificial Sequence: Synthetic oligonucleotide
  Target: ATXN1; (+) strand; PAM type: NNAGAAW; PAM sequence: TAAGAAT
aataatcattgaggaactct

SEQ ID NO: 11289 - DNA, 20 bp, Artificial Sequence
  Description of Artificial Sequence: Synthetic oligonucleotide
  Target: ATXN1; (+) strand; PAM type: NNAGAAW; PAM sequence: AGAGAAT
cctccagcttaggcgacctg

SEQ ID NO: 11290 - DNA, 20 bp, Artificial Sequence
  Description of Artificial Sequence: Synthetic oligonucleotide
  Target: ATXN1; (+) strand; PAM type: NNAGAAW; PAM sequence: TCAGAAT
gaatttttaaaaccctcttt

SEQ ID NO: 11291 - DNA, 20 bp, Artificial Sequence
  Description of Artificial Sequence: Synthetic oligonucleotide
  Target: ATXN1; (+) strand; PAM type: NNAGAAW; PAM sequence: AGAGAAA
ttctccccttctcatttcca

SEQ ID NO: 11292 - DNA, 20 bp, Artificial Sequence
  Description of Artificial Sequence: Synthetic oligonucleotide
  Target: ATXN1; (+) strand; PAM type: NNAGAAW; PAM sequence: TTAGAAT
cccagttaaggagacgccat

SEQ ID NO: 11293 - DNA, 20 bp, Artificial Sequence
  Description of Artificial Sequence: Synthetic oligonucleotide
  Target: ATXN1; (+) strand; PAM type: NNAGAAW; PAM sequence: GCAGAAT
cggaagctttgccccagaga

SEQ ID NO: 11294 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
catgcacagaggtgacgggg

SEQ ID NO: 11295 - DNA, 20 bp, Artificial Sequence
  Description of Artificial Sequence: Synthetic oligonucleotide
  Target: ATXN1; (+) strand; PAM type: NNAGAAW; PAM sequence: ACAGAAA
tgtatggtttaagaagttaa

SEQ ID NO: 11296 - DNA, 20 bp, Artificial Sequence
  Description of Artificial Sequence: Synthetic oligonucleotide
  Target: ATXN1; (+) strand; PAM type: NNAGAAW; PAM sequence: AGAGAAA
aagttaaacagaaagttaac

SEQ ID NO: 11297 - DNA, 20 bp, Artificial Sequence
  Description of Artificial Sequence: Synthetic oligonucleotide
  Target: ATXN1; (+) strand; PAM type: NNAGAAW; PAM sequence: TGAGAAT
gagaaactgttcttgaagta

SEQ ID NO: 11298 - DNA, 20 bp, Artificial Sequence
  Description of Artificial Sequence: Synthetic oligonucleotide
  Target: ATXN1; (+) strand; PAM type: NNAGAAW; PAM sequence: GCAGAAA
ctaagctaattttttaaaag

SEQ ID NO: 11299 - DNA, 20 bp, Artificial Sequence
  Description of Artificial Sequence: Synthetic oligonucleotide
  Target: ATXN1; (+) strand; PAM type: NNAGAAW; PAM sequence: CCAGAAA
ttaaaaggcagaaaatctaa

SEQ ID NO: 11300 - DNA, 20 bp, Artificial Sequence
  Description of Artificial Sequence: Synthetic oligonucleotide
  Target: ATXN1; (+) strand; PAM type: NNAGAAW; PAM sequence: AAAGAAT
aggcagaaaatctaaccaga

SEQ ID NO: 11301 - DNA, 20 bp, Artificial Sequence
  Description of Artificial Sequence: Synthetic oligonucleotide
  Target: ATXN1; (+) strand; PAM type: NNAGAAW; PAM sequence: CCAGAAA
ttgtacaacataaactttgt

SEQ ID NO: 11302 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
aaatcagtatctgctcttcc

SEQ ID NO: 11303 - DNA, 20 bp, Artificial Sequence
  Description of Artificial Sequence: Synthetic oligonucleotide
  Target: ATXN1; (+) strand; PAM type: NNAGAAW; PAM sequence: GCAGAAA
aagggttcagtagctccacg

SEQ ID NO: 11304 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
gttcagtagctccacggcag

SEQ ID NO: 11305 - DNA, 20 bp, Artificial Sequence
  Description of Artificial Sequence: Synthetic oligonucleotide
  Target: ATXN1; (+) strand; PAM type: NNAGAAW; PAM sequence: TTAGAAA
ctgtcatccatctgaacctg

SEQ ID NO: 11306 - DNA, 20 bp, Artificial Sequence
  Description of Artificial Sequence: Synthetic oligonucleotide
  Target: ATXN1; (+) strand; PAM type: NNAGAAW; PAM sequence: ATAGAAT
ttagaaatctcaagctcgtc

SEQ ID NO: 11307 - DNA, 20 bp, Artificial Sequence
  Description of Artificial Sequence: Synthetic oligonucleotide
  Target: ATXN1; (+) strand; PAM type: NNAGAAW; PAM sequence: GAAGAAA
cagacactgaaaggtgataa

SEQ ID NO: 11308 - DNA, 20 bp, Artificial Sequence
  Description of Artificial Sequence: Synthetic oligonucleotide
  Target: ATXN1; (+) strand; PAM type: NNAGAAW; PAM sequence: TAAGAAT
cagactcgcatgattctgag

SEQ ID NO: 11309 - DNA, 20 bp, Artificial Sequence
  Description of Artificial Sequence: Synthetic oligonucleotide
  Target: ATXN1; (+) strand; PAM type: NNAGAAW; PAM sequence: GAAGAAA
agaatcaactgtgtccctta

SEQ ID NO: 11310 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
taaaatgatccgctgaatga

SEQ ID NO: 11311 - DNA, 20 bp, Artificial Sequence
  Description of Artificial Sequence: Synthetic oligonucleotide
  Target: ATXN1; (+) strand; PAM type: NNAGAAW; PAM sequence: AGAGAAA
ggcagtttgtgctttgcagc

SEQ ID NO: 11312 - DNA, 20 bp, Artificial Sequence
  Description of Artificial Sequence: Synthetic oligonucleotide
  Target: ATXN1; (+) strand; PAM type: NNAGAAW; PAM sequence: GAAGAAT
gagcaaggtgctcaactctt

SEQ ID NO: 11313 - DNA, 20 bp, Artificial Sequence
  Description of Artificial Sequence: Synthetic oligonucleotide
  Target: ATXN1; (+) strand; PAM type: NNAGAAW; PAM sequence: GCAGAAA
tacttctctgcatctggggt

SEQ ID NO: 11314 - DNA, 20 bp, Artificial Sequence
  Description of Artificial Sequence: Synthetic oligonucleotide
  Target: ATXN1; (+) strand; PAM type: NNAGAAW; PAM sequence: GAAGAAA
aagtggaaaacagatcttaa

SEQ ID NO: 11315 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
aaaacagatcttaagaagaa

SEQ ID NO: 11316 - DNA, 20 bp, Artificial Sequence
  Description of Artificial Sequence: Synthetic oligonucleotide
  Target: ATXN1; (+) strand; PAM type: NNAGAAW; PAM sequence: ACAGAAA
gccattaaaaaagtttagat

SEQ ID NO: 11317 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
tttagatacagaaactacac

SEQ ID NO: 11318 - DNA, 20 bp, Artificial Sequence
  Description of Artificial Sequence: Synthetic oligonucleotide
  Target: ATXN1; (+) strand; PAM type: NNAGAAW; PAM sequence: CTAGAAA
cagatgacatgatcatatat

SEQ ID NO: 11319 - DNA, 20 bp, Artificial Sequence
  Description of Artificial Sequence: Synthetic oligonucleotide
  Target: ATXN1; (+) strand; PAM type: NNAGAAW; PAM sequence: AGAGAAT
cctattcacaactgcttcaa

SEQ ID NO: 11320 - DNA, 20 bp, Artificial Sequence
  Description of Artificial Sequence: Synthetic oligonucleotide
  Target: ATXN1; (+) strand; PAM type: NNAGAAW; PAM sequence: ACAGAAT
agctaccaatgactttcttc

SEQ ID NO: 11321 - DNA, 20 bp, Artificial Sequence
  Description of Artificial Sequence: Synthetic oligonucleotide
  Target: ATXN1; (+) strand; PAM type: NNAGAAW; PAM sequence: TCAGAAA
aatggaacagaacagagccc

SEQ ID NO: 11322 - DNA, 20 bp, Artificial Sequence
  Description of Artificial Sequence: Synthetic oligonucleotide
  Target: ATXN1; (+) strand; PAM type: NNAGAAW; PAM sequence: CAAGAAA
tttgacaaacctgacaaaaa

SEQ ID NO: 11323 - DNA, 20 bp, Artificial Sequence
  Description of Artificial Sequence: Synthetic oligonucleotide
  Target: ATXN1; (+) strand; PAM type: NNAGAAW; PAM sequence: GTAGAAA
ggaaaactggctagccatat

SEQ ID NO: 11324 - DNA, 20 bp, Artificial Sequence
  Description of Artificial Sequence: Synthetic oligonucleotide
  Target: ATXN1; (+) strand; PAM type: NNAGAAW; PAM sequence: GAAGAAA
ctaaaaccataaaaacccta

SEQ ID NO: 11325 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
taaagagcttctgcacagcc

SEQ ID NO: 11326 - DNA, 20 bp, Artificial Sequence
  Description of Artificial Sequence: Synthetic oligonucleotide
  Target: ATXN1; (+) strand; PAM type: NNAGAAW; PAM sequence: ACAGAAT
tcggagtgaacaggcaacct

SEQ ID NO: 11327 - DNA, 20 bp, Artificial Sequence
  Description of Artificial Sequence: Synthetic oligonucleotide
  Target: ATXN1; (+) strand; PAM type: NNAGAAW; PAM sequence: GGAGAAA
aacaggcaacctacagaatg

SEQ ID NO: 11328 - DNA, 20 bp, Artificial Sequence
  Description of Artificial Sequence: Synthetic oligonucleotide
  Target: ATXN1; (+) strand; PAM type: NNAGAAW; PAM sequence: CCAGAAT
atcggacaaagggctaatat

SEQ ID NO: 11329 - DNA, 20 bp, Artificial Sequence
  Description of Artificial Sequence: Synthetic oligonucleotide
  Target: ATXN1; (+) strand; PAM type: NNAGAAW; PAM sequence: CAAGAAA
aaagaactcaaacaaattta

SEQ ID NO: 11330 - DNA, 20 bp, Artificial Sequence
  Description of Artificial Sequence: Synthetic oligonucleotide
  Target: ATXN1; (+) strand; PAM type: NNAGAAW; PAM sequence: AGAGAAA
gctcatcatcactggccatc

SEQ ID NO: 11331 - DNA, 20 bp, Artificial Sequence
  Description of Artificial Sequence: Synthetic oligonucleotide
  Target: ATXN1; (+) strand; PAM type: NNAGAAW; PAM sequence: TTAGAAT
gacataccatctcacaccag

SEQ ID NO: 11332 - DNA, 20 bp, Artificial Sequence
  Description of Artificial Sequence: Synthetic oligonucleotide
  Target: ATXN1; (+) strand; PAM type: NNAGAAW; PAM sequence: CTAGAAA
gattcctcagggatctagaa

SEQ ID NO: 11333 - DNA, 20 bp, Artificial Sequence
  Description of Artificial Sequence: Synthetic oligonucleotide
  Target: ATXN1; (+) strand; PAM type: NNAGAAW; PAM sequence: TAAGAAA
ccaacaatgataaactgcat

SEQ ID NO: 11334 - DNA, 20 bp, Artificial Sequence
  Description of Artificial Sequence: Synthetic oligonucleotide
  Target: ATXN1; (+) strand; PAM type: NNAGAAW; PAM sequence: GGAGAAT
ctacccgggagcctgagcca

SEQ ID NO: 11335 - DNA, 20 bp, Artificial Sequence
  Description of Artificial Sequence: Synthetic oligonucleotide
  Target: ATXN1; (+) strand; PAM type: NNAGAAW; PAM sequence: ACAGAAT
ccaagattgactgtcggtct

SEQ ID NO: 11336 - DNA, 20 bp, Artificial Sequence
  Description of Artificial Sequence: Synthetic oligonucleotide
  Target: ATXN1; (+) strand; PAM type: NNAGAAW; PAM sequence: TAAGAAT
ctcctgcgaggcgctccctc

SEQ ID NO: 11337 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
gcagggatcagagggtgagc

SEQ ID NO: 11338 - DNA, 20 bp, Artificial Sequence
  Description of Artificial Sequence: Synthetic oligonucleotide
  Target: ATXN1; (+) strand; PAM type: NNAGAAW; PAM sequence: ACAGAAT
tgagcaaagaaattaatgat

SEQ ID NO: 11339 - DNA, 20 bp, Artificial Sequence
  Description of Artificial Sequence: Synthetic oligonucleotide
  Target: ATXN1; (+) strand; PAM type: NNAGAAW; PAM sequence: GCAGAAT
gacccaaactgaatgatgga

SEQ ID NO: 11340 - DNA, 20 bp, Artificial Sequence
  Description of Artificial Sequence: Synthetic oligonucleotide
  Target: ATXN1; (+) strand; PAM type: NNAGAAW; PAM sequence: ACAGAAT
atgccaaatgcatagcacta

SEQ ID NO: 11341 - DNA, 20 bp, Artificial Sequence
  Description of Artificial Sequence: Synthetic oligonucleotide
  Target: ATXN1; (+) strand; PAM type: NNAGAAW; PAM sequence: GCAGAAT
ctttagcctcaatacctaga

SEQ ID NO: 11342 - DNA, 20 bp, Artificial Sequence
  Description of Artificial Sequence: Synthetic oligonucleotide
  Target: ATXN1; (+) strand; PAM type: NNAGAAW; PAM sequence: CAAGAAA
tttggcgcccaatacgtatg

SEQ ID NO: 11343 - DNA, 20 bp, Artificial Sequence
  Description of Artificial Sequence: Synthetic oligonucleotide
  Target: ATXN1; (+) strand; PAM type: NNAGAAW; PAM sequence: GAAGAAT
gaaatctttgttgaattaat

SEQ ID NO: 11344 - DNA, 20 bp, Artificial Sequence
  Description of Artificial Sequence: Synthetic oligonucleotide
  Target: ATXN1; (+) strand; PAM type: NNAGAAW; PAM sequence: GGAGAAA
ttgttgaattaatgaagaat

SEQ ID NO: 11345 - DNA, 20 bp, Artificial Sequence
  Description of Artificial Sequence: Synthetic oligonucleotide
  Target: ATXN1; (+) strand; PAM type: NNAGAAW; PAM sequence: AGAGAAA
agaaagagaacgagaggcag

SEQ ID NO: 11346 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
agagaacgagaggcagagag

SEQ ID NO: 11347 - DNA, 20 bp, Artificial Sequence
  Description of Artificial Sequence: Synthetic oligonucleotide
  Target: ATXN1; (+) strand; PAM type: NNAGAAW; PAM sequence: GGAGAAT
ctactcaggagactgaggca

SEQ ID NO: 11348 - DNA, 20 bp, Artificial Sequence
  Description of Artificial Sequence: Synthetic oligonucleotide
  Target: ATXN1; (+) strand; PAM type: NNAGAAW; PAM sequence: GAAGAAA
tcaaaaaaaaaaaaaaaaag

SEQ ID NO: 11349 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
aaaaaaaaaaaaaaaggaag

SEQ ID NO: 11350 - DNA, 20 bp, Artificial Sequence
  Description of Artificial Sequence: Synthetic oligonucleotide
  Target: ATXN1; (+) strand; PAM type: NNAGAAW; PAM sequence: CAAGAAT
ctaaataaaccagactggga

SEQ ID NO: 11351 - DNA, 20 bp, Artificial Sequence
  Description of Artificial Sequence: Synthetic oligonucleotide
  Target: ATXN1; (+) strand; PAM type: NNAGAAW; PAM sequence: GAAGAAA
gcagctcaaattcaaaagat

SEQ ID NO: 11352 - DNA, 20 bp, Artificial Sequence
  Description of Artificial Sequence: Synthetic oligonucleotide
  Target: ATXN1; (+) strand; PAM type: NNAGAAW; PAM sequence: CAAGAAA
atttctaaccaccctgccac

SEQ ID NO: 11353 - DNA, 20 bp, Artificial Sequence
  Description of Artificial Sequence: Synthetic oligonucleotide
  Target: ATXN1; (+) strand; PAM type: NNAGAAW; PAM sequence: ACAGAAA
tcatacagtcagcacttgag

SEQ ID NO: 11354 - DNA, 20 bp, Artificial Sequence
  Description of Artificial Sequence: Synthetic oligonucleotide
  Target: ATXN1; (+) strand; PAM type: NNAGAAW; PAM sequence: AGAGAAT
caaatggaatttgggaggga

SEQ ID NO: 11355 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
gaatagggtaggaaaaaata

SEQ ID NO: 11356 - DNA, 20 bp, Artificial Sequence
  Description of Artificial Sequence: Synthetic oligonucleotide
  Target: ATXN1; (+) strand; PAM type: NNAGAAW; PAM sequence: AGAGAAT
ttctatcttctactctgccc

SEQ ID NO: 11357 - DNA, 20 bp, Artificial Sequence
  Description of Artificial Sequence: Synthetic oligonucleotide
  Target: ATXN1; (+) strand; PAM type: NNAGAAW; PAM sequence: CAAGAAT
aaataaaggtataaatgcta

SEQ ID NO: 11358 - DNA, 20 bp, Artificial Sequence
  Description of Artificial Sequence: Synthetic oligonucleotide
  Target: ATXN1; (+) strand; PAM type: NNAGAAW; PAM sequence: GAAGAAA
aaaatccgatctatccaaag

SEQ ID NO: 11359 - DNA, 20 bp, Artificial Sequence
  Description of Artificial Sequence: Synthetic oligonucleotide
  Target: ATXN1; (+) strand; PAM type: NNAGAAW; PAM sequence: GTAGAAA
aaaacaaaaagtaaagccaa

SEQ ID NO: 11360 - DNA, 20 bp, Artificial Sequence
  Description of Artificial Sequence: Synthetic oligonucleotide
  Target: ATXN1; (+) strand; PAM type: NNAGAAW; PAM sequence: GAAGAAT
gcacaatatgtggtgggggg

SEQ ID NO: 11361 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
aaaactaaaagatttttaaa

SEQ ID NO: 11362 - DNA, 20 bp, Artificial Sequence
  Description of Artificial Sequence: Synthetic oligonucleotide
  Target: ATXN1; (+) strand; PAM type: NNAGAAW; PAM sequence: AGAGAAA
atttaaagcaacaactatga

SEQ ID NO: 11363 - DNA, 20 bp, Artificial Sequence
  Description of Artificial Sequence: Synthetic oligonucleotide
  Target: ATXN1; (+) strand; PAM type: NNAGAAW; PAM sequence: GGAGAAT
atcagtagatttctagacaa

SEQ ID NO: 11364 - DNA, 20 bp, Artificial Sequence
  Description of Artificial Sequence: Synthetic oligonucleotide
  Target: ATXN1; (+) strand; PAM type: NNAGAAW; PAM sequence: ACAGAAA
aaaagtgtgtgtacctagga

SEQ ID NO: 11365 - DNA, 20 bp, Artificial Sequence
  Description of Artificial Sequence: Synthetic oligonucleotide
  Target: ATXN1; (+) strand; PAM type: NNAGAAW; PAM sequence: AGAGAAA
gacgttcaaatcagtgatat

SEQ ID NO: 11366 - DNA, 20 bp, Artificial Sequence
  Description of Artificial Sequence: Synthetic oligonucleotide
  Target: ATXN1; (+) strand; PAM type: NNAGAAW; PAM sequence: GGAGAAT
ctacttgggaggctgaggca

SEQ ID NO: 11367 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
actctgtctcaaaaaaaaaa

SEQ ID NO: 11368 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
gtctcaaaaaaaaaaaaaga

SEQ ID NO: 11369 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
aaaaaaaaaaaaagaaaaga

SEQ ID NO: 11370 - DNA, 20 bp, Artificial Sequence
  Description of Artificial Sequence: Synthetic oligonucleotide
  Target: ATXN1; (+) strand; PAM type: NNAGAAW; PAM sequence: AGAGAAA
aaaaagaaaagaaaagaaaa

SEQ ID NO: 11371 - DNA, 20 bp, Artificial Sequence
  Description of Artificial Sequence: Synthetic oligonucleotide
  Target: ATXN1; (+) strand; PAM type: NNAGAAW; PAM sequence: ACAGAAA
agaaggaaataatgagaaga

SEQ ID NO: 11372 - DNA, 20 bp, Artificial Sequence
  Description of Artificial Sequence: Synthetic oligonucleotide
  Target: ATXN1; (+) strand; PAM type: NNAGAAW; PAM sequence: GAAGAAA
tacagacactaaatagataa

SEQ ID NO: 11373 - DNA, 20 bp, Artificial Sequence
  Description of Artificial Sequence: Synthetic oligonucleotide
  Target: ATXN1; (+) strand; PAM type: NNAGAAW; PAM sequence: ATAGAAA
aataaaaaacttcttgaaaa

SEQ ID NO: 11374 - DNA, 20 bp, Artificial Sequence
  Description of Artificial Sequence: Synthetic oligonucleotide
  Target: ATXN1; (+) strand; PAM type: NNAGAAW; PAM sequence: CAAGAAT
aaagcataacttaccaatag

SEQ ID NO: 11375 - DNA, 20 bp, Artificial Sequence
  Description of Artificial Sequence: Synthetic oligonucleotide
  Target: ATXN1; (+) strand; PAM type: NNAGAAW; PAM sequence: ACAGAAA
cttaccaatagcaagaataa

SEQ ID NO: 11376 - DNA, 20 bp, Artificial Sequence
  Description of Artificial Sequence: Synthetic oligonucleotide
  Target: ATXN1; (+) strand; PAM type: NNAGAAW; PAM sequence: TAAGAAA
ctgaagagttggctatatgt

SEQ ID NO: 11377 - DNA, 20 bp, Artificial Sequence
  Description of Artificial Sequence: Synthetic oligonucleotide
  Target: ATXN1; (+) strand; PAM type: NNAGAAW; PAM sequence: ATAGAAT
ctctacacatgttaaaatgc

SEQ ID NO: 11378 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
atttcatcaattttaagagg

SEQ ID NO: 11379 - DNA, 20 bp, Artificial Sequence
  Description of Artificial Sequence: Synthetic oligonucleotide
  Target: ATXN1; (+) strand; PAM type: NNAGAAW; PAM sequence: TCAGAAA
aaaatcttacataaattctt

SEQ ID NO: 11380 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
aaccctagtaaatattatat

SEQ ID NO: 11381 - DNA, 20 bp, Artificial Sequence
  Description of Artificial Sequence: Synthetic oligonucleotide
  Target: ATXN1; (+) strand; PAM type: NNAGAAW; PAM sequence: TTAGAAA
aaacaaacaaacacaaattc

SEQ ID NO: 11382 - DNA, 20 bp, Artificial Sequence
  Description of Artificial Sequence: Synthetic oligonucleotide
  Target: ATXN1; (+) strand; PAM type: NNAGAAW; PAM sequence: AGAGAAT
aacacaaattcttagaaaaa

SEQ ID NO: 11383 - DNA, 20 bp, Artificial Sequence
  Description of Artificial Sequence: Synthetic oligonucleotide
  Target: ATXN1; (+) strand; PAM type: NNAGAAW; PAM sequence: TCAGAAA
ttaatactttccctgtacga

SEQ ID NO: 11384 - DNA, 20 bp, Artificial Sequence
  Description of Artificial Sequence: Synthetic oligonucleotide
  Target: ATXN1; (+) strand; PAM type: NNAGAAW; PAM sequence: GCAGAAA
aaaacagggaaacattcctg

SEQ ID NO: 11385 - DNA, 20 bp, Artificial Sequence
  Description of Artificial Sequence: Synthetic oligonucleotide
  Target: ATXN1; (+) strand; PAM type: NNAGAAW; PAM sequence: AGAGAAA
cagaaattcattaaaaaggc

SEQ ID NO: 11386 - DNA, 20 bp, Artificial Sequence
  Description of Artificial Sequence: Synthetic oligonucleotide
  Target: ATXN1; (+) strand; PAM type: NNAGAAW; PAM sequence: CTAGAAA
acttaaatgttaaggctaaa

SEQ ID NO: 11387 - DNA, 20 bp, Artificial Sequence
  Description of Artificial Sequence: Synthetic oligonucleotide
  Target: ATXN1; (+) strand; PAM type: NNAGAAW; PAM sequence: GGAGAAA
gctaaactagaaatcttcca

SEQ ID NO: 11388 - DNA, 20 bp, Artificial Sequence
  Description of Artificial Sequence: Synthetic oligonucleotide
  Target: ATXN1; (+) strand; PAM type: NNAGAAW; PAM sequence: TGAGAAA
gaaaaaggtaagccaaacac

SEQ ID NO: 11389 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
caaaaatgatatgctgaaca

SEQ ID NO: 11390 - DNA, 20 bp, Artificial Sequence
  Description of Artificial Sequence: Synthetic oligonucleotide
  Target: ATXN1; (+) strand; PAM type: NNAGAAW; PAM sequence: ACAGAAA
aacaaaattcaattacagtg

SEQ ID NO: 11391 - DNA, 20 bp, Artificial Sequence
  Description of Artificial Sequence: Synthetic oligonucleotide
  Target: ATXN1; (+) strand; PAM type: NNAGAAW; PAM sequence: ATAGAAA
tcactgtatgttctccctaa

SEQ ID NO: 11392 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
agaaactaatttattagtga

SEQ ID NO: 11393 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
ataaactaatttattagtga

SEQ ID NO: 11394 - DNA, 20 bp, Artificial Sequence
  Description of Artificial Sequence: Synthetic oligonucleotide
  Target: ATXN1; (+) strand; PAM type: NNAGAAW; PAM sequence: TGAGAAA
cacgcaaggcagacagcaag

SEQ ID NO: 11395 - DNA, 20 bp, Artificial Sequence
  Description of Artificial Sequence: Synthetic oligonucleotide
  Target: ATXN1; (+) strand; PAM type: NNAGAAW; PAM sequence: AGAGAAA
ggtggtctgctacagtgaga

SEQ ID NO: 11396 - DNA, 20 bp, Artificial Sequence
  Description of Artificial Sequence: Synthetic oligonucleotide
  Target: ATXN1; (+) strand; PAM type: NNAGAAW; PAM sequence: GTAGAAA
gagtgaactgaacgcaagaa

SEQ ID NO: 11397 - DNA, 20 bp, Artificial Sequence
  Description of Artificial Sequence: Synthetic oligonucleotide
  Target: ATXN1; (+) strand; PAM type: NNAGAAW; PAM sequence: AAAGAAT
ctgagtcatcccttccagtg

SEQ ID NO: 11398 - DNA, 20 bp, Artificial Sequence
  Description of Artificial Sequence: Synthetic oligonucleotide
  Target: ATXN1; (+) strand; PAM type: NNAGAAW; PAM sequence: GTAGAAA
tgtgaacaagctgatgctgt

SEQ ID NO: 11399 - DNA, 20 bp, Artificial Sequence
  Description of Artificial Sequence: Synthetic oligonucleotide
  Target: ATXN1; (+) strand; PAM type: NNAGAAW; PAM sequence: AAAGAAT
accaaatattccagacaggg

SEQ ID NO: 11400 - DNA, 20 bp, Artificial Sequence
  Description of Artificial Sequence: Synthetic oligonucleotide
  Target: ATXN1; (+) strand; PAM type: NNAGAAW; PAM sequence: TGAGAAA
ttccagacagggaaagaatc

SEQ ID NO: 11401 - DNA, 20 bp, Artificial Sequence
  Description of Artificial Sequence: Synthetic oligonucleotide
  Target: ATXN1; (+) strand; PAM type: NNAGAAW; PAM sequence: TCAGAAA
cagtttcacggagggatttg

SEQ ID NO: 11402 - DNA, 20 bp, Artificial Sequence
  Description of Artificial Sequence: Synthetic oligonucleotide
  Target: ATXN1; (+) strand; PAM type: NNAGAAW; PAM sequence: CCAGAAA
agaacccctgggcctggcgc

SEQ ID NO: 11403 - DNA, 20 bp, Artificial Sequence
  Description of Artificial Sequence: Synthetic oligonucleotide
  Target: ATXN1; (+) strand; PAM type: NNAGAAW; PAM sequence: AGAGAAT
gctacttgggaggttgaggc

SEQ ID NO: 11404 - DNA, 20 bp, Artificial Sequence
  Description of Artificial Sequence: Synthetic oligonucleotide
  Target: ATXN1; (+) strand; PAM type: NNAGAAW; PAM sequence: GTAGAAA
ctgggcgacagagtaagact

SEQ ID NO: 11405 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
cagagtaagactgtagaaaa

SEQ ID NO: 11406 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
gtaagactgtagaaaaaaag

SEQ ID NO: 11407 - DNA, 20 bp, Artificial Sequence
  Description of Artificial Sequence: Synthetic oligonucleotide
  Target: ATXN1; (+) strand; PAM type: NNAGAAW; PAM sequence: ACAGAAA
acatattcattttgaaaaat

SEQ ID NO: 11408 - DNA, 20 bp, Artificial Sequence
  Description of Artificial Sequence: Synthetic oligonucleotide
  Target: ATXN1; (+) strand; PAM type: NNAGAAW; PAM sequence: GAAGAAA
aaaaatacagaaatggcaaa

SEQ ID NO: 11409 - DNA, 20 bp, Artificial Sequence
  Description of Artificial Sequence: Synthetic oligonucleotide
  Target: ATXN1; (+) strand; PAM type: NNAGAAW; PAM sequence: ACAGAAA
ccattctatgccatcaagtc

SEQ ID NO: 11410 - DNA, 20 bp, Artificial Sequence
  Description of Artificial Sequence: Synthetic oligonucleotide
  Target: ATXN1; (+) strand; PAM type: NNAGAAW; PAM sequence: ACAGAAT
tctgttgctttgggcatgaa

SEQ ID NO: 11411 - DNA, 20 bp, Artificial Sequence
  Description of Artificial Sequence: Synthetic oligonucleotide
  Target: ATXN1; (+) strand; PAM type: NNAGAAW; PAM sequence: GAAGAAA
cagccagctacatatatttg

SEQ ID NO: 11412 - DNA, 20 bp, Artificial Sequence
  Description of Artificial Sequence: Synthetic oligonucleotide
  Target: ATXN1; (+) strand; PAM type: NNAGAAW; PAM sequence: CAAGAAA
aatgtgcaggtcctctttta

SEQ ID NO: 11413 - DNA, 20 bp, Artificial Sequence
  Description of Artificial Sequence: Synthetic oligonucleotide
  Target: ATXN1; (+) strand; PAM type: NNAGAAW; PAM sequence: TTAGAAA
tatgttttggaatctacaga

SEQ ID NO: 11414 - DNA, 20 bp, Artificial Sequence
  Description of Artificial Sequence: Synthetic oligonucleotide
  Target: ATXN1; (+) strand; PAM type: NNAGAAW; PAM sequence: CTAGAAT
atctacagattagaaaaccc

SEQ ID NO: 11415 - DNA, 20 bp, Artificial Sequence
  Description of Artificial Sequence: Synthetic oligonucleotide
  Target: ATXN1; (+) strand; PAM type: NNAGAAW; PAM sequence: CCAGAAA
aatggttaatcatctgtaaa

SEQ ID NO: 11416 - DNA, 20 bp, Artificial Sequence
  Description of Artificial Sequence: Synthetic oligonucleotide
  Target: ATXN1; (+) strand; PAM type: NNAGAAW; PAM sequence: GAAGAAA
atggacatacaaagccaact

SEQ ID NO: 11417 - DNA, 20 bp, Artificial Sequence
  Description of Artificial Sequence: Synthetic oligonucleotide
  Target: ATXN1; (+) strand; PAM type: NNAGAAW; PAM sequence: TAAGAAA
atgaaatatagtcatgaatt

SEQ ID NO: 11418 - DNA, 20 bp, Artificial Sequence
  Description of Artificial Sequence: Synthetic oligonucleotide
  Target: ATXN1; (+) strand; PAM type: NNAGAAW; PAM sequence: GGAGAAT
ggcaatgccaaggttgttgg

SEQ ID NO: 11419 - DNA, 20 bp, Artificial Sequence
  Description of Artificial Sequence: Synthetic oligonucleotide
  Target: ATXN1; (+) strand; PAM type: NNAGAAW; PAM sequence: CTAGAAA
ctgacatgttcctggtccca

SEQ ID NO: 11420 - DNA, 20 bp, Artificial Sequence
  Description of Artificial Sequence: Synthetic oligonucleotide
  Target: ATXN1; (+) strand; PAM type: NNAGAAW; PAM sequence: AGAGAAT
ccatgcagcttaacacagag

SEQ ID NO: 11421 - DNA, 20 bp, Artificial Sequence
  Description of Artificial Sequence: Synthetic oligonucleotide
  Target: ATXN1; (+) strand; PAM type: NNAGAAW; PAM sequence: ATAGAAT
gtttgcttccctatacatgt

SEQ ID NO: 11422 - DNA, 20 bp, Artificial Sequence
  Description of Artificial Sequence: Synthetic oligonucleotide
  Target: ATXN1; (+) strand; PAM type: NNAGAAW; PAM sequence: CCAGAAA
tagtgaagggtcaatgatgc

SEQ ID NO: 11423 - DNA, 20 bp, Artificial Sequence
  Description of Artificial Sequence: Synthetic oligonucleotide
  Target: ATXN1; (+) strand; PAM type: NNAGAAW; PAM sequence: GCAGAAA
cagctcttttgccctattaa

SEQ ID NO: 11424 - DNA, 20 bp, Artificial Sequence
  Description of Artificial Sequence: Synthetic oligonucleotide
  Target: ATXN1; (+) strand; PAM type: NNAGAAW; PAM sequence: TTAGAAA
aaaggctcagtgtatagaag

SEQ ID NO: 11425 - DNA, 20 bp, Artificial Sequence
  Description of Artificial Sequence: Synthetic oligonucleotide
  Target: ATXN1; (+) strand; PAM type: NNAGAAW; PAM sequence: CCAGAAA
gggcaaaatgaaagagcatt

SEQ ID NO: 11426 - DNA, 20 bp, Artificial Sequence
  Description of Artificial Sequence: Synthetic oligonucleotide
  Target: ATXN1; (+) strand; PAM type: NNAGAAW; PAM sequence: CAAGAAT
caaaactaactgcaacggag

SEQ ID NO: 11427 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
taaggaagctgctggtttcc

SEQ ID NO: 11428 - DNA, 20 bp, Artificial Sequence
  Description of Artificial Sequence: Synthetic oligonucleotide
  Target: ATXN1; (+) strand; PAM type: NNAGAAW; PAM sequence: TGAGAAA
ttttaacactgtgattttag

SEQ ID NO: 11429 - DNA, 20 bp, Artificial Sequence
  Description of Artificial Sequence: Synthetic oligonucleotide
  Target: ATXN1; (+) strand; PAM type: NNAGAAW; PAM sequence: AGAGAAA
ccacaatatcaacgcaatta

SEQ ID NO: 11430 - DNA, 20 bp, Artificial Sequence
  Description of Artificial Sequence: Synthetic oligonucleotide
  Target: ATXN1; (+) strand; PAM type: NNAGAAW; PAM sequence: ATAGAAA
ttagtcctctgtcttcttat

SEQ ID NO: 11431 - DNA, 20 bp, Artificial Sequence
  Description of Artificial Sequence: Synthetic oligonucleotide
  Target: ATXN1; (+) strand; PAM type: NNAGAAW; PAM sequence: GAAGAAA
tacattcccccaaagcacag

SEQ ID NO: 11432 - DNA, 20 bp, Artificial Sequence
  Description of Artificial Sequence: Synthetic oligonucleotide
  Target: ATXN1; (+) strand; PAM type: NNAGAAW; PAM sequence: TAAGAAA
ttaataaatgaagatggctt

SEQ ID NO: 11433 - DNA, 20 bp, Artificial Sequence
  Description of Artificial Sequence: Synthetic oligonucleotide
  Target: ATXN1; (+) strand; PAM type: NNAGAAW; PAM sequence: CTAGAAA
aaaaagcatgtcatctacaa

SEQ ID NO: 11434 - DNA, 20 bp, Artificial Sequence
  Description of Artificial Sequence: Synthetic oligonucleotide
  Target: ATXN1; (+) strand; PAM type: NNAGAAW; PAM sequence: TTAGAAT
gccagtcagggctatagggc

SEQ ID NO: 11435 - DNA, 20 bp, Artificial Sequence
  Description of Artificial Sequence: Synthetic oligonucleotide
  Target: ATXN1; (+) strand; PAM type: NNAGAAW; PAM sequence: CAAGAAT
atgaaagattaaagaggaaa

SEQ ID NO: 11436 - DNA, 20 bp, Artificial Sequence
  Description of Artificial Sequence: Synthetic oligonucleotide
  Target: ATXN1; (+) strand; PAM type: NNAGAAW; PAM sequence: AAAGAAT
ttccctgactccaccaaaca

SEQ ID NO: 11437 - DNA, 20 bp, Artificial Sequence
  Description of Artificial Sequence: Synthetic oligonucleotide
  Target: ATXN1; (+) strand; PAM type: NNAGAAW; PAM sequence: GCAGAAA
tgcatacaaccatgtctggt

SEQ ID NO: 11438 - DNA, 20 bp, Artificial Sequence
  Description of Artificial Sequence: Synthetic oligonucleotide
  Target: ATXN1; (+) strand; PAM type: NNAGAAW; PAM sequence: TAAGAAT
tcaataaatacttggttgta

SEQ ID NO: 11439 - DNA, 20 bp, Artificial Sequence
  Description of Artificial Sequence: Synthetic oligonucleotide
  Target: ATXN1; (+) strand; PAM type: NNAGAAW; PAM sequence: CAAGAAT
acattctctgcattgcaagt

SEQ ID NO: 11440 - DNA, 20 bp, Artificial Sequence
  Description of Artificial Sequence: Synthetic oligonucleotide
  Target: ATXN1; (+) strand; PAM type: NNAGAAW; PAM sequence: GTAGAAA
taattaccctctttgagcct

SEQ ID NO: 11441 - DNA, 20 bp, Artificial Sequence
  Description of Artificial Sequence: Synthetic oligonucleotide
  Target: ATXN1; (+) strand; PAM type: NNAGAAW; PAM sequence: AAAGAAT
accctctttgagcctgtaga

SEQ ID NO: 11442 - DNA, 20 bp, Artificial Sequence
  Description of Artificial Sequence: Synthetic oligonucleotide
  Target: ATXN1; (+) strand; PAM type: NNAGAAW; PAM sequence: CAAGAAA
tgacacagttagaacccagg

SEQ ID NO: 11443 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
tattccttttcattatttca

SEQ ID NO: 11444 - DNA, 20 bp, Artificial Sequence
  Description of Artificial Sequence: Synthetic oligonucleotide
  Target: ATXN1; (+) strand; PAM type: NNAGAAW; PAM sequence: TGAGAAA
aatggttcctatgaaccttt

SEQ ID NO: 11445 - DNA, 20 bp, Artificial Sequence
  Description of Artificial Sequence: Synthetic oligonucleotide
  Target: ATXN1; (+) strand; PAM type: NNAGAAW; PAM sequence: ACAGAAT
tcctatgaaccttttgagaa

SEQ ID NO: 11446 - DNA, 20 bp, Artificial Sequence
  Description of Artificial Sequence: Synthetic oligonucleotide
  Target: ATXN1; (+) strand; PAM type: NNAGAAW; PAM sequence: CCAGAAA
ttgaaagctacaatcctctc

SEQ ID NO: 11447 - DNA, 20 bp, Artificial Sequence
  Description of Artificial Sequence: Synthetic oligonucleotide
  Target: ATXN1; (+) strand; PAM type: NNAGAAW; PAM sequence: ACAGAAT
tcccagaaaaacccacatac

SEQ ID NO: 11448 - DNA, 20 bp, Artificial Sequence
  Description of Artificial Sequence: Synthetic oligonucleotide
  Target: ATXN1; (+) strand; PAM type: NNAGAAW; PAM sequence: TCAGAAA
gttctggaaaagttcagtga

SEQ ID NO: 11449 - DNA, 20 bp, Artificial Sequence
  Description of Artificial Sequence: Synthetic oligonucleotide
  Target: ATXN1; (+) strand; PAM type: NNAGAAW; PAM sequence: GAAGAAT
aaagttcagtgatcagaaat

SEQ ID NO: 11450 - DNA, 20 bp, Artificial Sequence
  Description of Artificial Sequence: Synthetic oligonucleotide
  Target: ATXN1; (+) strand; PAM type: NNAGAAW; PAM sequence: CAAGAAA
tagccatgacctcccaatgc

SEQ ID NO: 11451 - DNA, 20 bp, Artificial Sequence
  Description of Artificial Sequence: Synthetic oligonucleotide
  Target: ATXN1; (+) strand; PAM type: NNAGAAW; PAM sequence: TTAGAAA
agttcagcaaatggggatga

SEQ ID NO: 11452 - DNA, 20 bp, Artificial Sequence
  Description of Artificial Sequence: Synthetic oligonucleotide
  Target: ATXN1; (+) strand; PAM type: NNAGAAW; PAM sequence: CAAGAAA
ggggatgattagaaatttta

SEQ ID NO: 11453 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
tccacgtcctgtgaagttat

SEQ ID NO: 11454 - DNA, 20 bp, Artificial Sequence
  Description of Artificial Sequence: Synthetic oligonucleotide
  Target: ATXN1; (+) strand; PAM type: NNAGAAW; PAM sequence: AGAGAAA
ggaaacatctacaattatcc

SEQ ID NO: 11455 - DNA, 20 bp, Artificial Sequence
  Description of Artificial Sequence: Synthetic oligonucleotide
  Target: ATXN1; (+) strand; PAM type: NNAGAAW; PAM sequence: TGAGAAT
actgttgctttccccatggc

SEQ ID NO: 11456 - DNA, 20 bp, Artificial Sequence
  Description of Artificial Sequence: Synthetic oligonucleotide
  Target: ATXN1; (+) strand; PAM type: NNAGAAW; PAM sequence: TAAGAAT
ttcaaaagatctgttatgtt

SEQ ID NO: 11457 - DNA, 20 bp, Artificial Sequence
  Description of Artificial Sequence: Synthetic oligonucleotide
  Target: ATXN1; (+) strand; PAM type: NNAGAAW; PAM sequence: TCAGAAA
taaacatttatacagacttc

SEQ ID NO: 11458 - DNA, 20 bp, Artificial Sequence
  Description of Artificial Sequence: Synthetic oligonucleotide
  Target: ATXN1; (+) strand; PAM type: NNAGAAW; PAM sequence: GGAGAAT
acagacttctcagaaataaa

SEQ ID NO: 11459 - DNA, 20 bp, Artificial Sequence
  Description of Artificial Sequence: Synthetic oligonucleotide
  Target: ATXN1; (+) strand; PAM type: NNAGAAW; PAM sequence: ACAGAAT
ggacaaattccctgcattca

SEQ ID NO: 11460 - DNA, 20 bp, Artificial Sequence
  Description of Artificial Sequence: Synthetic oligonucleotide
  Target: ATXN1; (+) strand; PAM type: NNAGAAW; PAM sequence: TCAGAAA
gaataagttccaatgtttag

SEQ ID NO: 11461 - DNA, 20 bp, Artificial Sequence
  Description of Artificial Sequence: Synthetic oligonucleotide
  Target: ATXN1; (+) strand; PAM type: NNAGAAW; PAM sequence: AAAGAAT
tagaaggaaatttaaattac

SEQ ID NO: 11462 - DNA, 20 bp, Artificial Sequence
  Description of Artificial Sequence: Synthetic oligonucleotide
  Target: ATXN1; (+) strand; PAM type: NNAGAAW; PAM sequence: TGAGAAA
ctaaatatggaaaaacttca

SEQ ID NO: 11463 - DNA, 20 bp, Artificial Sequence
  Description of Artificial Sequence: Synthetic oligonucleotide
  Target: ATXN1; (+) strand; PAM type: NNAGAAW; PAM sequence: AGAGAAA
cagtccttcagtatgaatcg

SEQ ID NO: 11464 - DNA, 20 bp, Artificial Sequence
  Description of Artificial Sequence: Synthetic oligonucleotide
  Target: ATXN1; (+) strand; PAM type: NNAGAAW; PAM sequence: AAAGAAT
gaaaattcatgaagtctcca

SEQ ID NO: 11465 - DNA, 20 bp, Artificial Sequence
  Description of Artificial Sequence: Synthetic oligonucleotide
  Target: ATXN1; (+) strand; PAM type: NNAGAAW; PAM sequence: ATAGAAT
agtcaggtttgattgctgat

SEQ ID NO: 11466 - DNA, 20 bp, Artificial Sequence
  Description of Artificial Sequence: Synthetic oligonucleotide
  Target: ATXN1; (+) strand; PAM type: NNAGAAW; PAM sequence: AGAGAAA
tcactattaccagcttcacc

SEQ ID NO: 11467 - DNA, 20 bp, Artificial Sequence
  Description of Artificial Sequence: Synthetic oligonucleotide
  Target: ATXN1; (+) strand; PAM type: NNAGAAW; PAM sequence: AGAGAAA
caggctaacatgagtttccc

SEQ ID NO: 11468 - DNA, 20 bp, Artificial Sequence
  Description of Artificial Sequence: Synthetic oligonucleotide
  Target: ATXN1; (+) strand; PAM type: NNAGAAW; PAM sequence: GAAGAAT
ctaaccgtttattaagtttt

SEQ ID NO: 11469 - DNA, 20 bp, Artificial Sequence
  Description of Artificial Sequence: Synthetic oligonucleotide
  Target: ATXN1; (+) strand; PAM type: NNAGAAW; PAM sequence: AGAGAAA
cttaaggagtcaaaacatcc

SEQ ID NO: 11470 - DNA, 20 bp, Artificial Sequence
  Description of Artificial Sequence: Synthetic oligonucleotide
  Target: ATXN1; (+) strand; PAM type: NNAGAAW; PAM sequence: CTAGAAA
actacacacagcaataaagg

SEQ ID NO: 11471 - DNA, 20 bp, Artificial Sequence
  Description of Artificial Sequence: Synthetic oligonucleotide
  Target: ATXN1; (+) strand; PAM type: NNAGAAW; PAM sequence: TAAGAAA
ctgctaaagacatgggggat

SEQ ID NO: 11472 - DNA, 20 bp, Artificial Sequence
  Description of Artificial Sequence: Synthetic oligonucleotide
  Target: ATXN1; (+) strand; PAM type: NNAGAAW; PAM sequence: CAAGAAA
atttgttcagatgaaacaaa

SEQ ID NO: 11473 - DNA, 20 bp, Artificial Sequence
  Description of Artificial Sequence: Synthetic oligonucleotide
  Target: ATXN1; (+) strand; PAM type: NNAGAAW; PAM sequence: TCAGAAA
agctaaatccagtttttgaa

SEQ ID NO: 11474 - DNA, 20 bp, Artificial Sequence
  Description of Artificial Sequence: Synthetic oligonucleotide
  Target: ATXN1; (+) strand; PAM type: NNAGAAW; PAM sequence: TTAGAAA
ttttgaatcagaaaccgaat

SEQ ID NO: 11475 - DNA, 20 bp, Artificial Sequence
  Description of Artificial Sequence: Synthetic oligonucleotide
  Target: ATXN1; (+) strand; PAM type: NNAGAAW; PAM sequence: AGAGAAT
tatttatgcccagataaggg

SEQ ID NO: 11476 - DNA, 20 bp, Artificial Sequence
  Description of Artificial Sequence: Synthetic oligonucleotide
  Target: ATXN1; (+) strand; PAM type: NNAGAAW; PAM sequence: AGAGAAA
tcctgcaccattttaaagga

SEQ ID NO: 11477 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
ggaagagaaaaaaagcatca

SEQ ID NO: 11478 - DNA, 20 bp, Artificial Sequence
  Description of Artificial Sequence: Synthetic oligonucleotide
  Target: ATXN1; (+) strand; PAM type: NNAGAAW; PAM sequence: CTAGAAA
caccatattaagatgaagcc

SEQ ID NO: 11479 - DNA, 20 bp, Artificial Sequence
  Description of Artificial Sequence: Synthetic oligonucleotide
  Target: ATXN1; (+) strand; PAM type: NNAGAAW; PAM sequence: AGAGAAT
ctacacaggtggctgaggca

SEQ ID NO: 11480 - DNA, 20 bp, Artificial Sequence
  Description of Artificial Sequence: Synthetic oligonucleotide
  Target: ATXN1; (+) strand; PAM type: NNAGAAW; PAM sequence: ATAGAAT
tgcacccaattatgtatgac

SEQ ID NO: 11481 - DNA, 20 bp, Artificial Sequence
  Description of Artificial Sequence: Synthetic oligonucleotide
  Target: ATXN1; (+) strand; PAM type: NNAGAAW; PAM sequence: GAAGAAT
ctactcaggaggctgaggca

SEQ ID NO: 11482 - DNA, 20 bp, Artificial Sequence
  Description of Artificial Sequence: Synthetic oligonucleotide
  Target: ATXN1; (+) strand; PAM type: NNAGAAW; PAM sequence: AAAGAAT
acttcatctcaaaaaaaaac

SEQ ID NO: 11483 - DNA, 20 bp, Artificial Sequence
  Description of Artificial Sequence: Synthetic oligonucleotide
  Target: ATXN1; (+) strand; PAM type: NNAGAAW; PAM sequence: CCAGAAA
tattacaaaagctatttttt

SEQ ID NO: 11484 - DNA, 20 bp, Artificial Sequence
  Description of Artificial Sequence: Synthetic oligonucleotide
  Target: ATXN1; (+) strand; PAM type: NNAGAAW; PAM sequence: AGAGAAA
tccatatatactagtaggta

SEQ ID NO: 11485 - DNA, 20 bp, Artificial Sequence
  Description of Artificial Sequence: Synthetic oligonucleotide
  Target: ATXN1; (+) strand; PAM type: NNAGAAW; PAM sequence: TAAGAAA
gagaagacatctaatatgaa

SEQ ID NO: 11486 - DNA, 20 bp, Artificial Sequence
  Description of Artificial Sequence: Synthetic oligonucleotide
  Target: ATXN1; (+) strand; PAM type: NNAGAAW; PAM sequence: GAAGAAA
tccaaattacaatgtttcaa

SEQ ID NO: 11487 - DNA, 20 bp, Artificial Sequence
  Description of Artificial Sequence: Synthetic oligonucleotide
  Target: ATXN1; (+) strand; PAM type: NNAGAAW; PAM sequence: AGAGAAA
gagcatgctgagtttatcac

SEQ ID NO: 11488 - DNA, 20 bp, Artificial Sequence
  Description of Artificial Sequence: Synthetic oligonucleotide
  Target: ATXN1; (+) strand; PAM type: NNAGAAW; PAM sequence: GCAGAAT
tgctgggcatggacagtggg

SEQ ID NO: 11489 - DNA, 20 bp, Artificial Sequence
  Description of Artificial Sequence: Synthetic oligonucleotide
  Target: ATXN1; (+) strand; PAM type: NNAGAAW; PAM sequence: TCAGAAA
ctcacagcaaagcagggtgg

SEQ ID NO: 11490 - DNA, 20 bp, Artificial Sequence
  Description of Artificial Sequence: Synthetic oligonucleotide
  Target: ATXN1; (+) strand; PAM type: NNAGAAW; PAM sequence: ACAGAAA
ggcaacatctgggatgtagg

SEQ ID NO: 11491 - DNA, 20 bp, Artificial Sequence
  Description of Artificial Sequence: Synthetic oligonucleotide
  Target: ATXN1; (+) strand; PAM type: NNAGAAW; PAM sequence: TTAGAAA
ctaaatgctacacaaataag

SEQ ID NO: 11492 - DNA, 20 bp, Artificial Sequence
  Description of Artificial Sequence: Synthetic oligonucleotide
  Target: ATXN1; (+) strand; PAM type: NNAGAAW; PAM sequence: GGAGAAT
ataagttagaaaactccaaa

SEQ ID NO: 11493 - DNA, 20 bp, Artificial Sequence
  Description of Artificial Sequence: Synthetic oligonucleotide
  Target: ATXN1; (+) strand; PAM type: NNAGAAW; PAM sequence: GAAGAAA
ataatccccactcttcagat

SEQ ID NO: 11494 - DNA, 20 bp, Artificial Sequence
  Description of Artificial Sequence: Synthetic oligonucleotide
  Target: ATXN1; (+) strand; PAM type: NNAGAAW; PAM sequence: TAAGAAT
ttctatttattcctagttac

SEQ ID NO: 11495 - DNA, 20 bp, Artificial Sequence
  Description of Artificial Sequence: Synthetic oligonucleotide
  Target: ATXN1; (+) strand; PAM type: NNAGAAW; PAM sequence: TGAGAAA
atccaaacacagcagacatc

SEQ ID NO: 11496 - DNA, 20 bp, Artificial Sequence
  Description of Artificial Sequence: Synthetic oligonucleotide
  Target: ATXN1; (+) strand; PAM type: NNAGAAW; PAM sequence: ACAGAAT
atcctgaaacaagtcttcct

SEQ ID NO: 11497 - DNA, 20 bp, Artificial Sequence
  Description of Artificial Sequence: Synthetic oligonucleotide
  Target: ATXN1; (+) strand; PAM type: NNAGAAW; PAM sequence: TGAGAAT
ctgcctgcctctctggcaac

SEQ ID NO: 11498 - DNA, 20 bp, Artificial Sequence
  Description of Artificial Sequence: Synthetic oligonucleotide
  Target: ATXN1; (+) strand; PAM type: NNAGAAW; PAM sequence: AGAGAAA
cggctggactgagagagcaa

SEQ ID NO: 11499 - DNA, 20 bp, Artificial Sequence
  Description of Artificial Sequence: Synthetic oligonucleotide
  Target: ATXN1; (+) strand; PAM type: NNAGAAW; PAM sequence: AGAGAAA
tcccacctgattcctgacac

SEQ ID NO: 11500 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
gagatggcaacagattaaaa

SEQ ID NO: 11501 - DNA, 20 bp, Artificial Sequence
  Description of Artificial Sequence: Synthetic oligonucleotide
  Target: ATXN1; (+) strand; PAM type: NNAGAAW; PAM sequence: GGAGAAT
ctactcaggaggctggggca

SEQ ID NO: 11502 - DNA, 20 bp, Artificial Sequence
  Description of Artificial Sequence: Synthetic oligonucleotide
  Target: ATXN1; (+) strand; PAM type: NNAGAAW; PAM sequence: ACAGAAA
atttcttaattctacaaaat

SEQ ID NO: 11503 - DNA, 20 bp, Artificial Sequence
  Description of Artificial Sequence: Synthetic oligonucleotide
  Target: ATXN1; (+) strand; PAM type: NNAGAAW; PAM sequence: AAAGAAT
cttaattctacaaaatacag

SEQ ID NO: 11504 - DNA, 20 bp, Artificial Sequence
  Description of Artificial Sequence: Synthetic oligonucleotide
  Target: ATXN1; (+) strand; PAM type: NNAGAAW; PAM sequence: TAAGAAA
aaaatacagaaagaatatta

SEQ ID NO: 11505 - DNA, 20 bp, Artificial Sequence
  Description of Artificial Sequence: Synthetic oligonucleotide
  Target: ATXN1; (+) strand; PAM type: NNAGAAW; PAM sequence: GAAGAAT
cccgtattaacagagccagg

SEQ ID NO: 11506 - DNA, 20 bp, Artificial Sequence
  Description of Artificial Sequence: Synthetic oligonucleotide
  Target: ATXN1; (+) strand; PAM type: NNAGAAW; PAM sequence: TGAGAAA
tcacaagcactgagctgcaa

SEQ ID NO: 11507 - DNA, 20 bp, Artificial Sequence
  Description of Artificial Sequence: Synthetic oligonucleotide
  Target: ATXN1; (+) strand; PAM type: NNAGAAW; PAM sequence: AAAGAAT
cactggcattctctgtggtc

SEQ ID NO: 11508 - DNA, 20 bp, Artificial Sequence
  Description of Artificial Sequence: Synthetic oligonucleotide
  Target: ATXN1; (+) strand; PAM type: NNAGAAW; PAM sequence: ACAGAAA
ttcctatagtaatagctgtc

SEQ ID NO: 11509 - DNA, 20 bp, Artificial Sequence
  Description of Artificial Sequence: Synthetic oligonucleotide
  Target: ATXN1; (+) strand; PAM type: NNAGAAW; PAM sequence: CCAGAAT
atactgcttggtgttacagg

SEQ ID NO: 11510 - DNA, 20 bp, Artificial Sequence
  Description of Artificial Sequence: Synthetic oligonucleotide
  Target: ATXN1; (+) strand; PAM type: NNAGAAW; PAM sequence: GGAGAAT
ctactttggaggctgaggca

SEQ ID NO: 11511 - DNA, 20 bp, Artificial Sequence
  Description of Artificial Sequence: Synthetic oligonucleotide
  Target: ATXN1; (+) strand; PAM type: NNAGAAW; PAM sequence: ACAGAAT
ttaaattgccacctccatct

SEQ ID NO: 11512 - DNA, 20 bp, Artificial Sequence
  Description of Artificial Sequence: Synthetic oligonucleotide
  Target: ATXN1; (+) strand; PAM type: NNAGAAW; PAM sequence: AAAGAAT
aacatattttccaaccgatg

SEQ ID NO: 11513 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
actgacctcttggaaaaaaa

SEQ ID NO: 11514 - DNA, 20 bp, Artificial Sequence
  Description of Artificial Sequence: Synthetic oligonucleotide
  Target: ATXN1; (+) strand; PAM type: NNAGAAW; PAM sequence: GGAGAAA
aagaccagcttgaccaacat

SEQ ID NO: 11515 - DNA, 20 bp, Artificial Sequence
  Description of Artificial Sequence: Synthetic oligonucleotide
  Target: ATXN1; (+) strand; PAM type: NNAGAAW; PAM sequence: GGAGAAT
ctacttgggaggctgaggca

SEQ ID NO: 11516 - DNA, 20 bp, Artificial Sequence
  Description of Artificial Sequence: Synthetic oligonucleotide
  Target: ATXN1; (+) strand; PAM type: NNAGAAW; PAM sequence: GGAGAAT
ccactccggaggctgacgca

SEQ ID NO: 11517 - DNA, 20 bp, Artificial Sequence
  Description of Artificial Sequence: Synthetic oligonucleotide
  Target: ATXN1; (+) strand; PAM type: NNAGAAW; PAM sequence: CAAGAAT
caaaaatattgtcatctcac

SEQ ID NO: 11518 - DNA, 20 bp, Artificial Sequence
  Description of Artificial Sequence: Synthetic oligonucleotide
  Target: ATXN1; (+) strand; PAM type: NNAGAAW; PAM sequence: CGAGAAA
ctttgttctccatgatggtg

SEQ ID NO: 11519 - DNA, 20 bp, Artificial Sequence
  Description of Artificial Sequence: Synthetic oligonucleotide
  Target: ATXN1; (+) strand; PAM type: NNAGAAW; PAM sequence: AGAGAAA
gaaaaagtagggaaaaaaga

SEQ ID NO: 11520 - DNA, 20 bp, Artificial Sequence
  Description of Artificial Sequence: Synthetic oligonucleotide
  Target: ATXN1; (+) strand; PAM type: NNAGAAW; PAM sequence: AGAGAAA
gaaaaaagaagagaaaaagg

SEQ ID NO: 11521 - DNA, 20 bp, Artificial Sequence
  Description of Artificial Sequence: Synthetic oligonucleotide
  Target: ATXN1; (+) strand; PAM type: NNAGAAW; PAM sequence: GAAGAAT
agtggttccttctgaggtgg

SEQ ID NO: 11522 - DNA, 20 bp, Artificial Sequence
  Description of Artificial Sequence: Synthetic oligonucleotide
  Target: ATXN1; (+) strand; PAM type: NNAGAAW; PAM sequence: TAAGAAA
gaaacaaatctaatggttta

SEQ ID NO: 11523 - DNA, 20 bp, Artificial Sequence
  Description of Artificial Sequence: Synthetic oligonucleotide
  Target: ATXN1; (+) strand; PAM type: NNAGAAW; PAM sequence: GAAGAAT
atggtttataagaaaagtgt

SEQ ID NO: 11524 - DNA, 20 bp, Artificial Sequence
  Description of Artificial Sequence: Synthetic oligonucleotide
  Target: ATXN1; (+) strand; PAM type: NNAGAAW; PAM sequence: AAAGAAT
tcctaatatcttacattgac

SEQ ID NO: 11525 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
gtgcgagactccatctcaaa

SEQ ID NO: 11526 - DNA, 20 bp, Artificial Sequence
  Description of Artificial Sequence: Synthetic oligonucleotide
  Target: ATXN1; (+) strand; PAM type: NNAGAAW; PAM sequence: TGAGAAA
gtactctgcatatagtaggc

SEQ ID NO: 11527 - DNA, 20 bp, Artificial Sequence
  Description of Artificial Sequence: Synthetic oligonucleotide
  Target: ATXN1; (+) strand; PAM type: NNAGAAW; PAM sequence: ATAGAAT
atatagtaggctgagaaaaa

SEQ ID NO: 11528 - DNA, 20 bp, Artificial Sequence
  Description of Artificial Sequence: Synthetic oligonucleotide
  Target: ATXN1; (+) strand; PAM type: NNAGAAW; PAM sequence: CCAGAAT
ctgatattcatggctaaact

SEQ ID NO: 11529 - DNA, 20 bp, Artificial Sequence
  Description of Artificial Sequence: Synthetic oligonucleotide
  Target: ATXN1; (+) strand; PAM type: NNAGAAW; PAM sequence: TAAGAAT
taattttattatcaaagtat

SEQ ID NO: 11530 - DNA, 20 bp, Artificial Sequence
  Description of Artificial Sequence: Synthetic oligonucleotide
  Target: ATXN1; (+) strand; PAM type: NNAGAAW; PAM sequence: TTAGAAA
tatgcctacctggtaagttt

SEQ ID NO: 11531 - DNA, 20 bp, Artificial Sequence
  Description of Artificial Sequence: Synthetic oligonucleotide
  Target: ATXN1; (+) strand; PAM type: NNAGAAW; PAM sequence: GTAGAAT
ctaacacaacagttctccta

SEQ ID NO: 11532 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
agtaaaaagaggctgttaca

SEQ ID NO: 11533 - DNA, 20 bp, Artificial Sequence
  Description of Artificial Sequence: Synthetic oligonucleotide
  Target: ATXN1; (+) strand; PAM type: NNAGAAW; PAM sequence: TTAGAAA
atcacatagtaatttacatc

SEQ ID NO: 11534 - DNA, 20 bp, Artificial Sequence
  Description of Artificial Sequence: Synthetic oligonucleotide
  Target: ATXN1; (+) strand; PAM type: NNAGAAW; PAM sequence: GCAGAAA
ataaatcccctttccagaga

SEQ ID NO: 11535 - DNA, 20 bp, Artificial Sequence
  Description of Artificial Sequence: Synthetic oligonucleotide
  Target: ATXN1; (+) strand; PAM type: NNAGAAW; PAM sequence: AGAGAAA
aggcaaaaactttcagtcag

SEQ ID NO: 11536 - DNA, 20 bp, Artificial Sequence
  Description of Artificial Sequence: Synthetic oligonucleotide
  Target: ATXN1; (+) strand; PAM type: NNAGAAW; PAM sequence: AAAGAAT
cttcacagagactggtaaat

SEQ ID NO: 11537 - DNA, 20 bp, Artificial Sequence
  Description of Artificial Sequence: Synthetic oligonucleotide
  Target: ATXN1; (+) strand; PAM type: NNAGAAW; PAM sequence: TCAGAAA
gtttctgccaaccgcctggt

SEQ ID NO: 11538 - DNA, 20 bp, Artificial Sequence
  Description of Artificial Sequence: Synthetic oligonucleotide
  Target: ATXN1; (+) strand; PAM type: NNAGAAW; PAM sequence: ACAGAAA
cctgacccacagcaaagaac

SEQ ID NO: 11539 - DNA, 20 bp, Artificial Sequence
  Description of Artificial Sequence: Synthetic oligonucleotide
  Target: ATXN1; (+) strand; PAM type: NNAGAAW; PAM sequence: ACAGAAA
agctgtagggtgtatgaaga

SEQ ID NO: 11540 - DNA, 20 bp, Artificial Sequence
  Description of Artificial Sequence: Synthetic oligonucleotide
  Target: ATXN1; (+) strand; PAM type: NNAGAAW; PAM sequence: TGAGAAA
gacaaatagattttcatctc

SEQ ID NO: 11541 - DNA, 20 bp, Artificial Sequence
  Description of Artificial Sequence: Synthetic oligonucleotide
  Target: ATXN1; (+) strand; PAM type: NNAGAAW; PAM sequence: CAAGAAA
tctgagaaataacaatggag

SEQ ID NO: 11542 - DNA, 20 bp, Artificial Sequence
  Description of Artificial Sequence: Synthetic oligonucleotide
  Target: ATXN1; (+) strand; PAM type: NNAGAAW; PAM sequence: GAAGAAA
atggagcaagaaatagagag

SEQ ID NO: 11543 - DNA, 20 bp, Artificial Sequence
  Description of Artificial Sequence: Synthetic oligonucleotide
  Target: ATXN1; (+) strand; PAM type: NNAGAAW; PAM sequence: TCAGAAT
ggaaactccagccataatat

SEQ ID NO: 11544 - DNA, 20 bp, Artificial Sequence
  Description of Artificial Sequence: Synthetic oligonucleotide
  Target: ATXN1; (+) strand; PAM type: NNAGAAW; PAM sequence: CTAGAAT
ataatattcagaataacaca

SEQ ID NO: 11545 - DNA, 20 bp, Artificial Sequence
  Description of Artificial Sequence: Synthetic oligonucleotide
  Target: ATXN1; (+) strand; PAM type: NNAGAAW; PAM sequence: GTAGAAA
gatgaaatcccagaagagaa

SEQ ID NO: 11546 - DNA, 20 bp, Artificial Sequence
  Description of Artificial Sequence: Synthetic oligonucleotide
  Target: ATXN1; (+) strand; PAM type: NNAGAAW; PAM sequence: ACAGAAA
agcgatggttcagcaataag

SEQ ID NO: 11547 - DNA, 20 bp, Artificial Sequence
  Description of Artificial Sequence: Synthetic oligonucleotide
  Target: ATXN1; (+) strand; PAM type: NNAGAAW; PAM sequence: TAAGAAA
aaaaaaaagtagtttctaag

SEQ ID NO: 11548 - DNA, 20 bp, Artificial Sequence
  Description of Artificial Sequence: Synthetic oligonucleotide
  Target: ATXN1; (+) strand; PAM type: NNAGAAW; PAM sequence: ACAGAAA
gtagcaaattagttataaac

SEQ ID NO: 11549 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
caaattagttataaacacag

SEQ ID NO: 11550 - DNA, 20 bp, Artificial Sequence
  Description of Artificial Sequence: Synthetic oligonucleotide
  Target: ATXN1; (+) strand; PAM type: NNAGAAW; PAM sequence: TAAGAAT
caaaatagacggcatccagt

SEQ ID NO: 11551 - DNA, 20 bp, Artificial Sequence
  Description of Artificial Sequence: Synthetic oligonucleotide
  Target: ATXN1; (+) strand; PAM type: NNAGAAW; PAM sequence: GCAGAAT
tccagttaagaattttgaaa

SEQ ID NO: 11552 - DNA, 20 bp, Artificial Sequence
  Description of Artificial Sequence: Synthetic oligonucleotide
  Target: ATXN1; (+) strand; PAM type: NNAGAAW; PAM sequence: CCAGAAT
cagcgaatccaggaccaatg

SEQ ID NO: 11553 - DNA, 20 bp, Artificial Sequence
  Description of Artificial Sequence: Synthetic oligonucleotide
  Target: ATXN1; (+) strand; PAM type: NNAGAAW; PAM sequence: GTAGAAA
ctaatttctccttgaggaga

SEQ ID NO: 11554 - DNA, 20 bp, Artificial Sequence
  Description of Artificial Sequence: Synthetic oligonucleotide
  Target: ATXN1; (+) strand; PAM type: NNAGAAW; PAM sequence: GGAGAAT
tccttgaggagagtagaaat

SEQ ID NO: 11555 - DNA, 20 bp, Artificial Sequence
  Description of Artificial Sequence: Synthetic oligonucleotide
  Target: ATXN1; (+) strand; PAM type: NNAGAAW; PAM sequence: GAAGAAA
tcagggagccatcatgagga

SEQ ID NO: 11556 - DNA, 20 bp, Artificial Sequence
  Description of Artificial Sequence: Synthetic oligonucleotide
  Target: ATXN1; (+) strand; PAM type: NNAGAAW; PAM sequence: TCAGAAA
aagaaaaaaggtaatctgtt

SEQ ID NO: 11557 - DNA, 20 bp, Artificial Sequence
  Description of Artificial Sequence: Synthetic oligonucleotide
  Target: ATXN1; (+) strand; PAM type: NNAGAAW; PAM sequence: CTAGAAT
gtgtgtgtattggcaaaaga

SEQ ID NO: 11558 - DNA, 20 bp, Artificial Sequence
  Description of Artificial Sequence: Synthetic oligonucleotide
  Target: ATXN1; (+) strand; PAM type: NNAGAAW; PAM sequence: TTAGAAA
ctgcaggcactggccctggc

SEQ ID NO: 11559 - DNA, 20 bp, Artificial Sequence
  Description of Artificial Sequence: Synthetic oligonucleotide
  Target: ATXN1; (+) strand; PAM type: NNAGAAW; PAM sequence: TTAGAAA
gcttagaaatgttatttcat

SEQ ID NO: 11560 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
aattcaattttctttaagtg

SEQ ID NO: 11561 - DNA, 20 bp, Artificial Sequence
  Description of Artificial Sequence: Synthetic oligonucleotide
  Target: ATXN1; (+) strand; PAM type: NNAGAAW; PAM sequence: CTAGAAA
tgtatctgcttatgtaaaca

SEQ ID NO: 11562 - DNA, 20 bp, Artificial Sequence
  Description of Artificial Sequence: Synthetic oligonucleotide
  Target: ATXN1; (+) strand; PAM type: NNAGAAW; PAM sequence: GGAGAAA
tgtaaacactagaaatccag

SEQ ID NO: 11563 - DNA, 20 bp, Artificial Sequence
  Description of Artificial Sequence: Synthetic oligonucleotide
  Target: ATXN1; (+) strand; PAM type: NNAGAAW; PAM sequence: CCAGAAT
gtgtcatcctttagggtggc

SEQ ID NO: 11564 - DNA, 20 bp, Artificial Sequence
  Description of Artificial Sequence: Synthetic oligonucleotide
  Target: ATXN1; (+) strand; PAM type: NNAGAAW; PAM sequence: AGAGAAA
tctgttctgtgacctgttag

SEQ ID NO: 11565 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
caccagcaaactacttctgc

SEQ ID NO: 11566 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
agcaaactacttctgcaaag

SEQ ID NO: 11567 - DNA, 20 bp, Artificial Sequence
  Description of Artificial Sequence: Synthetic oligonucleotide
  Target: ATXN1; (+) strand; PAM type: NNAGAAW; PAM sequence: GCAGAAT
caccagctccttcttgccta

SEQ ID NO: 11568 - DNA, 20 bp, Artificial Sequence
  Description of Artificial Sequence: Synthetic oligonucleotide
  Target: ATXN1; (+) strand; PAM type: NNAGAAW; PAM sequence: GTAGAAA
aatctcttctgtaacatcta

SEQ ID NO: 11569 - DNA, 20 bp, Artificial Sequence
  Description of Artificial Sequence: Synthetic oligonucleotide
  Target: ATXN1; (+) strand; PAM type: NNAGAAW; PAM sequence: AGAGAAA
aagacagcagatacctacac

SEQ ID NO: 11570 - DNA, 20 bp, Artificial Sequence
  Description of Artificial Sequence: Synthetic oligonucleotide
  Target: ATXN1; (+) strand; PAM type: NNAGAAW; PAM sequence: TCAGAAA
gaagagagctgaactacaag

SEQ ID NO: 11571 - DNA, 20 bp, Artificial Sequence
  Description of Artificial Sequence: Synthetic oligonucleotide
  Target: ATXN1; (+) strand; PAM type: NNAGAAW; PAM sequence: CTAGAAA
cgtaggttctgttttctccc

SEQ ID NO: 11572 - DNA, 20 bp, Artificial Sequence
  Description of Artificial Sequence: Synthetic oligonucleotide
  Target: ATXN1; (+) strand; PAM type: NNAGAAW; PAM sequence: GCAGAAT
ctaaatcagaggctcagact

SEQ ID NO: 11573 - DNA, 20 bp, Artificial Sequence
  Description of Artificial Sequence: Synthetic oligonucleotide
  Target: ATXN1; (+) strand; PAM type: NNAGAAW; PAM sequence: AGAGAAA
cagactgcagaataccatca

SEQ ID NO: 11574 - DNA, 20 bp, Artificial Sequence
  Description of Artificial Sequence: Synthetic oligonucleotide
  Target: ATXN1; (+) strand; PAM type: NNAGAAW; PAM sequence: AGAGAAA
tacttttgactagtcctaca

SEQ ID NO: 11575 - DNA, 20 bp, Artificial Sequence
  Description of Artificial Sequence: Synthetic oligonucleotide
  Target: ATXN1; (+) strand; PAM type: NNAGAAW; PAM sequence: TGAGAAA
aagaccctggacatttaaaa

SEQ ID NO: 11576 - DNA, 20 bp, Artificial Sequence
  Description of Artificial Sequence: Synthetic oligonucleotide
  Target: ATXN1; (+) strand; PAM type: NNAGAAW; PAM sequence: ACAGAAA
attaagtgcacccttcagag

SEQ ID NO: 11577 - DNA, 20 bp, Artificial Sequence
  Description of Artificial Sequence: Synthetic oligonucleotide
  Target: ATXN1; (+) strand; PAM type: NNAGAAW; PAM sequence: TCAGAAA
cccacatttcaaggtcctac

SEQ ID NO: 11578 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
agctcgctgggaggaaaatt

SEQ ID NO: 11579 - DNA, 20 bp, Artificial Sequence
  Description of Artificial Sequence: Synthetic oligonucleotide
  Target: ATXN1; (+) strand; PAM type: NNAGAAW; PAM sequence: AGAGAAA
acttgttccttctgaagagt

SEQ ID NO: 11580 - DNA, 20 bp, Artificial Sequence
  Description of Artificial Sequence: Synthetic oligonucleotide
  Target: ATXN1; (+) strand; PAM type: NNAGAAW; PAM sequence: ATAGAAA
ccatatttccttcaaactca

SEQ ID NO: 11581 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
tgggtctatgaccacttaca

SEQ ID NO: 11582 - DNA, 20 bp, Artificial Sequence
  Description of Artificial Sequence: Synthetic oligonucleotide
  Target: ATXN1; (+) strand; PAM type: NNAGAAW; PAM sequence: CCAGAAA
gaaaagtatcagatcagaca

SEQ ID NO: 11583 - DNA, 20 bp, Artificial Sequence
  Description of Artificial Sequence: Synthetic oligonucleotide
  Target: ATXN1; (+) strand; PAM type: NNAGAAW; PAM sequence: GAAGAAT
acacagagcctggaaaaggg

SEQ ID NO: 11584 - DNA, 20 bp, Artificial Sequence
  Description of Artificial Sequence: Synthetic oligonucleotide
  Target: ATXN1; (+) strand; PAM type: NNAGAAW; PAM sequence: TCAGAAT
gggaggcatttccatacctg

SEQ ID NO: 11585 - DNA, 20 bp, Artificial Sequence
  Description of Artificial Sequence: Synthetic oligonucleotide
  Target: ATXN1; (+) strand; PAM type: NNAGAAW; PAM sequence: CTAGAAA
tccttgggataactatctca

SEQ ID NO: 11586 - DNA, 20 bp, Artificial Sequence
  Description of Artificial Sequence: Synthetic oligonucleotide
  Target: ATXN1; (+) strand; PAM type: NNAGAAW; PAM sequence: TCAGAAA
ttaaaggagactgatcaaag

SEQ ID NO: 11587 - DNA, 20 bp, Artificial Sequence
  Description of Artificial Sequence: Synthetic oligonucleotide
  Target: ATXN1; (+) strand; PAM type: NNAGAAW; PAM sequence: CCAGAAA
tattacgtacagctttcttt

SEQ ID NO: 11588 - DNA, 20 bp, Artificial Sequence
  Description of Artificial Sequence: Synthetic oligonucleotide
  Target: ATXN1; (+) strand; PAM type: NNAGAAW; PAM sequence: GAAGAAT
tgtgaagtattatacaaggg

SEQ ID NO: 11589 - DNA, 20 bp, Artificial Sequence
  Description of Artificial Sequence: Synthetic oligonucleotide
  Target: ATXN1; (+) strand; PAM type: NNAGAAW; PAM sequence: CCAGAAA
gaatggggtgctatgggaac

SEQ ID NO: 11590 - DNA, 20 bp, Artificial Sequence
  Description of Artificial Sequence: Synthetic oligonucleotide
  Target: ATXN1; (+) strand; PAM type: NNAGAAW; PAM sequence: CAAGAAT
gagactctaagctgagattt

SEQ ID NO: 11591 - DNA, 20 bp, Artificial Sequence
  Description of Artificial Sequence: Synthetic oligonucleotide
  Target: ATXN1; (+) strand; PAM type: NNAGAAW; PAM sequence: TAAGAAA
tgagaacccagggagggagt

SEQ ID NO: 11592 - DNA, 20 bp, Artificial Sequence
  Description of Artificial Sequence: Synthetic oligonucleotide
  Target: ATXN1; (+) strand; PAM type: NNAGAAW; PAM sequence: GCAGAAA
gcagggcagcctgctacgta

SEQ ID NO: 11593 - DNA, 20 bp, Artificial Sequence
  Description of Artificial Sequence: Synthetic oligonucleotide
  Target: ATXN1; (+) strand; PAM type: NNAGAAW; PAM sequence: TGAGAAA
gctcccaggacagggctccc

SEQ ID NO: 11594 - DNA, 20 bp, Artificial Sequence
  Description of Artificial Sequence: Synthetic oligonucleotide
  Target: ATXN1; (+) strand; PAM type: NNAGAAW; PAM sequence: TGAGAAT
ggaaaccggcacagggtggg

SEQ ID NO: 11595 - DNA, 20 bp, Artificial Sequence
  Description of Artificial Sequence: Synthetic oligonucleotide
  Target: ATXN1; (+) strand; PAM type: NNAGAAW; PAM sequence: ATAGAAA
ggggaaaggggcccttggaa

SEQ ID NO: 11596 - DNA, 20 bp, Artificial Sequence
  Description of Artificial Sequence: Synthetic oligonucleotide
  Target: ATXN1; (+) strand; PAM type: NNAGAAW; PAM sequence: GAAGAAA
cccaaggggaaaagtgagca

SEQ ID NO: 11597 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
aggggaaaagtgagcagaag

SEQ ID NO: 11598 - DNA, 20 bp, Artificial Sequence
  Description of Artificial Sequence: Synthetic oligonucleotide
  Target: ATXN1; (+) strand; PAM type: NNAGAAW; PAM sequence: GCAGAAT
ggaccactcgccagcctggt

SEQ ID NO: 11599 - DNA, 20 bp, Artificial Sequence
  Description of Artificial Sequence: Synthetic oligonucleotide
  Target: ATXN1; (+) strand; PAM type: NNAGAAW; PAM sequence: GAAGAAA
gttggccctgggtacaagta

SEQ ID NO: 11600 - DNA, 20 bp, Artificial Sequence
  Description of Artificial Sequence: Synthetic oligonucleotide
  Target: ATXN1; (+) strand; PAM type: NNAGAAW; PAM sequence: TTAGAAA
aaagagctcatatacataga

SEQ ID NO: 11601 - DNA, 20 bp, Artificial Sequence
  Description of Artificial Sequence: Synthetic oligonucleotide
  Target: ATXN1; (+) strand; PAM type: NNAGAAW; PAM sequence: TTAGAAA
atgtaaattggtacagcctt

SEQ ID NO: 11602 - DNA, 20 bp, Artificial Sequence
  Description of Artificial Sequence: Synthetic oligonucleotide
  Target: ATXN1; (+) strand; PAM type: NNAGAAW; PAM sequence: TTAGAAA
ggctttacaacagtaaacaa

SEQ ID NO: 11603 - DNA, 20 bp, Artificial Sequence
  Description of Artificial Sequence: Synthetic oligonucleotide
  Target: ATXN1; (+) strand; PAM type: NNAGAAW; PAM sequence: ATAGAAT
aattaagataaaacaacctg

SEQ ID NO: 11604 - DNA, 20 bp, Artificial Sequence
  Description of Artificial Sequence: Synthetic oligonucleotide
  Target: ATXN1; (+) strand; PAM type: NNAGAAW; PAM sequence: TAAGAAT
aactgtatagctgaagttac

SEQ ID NO: 11605 - DNA, 20 bp, Artificial Sequence
  Description of Artificial Sequence: Synthetic oligonucleotide
  Target: ATXN1; (+) strand; PAM type: NNAGAAW; PAM sequence: GCAGAAA
gtccttcccaagagctacct

SEQ ID NO: 11606 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
tctatttgcactagctgcct

SEQ ID NO: 11607 - DNA, 20 bp, Artificial Sequence
  Description of Artificial Sequence: Synthetic oligonucleotide
  Target: ATXN1; (+) strand; PAM type: NNAGAAW; PAM sequence: AGAGAAA
attgggaaagttgacgcaga

SEQ ID NO: 11608 - DNA, 20 bp, Artificial Sequence
  Description of Artificial Sequence: Synthetic oligonucleotide
  Target: ATXN1; (+) strand; PAM type: NNAGAAW; PAM sequence: GCAGAAT
tttctacttgcaaattaaaa

SEQ ID NO: 11609 - DNA, 20 bp, Artificial Sequence
  Description of Artificial Sequence: Synthetic oligonucleotide
  Target: ATXN1; (+) strand; PAM type: NNAGAAW; PAM sequence: TTAGAAA
atggcccttgatattactgc

SEQ ID NO: 11610 - DNA, 20 bp, Artificial Sequence
  Description of Artificial Sequence: Synthetic oligonucleotide
  Target: ATXN1; (+) strand; PAM type: NNAGAAW; PAM sequence: CCAGAAA
agttatactgcattccacct

SEQ ID NO: 11611 - DNA, 20 bp, Artificial Sequence
  Description of Artificial Sequence: Synthetic oligonucleotide
  Target: ATXN1; (+) strand; PAM type: NNAGAAW; PAM sequence: CAAGAAT
ggtcttgggggagccgggag

SEQ ID NO: 11612 - DNA, 20 bp, Artificial Sequence
  Description of Artificial Sequence: Synthetic oligonucleotide
  Target: ATXN1; (+) strand; PAM type: NNAGAAW; PAM sequence: ACAGAAA
atcctgttgcagggcaggca

SEQ ID NO: 11613 - DNA, 20 bp, Artificial Sequence
  Description of Artificial Sequence: Synthetic oligonucleotide
  Target: ATXN1; (+) strand; PAM type: NNAGAAW; PAM sequence: TCAGAAA
catcgctgttaagtaactca

SEQ ID NO: 11614 - DNA, 20 bp, Artificial Sequence
  Description of Artificial Sequence: Synthetic oligonucleotide
  Target: ATXN1; (+) strand; PAM type: NNAGAAW; PAM sequence: TAAGAAA
cagtaatttttcactcagtg

SEQ ID NO: 11615 - DNA, 20 bp, Artificial Sequence
  Description of Artificial Sequence: Synthetic oligonucleotide
  Target: ATXN1; (+) strand; PAM type: NNAGAAW; PAM sequence: AGAGAAA
ggccttccctaagccagcta

SEQ ID NO: 11616 - DNA, 20 bp, Artificial Sequence
  Description of Artificial Sequence: Synthetic oligonucleotide
  Target: ATXN1; (+) strand; PAM type: NNAGAAW; PAM sequence: AGAGAAA
attcactgttctagtgaagg

SEQ ID NO: 11617 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
aggagatatgagtaagagtg

SEQ ID NO: 11618 - DNA, 20 bp, Artificial Sequence
  Description of Artificial Sequence: Synthetic oligonucleotide
  Target: ATXN1; (+) strand; PAM type: NNAGAAW; PAM sequence: GGAGAAA
tgagtaagagtgaaagaaag

SEQ ID NO: 11619 - DNA, 20 bp, Artificial Sequence
  Description of Artificial Sequence: Synthetic oligonucleotide
  Target: ATXN1; (+) strand; PAM type: NNAGAAW; PAM sequence: TCAGAAA
cctgcatgggacagcctgtg

SEQ ID NO: 11620 - DNA, 20 bp, Artificial Sequence
  Description of Artificial Sequence: Synthetic oligonucleotide
  Target: ATXN1; (+) strand; PAM type: NNAGAAW; PAM sequence: GGAGAAA
agtttcctcgcctgtgcaat

SEQ ID NO: 11621 - DNA, 20 bp, Artificial Sequence
  Description of Artificial Sequence: Synthetic oligonucleotide
  Target: ATXN1; (+) strand; PAM type: NNAGAAW; PAM sequence: GCAGAAT
aggattcaataagttaatat

SEQ ID NO: 11622 - DNA, 20 bp, Artificial Sequence
  Description of Artificial Sequence: Synthetic oligonucleotide
  Target: ATXN1; (+) strand; PAM type: NNAGAAW; PAM sequence: GCAGAAA
tctcacattttaaagagtct

SEQ ID NO: 11623 - DNA, 20 bp, Artificial Sequence
  Description of Artificial Sequence: Synthetic oligonucleotide
  Target: ATXN1; (+) strand; PAM type: NNAGAAW; PAM sequence: GTAGAAA
gtgagatgaataaatcaacg

SEQ ID NO: 11624 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
aatcaacggtagaaaagatc

SEQ ID NO: 11625 - DNA, 20 bp, Artificial Sequence
  Description of Artificial Sequence: Synthetic oligonucleotide
  Target: ATXN1; (+) strand; PAM type: NNAGAAW; PAM sequence: CCAGAAA
tctctactgtctgctcgaat

SEQ ID NO: 11626 - DNA, 20 bp, Artificial Sequence
  Description of Artificial Sequence: Synthetic oligonucleotide
  Target: ATXN1; (+) strand; PAM type: NNAGAAW; PAM sequence: ACAGAAA
tgctccatccatctcttccc

SEQ ID NO: 11627 - DNA, 20 bp, Artificial Sequence
  Description of Artificial Sequence: Synthetic oligonucleotide
  Target: ATXN1; (+) strand; PAM type: NNAGAAW; PAM sequence: GAAGAAA
tctttcccctgcctgaccag

SEQ ID NO: 11628 - DNA, 20 bp, Artificial Sequence
  Description of Artificial Sequence: Synthetic oligonucleotide
  Target: ATXN1; (+) strand; PAM type: NNAGAAW; PAM sequence: CCAGAAA
tatttataaaataactagaa

SEQ ID NO: 11629 - DNA, 20 bp, Artificial Sequence
  Description of Artificial Sequence: Synthetic oligonucleotide
  Target: ATXN1; (+) strand; PAM type: NNAGAAW; PAM sequence: TAAGAAA
aaagaactataatgtaggtt

SEQ ID NO: 11630 - DNA, 20 bp, Artificial Sequence
  Description of Artificial Sequence: Synthetic oligonucleotide
  Target: ATXN1; (+) strand; PAM type: NNAGAAW; PAM sequence: ATAGAAA
agctttctttaaatgcaatc

SEQ ID NO: 11631 - DNA, 20 bp, Artificial Sequence
  Description of Artificial Sequence: Synthetic oligonucleotide
  Target: ATXN1; (+) strand; PAM type: NNAGAAW; PAM sequence: TCAGAAT
gtcagagagttgtgataaat

SEQ ID NO: 11632 - DNA, 20 bp, Artificial Sequence
  Description of Artificial Sequence: Synthetic oligonucleotide
  Target: ATXN1; (+) strand; PAM type: NNAGAAW; PAM sequence: TAAGAAA
ccatcctcacagcagcccta

SEQ ID NO: 11633 - DNA, 20 bp, Artificial Sequence
  Description of Artificial Sequence: Synthetic oligonucleotide
  Target: ATXN1; (+) strand; PAM type: NNAGAAW; PAM sequence: AGAGAAT
atgctcttatctaagatgcc

SEQ ID NO: 11634 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
aaagaggcagctctttcttc

SEQ ID NO: 11635 - DNA, 20 bp, Artificial Sequence
  Description of Artificial Sequence: Synthetic oligonucleotide
  Target: ATXN1; (+) strand; PAM type: NNAGAAW; PAM sequence: GTAGAAT
aaatgggagatttgctaaaa

SEQ ID NO: 11636 - DNA, 20 bp, Artificial Sequence
  Description of Artificial Sequence: Synthetic oligonucleotide
  Target: ATXN1; (+) strand; PAM type: NNAGAAW; PAM sequence: ATAGAAA
caggtccatttccaaggcaa

SEQ ID NO: 11637 - DNA, 20 bp, Artificial Sequence
  Description of Artificial Sequence: Synthetic oligonucleotide
  Target: ATXN1; (+) strand; PAM type: NNAGAAW; PAM sequence: CCAGAAA
tgtctgcatgactctccagg

SEQ ID NO: 11638 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
tgtaaaatccaaacagacac

SEQ ID NO: 11639 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
tatgcccaaacagagtttgc

SEQ ID NO: 11640 - DNA, 20 bp, Artificial Sequence
  Description of Artificial Sequence: Synthetic oligonucleotide
  Target: ATXN1; (+) strand; PAM type: NNAGAAW; PAM sequence: ACAGAAT
gaggaaatccaaaatgaaaa

SEQ ID NO: 11641 - DNA, 20 bp, Artificial Sequence
  Description of Artificial Sequence: Synthetic oligonucleotide
  Target: ATXN1; (+) strand; PAM type: NNAGAAW; PAM sequence: TGAGAAT
acattcggcattctgttgta

SEQ ID NO: 11642 - DNA, 20 bp, Artificial Sequence
  Description of Artificial Sequence: Synthetic oligonucleotide
  Target: ATXN1; (+) strand; PAM type: NNAGAAW; PAM sequence: GAAGAAA
cataccagtccaatggaata

SEQ ID NO: 11643 - DNA, 20 bp, Artificial Sequence
  Description of Artificial Sequence: Synthetic oligonucleotide
  Target: ATXN1; (+) strand; PAM type: NNAGAAW; PAM sequence: GCAGAAA
aatagaagaaaggaaaaaat

SEQ ID NO: 11644 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
aatgtgtgaatggatgaatg

SEQ ID NO: 11645 - DNA, 20 bp, Artificial Sequence
  Description of Artificial Sequence: Synthetic oligonucleotide
  Target: ATXN1; (+) strand; PAM type: NNAGAAW; PAM sequence: AAAGAAT
tgtgaatggatgaatgaaag

SEQ ID NO: 11646 - DNA, 20 bp, Artificial Sequence
  Description of Artificial Sequence: Synthetic oligonucleotide
  Target: ATXN1; (+) strand; PAM type: NNAGAAW; PAM sequence: ATAGAAA
ttgtgaggtaaaacctatgc

SEQ ID NO: 11647 - DNA, 20 bp, Artificial Sequence
  Description of Artificial Sequence: Synthetic oligonucleotide
  Target: ATXN1; (+) strand; PAM type: NNAGAAW; PAM sequence: ACAGAAA
ttaccaattatccacattaa

SEQ ID NO: 11648 - DNA, 20 bp, Artificial Sequence
  Description of Artificial Sequence: Synthetic oligonucleotide
  Target: ATXN1; (+) strand; PAM type: NNAGAAW; PAM sequence: TCAGAAA
gcccaggtttatattggatg

SEQ ID NO: 11649 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
aggtttatattggatgtcag

SEQ ID NO: 11650 - DNA, 20 bp, Artificial Sequence
  Description of Artificial Sequence: Synthetic oligonucleotide
  Target: ATXN1; (+) strand; PAM type: NNAGAAW; PAM sequence: CAAGAAT
ttccatcagagggaagaagg

SEQ ID NO: 11651 - DNA, 20 bp, Artificial Sequence
  Description of Artificial Sequence: Synthetic oligonucleotide
  Target: ATXN1; (+) strand; PAM type: NNAGAAW; PAM sequence: CCAGAAA
aaaacttacaaaataatata

SEQ ID NO: 11652 - DNA, 20 bp, Artificial Sequence
  Description of Artificial Sequence: Synthetic oligonucleotide
  Target: ATXN1; (+) strand; PAM type: NNAGAAW; PAM sequence: CAAGAAA
tattaatattggaagattaa

SEQ ID NO: 11653 - DNA, 20 bp, Artificial Sequence
  Description of Artificial Sequence: Synthetic oligonucleotide
  Target: ATXN1; (+) strand; PAM type: NNAGAAW; PAM sequence: TGAGAAA
gtaagtaccaggagataatg

SEQ ID NO: 11654 - DNA, 20 bp, Artificial Sequence
  Description of Artificial Sequence: Synthetic oligonucleotide
  Target: ATXN1; (+) strand; PAM type: NNAGAAW; PAM sequence: CAAGAAA
ggggaacaaaattaagggca

SEQ ID NO: 11655 - DNA, 20 bp, Artificial Sequence
  Description of Artificial Sequence: Synthetic oligonucleotide
  Target: ATXN1; (+) strand; PAM type: NNAGAAW; PAM sequence: ACAGAAA
aaagtttgccatacacagtg

SEQ ID NO: 11656 - DNA, 20 bp, Artificial Sequence
  Description of Artificial Sequence: Synthetic oligonucleotide
  Target: ATXN1; (+) strand; PAM type: NNAGAAW; PAM sequence: ACAGAAA
aatgggatgcattaaaagtt

SEQ ID NO: 11657 - DNA, 20 bp, Artificial Sequence
  Description of Artificial Sequence: Synthetic oligonucleotide
  Target: ATXN1; (+) strand; PAM type: NNAGAAW; PAM sequence: AAAGAAT
tatccataaatataattata

SEQ ID NO: 11658 - DNA, 20 bp, Artificial Sequence
  Description of Artificial Sequence: Synthetic oligonucleotide
  Target: ATXN1; (+) strand; PAM type: NNAGAAW; PAM sequence: TTAGAAA
gatgacttaaaattcttatc

SEQ ID NO: 11659 - DNA, 20 bp, Artificial Sequence
  Description of Artificial Sequence: Synthetic oligonucleotide
  Target: ATXN1; (+) strand; PAM type: NNAGAAW; PAM sequence: ACAGAAA
tctatatgtaaggtcctaaa

SEQ ID NO: 11660 - DNA, 20 bp, Artificial Sequence
  Description of Artificial Sequence: Synthetic oligonucleotide
  Target: ATXN1; (+) strand; PAM type: NNAGAAW; PAM sequence: ACAGAAA
tgcacagatctaaatctctc

SEQ ID NO: 11661 - DNA, 20 bp, Artificial Sequence
  Description of Artificial Sequence: Synthetic oligonucleotide
  Target: ATXN1; (+) strand; PAM type: NNAGAAW; PAM sequence: AAAGAAT
ttttcagataactacagttt

SEQ ID NO: 11662 - DNA, 20 bp, Artificial Sequence
  Description of Artificial Sequence: Synthetic oligonucleotide
  Target: ATXN1; (+) strand; PAM type: NNAGAAW; PAM sequence: TCAGAAT
tttacctacttacgtgagtt

SEQ ID NO: 11663 - DNA, 20 bp, Artificial Sequence
  Description of Artificial Sequence: Synthetic oligonucleotide
  Target: ATXN1; (+) strand; PAM type: NNAGAAW; PAM sequence: TCAGAAA
atgagtgttagtgttagtca

SEQ ID NO: 11664 - DNA, 20 bp, Artificial Sequence
  Description of Artificial Sequence: Synthetic oligonucleotide
  Target: ATXN1; (+) strand; PAM type: NNAGAAW; PAM sequence: TCAGAAT
agtaaaatccacttgacatt

SEQ ID NO: 11665 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
ataaaggcacaacattattc

SEQ ID NO: 11666 - DNA, 20 bp, Artificial Sequence
  Description of Artificial Sequence: Synthetic oligonucleotide
  Target: ATXN1; (+) strand; PAM type: NNAGAAW; PAM sequence: ATAGAAT
atttttctatatgttgcaaa

SEQ ID NO: 11667 - DNA, 20 bp, Artificial Sequence
  Description of Artificial Sequence: Synthetic oligonucleotide
  Target: ATXN1; (+) strand; PAM type: NNAGAAW; PAM sequence: GAAGAAA
ttataaaagttgagtagcta

SEQ ID NO: 11668 - DNA, 20 bp, Artificial Sequence
  Description of Artificial Sequence: Synthetic oligonucleotide
  Target: ATXN1; (+) strand; PAM type: NNAGAAW; PAM sequence: CTAGAAT
gtggtgccctaatgcaaaga

SEQ ID NO: 11669 - DNA, 20 bp, Artificial Sequence
  Description of Artificial Sequence: Synthetic oligonucleotide
  Target: ATXN1; (+) strand; PAM type: NNAGAAW; PAM sequence: TAAGAAT
cacagccaatagatccaaat

SEQ ID NO: 11670 - DNA, 20 bp, Artificial Sequence
  Description of Artificial Sequence: Synthetic oligonucleotide
  Target: ATXN1; (+) strand; PAM type: NNAGAAW; PAM sequence: TCAGAAT
caaattaagaatgaatacat

SEQ ID NO: 11671 - DNA, 20 bp, Artificial Sequence
  Description of Artificial Sequence: Synthetic oligonucleotide
  Target: ATXN1; (+) strand; PAM type: NNAGAAW; PAM sequence: TTAGAAA
tattcccctgagtaaaccct

SEQ ID NO: 11672 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
gccaaaggcaccagactgca

SEQ ID NO: 11673 - DNA, 20 bp, Artificial Sequence
  Description of Artificial Sequence: Synthetic oligonucleotide
  Target: ATXN1; (+) strand; PAM type: NNAGAAW; PAM sequence: ACAGAAA
cagcctcctaaaaaacccaa

SEQ ID NO: 11674 - DNA, 20 bp, Artificial Sequence
  Description of Artificial Sequence: Synthetic oligonucleotide
  Target: ATXN1; (+) strand; PAM type: NNAGAAW; PAM sequence: GGAGAAA
atgcacgacaggatgtgcag

SEQ ID NO: 11675 - DNA, 20 bp, Artificial Sequence
  Description of Artificial Sequence: Synthetic oligonucleotide
  Target: ATXN1; (+) strand; PAM type: NNAGAAW; PAM sequence: TAAGAAT
tgtggatctcgcagggaagc

SEQ ID NO: 11676 - DNA, 20 bp, Artificial Sequence
  Description of Artificial Sequence: Synthetic oligonucleotide
  Target: ATXN1; (+) strand; PAM type: NNAGAAW; PAM sequence: CAAGAAA
ttatctgtaggattatatac

SEQ ID NO: 11677 - DNA, 20 bp, Artificial Sequence
  Description of Artificial Sequence: Synthetic oligonucleotide
  Target: ATXN1; (+) strand; PAM type: NNAGAAW; PAM sequence: TTAGAAA
gaaccgaatccccgccgtcc

SEQ ID NO: 11678 - DNA, 20 bp, Artificial Sequence
  Description of Artificial Sequence: Synthetic oligonucleotide
  Target: ATXN1; (+) strand; PAM type: NNAGAAW; PAM sequence: CTAGAAA
aaggttcttgctcaatctcc

SEQ ID NO: 11679 - DNA, 20 bp, Artificial Sequence
  Description of Artificial Sequence: Synthetic oligonucleotide
  Target: ATXN1; (+) strand; PAM type: NNAGAAW; PAM sequence: AAAGAAT
aagggaatgggggagggggg

SEQ ID NO: 11680 - DNA, 20 bp, Artificial Sequence
  Description of Artificial Sequence: Synthetic oligonucleotide
  Target: ATXN1; (+) strand; PAM type: NNAGAAW; PAM sequence: AGAGAAA
ggggaagggggggcagaggg

SEQ ID NO: 11681 - DNA, 20 bp, Artificial Sequence
  Description of Artificial Sequence: Synthetic oligonucleotide
  Target: ATXN1; (+) strand; PAM type: NNAGAAW; PAM sequence: GTAGAAA
tgtacggctccgccactgta

SEQ ID NO: 11682 - DNA, 20 bp, Artificial Sequence
  Description of Artificial Sequence: Synthetic oligonucleotide
  Target: ATXN1; (+) strand; PAM type: NNAGAAW; PAM sequence: AGAGAAA
aggtaaccagtgtaggagac

SEQ ID NO: 11683 - DNA, 20 bp, Artificial Sequence
  Description of Artificial Sequence: Synthetic oligonucleotide
  Target: ATXN1; (+) strand; PAM type: NNAGAAW; PAM sequence: CGAGAAT
gagcatcaaatggcagttct

SEQ ID NO: 11684 - DNA, 20 bp, Artificial Sequence
  Description of Artificial Sequence: Synthetic oligonucleotide
  Target: ATXN1; (+) strand; PAM type: NNAGAAW; PAM sequence: TCAGAAA
cctgcttggcaaagacgact

SEQ ID NO: 11685 - DNA, 20 bp, Artificial Sequence
  Description of Artificial Sequence: Synthetic oligonucleotide
  Target: ATXN1; (+) strand; PAM type: NNAGAAW; PAM sequence: ATAGAAA
cagaagcttgttggctttat

SEQ ID NO: 11686 - DNA, 20 bp, Artificial Sequence
  Description of Artificial Sequence: Synthetic oligonucleotide
  Target: ATXN1; (+) strand; PAM type: NNAGAAW; PAM sequence: ACAGAAA
tattactggactgtgaataa

SEQ ID NO: 11687 - DNA, 20 bp, Artificial Sequence
  Description of Artificial Sequence: Synthetic oligonucleotide
  Target: ATXN1; (+) strand; PAM type: NNAGAAW; PAM sequence: ACAGAAA
tcatctcaaatatttttata

SEQ ID NO: 11688 - DNA, 20 bp, Artificial Sequence
  Description of Artificial Sequence: Synthetic oligonucleotide
  Target: ATXN1; (+) strand; PAM type: NNAGAAW; PAM sequence: TAAGAAA
caaatggtaaaaacaattaa

SEQ ID NO: 11689 - DNA, 20 bp, Artificial Sequence
  Description of Artificial Sequence: Synthetic oligonucleotide
  Target: ATXN1; (+) strand; PAM type: NNAGAAW; PAM sequence: TTAGAAA
aaataacaggcactgattct

SEQ ID NO: 11690 - DNA, 20 bp, Artificial Sequence
  Description of Artificial Sequence: Synthetic oligonucleotide
  Target: ATXN1; (+) strand; PAM type: NNAGAAW; PAM sequence: TCAGAAT
tctaccccagacataccaaa

SEQ ID NO: 11691 - DNA, 20 bp, Artificial Sequence
  Description of Artificial Sequence: Synthetic oligonucleotide
  Target: ATXN1; (+) strand; PAM type: NNAGAAW; PAM sequence: AAAGAAT
tctgcatcattattgccaaa

SEQ ID NO: 11692 - DNA, 20 bp, Artificial Sequence
  Description of Artificial Sequence: Synthetic oligonucleotide
  Target: ATXN1; (+) strand; PAM type: NNAGAAW; PAM sequence: AAAGAAA
gttttaggcttgaattctta

SEQ ID NO: 11693 - DNA, 20 bp, Artificial Sequence
  Description of Artificial Sequence: Synthetic oligonucleotide
  Target: ATXN1; (+) strand; PAM type: NNAGAAW; PAM sequence: ACAGAAT
aaaaacaaagataacacaac

SEQ ID NO: 11694 - DNA, 20 bp, Artificial Sequence
  Description of Artificial Sequence: Synthetic oligonucleotide
  Target: ATXN1; (+) strand; PAM type: NNAGAAW; PAM sequence: ACAGAAT
tactcaaaaacaaagataac

SEQ ID NO: 11695 - DNA, 20 bp, Artificial Sequence
  Description of Artificial Sequence: Synthetic oligonucleotide
  Target: ATXN1; (+) strand; PAM type: NNAGAAW; PAM sequence: TCAGAAT
gccttttgctgtgtttacac

SEQ ID NO: 11696 - DNA, 20 bp, Artificial Sequence
  Description of Artificial Sequence: Synthetic oligonucleotide
  Target: ATXN1; (+) strand; PAM type: NNAGAAW; PAM sequence: TGAGAAT
catctacaataactaagact

SEQ ID NO: 11697 - DNA, 20 bp, Artificial Sequence
  Description of Artificial Sequence: Synthetic oligonucleotide
  Target: ATXN1; (+) strand; PAM type: NNAGAAW; PAM sequence: CCAGAAT
ttgatgcgatccagcacctg

SEQ ID NO: 11698 - DNA, 20 bp, Artificial Sequence
  Description of Artificial Sequence: Synthetic oligonucleotide
  Target: ATXN1; (+) strand; PAM type: NNAGAAW; PAM sequence: TGAGAAT
agcaatcagacttccaaata

SEQ ID NO: 11699 - DNA, 20 bp, Artificial Sequence
  Description of Artificial Sequence: Synthetic oligonucleotide
  Target: ATXN1; (+) strand; PAM type: NNAGAAW; PAM sequence: TTAGAAT
ccaaatatgagaatcaaaca

SEQ ID NO: 11700 - DNA, 20 bp, Artificial Sequence
  Description of Artificial Sequence: Synthetic oligonucleotide
  Target: ATXN1; (+) strand; PAM type: NNAGAAW; PAM sequence: AAAGAAT
tatcttttctaaaatgctga

SEQ ID NO: 11701 - DNA, 20 bp, Artificial Sequence
  Description of Artificial Sequence: Synthetic oligonucleotide
  Target: ATXN1; (+) strand; PAM type: NNAGAAW; PAM sequence: CCAGAAA
ttatggctgtgtaataaatc

SEQ ID NO: 11702 - DNA, 20 bp, Artificial Sequence
  Description of Artificial Sequence: Synthetic oligonucleotide
  Target: ATXN1; (+) strand; PAM type: NNAGAAW; PAM sequence: ACAGAAT
aatttttaatggaaacactg

SEQ ID NO: 11703 - DNA, 20 bp, Artificial Sequence
  Description of Artificial Sequence: Synthetic oligonucleotide
  Target: ATXN1; (-) strand; PAM type: NNGRRT; PAM sequence: AGGAGT
agcaacgttcacattttcag

SEQ ID NO: 11704 - DNA, 20 bp, Artificial Sequence
  Description of Artificial Sequence: Synthetic oligonucleotide
  Target: ATXN1; (-) strand; PAM type: NNGRRT; PAM sequence: TTGGAT
gcaccagaggcttccaggct

SEQ ID NO: 11705 - DNA, 20 bp, Artificial Sequence
  Description of Artificial Sequence: Synthetic oligonucleotide
  Target: ATXN1; (-) strand; PAM type: NNGRRT; PAM sequence: TGGAAT
atgtgtgggtccaagcaagg

SEQ ID NO: 11706 - DNA, 20 bp, Artificial Sequence
  Description of Artificial Sequence: Synthetic oligonucleotide
  Target: ATXN1; (-) strand; PAM type: NNGRRT; PAM sequence: GTGGGT
acctatcaccctgcacatgt

SEQ ID NO: 11707 - DNA, 20 bp, Artificial Sequence
  Description of Artificial Sequence: Synthetic oligonucleotide
  Target: ATXN1; (-) strand; PAM type: NNGRRT; PAM sequence: CTGGGT
ctgcctgtctttctgctttg

SEQ ID NO: 11708 - DNA, 20 bp, Artificial Sequence
  Description of Artificial Sequence: Synthetic oligonucleotide
  Target: ATXN1; (-) strand; PAM type: NNGRRT; PAM sequence: ATGGAT
caggacgaggaggacataaa

SEQ ID NO: 11709 - DNA, 20 bp, Artificial Sequence
  Description of Artificial Sequence: Synthetic oligonucleotide
  Target: ATXN1; (-) strand; PAM type: NNGRRT; PAM sequence: CAGAAT
ccaggagcccaaaatgcccc

SEQ ID NO: 11710 - DNA, 20 bp, Artificial Sequence
  Description of Artificial Sequence: Synthetic oligonucleotide
  Target: ATXN1; (-) strand; PAM type: NNGRRT; PAM sequence: AGGAGT
tcctggtgagcagcgcttga

SEQ ID NO: 11711 - DNA, 20 bp, Artificial Sequence
  Description of Artificial Sequence: Synthetic oligonucleotide
  Target: ATXN1; (-) strand; PAM type: NNGRRT; PAM sequence: TAGAAT
ccccaccttaagagcccaat

SEQ ID NO: 11712 - DNA, 20 bp, Artificial Sequence
  Description of Artificial Sequence: Synthetic oligonucleotide
  Target: ATXN1; (-) strand; PAM type: NNGRRT; PAM sequence: CAGGAT
ctcagtcccccgagaatatc

SEQ ID NO: 11713 - DNA, 20 bp, Artificial Sequence
  Description of Artificial Sequence: Synthetic oligonucleotide
  Target: ATXN1; (-) strand; PAM type: NNGRRT; PAM sequence: GAGAAT
cacgtggacctcagtccccc

SEQ ID NO: 11714 - DNA, 20 bp, Artificial Sequence
  Description of Artificial Sequence: Synthetic oligonucleotide
  Target: ATXN1; (-) strand; PAM type: NNGRRT; PAM sequence: TTGAGT
ttgccctcctgctgagctcc

SEQ ID NO: 11715 - DNA, 20 bp, Artificial Sequence
  Description of Artificial Sequence: Synthetic oligonucleotide
  Target: ATXN1; (-) strand; PAM type: NNGRRT; PAM sequence: ATGAAT
tgtgctgctgggtcacccgg

SEQ ID NO: 11716 - DNA, 20 bp, Artificial Sequence
  Description of Artificial Sequence: Synthetic oligonucleotide
  Target: ATXN1; (-) strand; PAM type: NNGRRT; PAM sequence: CCGGAT
gtgttgtgctgctgggtcac

SEQ ID NO: 11717 - DNA, 20 bp, Artificial Sequence
  Description of Artificial Sequence: Synthetic oligonucleotide
  Target: ATXN1; (-) strand; PAM type: NNGRRT; PAM sequence: CTGGGT
ctgaacacggtgttgtgctg

SEQ ID NO: 11718 - DNA, 20 bp, Artificial Sequence
  Description of Artificial Sequence: Synthetic oligonucleotide
  Target: ATXN1; (-) strand; PAM type: NNGRRT; PAM sequence: CAGGGT
gccagacgctgctttgtccc

SEQ ID NO: 11719 - DNA, 20 bp, Artificial Sequence
  Description of Artificial Sequence: Synthetic oligonucleotide
  Target: ATXN1; (-) strand; PAM type: NNGRRT; PAM sequence: ATGAGT
ttggtttgaacaatgaggtt

SEQ ID NO: 11720 - DNA, 20 bp, Artificial Sequence
  Description of Artificial Sequence: Synthetic oligonucleotide
  Target: ATXN1; (-) strand; PAM type: NNGRRT; PAM sequence: AGGGAT
gcaaccaaaagctagaggtg

SEQ ID NO: 11721 - DNA, 20 bp, Artificial Sequence
  Description of Artificial Sequence: Synthetic oligonucleotide
  Target: ATXN1; (-) strand; PAM type: NNGRRT; PAM sequence: GTGAGT
aaacacattggctcaacttt

SEQ ID NO: 11722 - DNA, 20 bp, Artificial Sequence
  Description of Artificial Sequence: Synthetic oligonucleotide
  Target: ATXN1; (-) strand; PAM type: NNGRRT; PAM sequence: TGGAAT
ccttcccataaaacatcctg

SEQ ID NO: 11723 - DNA, 20 bp, Artificial Sequence
  Description of Artificial Sequence: Synthetic oligonucleotide
  Target: ATXN1; (-) strand; PAM type: NNGRRT; PAM sequence: TAGGAT
tgtctcaaaccaatgccttt

SEQ ID NO: 11724 - DNA, 20 bp, Artificial Sequence
  Description of Artificial Sequence: Synthetic oligonucleotide
  Target: ATXN1; (-) strand; PAM type: NNGRRT; PAM sequence: GGGAAT
aggattcactggcacactga

SEQ ID NO: 11725 - DNA, 20 bp, Artificial Sequence
  Description of Artificial Sequence: Synthetic oligonucleotide
  Target: ATXN1; (-) strand; PAM type: NNGRRT; PAM sequence: AAGGAT
gccatgtggtccttccgaga

SEQ ID NO: 11726 - DNA, 20 bp, Artificial Sequence
  Description of Artificial Sequence: Synthetic oligonucleotide
  Target: ATXN1; (-) strand; PAM type: NNGRRT; PAM sequence: CAGGGT
cctgtggatcttctctactc

SEQ ID NO: 11727 - DNA, 20 bp, Artificial Sequence
  Description of Artificial Sequence: Synthetic oligonucleotide
  Target: ATXN1; (-) strand; PAM type: NNGRRT; PAM sequence: GTGGAT
ccctggcacagcagcaccct

SEQ ID NO: 11728 - DNA, 20 bp, Artificial Sequence
  Description of Artificial Sequence: Synthetic oligonucleotide
  Target: ATXN1; (-) strand; PAM type: NNGRRT; PAM sequence: CAGAGT
acagtgggcctgtattatcc

SEQ ID NO: 11729 - DNA, 20 bp, Artificial Sequence
  Description of Artificial Sequence: Synthetic oligonucleotide
  Target: ATXN1; (-) strand; PAM type: NNGRRT; PAM sequence: CTGGAT
aatggagacaatgctgctgg

SEQ ID NO: 11730 - DNA, 20 bp, Artificial Sequence
  Description of Artificial Sequence: Synthetic oligonucleotide
  Target: ATXN1; (-) strand; PAM type: NNGRRT; PAM sequence: ATGGAT
aaaaaaaaaaaaaactctta

SEQ ID NO: 11731 - DNA, 20 bp, Artificial Sequence
  Description of Artificial Sequence: Synthetic oligonucleotide
  Target: ATXN1; (-) strand; PAM type: NNGRRT; PAM sequence: GAGGAT
tacttgggagactgaggtca

SEQ ID NO: 11732 - DNA, 20 bp, Artificial Sequence
  Description of Artificial Sequence: Synthetic oligonucleotide
  Target: ATXN1; (-) strand; PAM type: NNGRRT; PAM sequence: TGGAGT
caggtggatggcttgagccc

SEQ ID NO: 11733 - DNA, 20 bp, Artificial Sequence
  Description of Artificial Sequence: Synthetic oligonucleotide
  Target: ATXN1; (-) strand; PAM type: NNGRRT; PAM sequence: GTGGAT
ctttggggaggttgacgcag

SEQ ID NO: 11734 - DNA, 20 bp, Artificial Sequence
  Description of Artificial Sequence: Synthetic oligonucleotide
  Target: ATXN1; (-) strand; PAM type: NNGRRT; PAM sequence: AAGAGT
ccttgtgtttctacaggtgc

SEQ ID NO: 11735 - DNA, 20 bp, Artificial Sequence
  Description of Artificial Sequence: Synthetic oligonucleotide
  Target: ATXN1; (-) strand; PAM type: NNGRRT; PAM sequence: ACGAGT
tctgcttcaaaatggtccta

SEQ ID NO: 11736 - DNA, 20 bp, Artificial Sequence
  Description of Artificial Sequence: Synthetic oligonucleotide
  Target: ATXN1; (-) strand; PAM type: NNGRRT; PAM sequence: CTGGGT
attgtgccactgcactctgc

SEQ ID NO: 11737 - DNA, 20 bp, Artificial Sequence
  Description of Artificial Sequence: Synthetic oligonucleotide
  Target: ATXN1; (-) strand; PAM type: NNGRRT; PAM sequence: GAGAAT
tactctgaaggctgaggcac

SEQ ID NO: 11738 - DNA, 20 bp, Artificial Sequence
  Description of Artificial Sequence: Synthetic oligonucleotide
  Target: ATXN1; (-) strand; PAM type: NNGRRT; PAM sequence: CTGGGT
cccaggagtttgagaccagc

SEQ ID NO: 11739 - DNA, 20 bp, Artificial Sequence
  Description of Artificial Sequence: Synthetic oligonucleotide
  Target: ATXN1; (-) strand; PAM type: NNGRRT; PAM sequence: AGGAGT
tgggtggatcacccgagccc

SEQ ID NO: 11740 - DNA, 20 bp, Artificial Sequence
  Description of Artificial Sequence: Synthetic oligonucleotide
  Target: ATXN1; (-) strand; PAM type: NNGRRT; PAM sequence: GTGGAT
actttgggaggctgaggtgg

SEQ ID NO: 11741 - DNA, 20 bp, Artificial Sequence
  Description of Artificial Sequence: Synthetic oligonucleotide
  Target: ATXN1; (-) strand; PAM type: NNGRRT; PAM sequence: GTGGGT
cagcactttgggaggctgag

SEQ ID NO: 11742 - DNA, 20 bp, Artificial Sequence
  Description of Artificial Sequence: Synthetic oligonucleotide
  Target: ATXN1; (-) strand; PAM type: NNGRRT; PAM sequence: GTGGGT
gctctggcacaggaagccca

SEQ ID NO: 11743 - DNA, 20 bp, Artificial Sequence
  Description of Artificial Sequence: Synthetic oligonucleotide
  Target: ATXN1; (-) strand; PAM type: NNGRRT; PAM sequence: TCGAGT
gtggcccaaggcaaatggcg

SEQ ID NO: 11744 - DNA, 20 bp, Artificial Sequence
  Description of Artificial Sequence: Synthetic oligonucleotide
  Target: ATXN1; (-) strand; PAM type: NNGRRT; PAM sequence: CAGAGT
gagccctcagatggaacggc

SEQ ID NO: 11745 - DNA, 20 bp, Artificial Sequence
  Description of Artificial Sequence: Synthetic oligonucleotide
  Target: ATXN1; (-) strand; PAM type: NNGRRT; PAM sequence: TGGGGT
actgattgttctgacaagtt

SEQ ID NO: 11746 - DNA, 20 bp, Artificial Sequence
  Description of Artificial Sequence: Synthetic oligonucleotide
  Target: ATXN1; (-) strand; PAM type: NNGRRT; PAM sequence: TGGAGT
aagggctgccccaggtcctg

SEQ ID NO: 11747 - DNA, 20 bp, Artificial Sequence
  Description of Artificial Sequence: Synthetic oligonucleotide
  Target: ATXN1; (-) strand; PAM type: NNGRRT; PAM sequence: TGGGGT
cacagaggtgggagaacgct

SEQ ID NO: 11748 - DNA, 20 bp, Artificial Sequence
  Description of Artificial Sequence: Synthetic oligonucleotide
  Target: ATXN1; (-) strand; PAM type: NNGRRT; PAM sequence: TGGAAT
aagaacccatagcttccagg

SEQ ID NO: 11749 - DNA, 20 bp, Artificial Sequence
  Description of Artificial Sequence: Synthetic oligonucleotide
  Target: ATXN1; (-) strand; PAM type: NNGRRT; PAM sequence: AAGAGT
aggaactccccgtttacctc

SEQ ID NO: 11750 - DNA, 20 bp, Artificial Sequence
  Description of Artificial Sequence: Synthetic oligonucleotide
  Target: ATXN1; (-) strand; PAM type: NNGRRT; PAM sequence: GAGGAT
tacttaggggactgaggtgg

SEQ ID NO: 11751 - DNA, 20 bp, Artificial Sequence
  Description of Artificial Sequence: Synthetic oligonucleotide
  Target: ATXN1; (-) strand; PAM type: NNGRRT; PAM sequence: CCGGGT
tctacaaaaaatgaaattag

SEQ ID NO: 11752 - DNA, 20 bp, Artificial Sequence
  Description of Artificial Sequence: Synthetic oligonucleotide
  Target: ATXN1; (-) strand; PAM type: NNGRRT; PAM sequence: AGGAGT
cacaaggcctgcttgagccc

SEQ ID NO: 11753 - DNA, 20 bp, Artificial Sequence
  Description of Artificial Sequence: Synthetic oligonucleotide
  Target: ATXN1; (-) strand; PAM type: NNGRRT; PAM sequence: AAGAGT
gctgctaatgttttgggggg

SEQ ID NO: 11754 - DNA, 20 bp, Artificial Sequence
  Description of Artificial Sequence: Synthetic oligonucleotide
  Target: ATXN1; (-) strand; PAM type: NNGRRT; PAM sequence: CTGGGT
cccccgctcacgagttctcc

SEQ ID NO: 11755 - DNA, 20 bp, Artificial Sequence
  Description of Artificial Sequence: Synthetic oligonucleotide
  Target: ATXN1; (-) strand; PAM type: NNGRRT; PAM sequence: ACGAGT
ctccttattgacccccgctc

SEQ ID NO: 11756 - DNA, 20 bp, Artificial Sequence
  Description of Artificial Sequence: Synthetic oligonucleotide
  Target: ATXN1; (-) strand; PAM type: NNGRRT; PAM sequence: AAGAGT
ctcaaggaagaggccaggaa

SEQ ID NO: 11757 - DNA, 20 bp, Artificial Sequence
  Description of Artificial Sequence: Synthetic oligonucleotide
  Target: ATXN1; (-) strand; PAM type: NNGRRT; PAM sequence: TTGGGT
atgtgtgtctttgccttctg

SEQ ID NO: 11758 - DNA, 20 bp, Artificial Sequence
  Description of Artificial Sequence: Synthetic oligonucleotide
  Target: ATXN1; (-) strand; PAM type: NNGRRT; PAM sequence: TTGAAT
gatacactcgagtctgttta

SEQ ID NO: 11759 - DNA, 20 bp, Artificial Sequence
  Description of Artificial Sequence: Synthetic oligonucleotide
  Target: ATXN1; (-) strand; PAM type: NNGRRT; PAM sequence: TCGAGT
tgtctatttgtaggatacac

SEQ ID NO: 11760 - DNA, 20 bp, Artificial Sequence
  Description of Artificial Sequence: Synthetic oligonucleotide
  Target: ATXN1; (-) strand; PAM type: NNGRRT; PAM sequence: TAGGAT
aatcgtggtgtgtctatttg

SEQ ID NO: 11761 - DNA, 20 bp, Artificial Sequence
  Description of Artificial Sequence: Synthetic oligonucleotide
  Target: ATXN1; (-) strand; PAM type: NNGRRT; PAM sequence: AAGAAT
aaacaaatattaaaaaatgg

SEQ ID NO: 11762 - DNA, 20 bp, Artificial Sequence
  Description of Artificial Sequence: Synthetic oligonucleotide
  Target: ATXN1; (-) strand; PAM type: NNGRRT; PAM sequence: AGGAAT
gtacagaggagaactaggga

SEQ ID NO: 11763 - DNA, 20 bp, Artificial Sequence
  Description of Artificial Sequence: Synthetic oligonucleotide
  Target: ATXN1; (-) strand; PAM type: NNGRRT; PAM sequence: TTGGGT
gggaaaacagacaccagaac

SEQ ID NO: 11764 - DNA, 20 bp, Artificial Sequence
  Description of Artificial Sequence: Synthetic oligonucleotide
  Target: ATXN1; (-) strand; PAM type: NNGRRT; PAM sequence: CTGGAT
catctctgagactcgtacta

SEQ ID NO: 11765 - DNA, 20 bp, Artificial Sequence
  Description of Artificial Sequence: Synthetic oligonucleotide
  Target: ATXN1; (-) strand; PAM type: NNGRRT; PAM sequence: TGGAGT
cagtcttcatttccagccag

SEQ ID NO: 11766 - DNA, 20 bp, Artificial Sequence
  Description of Artificial Sequence: Synthetic oligonucleotide
  Target: ATXN1; (-) strand; PAM type: NNGRRT; PAM sequence: CGGGGT
gtgaatactgccctttttgg

SEQ ID NO: 11767 - DNA, 20 bp, Artificial Sequence
  Description of Artificial Sequence: Synthetic oligonucleotide
  Target: ATXN1; (-) strand; PAM type: NNGRRT; PAM sequence: GTGAAT
atacctgtgcattcagttct

SEQ ID NO: 11768 - DNA, 20 bp, Artificial Sequence
  Description of Artificial Sequence: Synthetic oligonucleotide
  Target: ATXN1; (-) strand; PAM type: NNGRRT; PAM sequence: TGGGGT
tcagttttctggcccaggag

SEQ ID NO: 11769 - DNA, 20 bp, Artificial Sequence
  Description of Artificial Sequence: Synthetic oligonucleotide
  Target: ATXN1; (-) strand; PAM type: NNGRRT; PAM sequence: AGGAGT
ctctttcagttttctggccc

SEQ ID NO: 11770 - DNA, 20 bp, Artificial Sequence
  Description of Artificial Sequence: Synthetic oligonucleotide
  Target: ATXN1; (-) strand; PAM type: NNGRRT; PAM sequence: CAGAAT
caagataacatactgtcctc

SEQ ID NO: 11771 - DNA, 20 bp, Artificial Sequence
  Description of Artificial Sequence: Synthetic oligonucleotide
  Target: ATXN1; (-) strand; PAM type: NNGRRT; PAM sequence: CTGGAT
ccctttagtttgtttgctgt

SEQ ID NO: 11772 - DNA, 20 bp, Artificial Sequence
  Description of Artificial Sequence: Synthetic oligonucleotide
  Target: ATXN1; (-) strand; PAM type: NNGRRT; PAM sequence: AAGAAT
atacaataacaacaatctct

SEQ ID NO: 11773 - DNA, 20 bp, Artificial Sequence
  Description of Artificial Sequence: Synthetic oligonucleotide
  Target: ATXN1; (-) strand; PAM type: NNGRRT; PAM sequence: CAGAAT
ccacttacaattcttaaatt

SEQ ID NO: 11774 - DNA, 20 bp, Artificial Sequence
  Description of Artificial Sequence: Synthetic oligonucleotide
  Target: ATXN1; (-) strand; PAM type: NNGRRT; PAM sequence: GGGGAT
agtggaaactggacagctgt

SEQ ID NO: 11775 - DNA, 20 bp, Artificial Sequence
  Description of Artificial Sequence: Synthetic oligonucleotide
  Target: ATXN1; (-) strand; PAM type: NNGRRT; PAM sequence: CAGAAT
ataaatacggagcatcttct

SEQ ID NO: 11776 - DNA, 20 bp, Artificial Sequence
  Description of Artificial Sequence: Synthetic oligonucleotide
  Target: ATXN1; (-) strand; PAM type: NNGRRT; PAM sequence: CAGAAT
tttatttaatataaagaggc

SEQ ID NO: 11777 - DNA, 20 bp, Artificial Sequence
  Description of Artificial Sequence: Synthetic oligonucleotide
  Target: ATXN1; (-) strand; PAM type: NNGRRT; PAM sequence: GGGAGT
ccacacctcatttaaatggg

SEQ ID NO: 11778 - DNA, 20 bp, Artificial Sequence
  Description of Artificial Sequence: Synthetic oligonucleotide
  Target: ATXN1; (-) strand; PAM type: NNGRRT; PAM sequence: AGGGAT
aacacgaagtgtttgtaaca

SEQ ID NO: 11779 - DNA, 20 bp, Artificial Sequence
  Description of Artificial Sequence: Synthetic oligonucleotide
  Target: ATXN1; (-) strand; PAM type: NNGRRT; PAM sequence: AAGAAT
ttcctgttcctataaaccca

SEQ ID NO: 11780 - DNA, 20 bp, Artificial Sequence
  Description of Artificial Sequence: Synthetic oligonucleotide
  Target: ATXN1; (-) strand; PAM type: NNGRRT; PAM sequence: GAGAAT
aactcggtattctgcgattt

SEQ ID NO: 11781 - DNA, 20 bp, Artificial Sequence
  Description of Artificial Sequence: Synthetic oligonucleotide
  Target: ATXN1; (-) strand; PAM type: NNGRRT; PAM sequence: AAGAAT
tttgtatggttatggcctgg

SEQ ID NO: 11782 - DNA, 20 bp, Artificial Sequence
  Description of Artificial Sequence: Synthetic oligonucleotide
  Target: ATXN1; (-) strand; PAM type: NNGRRT; PAM sequence: AAGGGT
gtaaaaaaaaaaaagcagag

SEQ ID NO: 11783 - DNA, 20 bp, Artificial Sequence
  Description of Artificial Sequence: Synthetic oligonucleotide
  Target: ATXN1; (-) strand; PAM type: NNGRRT; PAM sequence: ATGAGT
gatatggctctgttgaaaca

SEQ ID NO: 11784 - DNA, 20 bp, Artificial Sequence
  Description of Artificial Sequence: Synthetic oligonucleotide
  Target: ATXN1; (-) strand; PAM type: NNGRRT; PAM sequence: ATGAAT
aaaaattgcacaaaagaaaa

SEQ ID NO: 11785 - DNA, 20 bp, Artificial Sequence
  Description of Artificial Sequence: Synthetic oligonucleotide
  Target: ATXN1; (-) strand; PAM type: NNGRRT; PAM sequence: AGGAGT
attttgaagcactcactttg

SEQ ID NO: 11786 - DNA, 20 bp, Artificial Sequence
  Description of Artificial Sequence: Synthetic oligonucleotide
  Target: ATXN1; (-) strand; PAM type: NNGRRT; PAM sequence: GGGAAT
cttgtagcactataccttgt

SEQ ID NO: 11787 - DNA, 20 bp, Artificial Sequence
  Description of Artificial Sequence: Synthetic oligonucleotide
  Target: ATXN1; (-) strand; PAM type: NNGRRT; PAM sequence: TAGGAT
atacgttaccttactgatga

SEQ ID NO: 11788 - DNA, 20 bp, Artificial Sequence
  Description of Artificial Sequence: Synthetic oligonucleotide
  Target: ATXN1; (-) strand; PAM type: NNGRRT; PAM sequence: TTGGGT
cacatgcatctgctattgtg

SEQ ID NO: 11789 - DNA, 20 bp, Artificial Sequence
  Description of Artificial Sequence: Synthetic oligonucleotide
  Target: ATXN1; (-) strand; PAM type: NNGRRT; PAM sequence: GAGAAT
catcaagtaataaatataca

SEQ ID NO: 11790 - DNA, 20 bp, Artificial Sequence
  Description of Artificial Sequence: Synthetic oligonucleotide
  Target: ATXN1; (-) strand; PAM type: NNGRRT; PAM sequence: GAGAAT
aacccagaatttctgaaata

SEQ ID NO: 11791 - DNA, 20 bp, Artificial Sequence
  Description of Artificial Sequence: Synthetic oligonucleotide
  Target: ATXN1; (-) strand; PAM type: NNGRRT; PAM sequence: CAGAAT
ttccacatttgtttttaacc

SEQ ID NO: 11792 - DNA, 20 bp, Artificial Sequence
  Description of Artificial Sequence: Synthetic oligonucleotide
  Target: ATXN1; (-) strand; PAM type: NNGRRT; PAM sequence: GAGAAT
tcggtggtgatgtgaaagga

SEQ ID NO: 11793 - DNA, 20 bp, Artificial Sequence
  Description of Artificial Sequence: Synthetic oligonucleotide
  Target: ATXN1; (-) strand; PAM type: NNGRRT; PAM sequence: ATGGGT
aataccgtgctatttcagat

SEQ ID NO: 11794 - DNA, 20 bp, Artificial Sequence
  Description of Artificial Sequence: Synthetic oligonucleotide
  Target: ATXN1; (-) strand; PAM type: NNGRRT; PAM sequence: CTGGAT
ttatttttgttgttgtagct

SEQ ID NO: 11795 - DNA, 20 bp, Artificial Sequence
  Description of Artificial Sequence: Synthetic oligonucleotide
  Target: ATXN1; (-) strand; PAM type: NNGRRT; PAM sequence: GTGGAT
gtttggatttcctgcatctt

SEQ ID NO: 11796 - DNA, 20 bp, Artificial Sequence
  Description of Artificial Sequence: Synthetic oligonucleotide
  Target: ATXN1; (-) strand; PAM type: NNGRRT; PAM sequence: TTGGAT
tgtacaatttcaaggaatgt

SEQ ID NO: 11797 - DNA, 20 bp, Artificial Sequence
  Description of Artificial Sequence: Synthetic oligonucleotide
  Target: ATXN1; (-) strand; PAM type: NNGRRT; PAM sequence: AGGAAT
agtagggttgtacaatttca

SEQ ID NO: 11798 - DNA, 20 bp, Artificial Sequence
  Description of Artificial Sequence: Synthetic oligonucleotide
  Target: ATXN1; (-) strand; PAM type: NNGRRT; PAM sequence: TAGGGT
gcactttgactgctctggag

SEQ ID NO: 11799 - DNA, 20 bp, Artificial Sequence
  Description of Artificial Sequence: Synthetic oligonucleotide
  Target: ATXN1; (-) strand; PAM type: NNGRRT; PAM sequence: TGGAGT
aagcagcactttgactgctc

SEQ ID NO: 11800 - DNA, 20 bp, Artificial Sequence
  Description of Artificial Sequence: Synthetic oligonucleotide
  Target: ATXN1; (-) strand; PAM type: NNGRRT; PAM sequence: TTGGGT
ttttctgttaggtgagtgtg

SEQ ID NO: 11801 - DNA, 20 bp, Artificial Sequence
  Description of Artificial Sequence: Synthetic oligonucleotide
  Target: ATXN1; (-) strand; PAM type: NNGRRT; PAM sequence: GTGAGT
gcctctatgttttctgttag

SEQ ID NO: 11802 - DNA, 20 bp, Artificial Sequence
  Description of Artificial Sequence: Synthetic oligonucleotide
  Target: ATXN1; (-) strand; PAM type: NNGRRT; PAM sequence: TGGAAT
tgttgatcccatttctaact

SEQ ID NO: 11803 - DNA, 20 bp, Artificial Sequence
  Description of Artificial Sequence: Synthetic oligonucleotide
  Target: ATXN1; (-) strand; PAM type: NNGRRT; PAM sequence: TGGGAT
ctaactcacccagtttagtt

SEQ ID NO: 11804 - DNA, 20 bp, Artificial Sequence
  Description of Artificial Sequence: Synthetic oligonucleotide
  Target: ATXN1; (-) strand; PAM type: NNGRRT; PAM sequence: CAGGAT
tgaattttcatttggacttt

SEQ ID NO: 11805 - DNA, 20 bp, Artificial Sequence
  Description of Artificial Sequence: Synthetic oligonucleotide
  Target: ATXN1; (-) strand; PAM type: NNGRRT; PAM sequence: TTGAAT
ttttaaagtggaaatccaaa

SEQ ID NO: 11806 - DNA, 20 bp, Artificial Sequence
  Description of Artificial Sequence: Synthetic oligonucleotide
  Target: ATXN1; (-) strand; PAM type: NNGRRT; PAM sequence: ATGGAT
ggggagggagggatacagag

SEQ ID NO: 11807 - DNA, 20 bp, Artificial Sequence
  Description of Artificial Sequence: Synthetic oligonucleotide
  Target: ATXN1; (-) strand; PAM type: NNGRRT; PAM sequence: AGGGAT
ctggggcagaggggggaggg

SEQ ID NO: 11808 - DNA, 20 bp, Artificial Sequence
  Description of Artificial Sequence: Synthetic oligonucleotide
  Target: ATXN1; (-) strand; PAM type: NNGRRT; PAM sequence: AAGAAT
ttccttagaatgtttaactt

SEQ ID NO: 11809 - DNA, 20 bp, Artificial Sequence
  Description of Artificial Sequence: Synthetic oligonucleotide
  Target: ATXN1; (-) strand; PAM type: NNGRRT; PAM sequence: TAGAAT
tatataaaatgactgttcct

SEQ ID NO: 11810 - DNA, 20 bp, Artificial Sequence
  Description of Artificial Sequence: Synthetic oligonucleotide
  Target: ATXN1; (-) strand; PAM type: NNGRRT; PAM sequence: AGGGAT
aaacaagaacctctctttct

SEQ ID NO: 11811 - DNA, 20 bp, Artificial Sequence
  Description of Artificial Sequence: Synthetic oligonucleotide
  Target: ATXN1; (-) strand; PAM type: NNGRRT; PAM sequence: AAGGAT
ttcggtgccgttcagcttac

SEQ ID NO: 11812 - DNA, 20 bp, Artificial Sequence
  Description of Artificial Sequence: Synthetic oligonucleotide
  Target: ATXN1; (-) strand; PAM type: NNGRRT; PAM sequence: AGGGGT
tagcaaacattaacgatgac

SEQ ID NO: 11813 - DNA, 20 bp, Artificial Sequence
  Description of Artificial Sequence: Synthetic oligonucleotide
  Target: ATXN1; (-) strand; PAM type: NNGRRT; PAM sequence: CGGGGT
caagtgggcaggcccctcct

SEQ ID NO: 11814 - DNA, 20 bp, Artificial Sequence
  Description of Artificial Sequence: Synthetic oligonucleotide
  Target: ATXN1; (-) strand; PAM type: NNGRRT; PAM sequence: TGGAGT
cactctggagccatgtagcc

SEQ ID NO: 11815 - DNA, 20 bp, Artificial Sequence
  Description of Artificial Sequence: Synthetic oligonucleotide
  Target: ATXN1; (-) strand; PAM type: NNGRRT; PAM sequence: TGGAGT
accacacggaatagtgaatg

SEQ ID NO: 11816 - DNA, 20 bp, Artificial Sequence
  Description of Artificial Sequence: Synthetic oligonucleotide
  Target: ATXN1; (-) strand; PAM type: NNGRRT; PAM sequence: GTGAAT
ccctgtcaccacacggaata

SEQ ID NO: 11817 - DNA, 20 bp, Artificial Sequence
  Description of Artificial Sequence: Synthetic oligonucleotide
  Target: ATXN1; (-) strand; PAM type: NNGRRT; PAM sequence: CGGAAT
cagtgtcccctgtcaccaca

SEQ ID NO: 11818 - DNA, 20 bp, Artificial Sequence
  Description of Artificial Sequence: Synthetic oligonucleotide
  Target: ATXN1; (-) strand; PAM type: NNGRRT; PAM sequence: CTGAGT
cctttcccctgctgcggatg

SEQ ID NO: 11819 - DNA, 20 bp, Artificial Sequence
  Description of Artificial Sequence: Synthetic oligonucleotide
  Target: ATXN1; (-) strand; PAM type: NNGRRT; PAM sequence: GCGGAT
cctcccacctttcccctgct

SEQ ID NO: 11820 - DNA, 20 bp, Artificial Sequence
  Description of Artificial Sequence: Synthetic oligonucleotide
  Target: ATXN1; (-) strand; PAM type: NNGRRT; PAM sequence: TAGAGT
tgcaatactttctgtgccaa

SEQ ID NO: 11821 - DNA, 20 bp, Artificial Sequence
  Description of Artificial Sequence: Synthetic oligonucleotide
  Target: ATXN1; (-) strand; PAM type: NNGRRT; PAM sequence: AGGAAT
tgtggttctatttcaggtat

SEQ ID NO: 11822 - DNA, 20 bp, Artificial Sequence
  Description of Artificial Sequence: Synthetic oligonucleotide
  Target: ATXN1; (-) strand; PAM type: NNGRRT; PAM sequence: CTGGAT
tacttcgagtattgaattga

SEQ ID NO: 11823 - DNA, 20 bp, Artificial Sequence
  Description of Artificial Sequence: Synthetic oligonucleotide
  Target: ATXN1; (-) strand; PAM type: NNGRRT; PAM sequence: TTGAAT
cttttggcttacttcgagta

SEQ ID NO: 11824 - DNA, 20 bp, Artificial Sequence
  Description of Artificial Sequence: Synthetic oligonucleotide
  Target: ATXN1; (-) strand; PAM type: NNGRRT; PAM sequence: TCGAGT
acaccaccttttggcttact

SEQ ID NO: 11825 - DNA, 20 bp, Artificial Sequence
  Description of Artificial Sequence: Synthetic oligonucleotide
  Target: ATXN1; (-) strand; PAM type: NNGRRT; PAM sequence: AGGAAT
ttttagcctttgatggtaag

SEQ ID NO: 11826 - DNA, 20 bp, Artificial Sequence
  Description of Artificial Sequence: Synthetic oligonucleotide
  Target: ATXN1; (-) strand; PAM type: NNGRRT; PAM sequence: CTGGGT
ctcagcatgcttgcagagag

SEQ ID NO: 11827 - DNA, 20 bp, Artificial Sequence
  Description of Artificial Sequence: Synthetic oligonucleotide
  Target: ATXN1; (-) strand; PAM type: NNGRRT; PAM sequence: TCGAAT
gaatagttccttgactttcc

SEQ ID NO: 11828 - DNA, 20 bp, Artificial Sequence
  Description of Artificial Sequence: Synthetic oligonucleotide
  Target: ATXN1; (-) strand; PAM type: NNGRRT; PAM sequence: TAGAAT
ttgaataggtttagaatagc

SEQ ID NO: 11829 - DNA, 20 bp, Artificial Sequence
  Description of Artificial Sequence: Synthetic oligonucleotide
  Target: ATXN1; (-) strand; PAM type: NNGRRT; PAM sequence: TAGAAT
caaaaacatttgaataggtt

SEQ ID NO: 11830 - DNA, 20 bp, Artificial Sequence
  Description of Artificial Sequence: Synthetic oligonucleotide
  Target: ATXN1; (-) strand; PAM type: NNGRRT; PAM sequence: TTGAAT
ctggggtgtaccaaaaacat

SEQ ID NO: 11831 - DNA, 20 bp, Artificial Sequence
  Description of Artificial Sequence: Synthetic oligonucleotide
  Target: ATXN1; (-) strand; PAM type: NNGRRT; PAM sequence: TGGGGT
gatttttataaaccgttttc

SEQ ID NO: 11832 - DNA, 20 bp, Artificial Sequence
  Description of Artificial Sequence: Synthetic oligonucleotide
  Target: ATXN1; (-) strand; PAM type: NNGRRT; PAM sequence: TAGGGT
gtctagtattcatttacatt

SEQ ID NO: 11833 - DNA, 20 bp, Artificial Sequence
  Description of Artificial Sequence: Synthetic oligonucleotide
  Target: ATXN1; (-) strand; PAM type: NNGRRT; PAM sequence: TTGGAT
aaatttttaaatattcttac

SEQ ID NO: 11834 - DNA, 20 bp, Artificial Sequence
  Description of Artificial Sequence: Synthetic oligonucleotide
  Target: ATXN1; (-) strand; PAM type: NNGRRT; PAM sequence: TTGAAT
cgaaatatcatttgtgggtt

SEQ ID NO: 11835 - DNA, 20 bp, Artificial Sequence
  Description of Artificial Sequence: Synthetic oligonucleotide
  Target: ATXN1; (-) strand; PAM type: NNGRRT; PAM sequence: GTGGGT
agagatccgaaatatcattt

SEQ ID NO: 11836 - DNA, 20 bp, Artificial Sequence
  Description of Artificial Sequence: Synthetic oligonucleotide
  Target: ATXN1; (-) strand; PAM type: NNGRRT; PAM sequence: AAGGGT
atgtttggtacaaacccaga

SEQ ID NO: 11837 - DNA, 20 bp, Artificial Sequence
  Description of Artificial Sequence: Synthetic oligonucleotide
  Target: ATXN1; (-) strand; PAM type: NNGRRT; PAM sequence: CAGAAT
gttgttattaatgttatttt

SEQ ID NO: 11838 - DNA, 20 bp, Artificial Sequence
  Description of Artificial Sequence: Synthetic oligonucleotide
  Target: ATXN1; (-) strand; PAM type: NNGRRT; PAM sequence: GAGAGT
attttcttcagattcattga

SEQ ID NO: 11839 - DNA, 20 bp, Artificial Sequence
  Description of Artificial Sequence: Synthetic oligonucleotide
  Target: ATXN1; (-) strand; PAM type: NNGRRT; PAM sequence: GAGAAT
agcgggctcttagaaactct

SEQ ID NO: 11840 - DNA, 20 bp, Artificial Sequence
  Description of Artificial Sequence: Synthetic oligonucleotide
  Target: ATXN1; (-) strand; PAM type: NNGRRT; PAM sequence: TTGAGT
aaccttgcgatttgcacata

SEQ ID NO: 11841 - DNA, 20 bp, Artificial Sequence
  Description of Artificial Sequence: Synthetic oligonucleotide
  Target: ATXN1; (-) strand; PAM type: NNGRRT; PAM sequence: GAGAAT
gagagaaaagggatggagaa

SEQ ID NO: 11842 - DNA, 20 bp, Artificial Sequence
  Description of Artificial Sequence: Synthetic oligonucleotide
  Target: ATXN1; (-) strand; PAM type: NNGRRT; PAM sequence: AGGGAT
ggcagagaaactgagagaaa

SEQ ID NO: 11843 - DNA, 20 bp, Artificial Sequence
  Description of Artificial Sequence: Synthetic oligonucleotide
  Target: ATXN1; (-) strand; PAM type: NNGRRT; PAM sequence: CAGAGT
gaatcagttcaaggcatatg

SEQ ID NO: 11844 - DNA, 20 bp, Artificial Sequence
  Description of Artificial Sequence: Synthetic oligonucleotide
  Target: ATXN1; (-) strand; PAM type: NNGRRT; PAM sequence: GAGAAT
cacttttcactttgatgtct

SEQ ID NO: 11845 - DNA, 20 bp, Artificial Sequence
  Description of Artificial Sequence: Synthetic oligonucleotide
  Target: ATXN1; (-) strand; PAM type: NNGRRT; PAM sequence: GTGAAT
tgtggtttaaagggatgaat

SEQ ID NO: 11846 - DNA, 20 bp, Artificial Sequence
  Description of Artificial Sequence: Synthetic oligonucleotide
  Target: ATXN1; (-) strand; PAM type: NNGRRT; PAM sequence: ATGAAT
tttcaatgtggtttaaaggg

SEQ ID NO: 11847 - DNA, 20 bp, Artificial Sequence
  Description of Artificial Sequence: Synthetic oligonucleotide
  Target: ATXN1; (-) strand; PAM type: NNGRRT; PAM sequence: AGGGAT
aaagtttcaatgtggtttaa

SEQ ID NO: 11848 - DNA, 20 bp, Artificial Sequence
  Description of Artificial Sequence: Synthetic oligonucleotide
  Target: ATXN1; (-) strand; PAM type: NNGRRT; PAM sequence: CAGAAT
gtaactacatttcagctctg

SEQ ID NO: 11849 - DNA, 20 bp, Artificial Sequence
  Description of Artificial Sequence: Synthetic oligonucleotide
  Target: ATXN1; (-) strand; PAM type: NNGRRT; PAM sequence: AGGAAT
tcagattccagtgtgacatg

SEQ ID NO: 11850 - DNA, 20 bp, Artificial Sequence
  Description of Artificial Sequence: Synthetic oligonucleotide
  Target: ATXN1; (-) strand; PAM type: NNGRRT; PAM sequence: TCGGGT
agttcatgactatggacaac

SEQ ID NO: 11851 - DNA, 20 bp, Artificial Sequence
  Description of Artificial Sequence: Synthetic oligonucleotide
  Target: ATXN1; (-) strand; PAM type: NNGRRT; PAM sequence: TTGAGT
agcaacagaagctcttcacg

SEQ ID NO: 11852 - DNA, 20 bp, Artificial Sequence
  Description of Artificial Sequence: Synthetic oligonucleotide
  Target: ATXN1; (-) strand; PAM type: NNGRRT; PAM sequence: GGGGGT
cacatggggtaaggggggtt

SEQ ID NO: 11853 - DNA, 20 bp, Artificial Sequence
  Description of Artificial Sequence: Synthetic oligonucleotide
  Target: ATXN1; (-) strand; PAM type: NNGRRT; PAM sequence: GGGGGT
atggccccacatggggtaag

SEQ ID NO: 11854 - DNA, 20 bp, Artificial Sequence
  Description of Artificial Sequence: Synthetic oligonucleotide
  Target: ATXN1; (-) strand; PAM type: NNGRRT; PAM sequence: TGGGGT
cctgctgtcatggccccaca

SEQ ID NO: 11855 - DNA, 20 bp, Artificial Sequence
  Description of Artificial Sequence: Synthetic oligonucleotide
  Target: ATXN1; (-) strand; PAM type: NNGRRT; PAM sequence: CAGGGT
tactagtgcagcgatgtcac

SEQ ID NO: 11856 - DNA, 20 bp, Artificial Sequence
  Description of Artificial Sequence: Synthetic oligonucleotide
  Target: ATXN1; (-) strand; PAM type: NNGRRT; PAM sequence: CGGGAT
taaagagcaactgccacatg

SEQ ID NO: 11857 - DNA, 20 bp, Artificial Sequence
  Description of Artificial Sequence: Synthetic oligonucleotide
  Target: ATXN1; (-) strand; PAM type: NNGRRT; PAM sequence: TGGGGT
ggttcagagcagtgtcctcc

SEQ ID NO: 11858 - DNA, 20 bp, Artificial Sequence
  Description of Artificial Sequence: Synthetic oligonucleotide
  Target: ATXN1; (-) strand; PAM type: NNGRRT; PAM sequence: GGGGGT
ttgctatcggcatgggccgg

SEQ ID NO: 11859 - DNA, 20 bp, Artificial Sequence
  Description of Artificial Sequence: Synthetic oligonucleotide
  Target: ATXN1; (-) strand; PAM type: NNGRRT; PAM sequence: GAGGGT
caggcgctgtggcggcgagt

SEQ ID NO: 11860 - DNA, 20 bp, Artificial Sequence
  Description of Artificial Sequence: Synthetic oligonucleotide
  Target: ATXN1; (-) strand; PAM type: NNGRRT; PAM sequence: GCGAGT
ggtgcacaggcgctgtggcg

SEQ ID NO: 11861 - DNA, 20 bp, Artificial Sequence
  Description of Artificial Sequence: Synthetic oligonucleotide
  Target: ATXN1; (-) strand; PAM type: NNGRRT; PAM sequence: GGGGGT
gtgcagggttgcacgcatgt

SEQ ID NO: 11862 - DNA, 20 bp, Artificial Sequence
  Description of Artificial Sequence: Synthetic oligonucleotide
  Target: ATXN1; (-) strand; PAM type: NNGRRT; PAM sequence: CAGGGT
ggaagggtcctgcaggggtg

SEQ ID NO: 11863 - DNA, 20 bp, Artificial Sequence
  Description of Artificial Sequence: Synthetic oligonucleotide
  Target: ATXN1; (-) strand; PAM type: NNGRRT; PAM sequence: AGGGGT
tcccgtgggaagggtcctgc

SEQ ID NO: 11864 - DNA, 20 bp, Artificial Sequence
  Description of Artificial Sequence: Synthetic oligonucleotide
  Target: ATXN1; (-) strand; PAM type: NNGRRT; PAM sequence: AAGGGT
caggagaaaagtcccgtggg

SEQ ID NO: 11865 - DNA, 20 bp, Artificial Sequence
  Description of Artificial Sequence: Synthetic oligonucleotide
  Target: ATXN1; (-) strand; PAM type: NNGRRT; PAM sequence: ACGAGT
ctggtgcatatgctttttcc

SEQ ID NO: 11866 - DNA, 20 bp, Artificial Sequence
  Description of Artificial Sequence: Synthetic oligonucleotide
  Target: ATXN1; (-) strand; PAM type: NNGRRT; PAM sequence: TAGAGT
ttctgttctaaccttgtcat

SEQ ID NO: 11867 - DNA, 20 bp, Artificial Sequence
  Description of Artificial Sequence: Synthetic oligonucleotide
  Target: ATXN1; (-) strand; PAM type: NNGRRT; PAM sequence: TGGGAT
actgaagtttccagagaaaa

SEQ ID NO: 11868 - DNA, 20 bp, Artificial Sequence
  Description of Artificial Sequence: Synthetic oligonucleotide
  Target: ATXN1; (-) strand; PAM type: NNGRRT; PAM sequence: GAGAAT
ggagtgcccagatgctctct

SEQ ID NO: 11869 - DNA, 20 bp, Artificial Sequence
  Description of Artificial Sequence: Synthetic oligonucleotide
  Target: ATXN1; (-) strand; PAM type: NNGRRT; PAM sequence: GGGAGT
aggaaaacggaatcaaccag

SEQ ID NO: 11870 - DNA, 20 bp, Artificial Sequence
  Description of Artificial Sequence: Synthetic oligonucleotide
  Target: ATXN1; (-) strand; PAM type: NNGRRT; PAM sequence: CGGAAT
aggtatgccgagcaggaaaa

SEQ ID NO: 11871 - DNA, 20 bp, Artificial Sequence
  Description of Artificial Sequence: Synthetic oligonucleotide
  Target: ATXN1; (-) strand; PAM type: NNGRRT; PAM sequence: GTGGAT
ctgttaaaaagggccagccc

SEQ ID NO: 11872 - DNA, 20 bp, Artificial Sequence
  Description of Artificial Sequence: Synthetic oligonucleotide
  Target: ATXN1; (-) strand; PAM type: NNGRRT; PAM sequence: GGGGAT
cgtgttccaaactctcagtt

SEQ ID NO: 11873 - DNA, 20 bp, Artificial Sequence
  Description of Artificial Sequence: Synthetic oligonucleotide
  Target: ATXN1; (-) strand; PAM type: NNGRRT; PAM sequence: TAGAGT
ggtcagcgttgaagttttgg

SEQ ID NO: 11874 - DNA, 20 bp, Artificial Sequence
  Description of Artificial Sequence: Synthetic oligonucleotide
  Target: ATXN1; (-) strand; PAM type: NNGRRT; PAM sequence: AAGAAT
gtgtgtgcataaaatcaaac

SEQ ID NO: 11875 - DNA, 20 bp, Artificial Sequence
  Description of Artificial Sequence: Synthetic oligonucleotide
  Target: ATXN1; (-) strand; PAM type: NNGRRT; PAM sequence: GTGAGT
ttcagcctgtgtgtgtctgt

SEQ ID NO: 11876 - DNA, 20 bp, Artificial Sequence
  Description of Artificial Sequence: Synthetic oligonucleotide
  Target: ATXN1; (-) strand; PAM type: NNGRRT; PAM sequence: CTGAGT
gggagagggaggtttgcaaa

SEQ ID NO: 11877 - DNA, 20 bp, Artificial Sequence
  Description of Artificial Sequence: Synthetic oligonucleotide
  Target: ATXN1; (-) strand; PAM type: NNGRRT; PAM sequence: TTGAAT
ctaacacttgatggaatatt

SEQ ID NO: 11878 - DNA, 20 bp, Artificial Sequence
  Description of Artificial Sequence: Synthetic oligonucleotide
  Target: ATXN1; (-) strand; PAM type: NNGRRT; PAM sequence: TGGAAT
gctatagagctaacacttga

SEQ ID NO: 11879 - DNA, 20 bp, Artificial Sequence
  Description of Artificial Sequence: Synthetic oligonucleotide
  Target: ATXN1; (-) strand; PAM type: NNGRRT; PAM sequence: TGGGGT
agtgggtgctctgtcattac

SEQ ID NO: 11880 - DNA, 20 bp, Artificial Sequence
  Description of Artificial Sequence: Synthetic oligonucleotide
  Target: ATXN1; (-) strand; PAM type: NNGRRT; PAM sequence: GTGGGT
agcttggtgctgaaagctaa

SEQ ID NO: 11881 - DNA, 20 bp, Artificial Sequence
  Description of Artificial Sequence: Synthetic oligonucleotide
  Target: ATXN1; (-) strand; PAM type: NNGRRT; PAM sequence: TGGGAT
accttggtgtcccaaagtgc

SEQ ID NO: 11882 - DNA, 20 bp, Artificial Sequence
  Description of Artificial Sequence: Synthetic oligonucleotide
  Target: ATXN1; (-) strand; PAM type: NNGRRT; PAM sequence: CGGGGT
ttttttatttttagtggaga

SEQ ID NO: 11883 - DNA, 20 bp, Artificial Sequence
  Description of Artificial Sequence: Synthetic oligonucleotide
  Target: ATXN1; (-) strand; PAM type: NNGRRT; PAM sequence: TGGGAT
gtttcagcctcccaagtagc

SEQ ID NO: 11884 - DNA, 20 bp, Artificial Sequence
  Description of Artificial Sequence: Synthetic oligonucleotide
  Target: ATXN1; (-) strand; PAM type: NNGRRT; PAM sequence: CTGGGT
ctcgctgcaacatctgcctc

SEQ ID NO: 11885 - DNA, 20 bp, Artificial Sequence
  Description of Artificial Sequence: Synthetic oligonucleotide
  Target: ATXN1; (-) strand; PAM type: NNGRRT; PAM sequence: CTGGAT
gtctcactctgtggcccagg

SEQ ID NO: 11886 - DNA, 20 bp, Artificial Sequence
  Description of Artificial Sequence: Synthetic oligonucleotide
  Target: ATXN1; (-) strand; PAM type: NNGRRT; PAM sequence: CGGAGT
ttttttttttttttttgaga

SEQ ID NO: 11887 - DNA, 20 bp, Artificial Sequence
  Description of Artificial Sequence: Synthetic oligonucleotide
  Target: ATXN1; (-) strand; PAM type: NNGRRT; PAM sequence: GAGGGT
tttttagttgtcctcagaag

SEQ ID NO: 11888 - DNA, 20 bp, Artificial Sequence
  Description of Artificial Sequence: Synthetic oligonucleotide
  Target: ATXN1; (-) strand; PAM type: NNGRRT; PAM sequence: CAGAGT
tgtttgcttatatttttgtt

SEQ ID NO: 11889 - DNA, 20 bp, Artificial Sequence
  Description of Artificial Sequence: Synthetic oligonucleotide
  Target: ATXN1; (-) strand; PAM type: NNGRRT; PAM sequence: CAGAGT
aaaagtttaaacattttgtc

SEQ ID NO: 11890 - DNA, 20 bp, Artificial Sequence
  Description of Artificial Sequence: Synthetic oligonucleotide
  Target: ATXN1; (-) strand; PAM type: NNGRRT; PAM sequence: TGGGAT
gccttggcctcccaaagtgc

SEQ ID NO: 11891 - DNA, 20 bp, Artificial Sequence
  Description of Artificial Sequence: Synthetic oligonucleotide
  Target: ATXN1; (-) strand; PAM type: NNGRRT; PAM sequence: TGGGGT
ttttgtatttttagtagaga

SEQ ID NO: 11892 - DNA, 20 bp, Artificial Sequence
  Description of Artificial Sequence: Synthetic oligonucleotide
  Target: ATXN1; (-) strand; PAM type: NNGRRT; PAM sequence: TGGGAT
gcctcagcctcctgagtagc

SEQ ID NO: 11893 - DNA, 20 bp, Artificial Sequence
  Description of Artificial Sequence: Synthetic oligonucleotide
  Target: ATXN1; (-) strand; PAM type: NNGRRT; PAM sequence: CTGAGT
gattctcctgcctcagcctc

SEQ ID NO: 11894 - DNA, 20 bp, Artificial Sequence
  Description of Artificial Sequence: Synthetic oligonucleotide
  Target: ATXN1; (-) strand; PAM type: NNGRRT; PAM sequence: CAGAGT
catgctggccaggctggtct

SEQ ID NO: 11895 - DNA, 20 bp, Artificial Sequence
  Description of Artificial Sequence: Synthetic oligonucleotide
  Target: ATXN1; (-) strand; PAM type: NNGRRT; PAM sequence: CAGGGT
ttttgtatttttagtaggga

SEQ ID NO: 11896 - DNA, 20 bp, Artificial Sequence
  Description of Artificial Sequence: Synthetic oligonucleotide
  Target: ATXN1; (-) strand; PAM type: NNGRRT; PAM sequence: TGGGAT
gcctcagcctcctgagtagc

SEQ ID NO: 11897 - DNA, 20 bp, Artificial Sequence
  Description of Artificial Sequence: Synthetic oligonucleotide
  Target: ATXN1; (-) strand; PAM type: NNGRRT; PAM sequence: CTGAGT
gattctcttgcctcagcctc

SEQ ID NO: 11898 - DNA, 20 bp, Artificial Sequence
  Description of Artificial Sequence: Synthetic oligonucleotide
  Target: ATXN1; (-) strand; PAM type: NNGRRT; PAM sequence: CCGGGT
ttcactgcagcctccgcctc

SEQ ID NO: 11899 - DNA, 20 bp, Artificial Sequence
  Description of Artificial Sequence: Synthetic oligonucleotide
  Target: ATXN1; (-) strand; PAM type: NNGRRT; PAM sequence: TGGAGT
tttcactctgtcgcccaggc

SEQ ID NO: 11900 - DNA, 20 bp, Artificial Sequence
  Description of Artificial Sequence: Synthetic oligonucleotide
  Target: ATXN1; (-) strand; PAM type: NNGRRT; PAM sequence: CGGAGT
gtgtgtgtgtgtgtgtgtga

SEQ ID NO: 11901 - DNA, 20 bp, Artificial Sequence
  Description of Artificial Sequence: Synthetic oligonucleotide
  Target: ATXN1; (-) strand; PAM type: NNGRRT; PAM sequence: TGGAAT
gtttcccaactgctccactt

SEQ ID NO: 11902 - DNA, 20 bp, Artificial Sequence
  Description of Artificial Sequence: Synthetic oligonucleotide
  Target: ATXN1; (-) strand; PAM type: NNGRRT; PAM sequence: AAGAAT
gctttggggtcacaactcaa

SEQ ID NO: 11903 - DNA, 20 bp, Artificial Sequence
  Description of Artificial Sequence: Synthetic oligonucleotide
  Target: ATXN1; (-) strand; PAM type: NNGRRT; PAM sequence: TGGGGT
tcctctaagggacagtgctt

SEQ ID NO: 11904 - DNA, 20 bp, Artificial Sequence
  Description of Artificial Sequence: Synthetic oligonucleotide
  Target: ATXN1; (-) strand; PAM type: NNGRRT; PAM sequence: ATGAGT
atccagttttagggactcag

SEQ ID NO: 11905 - DNA, 20 bp, Artificial Sequence
  Description of Artificial Sequence: Synthetic oligonucleotide
  Target: ATXN1; (-) strand; PAM type: NNGRRT; PAM sequence: TTGAAT
caccaccccccttttttaaa

SEQ ID NO: 11906 - DNA, 20 bp, Artificial Sequence
  Description of Artificial Sequence: Synthetic oligonucleotide
  Target: ATXN1; (-) strand; PAM type: NNGRRT; PAM sequence: ATGGAT
gagccaccatgcctggcttc

SEQ ID NO: 11907 - DNA, 20 bp, Artificial Sequence
  Description of Artificial Sequence: Synthetic oligonucleotide
  Target: ATXN1; (-) strand; PAM type: NNGRRT; PAM sequence: CGGGGT
tttttaaatttctgtagaaa

SEQ ID NO: 11908 - DNA, 20 bp, Artificial Sequence
  Description of Artificial Sequence: Synthetic oligonucleotide
  Target: ATXN1; (-) strand; PAM type: NNGRRT; PAM sequence: CTGAGT
gatcctcctgcctcagcctc

SEQ ID NO: 11909 - DNA, 20 bp, Artificial Sequence
  Description of Artificial Sequence: Synthetic oligonucleotide
  Target: ATXN1; (-) strand; PAM type: NNGRRT; PAM sequence: TGGAGT
tctcactctgttgtccaggc

SEQ ID NO: 11910 - DNA, 20 bp, Artificial Sequence
  Description of Artificial Sequence: Synthetic oligonucleotide
  Target: ATXN1; (-) strand; PAM type: NNGRRT; PAM sequence: CAGAGT
attttttttttttttagaga

SEQ ID NO: 11911 - DNA, 20 bp, Artificial Sequence
  Description of Artificial Sequence: Synthetic oligonucleotide
  Target: ATXN1; (-) strand; PAM type: NNGRRT; PAM sequence: CTGAAT
ctaattagagaatccagttc

SEQ ID NO: 11912 - DNA, 20 bp, Artificial Sequence
  Description of Artificial Sequence: Synthetic oligonucleotide
  Target: ATXN1; (-) strand; PAM type: NNGRRT; PAM sequence: GAGAAT
ctcttctaaagctctaatta

SEQ ID NO: 11913 - DNA, 20 bp, Artificial Sequence
  Description of Artificial Sequence: Synthetic oligonucleotide
  Target: ATXN1; (-) strand; PAM type: NNGRRT; PAM sequence: TGGAGT
ttgtctctatgttcactctg

SEQ ID NO: 11914 - DNA, 20 bp, Artificial Sequence
  Description of Artificial Sequence: Synthetic oligonucleotide
  Target: ATXN1; (-) strand; PAM type: NNGRRT; PAM sequence: TAGGAT
tctccctctcttcctcctcc

SEQ ID NO: 11915 - DNA, 20 bp, Artificial Sequence
  Description of Artificial Sequence: Synthetic oligonucleotide
  Target: ATXN1; (-) strand; PAM type: NNGRRT; PAM sequence: GAGGAT
taattctcatctgcctcagt

SEQ ID NO: 11916 - DNA, 20 bp, Artificial Sequence
  Description of Artificial Sequence: Synthetic oligonucleotide
  Target: ATXN1; (-) strand; PAM type: NNGRRT; PAM sequence: TGGGAT
acctcggcctcccaaagtgc

SEQ ID NO: 11917 - DNA, 20 bp, Artificial Sequence
  Description of Artificial Sequence: Synthetic oligonucleotide
  Target: ATXN1; (-) strand; PAM type: NNGRRT; PAM sequence: TGGGGT
ttttgcatttttagtagaga

SEQ ID NO: 11918 - DNA, 20 bp, Artificial Sequence
  Description of Artificial Sequence: Synthetic oligonucleotide
  Target: ATXN1; (-) strand; PAM type: NNGRRT; PAM sequence: TGGGAT
gcctcagccccccgagtagc

SEQ ID NO: 11919 - DNA, 20 bp, Artificial Sequence
  Description of Artificial Sequence: Synthetic oligonucleotide
  Target: ATXN1; (-) strand; PAM type: NNGRRT; PAM sequence: CCGAGT
gattctcctgcctcagcccc

SEQ ID NO: 11920 - DNA, 20 bp, Artificial Sequence
  Description of Artificial Sequence: Synthetic oligonucleotide
  Target: ATXN1; (-) strand; PAM type: NNGRRT; PAM sequence: CCGGGT
ctcactgcaacctccgcctc

SEQ ID NO: 11921 - DNA, 20 bp, Artificial Sequence
  Description of Artificial Sequence: Synthetic oligonucleotide
  Target: ATXN1; (-) strand; PAM type: NNGRRT; PAM sequence: TGGAAT
tcgcccagtctagagtgtga

SEQ ID NO: 11922 - DNA, 20 bp, Artificial Sequence
  Description of Artificial Sequence: Synthetic oligonucleotide
  Target: ATXN1; (-) strand; PAM type: NNGRRT; PAM sequence: TAGAGT
ttctctattgtcgcccagtc

SEQ ID NO: 11923 - DNA, 20 bp, Artificial Sequence
  Description of Artificial Sequence: Synthetic oligonucleotide
  Target: ATXN1; (-) strand; PAM type: NNGRRT; PAM sequence: TGGAGT
tagaggctttttttttttaa

SEQ ID NO: 11924 - DNA, 20 bp, Artificial Sequence
  Description of Artificial Sequence: Synthetic oligonucleotide
  Target: ATXN1; (-) strand; PAM type: NNGRRT; PAM sequence: GTGAGT
tttttgttgagatgtaaact

SEQ ID NO: 11925 - DNA, 20 bp, Artificial Sequence
  Description of Artificial Sequence: Synthetic oligonucleotide
  Target: ATXN1; (-) strand; PAM type: NNGRRT; PAM sequence: TAGAAT
aaggatctttttgctccata

SEQ ID NO: 11926 - DNA, 20 bp, Artificial Sequence
  Description of Artificial Sequence: Synthetic oligonucleotide
  Target: ATXN1; (-) strand; PAM type: NNGRRT; PAM sequence: AAGGAT
ctattttgccttcattctgg

SEQ ID NO: 11927 - DNA, 20 bp, Artificial Sequence
  Description of Artificial Sequence: Synthetic oligonucleotide
  Target: ATXN1; (-) strand; PAM type: NNGRRT; PAM sequence: GTGAAT
ataatgcagatctgttgatg

SEQ ID NO: 11928 - DNA, 20 bp, Artificial Sequence
  Description of Artificial Sequence: Synthetic oligonucleotide
  Target: ATXN1; (-) strand; PAM type: NNGRRT; PAM sequence: AAGAAT
atttgttttttctctaccta

SEQ ID NO: 11929 - DNA, 20 bp, Artificial Sequence
  Description of Artificial Sequence: Synthetic oligonucleotide
  Target: ATXN1; (-) strand; PAM type: NNGRRT; PAM sequence: AAGAAT
ccctctcacaaaaagaaaaa

SEQ ID NO: 11930 - DNA, 20 bp, Artificial Sequence
  Description of Artificial Sequence: Synthetic oligonucleotide
  Target: ATXN1; (-) strand; PAM type: NNGRRT; PAM sequence: GGGAGT
acctgtagtcccagctactt

SEQ ID NO: 11931 - DNA, 20 bp, Artificial Sequence
  Description of Artificial Sequence: Synthetic oligonucleotide
  Target: ATXN1; (-) strand; PAM type: NNGRRT; PAM sequence: CAGGAT
aggcgggtggatcatgaggt

SEQ ID NO: 11932 - DNA, 20 bp, Artificial Sequence
  Description of Artificial Sequence: Synthetic oligonucleotide
  Target: ATXN1; (-) strand; PAM type: NNGRRT; PAM sequence: GTGGAT
actttgggagactgaggcgg

SEQ ID NO: 11933 - DNA, 20 bp, Artificial Sequence
  Description of Artificial Sequence: Synthetic oligonucleotide
  Target: ATXN1; (-) strand; PAM type: NNGRRT; PAM sequence: GCGGGT
cagcactttgggagactgag

SEQ ID NO: 11934 - DNA, 20 bp, Artificial Sequence
  Description of Artificial Sequence: Synthetic oligonucleotide
  Target: ATXN1; (-) strand; PAM type: NNGRRT; PAM sequence: CTGAAT
gcatgtgtgtttttgtgtgt

SEQ ID NO: 11935 - DNA, 20 bp, Artificial Sequence
  Description of Artificial Sequence: Synthetic oligonucleotide
  Target: ATXN1; (-) strand; PAM type: NNGRRT; PAM sequence: CAGAGT
tgtatcagaactagatcaat

SEQ ID NO: 11936 - DNA, 20 bp, Artificial Sequence
  Description of Artificial Sequence: Synthetic oligonucleotide
  Target: ATXN1; (-) strand; PAM type: NNGRRT; PAM sequence: ATGGAT
cttctaaaaatatgccttgt

SEQ ID NO: 11937 - DNA, 20 bp, Artificial Sequence
  Description of Artificial Sequence: Synthetic oligonucleotide
  Target: ATXN1; (-) strand; PAM type: NNGRRT; PAM sequence: ATGAAT
tcatgcttacaagctgccat

SEQ ID NO: 11938 - DNA, 20 bp, Artificial Sequence
  Description of Artificial Sequence: Synthetic oligonucleotide
  Target: ATXN1; (-) strand; PAM type: NNGRRT; PAM sequence: AGGGGT
ccagtaatacacacaggaga

SEQ ID NO: 11939 - DNA, 20 bp, Artificial Sequence
  Description of Artificial Sequence: Synthetic oligonucleotide
  Target: ATXN1; (-) strand; PAM type: NNGRRT; PAM sequence: GAGAGT
ttgtacctgagagcttgaca

SEQ ID NO: 11940 - DNA, 20 bp, Artificial Sequence
  Description of Artificial Sequence: Synthetic oligonucleotide
  Target: ATXN1; (-) strand; PAM type: NNGRRT; PAM sequence: TGGGAT
tgggtttgggggccaatgac

SEQ ID NO: 11941 - DNA, 20 bp, Artificial Sequence
  Description of Artificial Sequence: Synthetic oligonucleotide
  Target: ATXN1; (-) strand; PAM type: NNGRRT; PAM sequence: ATGGGT
ggaggcacagaaaaaagaaa

SEQ ID NO: 11942 - DNA, 20 bp, Artificial Sequence
  Description of Artificial Sequence: Synthetic oligonucleotide
  Target: ATXN1; (-) strand; PAM type: NNGRRT; PAM sequence: AAGGGT
attgtaatgtctttgctcac

SEQ ID NO: 11943 - DNA, 20 bp, Artificial Sequence
  Description of Artificial Sequence: Synthetic oligonucleotide
  Target: ATXN1; (-) strand; PAM type: NNGRRT; PAM sequence: AGGAAT
caccactgttggggggtagc

SEQ ID NO: 11944 - DNA, 20 bp, Artificial Sequence
  Description of Artificial Sequence: Synthetic oligonucleotide
  Target: ATXN1; (-) strand; PAM type: NNGRRT; PAM sequence: GGGGGT
gtcaatattcaccactgttg

SEQ ID NO: 11945 - DNA, 20 bp, Artificial Sequence
  Description of Artificial Sequence: Synthetic oligonucleotide
  Target: ATXN1; (-) strand; PAM type: NNGRRT; PAM sequence: TTGGAT
aagcccatgagctcatgcct

SEQ ID NO: 11946 - DNA, 20 bp, Artificial Sequence
  Description of Artificial Sequence: Synthetic oligonucleotide
  Target: ATXN1; (-) strand; PAM type: NNGRRT; PAM sequence: ATGAGT
tacagggtaactagaattgt

SEQ ID NO: 11947 - DNA, 20 bp, Artificial Sequence
  Description of Artificial Sequence: Synthetic oligonucleotide
  Target: ATXN1; (-) strand; PAM type: NNGRRT; PAM sequence: TAGAAT
acacacttgtacagggtaac

SEQ ID NO: 11948 - DNA, 20 bp, Artificial Sequence
  Description of Artificial Sequence: Synthetic oligonucleotide
  Target: ATXN1; (-) strand; PAM type: NNGRRT; PAM sequence: CAGGGT
aatagtgtcacacacttgta

SEQ ID NO: 11949 - DNA, 20 bp, Artificial Sequence
  Description of Artificial Sequence: Synthetic oligonucleotide
  Target: ATXN1; (-) strand; PAM type: NNGRRT; PAM sequence: GTGGGT
gtcctcctacttagaataca

SEQ ID NO: 11950 - DNA, 20 bp, Artificial Sequence
  Description of Artificial Sequence: Synthetic oligonucleotide
  Target: ATXN1; (-) strand; PAM type: NNGRRT; PAM sequence: TAGAAT
tccagattggtcctcctact

SEQ ID NO: 11951 - DNA, 20 bp, Artificial Sequence
  Description of Artificial Sequence: Synthetic oligonucleotide
  Target: ATXN1; (-) strand; PAM type: NNGRRT; PAM sequence: GAGGAT
tgactctaagaggtttgcaa

SEQ ID NO: 11952 - DNA, 20 bp, Artificial Sequence
  Description of Artificial Sequence: Synthetic oligonucleotide
  Target: ATXN1; (-) strand; PAM type: NNGRRT; PAM sequence: TGGGAT
aaaacaatctccacttgatg

SEQ ID NO: 11953 - DNA, 20 bp, Artificial Sequence
  Description of Artificial Sequence: Synthetic oligonucleotide
  Target: ATXN1; (-) strand; PAM type: NNGRRT; PAM sequence: TTGGAT
gagagttttatttttatgac

SEQ ID NO: 11954 - DNA, 20 bp, Artificial Sequence
  Description of Artificial Sequence: Synthetic oligonucleotide
  Target: ATXN1; (-) strand; PAM type: NNGRRT; PAM sequence: GAGAGT
cgagacagatgttaacacct

SEQ ID NO: 11955 - DNA, 20 bp, Artificial Sequence
  Description of Artificial Sequence: Synthetic oligonucleotide
  Target: ATXN1; (-) strand; PAM type: NNGRRT; PAM sequence: GAGAGT
agcaaaccgcaactctggta

SEQ ID NO: 11956 - DNA, 20 bp, Artificial Sequence
  Description of Artificial Sequence: Synthetic oligonucleotide
  Target: ATXN1; (-) strand; PAM type: NNGRRT; PAM sequence: AAGAAT
acctctgcctggtgttgggc

SEQ ID NO: 11957 - DNA, 20 bp, Artificial Sequence
  Description of Artificial Sequence: Synthetic oligonucleotide
  Target: ATXN1; (-) strand; PAM type: NNGRRT; PAM sequence: CTGAAT
gaactaaggcttctggtctt

SEQ ID NO: 11958 - DNA, 20 bp, Artificial Sequence
  Description of Artificial Sequence: Synthetic oligonucleotide
  Target: ATXN1; (-) strand; PAM type: NNGRRT; PAM sequence: GGGAGT
catctgccagcaaggagaca

SEQ ID NO: 11959 - DNA, 20 bp, Artificial Sequence
  Description of Artificial Sequence: Synthetic oligonucleotide
  Target: ATXN1; (-) strand; PAM type: NNGRRT; PAM sequence: ATGGGT
cacacaccaagggcctctcc

SEQ ID NO: 11960 - DNA, 20 bp, Artificial Sequence
  Description of Artificial Sequence: Synthetic oligonucleotide
  Target: ATXN1; (-) strand; PAM type: NNGRRT; PAM sequence: ATGAGT
gggcttgtagacatttctta

SEQ ID NO: 11961 - DNA, 20 bp, Artificial Sequence
  Description of Artificial Sequence: Synthetic oligonucleotide
  Target: ATXN1; (-) strand; PAM type: NNGRRT; PAM sequence: TGGAGT
gattacaagagtggtgtctt

SEQ ID NO: 11962 - DNA, 20 bp, Artificial Sequence
  Description of Artificial Sequence: Synthetic oligonucleotide
  Target: ATXN1; (-) strand; PAM type: NNGRRT; PAM sequence: AAGAGT
tcccaaagtgctgggattac

SEQ ID NO: 11963 - DNA, 20 bp, Artificial Sequence
  Description of Artificial Sequence: Synthetic oligonucleotide
  Target: ATXN1; (-) strand; PAM type: NNGRRT; PAM sequence: TGGGAT
acctcagcctcccaaagtgc

SEQ ID NO: 11964 - DNA, 20 bp, Artificial Sequence
  Description of Artificial Sequence: Synthetic oligonucleotide
  Target: ATXN1; (-) strand; PAM type: NNGRRT; PAM sequence: TGGAGT
taaaaccctttaaacaaaaa

SEQ ID NO: 11965 - DNA, 20 bp, Artificial Sequence
  Description of Artificial Sequence: Synthetic oligonucleotide
  Target: ATXN1; (-) strand; PAM type: NNGRRT; PAM sequence: AAGGGT
atcctagcctacgtgcagga

SEQ ID NO: 11966 - DNA, 20 bp, Artificial Sequence
  Description of Artificial Sequence: Synthetic oligonucleotide
  Target: ATXN1; (-) strand; PAM type: NNGRRT; PAM sequence: CAGAGT
atatacttcccctttaatcc

SEQ ID NO: 11967 - DNA, 20 bp, Artificial Sequence
  Description of Artificial Sequence: Synthetic oligonucleotide
  Target: ATXN1; (-) strand; PAM type: NNGRRT; PAM sequence: TGGGAT
gcctcggcctcccaaagtgc

SEQ ID NO: 11968 - DNA, 20 bp, Artificial Sequence
  Description of Artificial Sequence: Synthetic oligonucleotide
  Target: ATXN1; (-) strand; PAM type: NNGRRT; PAM sequence: GAGGGT
agtctttagtatttttaata

SEQ ID NO: 11969 - DNA, 20 bp, Artificial Sequence
  Description of Artificial Sequence: Synthetic oligonucleotide
  Target: ATXN1; (-) strand; PAM type: NNGRRT; PAM sequence: GAGGGT
atagacatttgggcaccagt

SEQ ID NO: 11970 - DNA, 20 bp, Artificial Sequence
  Description of Artificial Sequence: Synthetic oligonucleotide
  Target: ATXN1; (-) strand; PAM type: NNGRRT; PAM sequence: AGGGGT
gggggtatggggggagacga

SEQ ID NO: 11971 - DNA, 20 bp, Artificial Sequence
  Description of Artificial Sequence: Synthetic oligonucleotide
  Target: ATXN1; (-) strand; PAM type: NNGRRT; PAM sequence: GGGGGT
ttggagggtttttatgggag

SEQ ID NO: 11972 - DNA, 20 bp, Artificial Sequence
  Description of Artificial Sequence: Synthetic oligonucleotide
  Target: ATXN1; (-) strand; PAM type: NNGRRT; PAM sequence: GAGGGT
ccaattttttaggctggttg

SEQ ID NO: 11973 - DNA, 20 bp, Artificial Sequence
  Description of Artificial Sequence: Synthetic oligonucleotide
  Target: ATXN1; (-) strand; PAM type: NNGRRT; PAM sequence: GAGAAT
gcactccagcctgggcaaca

SEQ ID NO: 11974 - DNA, 20 bp, Artificial Sequence
  Description of Artificial Sequence: Synthetic oligonucleotide
  Target: ATXN1; (-) strand; PAM type: NNGRRT; PAM sequence: GAGAAT
tactcaggaggctgagacag

SEQ ID NO: 11975 - DNA, 20 bp, Artificial Sequence
  Description of Artificial Sequence: Synthetic oligonucleotide
  Target: ATXN1; (-) strand; PAM type: NNGRRT; PAM sequence: AGGAGT
caggcggatcacctaaggtc

SEQ ID NO: 11976 - DNA, 20 bp, Artificial Sequence
  Description of Artificial Sequence: Synthetic oligonucleotide
  Target: ATXN1; (-) strand; PAM type: NNGRRT; PAM sequence: GCGGAT
actttgggatgccaaggcag

SEQ ID NO: 11977 - DNA, 20 bp, Artificial Sequence
  Description of Artificial Sequence: Synthetic oligonucleotide
  Target: ATXN1; (-) strand; PAM type: NNGRRT; PAM sequence: TGGGAT
catctgtaatcccagcactt

SEQ ID NO: 11978 - DNA, 20 bp, Artificial Sequence
  Description of Artificial Sequence: Synthetic oligonucleotide
  Target: ATXN1; (-) strand; PAM type: NNGRRT; PAM sequence: TCGAGT
ggctggagtggtgcagtagc

SEQ ID NO: 11979 - DNA, 20 bp, Artificial Sequence
  Description of Artificial Sequence: Synthetic oligonucleotide
  Target: ATXN1; (-) strand; PAM type: NNGRRT; PAM sequence: TGGAGT
tcttgctctggcacacaggc

SEQ ID NO: 11980 - DNA, 20 bp, Artificial Sequence
  Description of Artificial Sequence: Synthetic oligonucleotide
  Target: ATXN1; (-) strand; PAM type: NNGRRT; PAM sequence: CAGAGT
tttggtttggtttttagaga

SEQ ID NO: 11981 - DNA, 20 bp, Artificial Sequence
  Description of Artificial Sequence: Synthetic oligonucleotide
  Target: ATXN1; (-) strand; PAM type: NNGRRT; PAM sequence: TGGAGT
aaggcctgtctttggagatt

SEQ ID NO: 11982 - DNA, 20 bp, Artificial Sequence
  Description of Artificial Sequence: Synthetic oligonucleotide
  Target: ATXN1; (-) strand; PAM type: NNGRRT; PAM sequence: GTGAAT
ctctccatcacttttctctc

SEQ ID NO: 11983 - DNA, 20 bp, Artificial Sequence
  Description of Artificial Sequence: Synthetic oligonucleotide
  Target: ATXN1; (-) strand; PAM type: NNGRRT; PAM sequence: CTGGGT
tggtgccactgcactccaac

SEQ ID NO: 11984 - DNA, 20 bp, Artificial Sequence
  Description of Artificial Sequence: Synthetic oligonucleotide
  Target: ATXN1; (-) strand; PAM type: NNGRRT; PAM sequence: TCGAAT
ggctgaggcaggagaatcgc

SEQ ID NO: 11985 - DNA, 20 bp, Artificial Sequence
  Description of Artificial Sequence: Synthetic oligonucleotide
  Target: ATXN1; (-) strand; PAM type: NNGRRT; PAM sequence: GAGAAT
tacttgggaggctgaggcag

SEQ ID NO: 11986 - DNA, 20 bp, Artificial Sequence
  Description of Artificial Sequence: Synthetic oligonucleotide
  Target: ATXN1; (-) strand; PAM type: NNGRRT; PAM sequence: AGGGGT
aaaaatataaaaaattagcc

SEQ ID NO: 11987 - DNA, 20 bp, Artificial Sequence
  Description of Artificial Sequence: Synthetic oligonucleotide
  Target: ATXN1; (-) strand; PAM type: NNGRRT; PAM sequence: GTGAAT
agactagcttggccaacatg

SEQ ID NO: 11988 - DNA, 20 bp, Artificial Sequence
  Description of Artificial Sequence: Synthetic oligonucleotide
  Target: ATXN1; (-) strand; PAM type: NNGRRT; PAM sequence: AGGAGT
cgggcagatcgcctgagatc

SEQ ID NO: 11989 - DNA, 20 bp, Artificial Sequence
  Description of Artificial Sequence: Synthetic oligonucleotide
  Target: ATXN1; (-) strand; PAM type: NNGRRT; PAM sequence: AAGAAT
agcctttgaagtgattaaag

SEQ ID NO: 11990 - DNA, 20 bp, Artificial Sequence
  Description of Artificial Sequence: Synthetic oligonucleotide
  Target: ATXN1; (-) strand; PAM type: NNGRRT; PAM sequence: CAGAAT
cctttggtaggaagcaaagg

SEQ ID NO: 11991 - DNA, 20 bp, Artificial Sequence
  Description of Artificial Sequence: Synthetic oligonucleotide
  Target: ATXN1; (-) strand; PAM type: NNGRRT; PAM sequence: CAGGGT
ctggtcgtggcatcttttcg

SEQ ID NO: 11992 - DNA, 20 bp, Artificial Sequence
  Description of Artificial Sequence: Synthetic oligonucleotide
  Target: ATXN1; (-) strand; PAM type: NNGRRT; PAM sequence: CTGAAT
gcctacaatgatcagattat

SEQ ID NO: 11993 - DNA, 20 bp, Artificial Sequence
  Description of Artificial Sequence: Synthetic oligonucleotide
  Target: ATXN1; (-) strand; PAM type: NNGRRT; PAM sequence: TTGAGT
gatagatttgctatgaatgc

SEQ ID NO: 11994 - DNA, 20 bp, Artificial Sequence
  Description of Artificial Sequence: Synthetic oligonucleotide
  Target: ATXN1; (-) strand; PAM type: NNGRRT; PAM sequence: ATGAAT
aaaataaagatagatttgct

SEQ ID NO: 11995 - DNA, 20 bp, Artificial Sequence
  Description of Artificial Sequence: Synthetic oligonucleotide
  Target: ATXN1; (-) strand; PAM type: NNGRRT; PAM sequence: AAGAAT
ttaatgatcagttaaccttt

SEQ ID NO: 11996 - DNA, 20 bp, Artificial Sequence
  Description of Artificial Sequence: Synthetic oligonucleotide
  Target: ATXN1; (-) strand; PAM type: NNGRRT; PAM sequence: GGGAAT
tggagaaggctcctctccaa

SEQ ID NO: 11997 - DNA, 20 bp, Artificial Sequence
  Description of Artificial Sequence: Synthetic oligonucleotide
  Target: ATXN1; (-) strand; PAM type: NNGRRT; PAM sequence: AGGAAT
ccatatgggttttaaattca

SEQ ID NO: 11998 - DNA, 20 bp, Artificial Sequence
  Description of Artificial Sequence: Synthetic oligonucleotide
  Target: ATXN1; (-) strand; PAM type: NNGRRT; PAM sequence: ATGGGT
gcatcatagagaatacccat

SEQ ID NO: 11999 - DNA, 20 bp, Artificial Sequence
  Description of Artificial Sequence: Synthetic oligonucleotide
  Target: ATXN1; (-) strand; PAM type: NNGRRT; PAM sequence: GAGAAT
ttgaagctatcagcatcata

SEQ ID NO: 12000 - DNA, 20 bp, Artificial Sequence
  Description of Artificial Sequence: Synthetic oligonucleotide
  Target: ATXN1; (-) strand; PAM type: NNGRRT; PAM sequence: TGGAGT
aatcgcttgaacccaggagg

SEQ ID NO: 12001 - DNA, 20 bp, Artificial Sequence
  Description of Artificial Sequence: Synthetic oligonucleotide
  Target: ATXN1; (-) strand; PAM type: NNGRRT; PAM sequence: GAGAAT
tactcgggaggctgaggcag

SEQ ID NO: 12002 - DNA, 20 bp, Artificial Sequence
  Description of Artificial Sequence: Synthetic oligonucleotide
  Target: ATXN1; (-) strand; PAM type: NNGRRT; PAM sequence: AGGAGT
caggcagatcacttgaggtc

SEQ ID NO: 12003 - DNA, 20 bp, Artificial Sequence
  Description of Artificial Sequence: Synthetic oligonucleotide
  Target: ATXN1; (-) strand; PAM type: NNGRRT; PAM sequence: TCGGAT
cgacatctgagtggacgtca

SEQ ID NO: 12004 - DNA, 20 bp, Artificial Sequence
  Description of Artificial Sequence: Synthetic oligonucleotide
  Target: ATXN1; (-) strand; PAM type: NNGRRT; PAM sequence: CTGAGT
ttgagttgcccattcgacat

SEQ ID NO: 12005 - DNA, 20 bp, Artificial Sequence
  Description of Artificial Sequence: Synthetic oligonucleotide
  Target: ATXN1; (-) strand; PAM type: NNGRRT; PAM sequence: TTGAGT
tgttttaggtcactttaagt

SEQ ID NO: 12006 - DNA, 20 bp, Artificial Sequence
  Description of Artificial Sequence: Synthetic oligonucleotide
  Target: ATXN1; (-) strand; PAM type: NNGRRT; PAM sequence: TGGGAT
tatggagatggggaagaaca

SEQ ID NO: 12007 - DNA, 20 bp, Artificial Sequence
  Description of Artificial Sequence: Synthetic oligonucleotide
  Target: ATXN1; (-) strand; PAM type: NNGRRT; PAM sequence: TGGGAT
tgattgaacagccggaagaa

SEQ ID NO: 12008 - DNA, 20 bp, Artificial Sequence
  Description of Artificial Sequence: Synthetic oligonucleotide
  Target: ATXN1; (-) strand; PAM type: NNGRRT; PAM sequence: AAGAAT
gtgcttgattgaacagccgg

SEQ ID NO: 12009 - DNA, 20 bp, Artificial Sequence
  Description of Artificial Sequence: Synthetic oligonucleotide
  Target: ATXN1; (-) strand; PAM type: NNGRRT; PAM sequence: TGGGAT
ccatacagtttgcttataat

SEQ ID NO: 12010 - DNA, 20 bp, Artificial Sequence
  Description of Artificial Sequence: Synthetic oligonucleotide
  Target: ATXN1; (-) strand; PAM type: NNGRRT; PAM sequence: GCGAGT
ggcttgcatgtggtgaccga

SEQ ID NO: 12011 - DNA, 20 bp, Artificial Sequence
  Description of Artificial Sequence: Synthetic oligonucleotide
  Target: ATXN1; (-) strand; PAM type: NNGRRT; PAM sequence: GGGAGT
accactgttgctacagtgta

SEQ ID NO: 12012 - DNA, 20 bp, Artificial Sequence
  Description of Artificial Sequence: Synthetic oligonucleotide
  Target: ATXN1; (-) strand; PAM type: NNGRRT; PAM sequence: AGGGGT
gcccagacggaaggcgcaag

SEQ ID NO: 12013 - DNA, 20 bp, Artificial Sequence
  Description of Artificial Sequence: Synthetic oligonucleotide
  Target: ATXN1; (-) strand; PAM type: NNGRRT; PAM sequence: GAGAGT
aaagattccaaatgaatgga

SEQ ID NO: 12014 - DNA, 20 bp, Artificial Sequence
  Description of Artificial Sequence: Synthetic oligonucleotide
  Target: ATXN1; (-) strand; PAM type: NNGRRT; PAM sequence: ATGAAT
tgaggcaaaaaagattccaa

SEQ ID NO: 12015 - DNA, 20 bp, Artificial Sequence
  Description of Artificial Sequence: Synthetic oligonucleotide
  Target: ATXN1; (-) strand; PAM type: NNGRRT; PAM sequence: GTGGGT
agttctctctgaaaaggaca

SEQ ID NO: 12016 - DNA, 20 bp, Artificial Sequence
  Description of Artificial Sequence: Synthetic oligonucleotide
  Target: ATXN1; (-) strand; PAM type: NNGRRT; PAM sequence: GGGAGT
attttaaatagaactgtcag

SEQ ID NO: 12017 - DNA, 20 bp, Artificial Sequence
  Description of Artificial Sequence: Synthetic oligonucleotide
  Target: ATXN1; (-) strand; PAM type: NNGRRT; PAM sequence: GAGGGT
aaaggaagctatggaaacta

SEQ ID NO: 12018 - DNA, 20 bp, Artificial Sequence
  Description of Artificial Sequence: Synthetic oligonucleotide
  Target: ATXN1; (-) strand; PAM type: NNGRRT; PAM sequence: AGGAGT
gcaagagggcacttgaggcc

SEQ ID NO: 12019 - DNA, 20 bp, Artificial Sequence
  Description of Artificial Sequence: Synthetic oligonucleotide
  Target: ATXN1; (-) strand; PAM type: NNGRRT; PAM sequence: GGGGAT
tggtctgttgcctgggggtt

SEQ ID NO: 12020 - DNA, 20 bp, Artificial Sequence
  Description of Artificial Sequence: Synthetic oligonucleotide
  Target: ATXN1; (-) strand; PAM type: NNGRRT; PAM sequence: GGGGGT
ctgctactggtctgttgcct

SEQ ID NO: 12021 - DNA, 20 bp, Artificial Sequence
  Description of Artificial Sequence: Synthetic oligonucleotide
  Target: ATXN1; (-) strand; PAM type: NNGRRT; PAM sequence: TGGAAT
acaggaggcggagctcagtc

SEQ ID NO: 12022 - DNA, 20 bp, Artificial Sequence
  Description of Artificial Sequence: Synthetic oligonucleotide
  Target: ATXN1; (-) strand; PAM type: NNGRRT; PAM sequence: GAGAAT
aatagggttcacgctcctat

SEQ ID NO: 12023 - DNA, 20 bp, Artificial Sequence
  Description of Artificial Sequence: Synthetic oligonucleotide
  Target: ATXN1; (-) strand; PAM type: NNGRRT; PAM sequence: TAGGGT
cttgcatgcgcagtttacaa

SEQ ID NO: 12024 - DNA, 20 bp, Artificial Sequence
  Description of Artificial Sequence: Synthetic oligonucleotide
  Target: ATXN1; (-) strand; PAM type: NNGRRT; PAM sequence: CTGGAT
tctcataaggagtgcacaac

SEQ ID NO: 12025 - DNA, 20 bp, Artificial Sequence
  Description of Artificial Sequence: Synthetic oligonucleotide
  Target: ATXN1; (-) strand; PAM type: NNGRRT; PAM sequence: AGGAGT
gcattagttagattctcata

SEQ ID NO: 12026 - DNA, 20 bp, Artificial Sequence
  Description of Artificial Sequence: Synthetic oligonucleotide
  Target: ATXN1; (-) strand; PAM type: NNGRRT; PAM sequence: TGGGAT
aagagggagggggatggttt

SEQ ID NO: 12027 - DNA, 20 bp, Artificial Sequence
  Description of Artificial Sequence: Synthetic oligonucleotide
  Target: ATXN1; (-) strand; PAM type: NNGRRT; PAM sequence: GGGGAT
ggcaggatgggaagagggag

SEQ ID NO: 12028 - DNA, 20 bp, Artificial Sequence
  Description of Artificial Sequence: Synthetic oligonucleotide
  Target: ATXN1; (-) strand; PAM type: NNGRRT; PAM sequence: CAGGAT
catggaagaagattttttgg

SEQ ID NO: 12029 - DNA, 20 bp, Artificial Sequence
  Description of Artificial Sequence: Synthetic oligonucleotide
  Target: ATXN1; (-) strand; PAM type: NNGRRT; PAM sequence: AAGAAT
aaatatacaagtaaataaaa

SEQ ID NO: 12030 - DNA, 20 bp, Artificial Sequence
  Description of Artificial Sequence: Synthetic oligonucleotide
  Target: ATXN1; (-) strand; PAM type: NNGRRT; PAM sequence: CTGAGT
tagactctggagatagaaca

SEQ ID NO: 12031 - DNA, 20 bp, Artificial Sequence
  Description of Artificial Sequence: Synthetic oligonucleotide
  Target: ATXN1; (-) strand; PAM type: NNGRRT; PAM sequence: TGGGAT
gcctctgcctcccaaagtgg

SEQ ID NO: 12032 - DNA, 20 bp, Artificial Sequence
  Description of Artificial Sequence: Synthetic oligonucleotide
  Target: ATXN1; (-) strand; PAM type: NNGRRT; PAM sequence: CAGGGT
ttttgtatttttagtagaga

SEQ ID NO: 12033 - DNA, 20 bp, Artificial Sequence
  Description of Artificial Sequence: Synthetic oligonucleotide
  Target: ATXN1; (-) strand; PAM type: NNGRRT; PAM sequence: CAGAGT
aattctcctgcttcagcctt

SEQ ID NO: 12034 - DNA, 20 bp, Artificial Sequence
  Description of Artificial Sequence: Synthetic oligonucleotide
  Target: ATXN1; (-) strand; PAM type: NNGRRT; PAM sequence: TGGGGT
tcttgcactgtcacctgggc

SEQ ID NO: 12035 - DNA, 20 bp, Artificial Sequence
  Description of Artificial Sequence: Synthetic oligonucleotide
  Target: ATXN1; (-) strand; PAM type: NNGRRT; PAM sequence: CGGAGT
tgtttttgttttttttaaga

SEQ ID NO: 12036 - DNA, 20 bp, Artificial Sequence
  Description of Artificial Sequence: Synthetic oligonucleotide
  Target: ATXN1; (-) strand; PAM type: NNGRRT; PAM sequence: GAGAGT
actaacacagctgcaagaac

SEQ ID NO: 12037 - DNA, 20 bp, Artificial Sequence
  Description of Artificial Sequence: Synthetic oligonucleotide
  Target: ATXN1; (-) strand; PAM type: NNGRRT; PAM sequence: TGGGAT
tcccatgagtttattttcat

SEQ ID NO: 12038 - DNA, 20 bp, Artificial Sequence
  Description of Artificial Sequence: Synthetic oligonucleotide
  Target: ATXN1; (-) strand; PAM type: NNGRRT; PAM sequence: ATGAGT
ttatctgtggtactgctccc

SEQ ID NO: 12039 - DNA, 20 bp, Artificial Sequence
  Description of Artificial Sequence: Synthetic oligonucleotide
  Target: ATXN1; (-) strand; PAM type: NNGRRT; PAM sequence: CTGGAT
tttgaaacaggatatattta

SEQ ID NO: 12040 - DNA, 20 bp, Artificial Sequence
  Description of Artificial Sequence: Synthetic oligonucleotide
  Target: ATXN1; (-) strand; PAM type: NNGRRT; PAM sequence: CAGGAT
actgcttagggtgtttgaaa

SEQ ID NO: 12041 - DNA, 20 bp, Artificial Sequence
  Description of Artificial Sequence: Synthetic oligonucleotide
  Target: ATXN1; (-) strand; PAM type: NNGRRT; PAM sequence: TAGGGT
aggctattctacttactgct

SEQ ID NO: 12042 - DNA, 20 bp, Artificial Sequence
  Description of Artificial Sequence: Synthetic oligonucleotide
  Target: ATXN1; (-) strand; PAM type: NNGRRT; PAM sequence: CAGAGT
ctacactctagccttggcga

SEQ ID NO: 12043 - DNA, 20 bp, Artificial Sequence
  Description of Artificial Sequence: Synthetic oligonucleotide
  Target: ATXN1; (-) strand; PAM type: NNGRRT; PAM sequence: GTGAAT
cctgggaggcagaggttacc

SEQ ID NO: 12044 - DNA, 20 bp, Artificial Sequence
  Description of Artificial Sequence: Synthetic oligonucleotide
  Target: ATXN1; (-) strand; PAM type: NNGRRT; PAM sequence: GAGAAT
tacttgggaggctgaggcag

SEQ ID NO: 12045 - DNA, 20 bp, Artificial Sequence
  Description of Artificial Sequence: Synthetic oligonucleotide
  Target: ATXN1; (-) strand; PAM type: NNGRRT; PAM sequence: AAGAGT
tgggtggatcatctgaggtc

SEQ ID NO: 12046 - DNA, 20 bp, Artificial Sequence
  Description of Artificial Sequence: Synthetic oligonucleotide
  Target: ATXN1; (-) strand; PAM type: NNGRRT; PAM sequence: GTGGAT
actttgggaggccgaggtgg

SEQ ID NO: 12047 - DNA, 20 bp, Artificial Sequence
  Description of Artificial Sequence: Synthetic oligonucleotide
  Target: ATXN1; (-) strand; PAM type: NNGRRT; PAM sequence: GTGGGT
cagcactttgggaggccgag

SEQ ID NO: 12048 - DNA, 20 bp, Artificial Sequence
  Description of Artificial Sequence: Synthetic oligonucleotide
  Target: ATXN1; (-) strand; PAM type: NNGRRT; PAM sequence: GAGGGT
gagggagggaaagagtggag

SEQ ID NO: 12049 - DNA, 20 bp, Artificial Sequence
  Description of Artificial Sequence: Synthetic oligonucleotide
  Target: ATXN1; (-) strand; PAM type: NNGRRT; PAM sequence: AAGAGT
gcagtgggaggagggaggga

SEQ ID NO: 12050 - DNA, 20 bp, Artificial Sequence
  Description of Artificial Sequence: Synthetic oligonucleotide
  Target: ATXN1; (-) strand; PAM type: NNGRRT; PAM sequence: AGGGGT
ttagggggatggatggagga

SEQ ID NO: 12051 - DNA, 20 bp, Artificial Sequence
  Description of Artificial Sequence: Synthetic oligonucleotide
  Target: ATXN1; (-) strand; PAM type: NNGRRT; PAM sequence: ATGGAT
agaggagtcgatttaggggg

SEQ ID NO: 12052 - DNA, 20 bp, Artificial Sequence
  Description of Artificial Sequence: Synthetic oligonucleotide
  Target: ATXN1; (-) strand; PAM type: NNGRRT; PAM sequence: GGGGAT
ttctagaggagtcgatttag

SEQ ID NO: 12053 - DNA, 20 bp, Artificial Sequence
  Description of Artificial Sequence: Synthetic oligonucleotide
  Target: ATXN1; (-) strand; PAM type: NNGRRT; PAM sequence: AGGAGT
gttggaggtgacagttctag

SEQ ID NO: 12054 - DNA, 20 bp, Artificial Sequence
  Description of Artificial Sequence: Synthetic oligonucleotide
  Target: ATXN1; (-) strand; PAM type: NNGRRT; PAM sequence: GGGAGT
taggttcgtccatccaaaat

SEQ ID NO: 12055 - DNA, 20 bp, Artificial Sequence
  Description of Artificial Sequence: Synthetic oligonucleotide
  Target: ATXN1; (-) strand; PAM type: NNGRRT; PAM sequence: GTGAGT
aaataattatgagcccagaa

SEQ ID NO: 12056 - DNA, 20 bp, Artificial Sequence
  Description of Artificial Sequence: Synthetic oligonucleotide
  Target: ATXN1; (-) strand; PAM type: NNGRRT; PAM sequence: TTGAAT
aagtggtgaaaggaatttta

SEQ ID NO: 12057 - DNA, 20 bp, Artificial Sequence
  Description of Artificial Sequence: Synthetic oligonucleotide
  Target: ATXN1; (-) strand; PAM type: NNGRRT; PAM sequence: AGGAAT
gttattgactaagtggtgaa

SEQ ID NO: 12058 - DNA, 20 bp, Artificial Sequence
  Description of Artificial Sequence: Synthetic oligonucleotide
  Target: ATXN1; (-) strand; PAM type: NNGRRT; PAM sequence: TGGGAT
acaggcgaaatttgtatgtc

SEQ ID NO: 12059 - DNA, 20 bp, Artificial Sequence
  Description of Artificial Sequence: Synthetic oligonucleotide
  Target: ATXN1; (-) strand; PAM type: NNGRRT; PAM sequence: GAGAAT
tactgaaacctagcttatga

SEQ ID NO: 12060 - DNA, 20 bp, Artificial Sequence
  Description of Artificial Sequence: Synthetic oligonucleotide
  Target: ATXN1; (-) strand; PAM type: NNGRRT; PAM sequence: AAGAAT
tttcacttgcagacaaagtt

SEQ ID NO: 12061 - DNA, 20 bp, Artificial Sequence
  Description of Artificial Sequence: Synthetic oligonucleotide
  Target: ATXN1; (-) strand; PAM type: NNGRRT; PAM sequence: GAGAAT
tctacaggtaaaacaagact

SEQ ID NO: 12062 - DNA, 20 bp, Artificial Sequence
  Description of Artificial Sequence: Synthetic oligonucleotide
  Target: ATXN1; (-) strand; PAM type: NNGRRT; PAM sequence: CGGGGT
tacccccttcatctttgaga

SEQ ID NO: 12063 - DNA, 20 bp, Artificial Sequence
  Description of Artificial Sequence: Synthetic oligonucleotide
  Target: ATXN1; (-) strand; PAM type: NNGRRT; PAM sequence: ATGGGT
atttttaaacattgcagtaa

SEQ ID NO: 12064 - DNA, 20 bp, Artificial Sequence
  Description of Artificial Sequence: Synthetic oligonucleotide
  Target: ATXN1; (-) strand; PAM type: NNGRRT; PAM sequence: CTGAGT
tgaaacacttccaccaagga

SEQ ID NO: 12065 - DNA, 20 bp, Artificial Sequence
  Description of Artificial Sequence: Synthetic oligonucleotide
  Target: ATXN1; (-) strand; PAM type: NNGRRT; PAM sequence: GTGGGT
aggcgtcccggtgctagggt

SEQ ID NO: 12066 - DNA, 20 bp, Artificial Sequence
  Description of Artificial Sequence: Synthetic oligonucleotide
  Target: ATXN1; (-) strand; PAM type: NNGRRT; PAM sequence: TAGGGT
gttaggaggcgtcccggtgc

SEQ ID NO: 12067 - DNA, 20 bp, Artificial Sequence
  Description of Artificial Sequence: Synthetic oligonucleotide
  Target: ATXN1; (-) strand; PAM type: NNGRRT; PAM sequence: TGGGAT
gaaaaacccagcttttaatg

SEQ ID NO: 12068 - DNA, 20 bp, Artificial Sequence
  Description of Artificial Sequence: Synthetic oligonucleotide
  Target: ATXN1; (-) strand; PAM type: NNGRRT; PAM sequence: AGGGAT
ccccaaagtgctgggattac

SEQ ID NO: 12069 - DNA, 20 bp, Artificial Sequence
  Description of Artificial Sequence: Synthetic oligonucleotide
  Target: ATXN1; (-) strand; PAM type: NNGRRT; PAM sequence: TGGGAT
gcctcaggcccccaaagtgc

SEQ ID NO: 12070 - DNA, 20 bp, Artificial Sequence
  Description of Artificial Sequence: Synthetic oligonucleotide
  Target: ATXN1; (-) strand; PAM type: NNGRRT; PAM sequence: CGGGGT
tttctatttttttgtagaga

SEQ ID NO: 12071 - DNA, 20 bp, Artificial Sequence
  Description of Artificial Sequence: Synthetic oligonucleotide
  Target: ATXN1; (-) strand; PAM type: NNGRRT; PAM sequence: TGGAGT
tcttgctctgttgcccaggc

SEQ ID NO: 12072 - DNA, 20 bp, Artificial Sequence
  Description of Artificial Sequence: Synthetic oligonucleotide
  Target: ATXN1; (-) strand; PAM type: NNGRRT; PAM sequence: TAGGGT
cacattttttttttttgaga

SEQ ID NO: 12073 - DNA, 20 bp, Artificial Sequence
  Description of Artificial Sequence: Synthetic oligonucleotide
  Target: ATXN1; (-) strand; PAM type: NNGRRT; PAM sequence: CTGAAT
tagctcatttctttttagca

SEQ ID NO: 12074 - DNA, 20 bp, Artificial Sequence
  Description of Artificial Sequence: Synthetic oligonucleotide
  Target: ATXN1; (-) strand; PAM type: NNGRRT; PAM sequence: TGGAAT
gttccagaatgccatgcagt

SEQ ID NO: 12075 - DNA, 20 bp, Artificial Sequence
  Description of Artificial Sequence: Synthetic oligonucleotide
  Target: ATXN1; (-) strand; PAM type: NNGRRT; PAM sequence: CAGAAT
ctccatagttttgcctgttc

SEQ ID NO: 12076 - DNA, 20 bp, Artificial Sequence
  Description of Artificial Sequence: Synthetic oligonucleotide
  Target: ATXN1; (-) strand; PAM type: NNGRRT; PAM sequence: ATGAAT
tgttgtacatgctgtttttg

SEQ ID NO: 12077 - DNA, 20 bp, Artificial Sequence
  Description of Artificial Sequence: Synthetic oligonucleotide
  Target: ATXN1; (-) strand; PAM type: NNGRRT; PAM sequence: CTGGGT
tgtgctatatgtgcccccaa

SEQ ID NO: 12078 - DNA, 20 bp, Artificial Sequence
  Description of Artificial Sequence: Synthetic oligonucleotide
  Target: ATXN1; (-) strand; PAM type: NNGRRT; PAM sequence: GTGGGT
gtcaaaccacatttttgttt

SEQ ID NO: 12079 - DNA, 20 bp, Artificial Sequence
  Description of Artificial Sequence: Synthetic oligonucleotide
  Target: ATXN1; (-) strand; PAM type: NNGRRT; PAM sequence: CTGGAT
cctgtgtgcagagcccagcc

SEQ ID NO: 12080 - DNA, 20 bp, Artificial Sequence
  Description of Artificial Sequence: Synthetic oligonucleotide
  Target: ATXN1; (-) strand; PAM type: NNGRRT; PAM sequence: ATGAAT
acatgccgagcttggtggcg

SEQ ID NO: 12081 - DNA, 20 bp, Artificial Sequence
  Description of Artificial Sequence: Synthetic oligonucleotide
  Target: ATXN1; (-) strand; PAM type: NNGRRT; PAM sequence: TAGAGT
gcaggcggcacatgagcctg

SEQ ID NO: 12082 - DNA, 20 bp, Artificial Sequence
  Description of Artificial Sequence: Synthetic oligonucleotide
  Target: ATXN1; (-) strand; PAM type: NNGRRT; PAM sequence: ATGGAT
gtggtaacattatgcattga

SEQ ID NO: 12083 - DNA, 20 bp, Artificial Sequence
  Description of Artificial Sequence: Synthetic oligonucleotide
  Target: ATXN1; (-) strand; PAM type: NNGRRT; PAM sequence: TTGAAT
atcggtggtaacattatgca

SEQ ID NO: 12084 - DNA, 20 bp, Artificial Sequence
  Description of Artificial Sequence: Synthetic oligonucleotide
  Target: ATXN1; (-) strand; PAM type: NNGRRT; PAM sequence: GTGAGT
ttggttgacttctgtgagct

SEQ ID NO: 12085 - DNA, 20 bp, Artificial Sequence
  Description of Artificial Sequence: Synthetic oligonucleotide
  Target: ATXN1; (-) strand; PAM type: NNGRRT; PAM sequence: GTGAGT
ccgactgtcctggcgtgggt

SEQ ID NO: 12086 - DNA, 20 bp, Artificial Sequence
  Description of Artificial Sequence: Synthetic oligonucleotide
  Target: ATXN1; (-) strand; PAM type: NNGRRT; PAM sequence: GTGGGT
ctcctcccgactgtcctggc

SEQ ID NO: 12087 - DNA, 20 bp, Artificial Sequence
  Description of Artificial Sequence: Synthetic oligonucleotide
  Target: ATXN1; (-) strand; PAM type: NNGRRT; PAM sequence: CTGGGT
aaatgtattggtaaagtgct

SEQ ID NO: 12088 - DNA, 20 bp, Artificial Sequence
  Description of Artificial Sequence: Synthetic oligonucleotide
  Target: ATXN1; (-) strand; PAM type: NNGRRT; PAM sequence: TGGAGT
agtacacagcatttgctcag

SEQ ID NO: 12089 - DNA, 20 bp, Artificial Sequence
  Description of Artificial Sequence: Synthetic oligonucleotide
  Target: ATXN1; (-) strand; PAM type: NNGRRT; PAM sequence: AAGAGT
tcctaggttcagcttctctg

SEQ ID NO: 12090 - DNA, 20 bp, Artificial Sequence
  Description of Artificial Sequence: Synthetic oligonucleotide
  Target: ATXN1; (-) strand; PAM type: NNGRRT; PAM sequence: CAGGAT
cccgctgggacagccctgcc

SEQ ID NO: 12091 - DNA, 20 bp, Artificial Sequence
  Description of Artificial Sequence: Synthetic oligonucleotide
  Target: ATXN1; (-) strand; PAM type: NNGRRT; PAM sequence: AGGGGT
ctgagtatgaactggatttg

SEQ ID NO: 12092 - DNA, 20 bp, Artificial Sequence
  Description of Artificial Sequence: Synthetic oligonucleotide
  Target: ATXN1; (-) strand; PAM type: NNGRRT; PAM sequence: CTGGAT
tctgtatttctgagtatgaa

SEQ ID NO: 12093 - DNA, 20 bp, Artificial Sequence
  Description of Artificial Sequence: Synthetic oligonucleotide
  Target: ATXN1; (-) strand; PAM type: NNGRRT; PAM sequence: CTGAGT
gagcatatcaatctgtattt

SEQ ID NO: 12094 - DNA, 20 bp, Artificial Sequence
  Description of Artificial Sequence: Synthetic oligonucleotide
  Target: ATXN1; (-) strand; PAM type: NNGRRT; PAM sequence: GCGAGT
aatcctcggggtggaatccc

SEQ ID NO: 12095 - DNA, 20 bp, Artificial Sequence
  Description of Artificial Sequence: Synthetic oligonucleotide
  Target: ATXN1; (-) strand; PAM type: NNGRRT; PAM sequence: TGGAAT
cctgcctgtaatcctcgggg

SEQ ID NO: 12096 - DNA, 20 bp, Artificial Sequence
  Description of Artificial Sequence: Synthetic oligonucleotide
  Target: ATXN1; (-) strand; PAM type: NNGRRT; PAM sequence: CGGGGT
tttaccctgcctgtaatcct

SEQ ID NO: 12097 - DNA, 20 bp, Artificial Sequence
  Description of Artificial Sequence: Synthetic oligonucleotide
  Target: ATXN1; (-) strand; PAM type: NNGRRT; PAM sequence: AAGAGT
caaaggcctcgtgttctaaa

SEQ ID NO: 12098 - DNA, 20 bp, Artificial Sequence
  Description of Artificial Sequence: Synthetic oligonucleotide
  Target: ATXN1; (-) strand; PAM type: NNGRRT; PAM sequence: CTGAGT
ggaactggcactgaagagat

SEQ ID NO: 12099 - DNA, 20 bp, Artificial Sequence
  Description of Artificial Sequence: Synthetic oligonucleotide
  Target: ATXN1; (-) strand; PAM type: NNGRRT; PAM sequence: TTGGGT
tggggcttcgcacctcctcc

SEQ ID NO: 12100 - DNA, 20 bp, Artificial Sequence
  Description of Artificial Sequence: Synthetic oligonucleotide
  Target: ATXN1; (-) strand; PAM type: NNGRRT; PAM sequence: AAGGAT
gagccaatgcaactcaaaag

SEQ ID NO: 12101 - DNA, 20 bp, Artificial Sequence
  Description of Artificial Sequence: Synthetic oligonucleotide
  Target: ATXN1; (-) strand; PAM type: NNGRRT; PAM sequence: CAGAAT
ttgagagtcccaaaggatga

SEQ ID NO: 12102 - DNA, 20 bp, Artificial Sequence
  Description of Artificial Sequence: Synthetic oligonucleotide
  Target: ATXN1; (-) strand; PAM type: NNGRRT; PAM sequence: AAGGAT
gattctggttgagagtccca

SEQ ID NO: 12103 - DNA, 20 bp, Artificial Sequence
  Description of Artificial Sequence: Synthetic oligonucleotide
  Target: ATXN1; (-) strand; PAM type: NNGRRT; PAM sequence: GAGAGT
gccatgccttgattctggtt

SEQ ID NO: 12104 - DNA, 20 bp, Artificial Sequence
  Description of Artificial Sequence: Synthetic oligonucleotide
  Target: ATXN1; (-) strand; PAM type: NNGRRT; PAM sequence: GAGAGT
gcacgttccccaccctggaa

SEQ ID NO: 12105 - DNA, 20 bp, Artificial Sequence
  Description of Artificial Sequence: Synthetic oligonucleotide
  Target: ATXN1; (-) strand; PAM type: NNGRRT; PAM sequence: GAGGGT
agcctccttcctcttcagtg

SEQ ID NO: 12106 - DNA, 20 bp, Artificial Sequence
  Description of Artificial Sequence: Synthetic oligonucleotide
  Target: ATXN1; (-) strand; PAM type: NNGRRT; PAM sequence: GGGAAT
taggtgctgtgggaggaaag

SEQ ID NO: 12107 - DNA, 20 bp, Artificial Sequence
  Description of Artificial Sequence: Synthetic oligonucleotide
  Target: ATXN1; (-) strand; PAM type: NNGRRT; PAM sequence: CTGAAT
tggggatgatttttaagggg

SEQ ID NO: 12108 - DNA, 20 bp, Artificial Sequence
  Description of Artificial Sequence: Synthetic oligonucleotide
  Target: ATXN1; (-) strand; PAM type: NNGRRT; PAM sequence: GGGGAT
aactgaggggtgtttagttt

SEQ ID NO: 12109 - DNA, 20 bp, Artificial Sequence
  Description of Artificial Sequence: Synthetic oligonucleotide
  Target: ATXN1; (-) strand; PAM type: NNGRRT; PAM sequence: AGGGGT
agccatggcatataaaactg

SEQ ID NO: 12110 - DNA, 20 bp, Artificial Sequence
  Description of Artificial Sequence: Synthetic oligonucleotide
  Target: ATXN1; (-) strand; PAM type: NNGRRT; PAM sequence: GAGGGT
cataggagataatctcttga

SEQ ID NO: 12111 - DNA, 20 bp, Artificial Sequence
  Description of Artificial Sequence: Synthetic oligonucleotide
  Target: ATXN1; (-) strand; PAM type: NNGRRT; PAM sequence: TGGGAT
acctcggtctcccaaaatgc

SEQ ID NO: 12112 - DNA, 20 bp, Artificial Sequence
  Description of Artificial Sequence: Synthetic oligonucleotide
  Target: ATXN1; (-) strand; PAM type: NNGRRT; PAM sequence: CAGGGT
tctgtgtttttttgtagaga

SEQ ID NO: 12113 - DNA, 20 bp, Artificial Sequence
  Description of Artificial Sequence: Synthetic oligonucleotide
  Target: ATXN1; (-) strand; PAM type: NNGRRT; PAM sequence: ATGGGT
cctccccagtagctgggact

SEQ ID NO: 12114 - DNA, 20 bp, Artificial Sequence
  Description of Artificial Sequence: Synthetic oligonucleotide
  Target: ATXN1; (-) strand; PAM type: NNGRRT; PAM sequence: TGGGAT
cccaggctgaagtgcagtga

SEQ ID NO: 12115 - DNA, 20 bp, Artificial Sequence
  Description of Artificial Sequence: Synthetic oligonucleotide
  Target: ATXN1; (-) strand; PAM type: NNGRRT; PAM sequence: CAGGGT
tttgtttgcttgttttgaga

SEQ ID NO: 12116 - DNA, 20 bp, Artificial Sequence
  Description of Artificial Sequence: Synthetic oligonucleotide
  Target: ATXN1; (-) strand; PAM type: NNGRRT; PAM sequence: GTGGGT
caaatgagttttgtttttct

SEQ ID NO: 12117 - DNA, 20 bp, Artificial Sequence
  Description of Artificial Sequence: Synthetic oligonucleotide
  Target: ATXN1; (-) strand; PAM type: NNGRRT; PAM sequence: ATGAGT
ctcctctctaaaccaggcaa

SEQ ID NO: 12118 - DNA, 20 bp, Artificial Sequence
  Description of Artificial Sequence: Synthetic oligonucleotide
  Target: ATXN1; (-) strand; PAM type: NNGRRT; PAM sequence: TTGGGT
acagacccaggggtgcggat

SEQ ID NO: 12119 - DNA, 20 bp, Artificial Sequence
  Description of Artificial Sequence: Synthetic oligonucleotide
  Target: ATXN1; (-) strand; PAM type: NNGRRT; PAM sequence: GCGGAT
gtggtgacagacccaggggt

SEQ ID NO: 12120 - DNA, 20 bp, Artificial Sequence
  Description of Artificial Sequence: Synthetic oligonucleotide
  Target: ATXN1; (-) strand; PAM type: NNGRRT; PAM sequence: AGGGGT
agtatggtggtgacagaccc

SEQ ID NO: 12121 - DNA, 20 bp, Artificial Sequence
  Description of Artificial Sequence: Synthetic oligonucleotide
  Target: ATXN1; (-) strand; PAM type: NNGRRT; PAM sequence: GAGGAT
tcctgcatgaacagactctt

SEQ ID NO: 12122 - DNA, 20 bp, Artificial Sequence
  Description of Artificial Sequence: Synthetic oligonucleotide
  Target: ATXN1; (-) strand; PAM type: NNGRRT; PAM sequence: AAGAAT
gggttttctcccctagcctg

SEQ ID NO: 12123 - DNA, 20 bp, Artificial Sequence
  Description of Artificial Sequence: Synthetic oligonucleotide
  Target: ATXN1; (-) strand; PAM type: NNGRRT; PAM sequence: AGGGGT
ccctctgcagtgccttcctg

SEQ ID NO: 12124 - DNA, 20 bp, Artificial Sequence
  Description of Artificial Sequence: Synthetic oligonucleotide
  Target: ATXN1; (-) strand; PAM type: NNGRRT; PAM sequence: CAGAGT
tttgccacaagtgacaggtt

SEQ ID NO: 12125 - DNA, 20 bp, Artificial Sequence
  Description of Artificial Sequence: Synthetic oligonucleotide
  Target: ATXN1; (-) strand; PAM type: NNGRRT; PAM sequence: CAGGGT
taaatctctctactgacagc

SEQ ID NO: 12126 - DNA, 20 bp, Artificial Sequence
  Description of Artificial Sequence: Synthetic oligonucleotide
  Target: ATXN1; (-) strand; PAM type: NNGRRT; PAM sequence: TGGGAT
ccgcctcagcctcctaaagc

SEQ ID NO: 12127 - DNA, 20 bp, Artificial Sequence
  Description of Artificial Sequence: Synthetic oligonucleotide
  Target: ATXN1; (-) strand; PAM type: NNGRRT; PAM sequence: CAGGGT
ttttgtatttttagtagaga

SEQ ID NO: 12128 - DNA, 20 bp, Artificial Sequence
  Description of Artificial Sequence: Synthetic oligonucleotide
  Target: ATXN1; (-) strand; PAM type: NNGRRT; PAM sequence: TGGGGT
ggctggagtgcagagtgcag

SEQ ID NO: 12129 - DNA, 20 bp, Artificial Sequence
  Description of Artificial Sequence: Synthetic oligonucleotide
  Target: ATXN1; (-) strand; PAM type: NNGRRT; PAM sequence: CAGAGT
ctgtcacccaggctggagtg

SEQ ID NO: 12130 - DNA, 20 bp, Artificial Sequence
  Description of Artificial Sequence: Synthetic oligonucleotide
  Target: ATXN1; (-) strand; PAM type: NNGRRT; PAM sequence: TGGAGT
tcttgctctgtcacccaggc

SEQ ID NO: 12131 - DNA, 20 bp, Artificial Sequence
  Description of Artificial Sequence: Synthetic oligonucleotide
  Target: ATXN1; (-) strand; PAM type: NNGRRT; PAM sequence: CAGAGT
tttttttttttttttggaga

SEQ ID NO: 12132 - DNA, 20 bp, Artificial Sequence
  Description of Artificial Sequence: Synthetic oligonucleotide
  Target: ATXN1; (-) strand; PAM type: NNGRRT; PAM sequence: GAGAAT
gccagcatcaacttcagctt

SEQ ID NO: 12133 - DNA, 20 bp, Artificial Sequence
  Description of Artificial Sequence: Synthetic oligonucleotide
  Target: ATXN1; (-) strand; PAM type: NNGRRT; PAM sequence: TAGAAT
tcattgcttttcatggtact

SEQ ID NO: 12134 - DNA, 20 bp, Artificial Sequence
  Description of Artificial Sequence: Synthetic oligonucleotide
  Target: ATXN1; (-) strand; PAM type: NNGRRT; PAM sequence: AAGAGT
atggaaaataaacatgagtg

SEQ ID NO: 12135 - DNA, 20 bp, Artificial Sequence
  Description of Artificial Sequence: Synthetic oligonucleotide
  Target: ATXN1; (-) strand; PAM type: NNGRRT; PAM sequence: ATGAGT
gtgacacatggaaaataaac

SEQ ID NO: 12136 - DNA, 20 bp, Artificial Sequence
  Description of Artificial Sequence: Synthetic oligonucleotide
  Target: ATXN1; (-) strand; PAM type: NNGRRT; PAM sequence: GTGGGT
acttcctgcatgaattaggg

SEQ ID NO: 12137 - DNA, 20 bp, Artificial Sequence
  Description of Artificial Sequence: Synthetic oligonucleotide
  Target: ATXN1; (-) strand; PAM type: NNGRRT; PAM sequence: AGGGGT
gttcacttcctgcatgaatt

SEQ ID NO: 12138 - DNA, 20 bp, Artificial Sequence
  Description of Artificial Sequence: Synthetic oligonucleotide
  Target: ATXN1; (-) strand; PAM type: NNGRRT; PAM sequence: ATGAAT
agtggctgttcacttcctgc

SEQ ID NO: 12139 - DNA, 20 bp, Artificial Sequence
  Description of Artificial Sequence: Synthetic oligonucleotide
  Target: ATXN1; (-) strand; PAM type: NNGRRT; PAM sequence: CAGGAT
atttaaaaaaaaaagaaaat

SEQ ID NO: 12140 - DNA, 20 bp, Artificial Sequence
  Description of Artificial Sequence: Synthetic oligonucleotide
  Target: ATXN1; (-) strand; PAM type: NNGRRT; PAM sequence: CTGAAT
attgccgagagcttttagcc

SEQ ID NO: 12141 - DNA, 20 bp, Artificial Sequence
  Description of Artificial Sequence: Synthetic oligonucleotide
  Target: ATXN1; (-) strand; PAM type: NNGRRT; PAM sequence: CTGGAT
ccagaaccactcgtgaatga

SEQ ID NO: 12142 - DNA, 20 bp, Artificial Sequence
  Description of Artificial Sequence: Synthetic oligonucleotide
  Target: ATXN1; (-) strand; PAM type: NNGRRT; PAM sequence: GTGAAT
tcagttttccagaaccactc

SEQ ID NO: 12143 - DNA, 20 bp, Artificial Sequence
  Description of Artificial Sequence: Synthetic oligonucleotide
  Target: ATXN1; (-) strand; PAM type: NNGRRT; PAM sequence: ACGAGT
aaagccctgagattacagac

SEQ ID NO: 12144 - DNA, 20 bp, Artificial Sequence
  Description of Artificial Sequence: Synthetic oligonucleotide
  Target: ATXN1; (-) strand; PAM type: NNGRRT; PAM sequence: TGGGGT
aaaaaacattttagtagaga

SEQ ID NO: 12145 - DNA, 20 bp, Artificial Sequence
  Description of Artificial Sequence: Synthetic oligonucleotide
  Target: ATXN1; (-) strand; PAM type: NNGRRT; PAM sequence: TGGAAT
gtgtttcttgtctcctaggc

SEQ ID NO: 12146 - DNA, 20 bp, Artificial Sequence
  Description of Artificial Sequence: Synthetic oligonucleotide
  Target: ATXN1; (-) strand; PAM type: NNGRRT; PAM sequence: TTGAAT
aagataaactaattaatggt

SEQ ID NO: 12147 - DNA, 20 bp, Artificial Sequence
  Description of Artificial Sequence: Synthetic oligonucleotide
  Target: ATXN1; (-) strand; PAM type: NNGRRT; PAM sequence: TTGAGT
ggacagagcctccttccagc

SEQ ID NO: 12148 - DNA, 20 bp, Artificial Sequence
  Description of Artificial Sequence: Synthetic oligonucleotide
  Target: ATXN1; (-) strand; PAM type: NNGRRT; PAM sequence: TAGGAT
tttctacaagtgtttccatc

SEQ ID NO: 12149 - DNA, 20 bp, Artificial Sequence
  Description of Artificial Sequence: Synthetic oligonucleotide
  Target: ATXN1; (-) strand; PAM type: NNGRRT; PAM sequence: GGGAGT
ctttcactgcccaagttgct

SEQ ID NO: 12150 - DNA, 20 bp, Artificial Sequence
  Description of Artificial Sequence: Synthetic oligonucleotide
  Target: ATXN1; (-) strand; PAM type: NNGRRT; PAM sequence: ATGAGT
taaagtcagctgtagccaag

SEQ ID NO: 12151 - DNA, 20 bp, Artificial Sequence
  Description of Artificial Sequence: Synthetic oligonucleotide
  Target: ATXN1; (-) strand; PAM type: NNGRRT; PAM sequence: TGGGGT
cccaggtgacctgctgggct

SEQ ID NO: 12152 - DNA, 20 bp, Artificial Sequence
  Description of Artificial Sequence: Synthetic oligonucleotide
  Target: ATXN1; (-) strand; PAM type: NNGRRT; PAM sequence: TGGGAT
cctaggagagactatacctc

SEQ ID NO: 12153 - DNA, 20 bp, Artificial Sequence
  Description of Artificial Sequence: Synthetic oligonucleotide
  Target: ATXN1; (-) strand; PAM type: NNGRRT; PAM sequence: AGGAAT
catataaaagtcaggcctct

SEQ ID NO: 12154 - DNA, 20 bp, Artificial Sequence
  Description of Artificial Sequence: Synthetic oligonucleotide
  Target: ATXN1; (-) strand; PAM type: NNGRRT; PAM sequence: AGGAAT
catatgaaagtcaggctcct

SEQ ID NO: 12155 - DNA, 20 bp, Artificial Sequence
  Description of Artificial Sequence: Synthetic oligonucleotide
  Target: ATXN1; (-) strand; PAM type: NNGRRT; PAM sequence: GGGAGT
accaatataggaggctgctg

SEQ ID NO: 12156 - DNA, 20 bp, Artificial Sequence
  Description of Artificial Sequence: Synthetic oligonucleotide
  Target: ATXN1; (-) strand; PAM type: NNGRRT; PAM sequence: GGGGAT
attgcatgaacccgggaggt

SEQ ID NO: 12157 - DNA, 20 bp, Artificial Sequence
  Description of Artificial Sequence: Synthetic oligonucleotide
  Target: ATXN1; (-) strand; PAM type: NNGRRT; PAM sequence: GAGAAT
tactccagaggctgaggtag

SEQ ID NO: 12158 - DNA, 20 bp, Artificial Sequence
  Description of Artificial Sequence: Synthetic oligonucleotide
  Target: ATXN1; (-) strand; PAM type: NNGRRT; PAM sequence: AGGAGT
cgggtggatcaccagaggtc

SEQ ID NO: 12159 - DNA, 20 bp, Artificial Sequence
  Description of Artificial Sequence: Synthetic oligonucleotide
  Target: ATXN1; (-) strand; PAM type: NNGRRT; PAM sequence: GTGGAT
actttgggaggctgaggcgg

SEQ ID NO: 12160 - DNA, 20 bp, Artificial Sequence
  Description of Artificial Sequence: Synthetic oligonucleotide
  Target: ATXN1; (-) strand; PAM type: NNGRRT; PAM sequence: GCGGGT
cagcactttgggaggctgag

SEQ ID NO: 12161 - DNA, 20 bp, Artificial Sequence
  Description of Artificial Sequence: Synthetic oligonucleotide
  Target: ATXN1; (-) strand; PAM type: NNGRRT; PAM sequence: TGGGGT
agttgtctggctgctggtgc

SEQ ID NO: 12162 - DNA, 20 bp, Artificial Sequence
  Description of Artificial Sequence: Synthetic oligonucleotide
  Target: ATXN1; (-) strand; PAM type: NNGRRT; PAM sequence: TGGGGT
tggataattccagtgtgctc

SEQ ID NO: 12163 - DNA, 20 bp, Artificial Sequence
  Description of Artificial Sequence: Synthetic oligonucleotide
  Target: ATXN1; (-) strand; PAM type: NNGRRT; PAM sequence: GTGGAT
cgggtttaggattggttaga

SEQ ID NO: 12164 - DNA, 20 bp, Artificial Sequence
  Description of Artificial Sequence: Synthetic oligonucleotide
  Target: ATXN1; (-) strand; PAM type: NNGRRT; PAM sequence: TAGAGT
taaacgggtttaggattggt

SEQ ID NO: 12165 - DNA, 20 bp, Artificial Sequence
  Description of Artificial Sequence: Synthetic oligonucleotide
  Target: ATXN1; (-) strand; PAM type: NNGRRT; PAM sequence: TAGGAT
ggaggcagggtaaacgggtt

SEQ ID NO: 12166 - DNA, 20 bp, Artificial Sequence
  Description of Artificial Sequence: Synthetic oligonucleotide
  Target: ATXN1; (-) strand; PAM type: NNGRRT; PAM sequence: ACGGGT
tttcatgggaggcagggtaa

SEQ ID NO: 12167 - DNA, 20 bp, Artificial Sequence
  Description of Artificial Sequence: Synthetic oligonucleotide
  Target: ATXN1; (-) strand; PAM type: NNGRRT; PAM sequence: CAGGGT
tattgtggtttcatgggagg

SEQ ID NO: 12168 - DNA, 20 bp, Artificial Sequence
  Description of Artificial Sequence: Synthetic oligonucleotide
  Target: ATXN1; (-) strand; PAM type: NNGRRT; PAM sequence: GGGAGT
caggtgggtcaggaggtgga

SEQ ID NO: 12169 - DNA, 20 bp, Artificial Sequence
  Description of Artificial Sequence: Synthetic oligonucleotide
  Target: ATXN1; (-) strand; PAM type: NNGRRT; PAM sequence: GTGGGT
ggcacctggggaagccccag

SEQ ID NO: 12170 - DNA, 20 bp, Artificial Sequence
  Description of Artificial Sequence: Synthetic oligonucleotide
  Target: ATXN1; (-) strand; PAM type: NNGRRT; PAM sequence: AGGAGT
caggaggatcacttgagccc

SEQ ID NO: 12171 - DNA, 20 bp, Artificial Sequence
  Description of Artificial Sequence: Synthetic oligonucleotide
  Target: ATXN1; (-) strand; PAM type: NNGRRT; PAM sequence: GAGGAT
tactccagagactgaggcag

SEQ ID NO: 12172 - DNA, 20 bp, Artificial Sequence
  Description of Artificial Sequence: Synthetic oligonucleotide
  Target: ATXN1; (-) strand; PAM type: NNGRRT; PAM sequence: CTGGGT
tttaaaatatgtcttattag

SEQ ID NO: 12173 - DNA, 20 bp, Artificial Sequence
  Description of Artificial Sequence: Synthetic oligonucleotide
  Target: ATXN1; (-) strand; PAM type: NNGRRT; PAM sequence: GGGGAT
agaggatgccgttggagtga

SEQ ID NO: 12174 - DNA, 20 bp, Artificial Sequence
  Description of Artificial Sequence: Synthetic oligonucleotide
  Target: ATXN1; (-) strand; PAM type: NNGRRT; PAM sequence: TGGAGT
gaaaagacagaggatgccgt

SEQ ID NO: 12175 - DNA, 20 bp, Artificial Sequence
  Description of Artificial Sequence: Synthetic oligonucleotide
  Target: ATXN1; (-) strand; PAM type: NNGRRT; PAM sequence: GAGGAT
tttcttaccaggaaaagaca

SEQ ID NO: 12176 - DNA, 20 bp, Artificial Sequence
  Description of Artificial Sequence: Synthetic oligonucleotide
  Target: ATXN1; (-) strand; PAM type: NNGRRT; PAM sequence: TTGAAT
ctcaccactctagttatttt

SEQ ID NO: 12177 - DNA, 20 bp, Artificial Sequence
  Description of Artificial Sequence: Synthetic oligonucleotide
  Target: ATXN1; (-) strand; PAM type: NNGRRT; PAM sequence: TGGAGT
atggagagtggggctagtta

SEQ ID NO: 12178 - DNA, 20 bp, Artificial Sequence
  Description of Artificial Sequence: Synthetic oligonucleotide
  Target: ATXN1; (-) strand; PAM type: NNGRRT; PAM sequence: GAGAGT
tgaattaacctccatgcatg

SEQ ID NO: 12179 - DNA, 20 bp, Artificial Sequence
  Description of Artificial Sequence: Synthetic oligonucleotide
  Target: ATXN1; (-) strand; PAM type: NNGRRT; PAM sequence: ATGAAT
cgtgatctctgctgtgtgta

SEQ ID NO: 12180 - DNA, 20 bp, Artificial Sequence
  Description of Artificial Sequence: Synthetic oligonucleotide
  Target: ATXN1; (-) strand; PAM type: NNGRRT; PAM sequence: TCGGGT
tgaggcaggattaagggttc

SEQ ID NO: 12181 - DNA, 20 bp, Artificial Sequence
  Description of Artificial Sequence: Synthetic oligonucleotide
  Target: ATXN1; (-) strand; PAM type: NNGRRT; PAM sequence: AAGGGT
tgcttctatgaggcaggatt

SEQ ID NO: 12182 - DNA, 20 bp, Artificial Sequence
  Description of Artificial Sequence: Synthetic oligonucleotide
  Target: ATXN1; (-) strand; PAM type: NNGRRT; PAM sequence: CAGGAT
gacgaattgcttctatgagg

SEQ ID NO: 12183 - DNA, 20 bp, Artificial Sequence
  Description of Artificial Sequence: Synthetic oligonucleotide
  Target: ATXN1; (-) strand; PAM type: NNGRRT; PAM sequence: ACGAAT
catcatcatctcctggcaag

SEQ ID NO: 12184 - DNA, 20 bp, Artificial Sequence
  Description of Artificial Sequence: Synthetic oligonucleotide
  Target: ATXN1; (-) strand; PAM type: NNGRRT; PAM sequence: AGGGAT
aacgttagccagggtggcac

SEQ ID NO: 12185 - DNA, 20 bp, Artificial Sequence
  Description of Artificial Sequence: Synthetic oligonucleotide
  Target: ATXN1; (-) strand; PAM type: NNGRRT; PAM sequence: CAGGGT
cgagcccaggtaacgttagc

SEQ ID NO: 12186 - DNA, 20 bp, Artificial Sequence
  Description of Artificial Sequence: Synthetic oligonucleotide
  Target: ATXN1; (-) strand; PAM type: NNGRRT; PAM sequence: GAGGAT
atcgactccagcaccgtaga

SEQ ID NO: 12187 - DNA, 20 bp, Artificial Sequence
  Description of Artificial Sequence: Synthetic oligonucleotide
  Target: ATXN1; (-) strand; PAM type: NNGRRT; PAM sequence: CAGAGT
taaaaacagaagatttcatc

SEQ ID NO: 12188 - DNA, 20 bp, Artificial Sequence
  Description of Artificial Sequence: Synthetic oligonucleotide
  Target: ATXN1; (-) strand; PAM type: NNGRRT; PAM sequence: GGGGGT
tacagcagtcgtgatccttc

SEQ ID NO: 12189 - DNA, 20 bp, Artificial Sequence
  Description of Artificial Sequence: Synthetic oligonucleotide
  Target: ATXN1; (-) strand; PAM type: NNGRRT; PAM sequence: ACGAGT
caagtcggttcctcacccgt

SEQ ID NO: 12190 - DNA, 20 bp, Artificial Sequence
  Description of Artificial Sequence: Synthetic oligonucleotide
  Target: ATXN1; (-) strand; PAM type: NNGRRT; PAM sequence: CGGGGT
ggctccggggctcatcaccc

SEQ ID NO: 12191 - DNA, 20 bp, Artificial Sequence
  Description of Artificial Sequence: Synthetic oligonucleotide
  Target: ATXN1; (-) strand; PAM type: NNGRRT; PAM sequence: TTGGGT
gccgcacaccttccagttca

SEQ ID NO: 12192 - DNA, 20 bp, Artificial Sequence
  Description of Artificial Sequence: Synthetic oligonucleotide
  Target: ATXN1; (-) strand; PAM type: NNGRRT; PAM sequence: GGGAAT
gtggagcttggtttacaaca

SEQ ID NO: 12193 - DNA, 20 bp, Artificial Sequence
  Description of Artificial Sequence: Synthetic oligonucleotide
  Target: ATXN1; (-) strand; PAM type: NNGRRT; PAM sequence: CCGGGT
accctgcccagcgacaacca

SEQ ID NO: 12194 - DNA, 20 bp, Artificial Sequence
  Description of Artificial Sequence: Synthetic oligonucleotide
  Target: ATXN1; (-) strand; PAM type: NNGRRT; PAM sequence: ACGAAT
atccaaccaagagcggagca

SEQ ID NO: 12195 - DNA, 20 bp, Artificial Sequence
  Description of Artificial Sequence: Synthetic oligonucleotide
  Target: ATXN1; (-) strand; PAM type: NNGRRT; PAM sequence: CTGGAT
gatgattcctcatgaagagc

SEQ ID NO: 12196 - DNA, 20 bp, Artificial Sequence
  Description of Artificial Sequence: Synthetic oligonucleotide
  Target: ATXN1; (-) strand; PAM type: NNGRRT; PAM sequence: GCGGAT
agcatccagagctgctgttg

SEQ ID NO: 12197 - DNA, 20 bp, Artificial Sequence
  Description of Artificial Sequence: Synthetic oligonucleotide
  Target: ATXN1; (-) strand; PAM type: NNGRRT; PAM sequence: CCGAGT
ttgggttatgggagttcaca

SEQ ID NO: 12198 - DNA, 20 bp, Artificial Sequence
  Description of Artificial Sequence: Synthetic oligonucleotide
  Target: ATXN1; (-) strand; PAM type: NNGRRT; PAM sequence: GGGAGT
ttggggtatgattgggttat

SEQ ID NO: 12199 - DNA, 20 bp, Artificial Sequence
  Description of Artificial Sequence: Synthetic oligonucleotide
  Target: ATXN1; (-) strand; PAM type: NNGRRT; PAM sequence: TTGGGT
cttcagtgcttggggtatga

SEQ ID NO: 12200 - DNA, 20 bp, Artificial Sequence
  Description of Artificial Sequence: Synthetic oligonucleotide
  Target: ATXN1; (-) strand; PAM type: NNGRRT; PAM sequence: TGGGGT
gttttctctgcttcagtgct

SEQ ID NO: 12201 - DNA, 20 bp, Artificial Sequence
  Description of Artificial Sequence: Synthetic oligonucleotide
  Target: ATXN1; (-) strand; PAM type: NNGRRT; PAM sequence: CAGGAT
cggggtttcaccatgttagc

SEQ ID NO: 12202 - DNA, 20 bp, Artificial Sequence
  Description of Artificial Sequence: Synthetic oligonucleotide
  Target: ATXN1; (-) strand; PAM type: NNGRRT; PAM sequence: CGGGGT
ttttttatttttggtagaga

SEQ ID NO: 12203 - DNA, 20 bp, Artificial Sequence
  Description of Artificial Sequence: Synthetic oligonucleotide
  Target: ATXN1; (-) strand; PAM type: NNGRRT; PAM sequence: CTGGGT
ctcactgcaacctctgcctc

SEQ ID NO: 12204 - DNA, 20 bp, Artificial Sequence
  Description of Artificial Sequence: Synthetic oligonucleotide
  Target: ATXN1; (-) strand; PAM type: NNGRRT; PAM sequence: TGGAGT
tgtcgctctgttgcccaggc

SEQ ID NO: 12205 - DNA, 20 bp, Artificial Sequence
  Description of Artificial Sequence: Synthetic oligonucleotide
  Target: ATXN1; (-) strand; PAM type: NNGRRT; PAM sequence: CAGAGT
ttttgtttcgtttttggaga

SEQ ID NO: 12206 - DNA, 20 bp, Artificial Sequence
  Description of Artificial Sequence: Synthetic oligonucleotide
  Target: ATXN1; (-) strand; PAM type: NNGRRT; PAM sequence: GGGAGT
gggtattgagaacatcttag

SEQ ID NO: 12207 - DNA, 20 bp, Artificial Sequence
  Description of Artificial Sequence: Synthetic oligonucleotide
  Target: ATXN1; (-) strand; PAM type: NNGRRT; PAM sequence: GAGGGT
ggagaaaaaaaaacaggaga

SEQ ID NO: 12208 - DNA, 20 bp, Artificial Sequence
  Description of Artificial Sequence: Synthetic oligonucleotide
  Target: ATXN1; (-) strand; PAM type: NNGRRT; PAM sequence: CAGGGT
tcagtgcctggctctgaggg

SEQ ID NO: 12209 - DNA, 20 bp, Artificial Sequence
  Description of Artificial Sequence: Synthetic oligonucleotide
  Target: ATXN1; (-) strand; PAM type: NNGRRT; PAM sequence: TCGAGT
ggcagatgaggattcagaaa

SEQ ID NO: 12210 - DNA, 20 bp, Artificial Sequence
  Description of Artificial Sequence: Synthetic oligonucleotide
  Target: ATXN1; (-) strand; PAM type: NNGRRT; PAM sequence: GAGGAT
gagtagtggctctggcagat

SEQ ID NO: 12211 - DNA, 20 bp, Artificial Sequence
  Description of Artificial Sequence: Synthetic oligonucleotide
  Target: ATXN1; (-) strand; PAM type: NNGRRT; PAM sequence: GAGAGT
cagagctaaggggaatcttg

SEQ ID NO: 12212 - DNA, 20 bp, Artificial Sequence
  Description of Artificial Sequence: Synthetic oligonucleotide
  Target: ATXN1; (-) strand; PAM type: NNGRRT; PAM sequence: GGGAAT
agtgtggacccagagctaag

SEQ ID NO: 12213 - DNA, 20 bp, Artificial Sequence
  Description of Artificial Sequence: Synthetic oligonucleotide
  Target: ATXN1; (-) strand; PAM type: NNGRRT; PAM sequence: CTGAGT
attatttctggcggcctctg

SEQ ID NO: 12214 - DNA, 20 bp, Artificial Sequence
  Description of Artificial Sequence: Synthetic oligonucleotide
  Target: ATXN1; (-) strand; PAM type: NNGRRT; PAM sequence: CAGGAT
cttttgaaacttgcagagaa

SEQ ID NO: 12215 - DNA, 20 bp, Artificial Sequence
  Description of Artificial Sequence: Synthetic oligonucleotide
  Target: ATXN1; (-) strand; PAM type: NNGRRT; PAM sequence: GGGAAT
atcatatgagtggctgtact

SEQ ID NO: 12216 - DNA, 20 bp, Artificial Sequence
  Description of Artificial Sequence: Synthetic oligonucleotide
  Target: ATXN1; (-) strand; PAM type: NNGRRT; PAM sequence: ATGAGT
cagtctcactccgtcatcat

SEQ ID NO: 12217 - DNA, 20 bp, Artificial Sequence
  Description of Artificial Sequence: Synthetic oligonucleotide
  Target: ATXN1; (-) strand; PAM type: NNGRRT; PAM sequence: TTGGGT
gccctatttttgtatggtat

SEQ ID NO: 12218 - DNA, 20 bp, Artificial Sequence
  Description of Artificial Sequence: Synthetic oligonucleotide
  Target: ATXN1; (-) strand; PAM type: NNGRRT; PAM sequence: GCGAGT
tgtcgtctctagtgttaatg

SEQ ID NO: 12219 - DNA, 20 bp, Artificial Sequence
  Description of Artificial Sequence: Synthetic oligonucleotide
  Target: ATXN1; (-) strand; PAM type: NNGRRT; PAM sequence: CAGGGT
ttgaccataagaactggctc

SEQ ID NO: 12220 - DNA, 20 bp, Artificial Sequence
  Description of Artificial Sequence: Synthetic oligonucleotide
  Target: ATXN1; (-) strand; PAM type: NNGRRT; PAM sequence: CTGGGT
cacatccgctgcttgctagc

SEQ ID NO: 12221 - DNA, 20 bp, Artificial Sequence
  Description of Artificial Sequence: Synthetic oligonucleotide
  Target: ATXN1; (-) strand; PAM type: NNGRRT; PAM sequence: CAGAAT
aagcccaatcccacagctct

SEQ ID NO: 12222 - DNA, 20 bp, Artificial Sequence
  Description of Artificial Sequence: Synthetic oligonucleotide
  Target: ATXN1; (-) strand; PAM type: NNGRRT; PAM sequence: TGGAAT
gataccaaaacccaagggtg

SEQ ID NO: 12223 - DNA, 20 bp, Artificial Sequence
  Description of Artificial Sequence: Synthetic oligonucleotide
  Target: ATXN1; (-) strand; PAM type: NNGRRT; PAM sequence: AAGGGT
gatgtgagataccaaaaccc

SEQ ID NO: 12224 - DNA, 20 bp, Artificial Sequence
  Description of Artificial Sequence: Synthetic oligonucleotide
  Target: ATXN1; (-) strand; PAM type: NNGRRT; PAM sequence: CTGGAT
cagatcattgaaaagagggt

SEQ ID NO: 12225 - DNA, 20 bp, Artificial Sequence
  Description of Artificial Sequence: Synthetic oligonucleotide
  Target: ATXN1; (-) strand; PAM type: NNGRRT; PAM sequence: GAGGGT
gaaaatcagatcattgaaaa

SEQ ID NO: 12226 - DNA, 20 bp, Artificial Sequence
  Description of Artificial Sequence: Synthetic oligonucleotide
  Target: ATXN1; (-) strand; PAM type: NNGRRT; PAM sequence: CAGGAT
gaaggaggatttcttgaggc

SEQ ID NO: 12227 - DNA, 20 bp, Artificial Sequence
  Description of Artificial Sequence: Synthetic oligonucleotide
  Target: ATXN1; (-) strand; PAM type: NNGRRT; PAM sequence: GAGGAT
actttgggaggccaaggaag

SEQ ID NO: 12228 - DNA, 20 bp, Artificial Sequence
  Description of Artificial Sequence: Synthetic oligonucleotide
  Target: ATXN1; (-) strand; PAM type: NNGRRT; PAM sequence: TGGAAT
tacacacagtggctcatgcc

SEQ ID NO: 12229 - DNA, 20 bp, Artificial Sequence
  Description of Artificial Sequence: Synthetic oligonucleotide
  Target: ATXN1; (-) strand; PAM type: NNGRRT; PAM sequence: TCGGAT
ttattgtgtttgttttaaaa

SEQ ID NO: 12230 - DNA, 20 bp, Artificial Sequence
  Description of Artificial Sequence: Synthetic oligonucleotide
  Target: ATXN1; (-) strand; PAM type: NNGRRT; PAM sequence: TTGAAT
tgctccaacatggacaagga

SEQ ID NO: 12231 - DNA, 20 bp, Artificial Sequence
  Description of Artificial Sequence: Synthetic oligonucleotide
  Target: ATXN1; (-) strand; PAM type: NNGRRT; PAM sequence: AAGGAT
agtgttgctccaacatggac

SEQ ID NO: 12232 - DNA, 20 bp, Artificial Sequence
  Description of Artificial Sequence: Synthetic oligonucleotide
  Target: ATXN1; (-) strand; PAM type: NNGRRT; PAM sequence: AGGGAT
aaagggggttatgtttcagt

SEQ ID NO: 12233 - DNA, 20 bp, Artificial Sequence
  Description of Artificial Sequence: Synthetic oligonucleotide
  Target: ATXN1; (-) strand; PAM type: NNGRRT; PAM sequence: GGGGGT
tagggggcagagtagagaaa

SEQ ID NO: 12234 - DNA, 20 bp, Artificial Sequence
  Description of Artificial Sequence: Synthetic oligonucleotide
  Target: ATXN1; (-) strand; PAM type: NNGRRT; PAM sequence: CAGAGT
aatagttacaaagtaggggg

SEQ ID NO: 12235 - DNA, 20 bp, Artificial Sequence
  Description of Artificial Sequence: Synthetic oligonucleotide
  Target: ATXN1; (-) strand; PAM type: NNGRRT; PAM sequence: GAGGAT
tacctgggaggctgaggtgg

SEQ ID NO: 12236 - DNA, 20 bp, Artificial Sequence
  Description of Artificial Sequence: Synthetic oligonucleotide
  Target: ATXN1; (-) strand; PAM type: NNGRRT; PAM sequence: CCGGGT
acaaaaagtacaaaaattag

SEQ ID NO: 12237 - DNA, 20 bp, Artificial Sequence
  Description of Artificial Sequence: Synthetic oligonucleotide
  Target: ATXN1; (-) strand; PAM type: NNGRRT; PAM sequence: GTGGAT
agcaccgggaggccaagtgg

SEQ ID NO: 12238 - DNA, 20 bp, Artificial Sequence
  Description of Artificial Sequence: Synthetic oligonucleotide
  Target: ATXN1; (-) strand; PAM type: NNGRRT; PAM sequence: GTGGGT
tcccagcaccgggaggccaa

SEQ ID NO: 12239 - DNA, 20 bp, Artificial Sequence
  Description of Artificial Sequence: Synthetic oligonucleotide
  Target: ATXN1; (-) strand; PAM type: NNGRRT; PAM sequence: AAGGAT
gatatctgatcaaaatcatt

SEQ ID NO: 12240 - DNA, 20 bp, Artificial Sequence
  Description of Artificial Sequence: Synthetic oligonucleotide
  Target: ATXN1; (-) strand; PAM type: NNGRRT; PAM sequence: TAGGGT
tttcttcagcataagtgttt

SEQ ID NO: 12241 - DNA, 20 bp, Artificial Sequence
  Description of Artificial Sequence: Synthetic oligonucleotide
  Target: ATXN1; (-) strand; PAM type: NNGRRT; PAM sequence: GAGAGT
aaaaaaaacacctgggttgc

SEQ ID NO: 12242 - DNA, 20 bp, Artificial Sequence
  Description of Artificial Sequence: Synthetic oligonucleotide
  Target: ATXN1; (-) strand; PAM type: NNGRRT; PAM sequence: CTGGGT
ccatctcaaaaaaaaaacac

SEQ ID NO: 12243 - DNA, 20 bp, Artificial Sequence
  Description of Artificial Sequence: Synthetic oligonucleotide
  Target: ATXN1; (-) strand; PAM type: NNGRRT; PAM sequence: CAGAGT
ttgccctccagcctgggcga

SEQ ID NO: 12244 - DNA, 20 bp, Artificial Sequence
  Description of Artificial Sequence: Synthetic oligonucleotide
  Target: ATXN1; (-) strand; PAM type: NNGRRT; PAM sequence: GAGAAT
tactcaggaggctgaggcag

SEQ ID NO: 12245 - DNA, 20 bp, Artificial Sequence
  Description of Artificial Sequence: Synthetic oligonucleotide
  Target: ATXN1; (-) strand; PAM type: NNGRRT; PAM sequence: AGGAGT
ctggtggatcatttgaggtc

SEQ ID NO: 12246 - DNA, 20 bp, Artificial Sequence
  Description of Artificial Sequence: Synthetic oligonucleotide
  Target: ATXN1; (-) strand; PAM type: NNGRRT; PAM sequence: GTGGAT
actttgggaggtagaggctg

SEQ ID NO: 12247 - DNA, 20 bp, Artificial Sequence
  Description of Artificial Sequence: Synthetic oligonucleotide
  Target: ATXN1; (-) strand; PAM type: NNGRRT; PAM sequence: GTGAGT
tggcattccctttcttaaga

SEQ ID NO: 12248 - DNA, 20 bp, Artificial Sequence
  Description of Artificial Sequence: Synthetic oligonucleotide
  Target: ATXN1; (-) strand; PAM type: NNGRRT; PAM sequence: AAGAGT
cgtttggcattccctttctt

SEQ ID NO: 12249 - DNA, 20 bp, Artificial Sequence
  Description of Artificial Sequence: Synthetic oligonucleotide
  Target: ATXN1; (-) strand; PAM type: NNGRRT; PAM sequence: ATGAGT
tctctgagtaggtctcacgc

SEQ ID NO: 12250 - DNA, 20 bp, Artificial Sequence
  Description of Artificial Sequence: Synthetic oligonucleotide
  Target: ATXN1; (-) strand; PAM type: NNGRRT; PAM sequence: CTGAGT
ggcgcatggactggttctct

SEQ ID NO: 12251 - DNA, 20 bp, Artificial Sequence
  Description of Artificial Sequence: Synthetic oligonucleotide
  Target: ATXN1; (-) strand; PAM type: NNGRRT; PAM sequence: TTGGAT
tgaaaccctgtggggtttta

SEQ ID NO: 12252 - DNA, 20 bp, Artificial Sequence
  Description of Artificial Sequence: Synthetic oligonucleotide
  Target: ATXN1; (-) strand; PAM type: NNGRRT; PAM sequence: TGGGGT
atatccctcatgaaaccctg

SEQ ID NO: 12253 - DNA, 20 bp, Artificial Sequence
  Description of Artificial Sequence: Synthetic oligonucleotide
  Target: ATXN1; (-) strand; PAM type: NNGRRT; PAM sequence: CTGAAT
gcattgctaatagacccttc

SEQ ID NO: 12254 - DNA, 20 bp, Artificial Sequence
  Description of Artificial Sequence: Synthetic oligonucleotide
  Target: ATXN1; (-) strand; PAM type: NNGRRT; PAM sequence: AGGAGT
tcctaaagaagtaccttcag

SEQ ID NO: 12255 - DNA, 20 bp, Artificial Sequence
  Description of Artificial Sequence: Synthetic oligonucleotide
  Target: ATXN1; (-) strand; PAM type: NNGRRT; PAM sequence: GTGAGT
tttcgcagaagaccagtcca

SEQ ID NO: 12256 - DNA, 20 bp, Artificial Sequence
  Description of Artificial Sequence: Synthetic oligonucleotide
  Target: ATXN1; (-) strand; PAM type: NNGRRT; PAM sequence: TTGGAT
aagttttcagaagaataaat

SEQ ID NO: 12257 - DNA, 20 bp, Artificial Sequence
  Description of Artificial Sequence: Synthetic oligonucleotide
  Target: ATXN1; (-) strand; PAM type: NNGRRT; PAM sequence: AAGAAT
atcaatggataagttttcag

SEQ ID NO: 12258 - DNA, 20 bp, Artificial Sequence
  Description of Artificial Sequence: Synthetic oligonucleotide
  Target: ATXN1; (-) strand; PAM type: NNGRRT; PAM sequence: ATGGAT
ggaaaagatgctgtttatca

SEQ ID NO: 12259 - DNA, 20 bp, Artificial Sequence
  Description of Artificial Sequence: Synthetic oligonucleotide
  Target: ATXN1; (-) strand; PAM type: NNGRRT; PAM sequence: ATGGGT
gccctaaatgtaggaggagg

SEQ ID NO: 12260 - DNA, 20 bp, Artificial Sequence
  Description of Artificial Sequence: Synthetic oligonucleotide
  Target: ATXN1; (-) strand; PAM type: NNGRRT; PAM sequence: GAGGAT
aatagccctaaatgtaggag

SEQ ID NO: 12261 - DNA, 20 bp, Artificial Sequence
  Description of Artificial Sequence: Synthetic oligonucleotide
  Target: ATXN1; (-) strand; PAM type: NNGRRT; PAM sequence: GTGGGT
gcaagacccaatctctaccc

SEQ ID NO: 12262 - DNA, 20 bp, Artificial Sequence
  Description of Artificial Sequence: Synthetic oligonucleotide
  Target: ATXN1; (-) strand; PAM type: NNGRRT; PAM sequence: AGGAAT
ccatgatcacccgatagacc

SEQ ID NO: 12263 - DNA, 20 bp, Artificial Sequence
  Description of Artificial Sequence: Synthetic oligonucleotide
  Target: ATXN1; (-) strand; PAM type: NNGRRT; PAM sequence: GGGGGT
cttccagagataaactcctc

SEQ ID NO: 12264 - DNA, 20 bp, Artificial Sequence
  Description of Artificial Sequence: Synthetic oligonucleotide
  Target: ATXN1; (-) strand; PAM type: NNGRRT; PAM sequence: AGGAAT
tccaatttcccttttccaat

SEQ ID NO: 12265 - DNA, 20 bp, Artificial Sequence
  Description of Artificial Sequence: Synthetic oligonucleotide
  Target: ATXN1; (-) strand; PAM type: NNGRRT; PAM sequence: ATGGGT
cagtgattatcaggcaaacc

SEQ ID NO: 12266 - DNA, 20 bp, Artificial Sequence
  Description of Artificial Sequence: Synthetic oligonucleotide
  Target: ATXN1; (-) strand; PAM type: NNGRRT; PAM sequence: ATGAAT
tagctctaaagcggcttaag

SEQ ID NO: 12267 - DNA, 20 bp, Artificial Sequence
  Description of Artificial Sequence: Synthetic oligonucleotide
  Target: ATXN1; (-) strand; PAM type: NNGRRT; PAM sequence: ACGGGT
ttgcagaggatgctgatgtc

SEQ ID NO: 12268 - DNA, 20 bp, Artificial Sequence
  Description of Artificial Sequence: Synthetic oligonucleotide
  Target: ATXN1; (-) strand; PAM type: NNGRRT; PAM sequence: GAGGAT
gcatttccagcaaacttgca

SEQ ID NO: 12269 - DNA, 20 bp, Artificial Sequence
  Description of Artificial Sequence: Synthetic oligonucleotide
  Target: ATXN1; (-) strand; PAM type: NNGRRT; PAM sequence: GAGAGT
tgcaggactgggtggggcct

SEQ ID NO: 12270 - DNA, 20 bp, Artificial Sequence
  Description of Artificial Sequence: Synthetic oligonucleotide
  Target: ATXN1; (-) strand; PAM type: NNGRRT; PAM sequence: CTGGGT
tatcttgttaaaatgcagga

SEQ ID NO: 12271 - DNA, 20 bp, Artificial Sequence
  Description of Artificial Sequence: Synthetic oligonucleotide
  Target: ATXN1; (-) strand; PAM type: NNGRRT; PAM sequence: CTGGAT
cttactgtgcatagaatcat

SEQ ID NO: 12272 - DNA, 20 bp, Artificial Sequence
  Description of Artificial Sequence: Synthetic oligonucleotide
  Target: ATXN1; (-) strand; PAM type: NNGRRT; PAM sequence: TAGAAT
ttctcaaaccttactgtgca

SEQ ID NO: 12273 - DNA, 20 bp, Artificial Sequence
  Description of Artificial Sequence: Synthetic oligonucleotide
  Target: ATXN1; (-) strand; PAM type: NNGRRT; PAM sequence: TAGGGT
aaatttaatcggatagctgc

SEQ ID NO: 12274 - DNA, 20 bp, Artificial Sequence
  Description of Artificial Sequence: Synthetic oligonucleotide
  Target: ATXN1; (-) strand; PAM type: NNGRRT; PAM sequence: TCGGAT
tttagcagtagaaaatttaa

SEQ ID NO: 12275 - DNA, 20 bp, Artificial Sequence
  Description of Artificial Sequence: Synthetic oligonucleotide
  Target: ATXN1; (-) strand; PAM type: NNGRRT; PAM sequence: AAGAGT
tagagatgtttaatttgctt

SEQ ID NO: 12276 - DNA, 20 bp, Artificial Sequence
  Description of Artificial Sequence: Synthetic oligonucleotide
  Target: ATXN1; (-) strand; PAM type: NNGRRT; PAM sequence: TTGAGT
atttttcttcctgggaatga

SEQ ID NO: 12277 - DNA, 20 bp, Artificial Sequence
  Description of Artificial Sequence: Synthetic oligonucleotide
  Target: ATXN1; (-) strand; PAM type: NNGRRT; PAM sequence: GGGAAT
taaatttcatttttcttcct

SEQ ID NO: 12278 - DNA, 20 bp, Artificial Sequence
  Description of Artificial Sequence: Synthetic oligonucleotide
  Target: ATXN1; (-) strand; PAM type: NNGRRT; PAM sequence: CTGAAT
cctatcacttcccaagcagt

SEQ ID NO: 12279 - DNA, 20 bp, Artificial Sequence
  Description of Artificial Sequence: Synthetic oligonucleotide
  Target: ATXN1; (-) strand; PAM type: NNGRRT; PAM sequence: AGGAGT
taggtttaagatgtattttt

SEQ ID NO: 12280 - DNA, 20 bp, Artificial Sequence
  Description of Artificial Sequence: Synthetic oligonucleotide
  Target: ATXN1; (-) strand; PAM type: NNGRRT; PAM sequence: GGGGGT
aaactgagaagcacaggatt

SEQ ID NO: 12281 - DNA, 20 bp, Artificial Sequence
  Description of Artificial Sequence: Synthetic oligonucleotide
  Target: ATXN1; (-) strand; PAM type: NNGRRT; PAM sequence: CAGGAT
ttcattcaaactgagaagca

SEQ ID NO: 12282 - DNA, 20 bp, Artificial Sequence
  Description of Artificial Sequence: Synthetic oligonucleotide
  Target: ATXN1; (-) strand; PAM type: NNGRRT; PAM sequence: ATGGGT
gatatacaggccaggcagcc

SEQ ID NO: 12283 - DNA, 20 bp, Artificial Sequence
  Description of Artificial Sequence: Synthetic oligonucleotide
  Target: ATXN1; (-) strand; PAM type: NNGRRT; PAM sequence: GAGAAT
gattggtgagtcagcacttt

SEQ ID NO: 12284 - DNA, 20 bp, Artificial Sequence
  Description of Artificial Sequence: Synthetic oligonucleotide
  Target: ATXN1; (-) strand; PAM type: NNGRRT; PAM sequence: GTGAGT
ataaagctggaaggagattg

SEQ ID NO: 12285 - DNA, 20 bp, Artificial Sequence
  Description of Artificial Sequence: Synthetic oligonucleotide
  Target: ATXN1; (-) strand; PAM type: NNGRRT; PAM sequence: TCGGGT
ttctagatactccaagcatg

SEQ ID NO: 12286 - DNA, 20 bp, Artificial Sequence
  Description of Artificial Sequence: Synthetic oligonucleotide
  Target: ATXN1; (-) strand; PAM type: NNGRRT; PAM sequence: ATGAAT
acggaatgagtgtttgatga

SEQ ID NO: 12287 - DNA, 20 bp, Artificial Sequence
  Description of Artificial Sequence: Synthetic oligonucleotide
  Target: ATXN1; (-) strand; PAM type: NNGRRT; PAM sequence: ATGAAT
agaaacggaatgagtgtttg

SEQ ID NO: 12288 - DNA, 20 bp, Artificial Sequence
  Description of Artificial Sequence: Synthetic oligonucleotide
  Target: ATXN1; (-) strand; PAM type: NNGRRT; PAM sequence: ATGAGT
tcatacatactagaaacgga

SEQ ID NO: 12289 - DNA, 20 bp, Artificial Sequence
  Description of Artificial Sequence: Synthetic oligonucleotide
  Target: ATXN1; (-) strand; PAM type: NNGRRT; PAM sequence: CGGAAT
cccgtcatacatactagaaa

SEQ ID NO: 12290 - DNA, 20 bp, Artificial Sequence
  Description of Artificial Sequence: Synthetic oligonucleotide
  Target: ATXN1; (-) strand; PAM type: NNGRRT; PAM sequence: TAGAGT
gaatagaacagaactaaaaa

SEQ ID NO: 12291 - DNA, 20 bp, Artificial Sequence
  Description of Artificial Sequence: Synthetic oligonucleotide
  Target: ATXN1; (-) strand; PAM type: NNGRRT; PAM sequence: TTGAAT
accaaaacactgtattagta

SEQ ID NO: 12292 - DNA, 20 bp, Artificial Sequence
  Description of Artificial Sequence: Synthetic oligonucleotide
  Target: ATXN1; (-) strand; PAM type: NNGRRT; PAM sequence: TTGAAT
tccggcttcttaagatatat

SEQ ID NO: 12293 - DNA, 20 bp, Artificial Sequence
  Description of Artificial Sequence: Synthetic oligonucleotide
  Target: ATXN1; (-) strand; PAM type: NNGRRT; PAM sequence: TTGAGT
ctaccaaatggttgttcata

SEQ ID NO: 12294 - DNA, 20 bp, Artificial Sequence
  Description of Artificial Sequence: Synthetic oligonucleotide
  Target: ATXN1; (-) strand; PAM type: NNGRRT; PAM sequence: TGGGAT
ctcctgggctcccaaagtgc

SEQ ID NO: 12295 - DNA, 20 bp, Artificial Sequence
  Description of Artificial Sequence: Synthetic oligonucleotide
  Target: ATXN1; (-) strand; PAM type: NNGRRT; PAM sequence: CAGGAT
ttttttattttttgtagaga

SEQ ID NO: 12296 - DNA, 20 bp, Artificial Sequence
  Description of Artificial Sequence: Synthetic oligonucleotide
  Target: ATXN1; (-) strand; PAM type: NNGRRT; PAM sequence: CTGGGT
aatcctcctgccttagcctc

SEQ ID NO: 12297 - DNA, 20 bp, Artificial Sequence
  Description of Artificial Sequence: Synthetic oligonucleotide
  Target: ATXN1; (-) strand; PAM type: NNGRRT; PAM sequence: TGGAGT
tcttgctttatcacctaggc

SEQ ID NO: 12298 - DNA, 20 bp, Artificial Sequence
  Description of Artificial Sequence: Synthetic oligonucleotide
  Target: ATXN1; (-) strand; PAM type: NNGRRT; PAM sequence: CAGGGT
ttctttctcttttcttgaga

SEQ ID NO: 12299 - DNA, 20 bp, Artificial Sequence
  Description of Artificial Sequence: Synthetic oligonucleotide
  Target: ATXN1; (-) strand; PAM type: NNGRRT; PAM sequence: CAGGAT
cttcccacgtgcctttgcag

SEQ ID NO: 12300 - DNA, 20 bp, Artificial Sequence
  Description of Artificial Sequence: Synthetic oligonucleotide
  Target: ATXN1; (-) strand; PAM type: NNGRRT; PAM sequence: TGGGGT
tgagtttctatcctgaccct

SEQ ID NO: 12301 - DNA, 20 bp, Artificial Sequence
  Description of Artificial Sequence: Synthetic oligonucleotide
  Target: ATXN1; (-) strand; PAM type: NNGRRT; PAM sequence: CTGAGT
gggacccctaccccatatcc

SEQ ID NO: 12302 - DNA, 20 bp, Artificial Sequence
  Description of Artificial Sequence: Synthetic oligonucleotide
  Target: ATXN1; (-) strand; PAM type: NNGRRT; PAM sequence: TAGAGT
ttcctaatggcaaaaaaatg

SEQ ID NO: 12303 - DNA, 20 bp, Artificial Sequence
  Description of Artificial Sequence: Synthetic oligonucleotide
  Target: ATXN1; (-) strand; PAM type: NNGRRT; PAM sequence: CAGAAT
acagagtggaatcacagtct

SEQ ID NO: 12304 - DNA, 20 bp, Artificial Sequence
  Description of Artificial Sequence: Synthetic oligonucleotide
  Target: ATXN1; (-) strand; PAM type: NNGRRT; PAM sequence: TGGAAT
ccagccaccttgacacagag

SEQ ID NO: 12305 - DNA, 20 bp, Artificial Sequence
  Description of Artificial Sequence: Synthetic oligonucleotide
  Target: ATXN1; (-) strand; PAM type: NNGRRT; PAM sequence: CAGAGT
acaagccagccaccttgaca

SEQ ID NO: 12306 - DNA, 20 bp, Artificial Sequence
  Description of Artificial Sequence: Synthetic oligonucleotide
  Target: ATXN1; (-) strand; PAM type: NNGRRT; PAM sequence: TGGGAT
aagaaattgtgacagtagac

SEQ ID NO: 12307 - DNA, 20 bp, Artificial Sequence
  Description of Artificial Sequence: Synthetic oligonucleotide
  Target: ATXN1; (-) strand; PAM type: NNGRRT; PAM sequence: CTGGAT
cctctctggtggtttctggc

SEQ ID NO: 12308 - DNA, 20 bp, Artificial Sequence
  Description of Artificial Sequence: Synthetic oligonucleotide
  Target: ATXN1; (-) strand; PAM type: NNGRRT; PAM sequence: AGGGGT
agagcaagatcccatgtccc

SEQ ID NO: 12309 - DNA, 20 bp, Artificial Sequence
  Description of Artificial Sequence: Synthetic oligonucleotide
  Target: ATXN1; (-) strand; PAM type: NNGRRT; PAM sequence: TTGGAT
tcgtgtggactccttctagc

SEQ ID NO: 12310 - DNA, 20 bp, Artificial Sequence
  Description of Artificial Sequence: Synthetic oligonucleotide
  Target: ATXN1; (-) strand; PAM type: NNGRRT; PAM sequence: AGGGAT
tctgagtgggcataactttt

SEQ ID NO: 12311 - DNA, 20 bp, Artificial Sequence
  Description of Artificial Sequence: Synthetic oligonucleotide
  Target: ATXN1; (-) strand; PAM type: NNGRRT; PAM sequence: CTGAGT
aataaagccattcccaggtt

SEQ ID NO: 12312 - DNA, 20 bp, Artificial Sequence
  Description of Artificial Sequence: Synthetic oligonucleotide
  Target: ATXN1; (-) strand; PAM type: NNGRRT; PAM sequence: CTGGAT
tctttgaattgagggcccac

SEQ ID NO: 12313 - DNA, 20 bp, Artificial Sequence
  Description of Artificial Sequence: Synthetic oligonucleotide
  Target: ATXN1; (-) strand; PAM type: NNGRRT; PAM sequence: TTGAAT
tcttataaggacatttgtct

SEQ ID NO: 12314 - DNA, 20 bp, Artificial Sequence
  Description of Artificial Sequence: Synthetic oligonucleotide
  Target: ATXN1; (-) strand; PAM type: NNGRRT; PAM sequence: TCGGGT
tcttgctgcttctagtagct

SEQ ID NO: 12315 - DNA, 20 bp, Artificial Sequence
  Description of Artificial Sequence: Synthetic oligonucleotide
  Target: ATXN1; (-) strand; PAM type: NNGRRT; PAM sequence: GGGGAT
tgttcccttcataggctcta

SEQ ID NO: 12316 - DNA, 20 bp, Artificial Sequence
  Description of Artificial Sequence: Synthetic oligonucleotide
  Target: ATXN1; (-) strand; PAM type: NNGRRT; PAM sequence: TTGGAT
aatcaataaatggaagatat

SEQ ID NO: 12317 - DNA, 20 bp, Artificial Sequence
  Description of Artificial Sequence: Synthetic oligonucleotide
  Target: ATXN1; (-) strand; PAM type: NNGRRT; PAM sequence: AAGAGT
aacctcacaaatttgttatg

SEQ ID NO: 12318 - DNA, 20 bp, Artificial Sequence
  Description of Artificial Sequence: Synthetic oligonucleotide
  Target: ATXN1; (-) strand; PAM type: NNGRRT; PAM sequence: TTGGGT
gagtgtaacccgcatcatgg

SEQ ID NO: 12319 - DNA, 20 bp, Artificial Sequence
  Description of Artificial Sequence: Synthetic oligonucleotide
  Target: ATXN1; (-) strand; PAM type: NNGRRT; PAM sequence: GTGAGT
gccatcgccatagccaggag

SEQ ID NO: 12320 - DNA, 20 bp, Artificial Sequence
  Description of Artificial Sequence: Synthetic oligonucleotide
  Target: ATXN1; (-) strand; PAM type: NNGRRT; PAM sequence: GTGGGT
atggcctggatcacaattgg

SEQ ID NO: 12321 - DNA, 20 bp, Artificial Sequence
  Description of Artificial Sequence: Synthetic oligonucleotide
  Target: ATXN1; (-) strand; PAM type: NNGRRT; PAM sequence: TTGGGT
tcctatggcctggatcacaa

SEQ ID NO: 12322 - DNA, 20 bp, Artificial Sequence
  Description of Artificial Sequence: Synthetic oligonucleotide
  Target: ATXN1; (-) strand; PAM type: NNGRRT; PAM sequence: CTGGAT
agtctcaccactcctatggc

SEQ ID NO: 12323 - DNA, 20 bp, Artificial Sequence
  Description of Artificial Sequence: Synthetic oligonucleotide
  Target: ATXN1; (-) strand; PAM type: NNGRRT; PAM sequence: TGGGGT
ccaaaaagtctatagatgca

SEQ ID NO: 12324 - DNA, 20 bp, Artificial Sequence
  Description of Artificial Sequence: Synthetic oligonucleotide
  Target: ATXN1; (-) strand; PAM type: NNGRRT; PAM sequence: GTGGAT
gaatgagactattattttgg

SEQ ID NO: 12325 - DNA, 20 bp, Artificial Sequence
  Description of Artificial Sequence: Synthetic oligonucleotide
  Target: ATXN1; (-) strand; PAM type: NNGRRT; PAM sequence: TTGGGT
acccgaatgagactattatt

SEQ ID NO: 12326 - DNA, 20 bp, Artificial Sequence
  Description of Artificial Sequence: Synthetic oligonucleotide
  Target: ATXN1; (-) strand; PAM type: NNGRRT; PAM sequence: CCGAAT
ctacccaagccagcgaccac

SEQ ID NO: 12327 - DNA, 20 bp, Artificial Sequence
  Description of Artificial Sequence: Synthetic oligonucleotide
  Target: ATXN1; (-) strand; PAM type: NNGRRT; PAM sequence: AGGAAT
cagtgcagctgtgtgtcttg

SEQ ID NO: 12328 - DNA, 20 bp, Artificial Sequence
  Description of Artificial Sequence: Synthetic oligonucleotide
  Target: ATXN1; (-) strand; PAM type: NNGRRT; PAM sequence: CAGAAT
tgccaagcagacaagttcag

SEQ ID NO: 12329 - DNA, 20 bp, Artificial Sequence
  Description of Artificial Sequence: Synthetic oligonucleotide
  Target: ATXN1; (-) strand; PAM type: NNGRRT; PAM sequence: AGGGAT
caaatcactcagccccactt

SEQ ID NO: 12330 - DNA, 20 bp, Artificial Sequence
  Description of Artificial Sequence: Synthetic oligonucleotide
  Target: ATXN1; (-) strand; PAM type: NNGRRT; PAM sequence: AAGAAT
atggcagaagccaggaatct

SEQ ID NO: 12331 - DNA, 20 bp, Artificial Sequence
  Description of Artificial Sequence: Synthetic oligonucleotide
  Target: ATXN1; (-) strand; PAM type: NNGRRT; PAM sequence: AGGAAT
gaatagcaatggcagaagcc

SEQ ID NO: 12332 - DNA, 20 bp, Artificial Sequence
  Description of Artificial Sequence: Synthetic oligonucleotide
  Target: ATXN1; (-) strand; PAM type: NNGRRT; PAM sequence: ACGAAT
agaactgtcatctgctcact

SEQ ID NO: 12333 - DNA, 20 bp, Artificial Sequence
  Description of Artificial Sequence: Synthetic oligonucleotide
  Target: ATXN1; (-) strand; PAM type: NNGRRT; PAM sequence: AGGGGT
gccgatgtcctgatgtttcc

SEQ ID NO: 12334 - DNA, 20 bp, Artificial Sequence
  Description of Artificial Sequence: Synthetic oligonucleotide
  Target: ATXN1; (-) strand; PAM type: NNGRRT; PAM sequence: AGGGAT
ttccatgtgagccggcttct

SEQ ID NO: 12335 - DNA, 20 bp, Artificial Sequence
  Description of Artificial Sequence: Synthetic oligonucleotide
  Target: ATXN1; (-) strand; PAM type: NNGRRT; PAM sequence: AGGAAT
tttccatcttgagcctttcc

SEQ ID NO: 12336 - DNA, 20 bp, Artificial Sequence
  Description of Artificial Sequence: Synthetic oligonucleotide
  Target: ATXN1; (-) strand; PAM type: NNGRRT; PAM sequence: TTGGAT
acaattcatttgggaccagc

SEQ ID NO: 12337 - DNA, 20 bp, Artificial Sequence
  Description of Artificial Sequence: Synthetic oligonucleotide
  Target: ATXN1; (-) strand; PAM type: NNGRRT; PAM sequence: TTGAAT
aaaaagtatttgcttctgta

SEQ ID NO: 12338 - DNA, 20 bp, Artificial Sequence
  Description of Artificial Sequence: Synthetic oligonucleotide
  Target: ATXN1; (-) strand; PAM type: NNGRRT; PAM sequence: TGGAAT
gtgcccccgggtagctaacc

SEQ ID NO: 12339 - DNA, 20 bp, Artificial Sequence
  Description of Artificial Sequence: Synthetic oligonucleotide
  Target: ATXN1; (-) strand; PAM type: NNGRRT; PAM sequence: CCGGGT
aaacagaaacgtgggtgccc

SEQ ID NO: 12340 - DNA, 20 bp, Artificial Sequence
  Description of Artificial Sequence: Synthetic oligonucleotide
  Target: ATXN1; (-) strand; PAM type: NNGRRT; PAM sequence: GTGGGT
agtggtggataaacagaaac

SEQ ID NO: 12341 - DNA, 20 bp, Artificial Sequence
  Description of Artificial Sequence: Synthetic oligonucleotide
  Target: ATXN1; (-) strand; PAM type: NNGRRT; PAM sequence: GTGGAT
cccagccttcaaccagagtg

SEQ ID NO: 12342 - DNA, 20 bp, Artificial Sequence
  Description of Artificial Sequence: Synthetic oligonucleotide
  Target: ATXN1; (-) strand; PAM type: NNGRRT; PAM sequence: CAGAGT
aactgttcccagccttcaac

SEQ ID NO: 12343 - DNA, 20 bp, Artificial Sequence
  Description of Artificial Sequence: Synthetic oligonucleotide
  Target: ATXN1; (-) strand; PAM type: NNGRRT; PAM sequence: TGGGAT
tgaaacaagttagtctggac

SEQ ID NO: 12344 - DNA, 20 bp, Artificial Sequence
  Description of Artificial Sequence: Synthetic oligonucleotide
  Target: ATXN1; (-) strand; PAM type: NNGRRT; PAM sequence: GAGAGT
gtggtaagaaacattcaagt

SEQ ID NO: 12345 - DNA, 20 bp, Artificial Sequence
  Description of Artificial Sequence: Synthetic oligonucleotide
  Target: ATXN1; (-) strand; PAM type: NNGRRT; PAM sequence: TCGGGT
ggatgtgaatgcttcatgca

SEQ ID NO: 12346 - DNA, 20 bp, Artificial Sequence
  Description of Artificial Sequence: Synthetic oligonucleotide
  Target: ATXN1; (-) strand; PAM type: NNGRRT; PAM sequence: GTGAAT
ttctaaataggacagtggat

SEQ ID NO: 12347 - DNA, 20 bp, Artificial Sequence
  Description of Artificial Sequence: Synthetic oligonucleotide
  Target: ATXN1; (-) strand; PAM type: NNGRRT; PAM sequence: GTGGAT
ttgatattctaaataggaca

SEQ ID NO: 12348 - DNA, 20 bp, Artificial Sequence
  Description of Artificial Sequence: Synthetic oligonucleotide
  Target: ATXN1; (-) strand; PAM type: NNGRRT; PAM sequence: TGGAAT
gtccttagtagtaatagcag

SEQ ID NO: 12349 - DNA, 20 bp, Artificial Sequence
  Description of Artificial Sequence: Synthetic oligonucleotide
  Target: ATXN1; (-) strand; PAM type: NNGRRT; PAM sequence: TGGGGT
aatggataacataggtggtt

SEQ ID NO: 12350 - DNA, 20 bp, Artificial Sequence
  Description of Artificial Sequence: Synthetic oligonucleotide
  Target: ATXN1; (-) strand; PAM type: NNGRRT; PAM sequence: ATGGAT
ccaaaattatatttttaaaa

SEQ ID NO: 12351 - DNA, 20 bp, Artificial Sequence
  Description of Artificial Sequence: Synthetic oligonucleotide
  Target: ATXN1; (-) strand; PAM type: NNGRRT; PAM sequence: CTGGGT
cgcctcagcctcctaaagtg

SEQ ID NO: 12352 - DNA, 20 bp, Artificial Sequence
  Description of Artificial Sequence: Synthetic oligonucleotide
  Target: ATXN1; (-) strand; PAM type: NNGRRT; PAM sequence: CAGGAT
caggatttcactgtgttatc

SEQ ID NO: 12353 - DNA, 20 bp, Artificial Sequence
  Description of Artificial Sequence: Synthetic oligonucleotide
  Target: ATXN1; (-) strand; PAM type: NNGRRT; PAM sequence: CAGGAT
ttttgtatttttagtagaga

SEQ ID NO: 12354 - DNA, 20 bp, Artificial Sequence
  Description of Artificial Sequence: Synthetic oligonucleotide
  Target: ATXN1; (-) strand; PAM type: NNGRRT; PAM sequence: CTGGGT
ctcactgcaacctccgcctc

SEQ ID NO: 12355 - DNA, 20 bp, Artificial Sequence
  Description of Artificial Sequence: Synthetic oligonucleotide
  Target: ATXN1; (-) strand; PAM type: NNGRRT; PAM sequence: TGGAGT
tctcgctctgtcgcccaggc

SEQ ID NO: 12356 - DNA, 20 bp, Artificial Sequence
  Description of Artificial Sequence: Synthetic oligonucleotide
  Target: ATXN1; (-) strand; PAM type: NNGRRT; PAM sequence: TGGAGT
ttaaaattattattttgaga

SEQ ID NO: 12357 - DNA, 20 bp, Artificial Sequence
  Description of Artificial Sequence: Synthetic oligonucleotide
  Target: ATXN1; (-) strand; PAM type: NNGRRT; PAM sequence: CTGAGT
actacgatggcgaccatgta

SEQ ID NO: 12358 - DNA, 20 bp, Artificial Sequence
  Description of Artificial Sequence: Synthetic oligonucleotide
  Target: ATXN1; (-) strand; PAM type: NNGRRT; PAM sequence: TTGAAT
aattcatgaggaaatgttta

SEQ ID NO: 12359 - DNA, 20 bp, Artificial Sequence
  Description of Artificial Sequence: Synthetic oligonucleotide
  Target: ATXN1; (-) strand; PAM type: NNGRRT; PAM sequence: GAGAAT
gataagtgtgggtgatcact

SEQ ID NO: 12360 - DNA, 20 bp, Artificial Sequence
  Description of Artificial Sequence: Synthetic oligonucleotide
  Target: ATXN1; (-) strand; PAM type: NNGRRT; PAM sequence: GTGGGT
gagatgagcaacagataagt

SEQ ID NO: 12361 - DNA, 20 bp, Artificial Sequence
  Description of Artificial Sequence: Synthetic oligonucleotide
  Target: ATXN1; (-) strand; PAM type: NNGRRT; PAM sequence: AAGAAT
aggaaaaaacagatgtttga

SEQ ID NO: 12362 - DNA, 20 bp, Artificial Sequence
  Description of Artificial Sequence: Synthetic oligonucleotide
  Target: ATXN1; (-) strand; PAM type: NNGRRT; PAM sequence: AGGGGT
tccttcttgttggtgtgcat

SEQ ID NO: 12363 - DNA, 20 bp, Artificial Sequence
  Description of Artificial Sequence: Synthetic oligonucleotide
  Target: ATXN1; (-) strand; PAM type: NNGRRT; PAM sequence: CTGAAT
ctgtttattctgcttgtgtg

SEQ ID NO: 12364 - DNA, 20 bp, Artificial Sequence
  Description of Artificial Sequence: Synthetic oligonucleotide
  Target: ATXN1; (-) strand; PAM type: NNGRRT; PAM sequence: TTGAGT
cttccctggaaatgccatcc

SEQ ID NO: 12365 - DNA, 20 bp, Artificial Sequence
  Description of Artificial Sequence: Synthetic oligonucleotide
  Target: ATXN1; (-) strand; PAM type: NNGRRT; PAM sequence: CAGAGT
aagtattgtggaaaagcagg

SEQ ID NO: 12366 - DNA, 20 bp, Artificial Sequence
  Description of Artificial Sequence: Synthetic oligonucleotide
  Target: ATXN1; (-) strand; PAM type: NNGRRT; PAM sequence: GGGAAT
atttccccaccatgcgtctt

SEQ ID NO: 12367 - DNA, 20 bp, Artificial Sequence
  Description of Artificial Sequence: Synthetic oligonucleotide
  Target: ATXN1; (-) strand; PAM type: NNGRRT; PAM sequence: GAGGAT
ttccctgcgggatgtggaag

SEQ ID NO: 12368 - DNA, 20 bp, Artificial Sequence
  Description of Artificial Sequence: Synthetic oligonucleotide
  Target: ATXN1; (-) strand; PAM type: NNGRRT; PAM sequence: CGGGAT
acagctggcagccttccctg

SEQ ID NO: 12369 - DNA, 20 bp, Artificial Sequence
  Description of Artificial Sequence: Synthetic oligonucleotide
  Target: ATXN1; (-) strand; PAM type: NNGRRT; PAM sequence: GCGGGT
tgaagctcgtgagtgtgtgt

SEQ ID NO: 12370 - DNA, 20 bp, Artificial Sequence
  Description of Artificial Sequence: Synthetic oligonucleotide
  Target: ATXN1; (-) strand; PAM type: NNGRRT; PAM sequence: GTGAGT
cgtgttgtgtggtgaagctc

SEQ ID NO: 12371 - DNA, 20 bp, Artificial Sequence
  Description of Artificial Sequence: Synthetic oligonucleotide
  Target: ATXN1; (-) strand; PAM type: NNGRRT; PAM sequence: CAGGAT
cccagccccctggtggctgg

SEQ ID NO: 12372 - DNA, 20 bp, Artificial Sequence
  Description of Artificial Sequence: Synthetic oligonucleotide
  Target: ATXN1; (-) strand; PAM type: NNGRRT; PAM sequence: GAGAGT
acctttttcctgacttgatg

SEQ ID NO: 12373 - DNA, 20 bp, Artificial Sequence
  Description of Artificial Sequence: Synthetic oligonucleotide
  Target: ATXN1; (-) strand; PAM type: NNGRRT; PAM sequence: CAGAGT
gaatagttttaagactctcc

SEQ ID NO: 12374 - DNA, 20 bp, Artificial Sequence
  Description of Artificial Sequence: Synthetic oligonucleotide
  Target: ATXN1; (-) strand; PAM type: NNGRRT; PAM sequence: GTGAAT
attcagccacaccaaggaca

SEQ ID NO: 12375 - DNA, 20 bp, Artificial Sequence
  Description of Artificial Sequence: Synthetic oligonucleotide
  Target: ATXN1; (-) strand; PAM type: NNGRRT; PAM sequence: ATGAAT
gaggaacagctggttagttt

SEQ ID NO: 12376 - DNA, 20 bp, Artificial Sequence
  Description of Artificial Sequence: Synthetic oligonucleotide
  Target: ATXN1; (-) strand; PAM type: NNGRRT; PAM sequence: TTGAAT
ggtctttgcagttgagagca

SEQ ID NO: 12377 - DNA, 20 bp, Artificial Sequence
  Description of Artificial Sequence: Synthetic oligonucleotide
  Target: ATXN1; (-) strand; PAM type: NNGRRT; PAM sequence: TGGGGT
gcctgggtcccgggaggtct

SEQ ID NO: 12378 - DNA, 20 bp, Artificial Sequence
  Description of Artificial Sequence: Synthetic oligonucleotide
  Target: ATXN1; (-) strand; PAM type: NNGRRT; PAM sequence: CTGGGT
cctgctgtgccttagagagc

SEQ ID NO: 12379 - DNA, 20 bp, Artificial Sequence
  Description of Artificial Sequence: Synthetic oligonucleotide
  Target: ATXN1; (-) strand; PAM type: NNGRRT; PAM sequence: TGGGGT
caatgtccttgtctttgaaa

SEQ ID NO: 12380 - DNA, 20 bp, Artificial Sequence
  Description of Artificial Sequence: Synthetic oligonucleotide
  Target: ATXN1; (-) strand; PAM type: NNGRRT; PAM sequence: TAGGAT
tagatcccaagttttcatat

SEQ ID NO: 12381 - DNA, 20 bp, Artificial Sequence
  Description of Artificial Sequence: Synthetic oligonucleotide
  Target: ATXN1; (-) strand; PAM type: NNGRRT; PAM sequence: CAGAGT
actgcactacagcatggtga

SEQ ID NO: 12382 - DNA, 20 bp, Artificial Sequence
  Description of Artificial Sequence: Synthetic oligonucleotide
  Target: ATXN1; (-) strand; PAM type: NNGRRT; PAM sequence: GAGAAT
ttcttggaaggctgaggcag

SEQ ID NO: 12383 - DNA, 20 bp, Artificial Sequence
  Description of Artificial Sequence: Synthetic oligonucleotide
  Target: ATXN1; (-) strand; PAM type: NNGRRT; PAM sequence: TTGGGT
ggcaaaggccagacctgagt

SEQ ID NO: 12384 - DNA, 20 bp, Artificial Sequence
  Description of Artificial Sequence: Synthetic oligonucleotide
  Target: ATXN1; (-) strand; PAM type: NNGRRT; PAM sequence: CTGAGT
ggtgggggcaaaggccagac

SEQ ID NO: 12385 - DNA, 20 bp, Artificial Sequence
  Description of Artificial Sequence: Synthetic oligonucleotide
  Target: ATXN1; (-) strand; PAM type: NNGRRT; PAM sequence: TAGAGT
ctcacgcgaacctcagcatc

SEQ ID NO: 12386 - DNA, 20 bp, Artificial Sequence
  Description of Artificial Sequence: Synthetic oligonucleotide
  Target: ATXN1; (-) strand; PAM type: NNGRRT; PAM sequence: AAGAAT
ctcctcccagccatgatgtg

SEQ ID NO: 12387 - DNA, 20 bp, Artificial Sequence
  Description of Artificial Sequence: Synthetic oligonucleotide
  Target: ATXN1; (-) strand; PAM type: NNGRRT; PAM sequence: AGGGGT
ggcatataggagaggtctag

SEQ ID NO: 12388 - DNA, 20 bp, Artificial Sequence
  Description of Artificial Sequence: Synthetic oligonucleotide
  Target: ATXN1; (-) strand; PAM type: NNGRRT; PAM sequence: CAGGGT
ggatacaagttaaacttagc

SEQ ID NO: 12389 - DNA, 20 bp, Artificial Sequence
  Description of Artificial Sequence: Synthetic oligonucleotide
  Target: ATXN1; (-) strand; PAM type: NNGRRT; PAM sequence: AAGGAT
actcatacttattacaggga

SEQ ID NO: 12390 - DNA, 20 bp, Artificial Sequence
  Description of Artificial Sequence: Synthetic oligonucleotide
  Target: ATXN1; (-) strand; PAM type: NNGRRT; PAM sequence: GGGGGT
caccacgaattgcaagttca

SEQ ID NO: 12391 - DNA, 20 bp, Artificial Sequence
  Description of Artificial Sequence: Synthetic oligonucleotide
  Target: ATXN1; (-) strand; PAM type: NNGRRT; PAM sequence: ACGAAT
gagagagcagtgcctgcacc

SEQ ID NO: 12392 - DNA, 20 bp, Artificial Sequence
  Description of Artificial Sequence: Synthetic oligonucleotide
  Target: ATXN1; (-) strand; PAM type: NNGRRT; PAM sequence: ATGGAT
attcttatcactgaacgctg

SEQ ID NO: 12393 - DNA, 20 bp, Artificial Sequence
  Description of Artificial Sequence: Synthetic oligonucleotide
  Target: ATXN1; (-) strand; PAM type: NNGRRT; PAM sequence: TGGGGT
cctgttccctggccacagtt

SEQ ID NO: 12394 - DNA, 20 bp, Artificial Sequence
  Description of Artificial Sequence: Synthetic oligonucleotide
  Target: ATXN1; (-) strand; PAM type: NNGRRT; PAM sequence: CTGAGT
ttggccctggtgacattaca

SEQ ID NO: 12395 - DNA, 20 bp, Artificial Sequence
  Description of Artificial Sequence: Synthetic oligonucleotide
  Target: ATXN1; (-) strand; PAM type: NNGRRT; PAM sequence: GAGGAT
tcaatttcactcagtgggct

SEQ ID NO: 12396 - DNA, 20 bp, Artificial Sequence
  Description of Artificial Sequence: Synthetic oligonucleotide
  Target: ATXN1; (-) strand; PAM type: NNGRRT; PAM sequence: TGGGAT
aactcctccatttggtctgt

SEQ ID NO: 12397 - DNA, 20 bp, Artificial Sequence
  Description of Artificial Sequence: Synthetic oligonucleotide
  Target: ATXN1; (-) strand; PAM type: NNGRRT; PAM sequence: AAGGGT
ggccctagtactaaggctgc

SEQ ID NO: 12398 - DNA, 20 bp, Artificial Sequence
  Description of Artificial Sequence: Synthetic oligonucleotide
  Target: ATXN1; (-) strand; PAM type: NNGRRT; PAM sequence: GAGAGT
atttcttattctgcaggtga

SEQ ID NO: 12399 - DNA, 20 bp, Artificial Sequence
  Description of Artificial Sequence: Synthetic oligonucleotide
  Target: ATXN1; (-) strand; PAM type: NNGRRT; PAM sequence: GTGAGT
tgtttttaaaagctccctgg

SEQ ID NO: 12400 - DNA, 20 bp, Artificial Sequence
  Description of Artificial Sequence: Synthetic oligonucleotide
  Target: ATXN1; (-) strand; PAM type: NNGRRT; PAM sequence: CTGGGT
attatgtttttaaaagctcc

SEQ ID NO: 12401 - DNA, 20 bp, Artificial Sequence
  Description of Artificial Sequence: Synthetic oligonucleotide
  Target: ATXN1; (-) strand; PAM type: NNGRRT; PAM sequence: TGGGGT
ggattcttattcagttggtc

SEQ ID NO: 12402 - DNA, 20 bp, Artificial Sequence
  Description of Artificial Sequence: Synthetic oligonucleotide
  Target: ATXN1; (-) strand; PAM type: NNGRRT; PAM sequence: AGGGAT
cagtggtggtcccaacatct

SEQ ID NO: 12403 - DNA, 20 bp, Artificial Sequence
  Description of Artificial Sequence: Synthetic oligonucleotide
  Target: ATXN1; (-) strand; PAM type: NNGRRT; PAM sequence: TAGAAT
tctcacctctggctgcaaat

SEQ ID NO: 12404 - DNA, 20 bp, Artificial Sequence
  Description of Artificial Sequence: Synthetic oligonucleotide
  Target: ATXN1; (-) strand; PAM type: NNGRRT; PAM sequence: GAGAAT
cactcgggaggctgaggcag

SEQ ID NO: 12405 - DNA, 20 bp, Artificial Sequence
  Description of Artificial Sequence: Synthetic oligonucleotide
  Target: ATXN1; (-) strand; PAM type: NNGRRT; PAM sequence: GTGGGT
aaaattagccaggcgtggtg

SEQ ID NO: 12406 - DNA, 20 bp, Artificial Sequence
  Description of Artificial Sequence: Synthetic oligonucleotide
  Target: ATXN1; (-) strand; PAM type: NNGRRT; PAM sequence: CCGGGT
ttaaagatcctctataccag

SEQ ID NO: 12407 - DNA, 20 bp, Artificial Sequence
  Description of Artificial Sequence: Synthetic oligonucleotide
  Target: ATXN1; (-) strand; PAM type: NNGRRT; PAM sequence: TGGAGT
gacatactgccaaggacaga

SEQ ID NO: 12408 - DNA, 20 bp, Artificial Sequence
  Description of Artificial Sequence: Synthetic oligonucleotide
  Target: ATXN1; (-) strand; PAM type: NNGRRT; PAM sequence: CTGGGT
tgcacccattgcacaccagc

SEQ ID NO: 12409 - DNA, 20 bp, Artificial Sequence
  Description of Artificial Sequence: Synthetic oligonucleotide
  Target: ATXN1; (-) strand; PAM type: NNGRRT; PAM sequence: GAGAAT
tacttgggaggctgaggcag

SEQ ID NO: 12410 - DNA, 20 bp, Artificial Sequence
  Description of Artificial Sequence: Synthetic oligonucleotide
  Target: ATXN1; (-) strand; PAM type: NNGRRT; PAM sequence: AGGAGT
gtaggtggatcgctcaggtc

SEQ ID NO: 12411 - DNA, 20 bp, Artificial Sequence
  Description of Artificial Sequence: Synthetic oligonucleotide
  Target: ATXN1; (-) strand; PAM type: NNGRRT; PAM sequence: GTGGAT
acgttgggaggccaaggtag

SEQ ID NO: 12412 - DNA, 20 bp, Artificial Sequence
  Description of Artificial Sequence: Synthetic oligonucleotide
  Target: ATXN1; (-) strand; PAM type: NNGRRT; PAM sequence: AAGGAT
tgtgttggcaaagtggggaa

SEQ ID NO: 12413 - DNA, 20 bp, Artificial Sequence
  Description of Artificial Sequence: Synthetic oligonucleotide
  Target: ATXN1; (-) strand; PAM type: NNGRRT; PAM sequence: ATGAGT
agaatataatgtccatctta

SEQ ID NO: 12414 - DNA, 20 bp, Artificial Sequence
  Description of Artificial Sequence: Synthetic oligonucleotide
  Target: ATXN1; (-) strand; PAM type: NNGRRT; PAM sequence: AAGAAT
ttgtttttttttttaaaaaa

SEQ ID NO: 12415 - DNA, 20 bp, Artificial Sequence
  Description of Artificial Sequence: Synthetic oligonucleotide
  Target: ATXN1; (-) strand; PAM type: NNGRRT; PAM sequence: CTGAGT
gatatccagacgtggaattg

SEQ ID NO: 12416 - DNA, 20 bp, Artificial Sequence
  Description of Artificial Sequence: Synthetic oligonucleotide
  Target: ATXN1; (-) strand; PAM type: NNGRRT; PAM sequence: TGGAAT
ttgtggtagatatccagacg

SEQ ID NO: 12417 - DNA, 20 bp, Artificial Sequence
  Description of Artificial Sequence: Synthetic oligonucleotide
  Target: ATXN1; (-) strand; PAM type: NNGRRT; PAM sequence: CTGAGT
tgaacacgggtgtggaatat

SEQ ID NO: 12418 - DNA, 20 bp, Artificial Sequence
  Description of Artificial Sequence: Synthetic oligonucleotide
  Target: ATXN1; (-) strand; PAM type: NNGRRT; PAM sequence: TGGAAT
tgctgctatgaacacgggtg

SEQ ID NO: 12419 - DNA, 20 bp, Artificial Sequence
  Description of Artificial Sequence: Synthetic oligonucleotide
  Target: ATXN1; (-) strand; PAM type: NNGRRT; PAM sequence: ACGGGT
tgcacaatgctgctatgaac

SEQ ID NO: 12420 - DNA, 20 bp, Artificial Sequence
  Description of Artificial Sequence: Synthetic oligonucleotide
  Target: ATXN1; (-) strand; PAM type: NNGRRT; PAM sequence: TTGGGT
tattcatctgttgatgatca

SEQ ID NO: 12421 - DNA, 20 bp, Artificial Sequence
  Description of Artificial Sequence: Synthetic oligonucleotide
  Target: ATXN1; (-) strand; PAM type: NNGRRT; PAM sequence: AAGGAT
gatgaataatagctcgtcat

SEQ ID NO: 12422 - DNA, 20 bp, Artificial Sequence
  Description of Artificial Sequence: Synthetic oligonucleotide
  Target: ATXN1; (-) strand; PAM type: NNGRRT; PAM sequence: ATGAAT
tcctttgtaaggagaggggg

SEQ ID NO: 12423 - DNA, 20 bp, Artificial Sequence
  Description of Artificial Sequence: Synthetic oligonucleotide
  Target: ATXN1; (-) strand; PAM type: NNGRRT; PAM sequence: GGGGAT
tcattcctttgtaaggagag

SEQ ID NO: 12424 - DNA, 20 bp, Artificial Sequence
  Description of Artificial Sequence: Synthetic oligonucleotide
  Target: ATXN1; (-) strand; PAM type: NNGRRT; PAM sequence: CAGAAT
atcaatgtcatagcatgtaa

SEQ ID NO: 12425 - DNA, 20 bp, Artificial Sequence
  Description of Artificial Sequence: Synthetic oligonucleotide
  Target: ATXN1; (-) strand; PAM type: NNGRRT; PAM sequence: GGGAAT
ttctagattcctcatagaag

SEQ ID NO: 12426 - DNA, 20 bp, Artificial Sequence
  Description of Artificial Sequence: Synthetic oligonucleotide
  Target: ATXN1; (-) strand; PAM type: NNGRRT; PAM sequence: CAGAAT
ccatcaccaccatctgtctc

SEQ ID NO: 12427 - DNA, 20 bp, Artificial Sequence
  Description of Artificial Sequence: Synthetic oligonucleotide
  Target: ATXN1; (-) strand; PAM type: NNGRRT; PAM sequence: TGGGAT
gcctcagcctcccaaagtgc

SEQ ID NO: 12428 - DNA, 20 bp, Artificial Sequence
  Description of Artificial Sequence: Synthetic oligonucleotide
  Target: ATXN1; (-) strand; PAM type: NNGRRT; PAM sequence: CAGGAT
cagggtttcaccgtgttagc

SEQ ID NO: 12429 - DNA, 20 bp, Artificial Sequence
  Description of Artificial Sequence: Synthetic oligonucleotide
  Target: ATXN1; (-) strand; PAM type: NNGRRT; PAM sequence: CAGGGT
tttctattttttagtagaga

SEQ ID NO: 12430 - DNA, 20 bp, Artificial Sequence
  Description of Artificial Sequence: Synthetic oligonucleotide
  Target: ATXN1; (-) strand; PAM type: NNGRRT; PAM sequence: TCGAGT
cattctcctgtctcagcctc

SEQ ID NO: 12431 - DNA, 20 bp, Artificial Sequence
  Description of Artificial Sequence: Synthetic oligonucleotide
  Target: ATXN1; (-) strand; PAM type: NNGRRT; PAM sequence: TGGAGT
tctcgctctgtcacccaggc

SEQ ID NO: 12432 - DNA, 20 bp, Artificial Sequence
  Description of Artificial Sequence: Synthetic oligonucleotide
  Target: ATXN1; (-) strand; PAM type: NNGRRT; PAM sequence: CAGAGT
atttatttatttatttgaga

SEQ ID NO: 12433 - DNA, 20 bp, Artificial Sequence
  Description of Artificial Sequence: Synthetic oligonucleotide
  Target: ATXN1; (-) strand; PAM type: NNGRRT; PAM sequence: TGGAAT
gatgccctgacgtccagtcc

SEQ ID NO: 12434 - DNA, 20 bp, Artificial Sequence
  Description of Artificial Sequence: Synthetic oligonucleotide
  Target: ATXN1; (-) strand; PAM type: NNGRRT; PAM sequence: AAGGAT
catacagctttaagggctta

SEQ ID NO: 12435 - DNA, 20 bp, Artificial Sequence
  Description of Artificial Sequence: Synthetic oligonucleotide
  Target: ATXN1; (-) strand; PAM type: NNGRRT; PAM sequence: GCGGAT
tacagctcacagtccccttt

SEQ ID NO: 12436 - DNA, 20 bp, Artificial Sequence
  Description of Artificial Sequence: Synthetic oligonucleotide
  Target: ATXN1; (-) strand; PAM type: NNGRRT; PAM sequence: AGGGAT
tcaggggagaagaggcatac

SEQ ID NO: 12437 - DNA, 20 bp, Artificial Sequence
  Description of Artificial Sequence: Synthetic oligonucleotide
  Target: ATXN1; (-) strand; PAM type: NNGRRT; PAM sequence: CAGAAT
gaactgacataacctgatga

SEQ ID NO: 12438 - DNA, 20 bp, Artificial Sequence
  Description of Artificial Sequence: Synthetic oligonucleotide
  Target: ATXN1; (-) strand; PAM type: NNGRRT; PAM sequence: GAGGGT
gttttccagtccctgattca

SEQ ID NO: 12439 - DNA, 20 bp, Artificial Sequence
  Description of Artificial Sequence: Synthetic oligonucleotide
  Target: ATXN1; (-) strand; PAM type: NNGRRT; PAM sequence: CTGAGT
ttcagcctgcagaggtagag

SEQ ID NO: 12440 - DNA, 20 bp, Artificial Sequence
  Description of Artificial Sequence: Synthetic oligonucleotide
  Target: ATXN1; (-) strand; PAM type: NNGRRT; PAM sequence: TCGAGT
ggtgaatgtgatgcgcacgc

SEQ ID NO: 12441 - DNA, 20 bp, Artificial Sequence
  Description of Artificial Sequence: Synthetic oligonucleotide
  Target: ATXN1; (-) strand; PAM type: NNGRRT; PAM sequence: GTGAAT
gcagcatctgggaactccgg

SEQ ID NO: 12442 - DNA, 20 bp, Artificial Sequence
  Description of Artificial Sequence: Synthetic oligonucleotide
  Target: ATXN1; (-) strand; PAM type: NNGRRT; PAM sequence: CCGGGT
atcagcagcatctgggaact

SEQ ID NO: 12443 - DNA, 20 bp, Artificial Sequence
  Description of Artificial Sequence: Synthetic oligonucleotide
  Target: ATXN1; (-) strand; PAM type: NNGRRT; PAM sequence: ATGGGT
tggaaggagagacctgaaag

SEQ ID NO: 12444 - DNA, 20 bp, Artificial Sequence
  Description of Artificial Sequence: Synthetic oligonucleotide
  Target: ATXN1; (-) strand; PAM type: NNGRRT; PAM sequence: TGGAGT
agaggcagagggtatggggt

SEQ ID NO: 12445 - DNA, 20 bp, Artificial Sequence
  Description of Artificial Sequence: Synthetic oligonucleotide
  Target: ATXN1; (-) strand; PAM type: NNGRRT; PAM sequence: TGGGGT
cagaggagaggcagagggta

SEQ ID NO: 12446 - DNA, 20 bp, Artificial Sequence
  Description of Artificial Sequence: Synthetic oligonucleotide
  Target: ATXN1; (-) strand; PAM type: NNGRRT; PAM sequence: GAGGGT
ggaggcacagaggagaggca

SEQ ID NO: 12447 - DNA, 20 bp, Artificial Sequence
  Description of Artificial Sequence: Synthetic oligonucleotide
  Target: ATXN1; (-) strand; PAM type: NNGRRT; PAM sequence: CAGGGT
tgtggatgagaatgttggag

SEQ ID NO: 12448 - DNA, 20 bp, Artificial Sequence
  Description of Artificial Sequence: Synthetic oligonucleotide
  Target: ATXN1; (-) strand; PAM type: NNGRRT; PAM sequence: GAGAAT
ttcctgaacggtgtgtggat

SEQ ID NO: 12449 - DNA, 20 bp, Artificial Sequence
  Description of Artificial Sequence: Synthetic oligonucleotide
  Target: ATXN1; (-) strand; PAM type: NNGRRT; PAM sequence: GTGGAT
aaacggttcctgaacggtgt

SEQ ID NO: 12450 - DNA, 20 bp, Artificial Sequence
  Description of Artificial Sequence: Synthetic oligonucleotide
  Target: ATXN1; (-) strand; PAM type: NNGRRT; PAM sequence: GAGGAT
ttagactaattggagccttg

SEQ ID NO: 12451 - DNA, 20 bp, Artificial Sequence
  Description of Artificial Sequence: Synthetic oligonucleotide
  Target: ATXN1; (-) strand; PAM type: NNGRRT; PAM sequence: GGGGGT
ccaccatggtgaaggcatgc

SEQ ID NO: 12452 - DNA, 20 bp, Artificial Sequence
  Description of Artificial Sequence: Synthetic oligonucleotide
  Target: ATXN1; (-) strand; PAM type: NNGRRT; PAM sequence: AAGAAT
acaccctcacagacacaacc

SEQ ID NO: 12453 - DNA, 20 bp, Artificial Sequence
  Description of Artificial Sequence: Synthetic oligonucleotide
  Target: ATXN1; (-) strand; PAM type: NNGRRT; PAM sequence: GTGGGT
tgtgcccacccagattgagg

SEQ ID NO: 12454 - DNA, 20 bp, Artificial Sequence
  Description of Artificial Sequence: Synthetic oligonucleotide
  Target: ATXN1; (-) strand; PAM type: NNGRRT; PAM sequence: GAGGGT
agattgtgcccacccagatt

SEQ ID NO: 12455 - DNA, 20 bp, Artificial Sequence
  Description of Artificial Sequence: Synthetic oligonucleotide
  Target: ATXN1; (-) strand; PAM type: NNGRRT; PAM sequence: TCGGGT
aaaagctgaagaacttcaag

SEQ ID NO: 12456 - DNA, 20 bp, Artificial Sequence
  Description of Artificial Sequence: Synthetic oligonucleotide
  Target: ATXN1; (-) strand; PAM type: NNGRRT; PAM sequence: AAGAGT
ccaaccattagtgtaggtcc

SEQ ID NO: 12457 - DNA, 20 bp, Artificial Sequence
  Description of Artificial Sequence: Synthetic oligonucleotide
  Target: ATXN1; (-) strand; PAM type: NNGRRT; PAM sequence: CTGAGT
gaagccagtggttgaccagt

SEQ ID NO: 12458 - DNA, 20 bp, Artificial Sequence
  Description of Artificial Sequence: Synthetic oligonucleotide
  Target: ATXN1; (-) strand; PAM type: NNGRRT; PAM sequence: AGGAAT
atatgaaggggagtttatta

SEQ ID NO: 12459 - DNA, 20 bp, Artificial Sequence
  Description of Artificial Sequence: Synthetic oligonucleotide
  Target: ATXN1; (-) strand; PAM type: NNGRRT; PAM sequence: GGGAGT
ggatagatgtatatatgaag

SEQ ID NO: 12460 - DNA, 20 bp, Artificial Sequence
  Description of Artificial Sequence: Synthetic oligonucleotide
  Target: ATXN1; (-) strand; PAM type: NNGRRT; PAM sequence: TAGGAT
ctctagacagacaggactaa

SEQ ID NO: 12461 - DNA, 20 bp, Artificial Sequence
  Description of Artificial Sequence: Synthetic oligonucleotide
  Target: ATXN1; (-) strand; PAM type: NNGRRT; PAM sequence: CAGGGT
aggggacccactgtattagt

SEQ ID NO: 12462 - DNA, 20 bp, Artificial Sequence
  Description of Artificial Sequence: Synthetic oligonucleotide
  Target: ATXN1; (-) strand; PAM type: NNGRRT; PAM sequence: AGGAAT
agtggctttgctgagagttt

SEQ ID NO: 12463 - DNA, 20 bp, Artificial Sequence
  Description of Artificial Sequence: Synthetic oligonucleotide
  Target: ATXN1; (-) strand; PAM type: NNGRRT; PAM sequence: GAGAGT
cagccggaagtggctttgct

SEQ ID NO: 12464 - DNA, 20 bp, Artificial Sequence
  Description of Artificial Sequence: Synthetic oligonucleotide
  Target: ATXN1; (-) strand; PAM type: NNGRRT; PAM sequence: AAGGAT
tgacgaaaacacgtgaaaac

SEQ ID NO: 12465 - DNA, 20 bp, Artificial Sequence
  Description of Artificial Sequence: Synthetic oligonucleotide
  Target: ATXN1; (-) strand; PAM type: NNGRRT; PAM sequence: CGGAGT
cttcagtctctaagcagcat

SEQ ID NO: 12466 - DNA, 20 bp, Artificial Sequence
  Description of Artificial Sequence: Synthetic oligonucleotide
  Target: ATXN1; (-) strand; PAM type: NNGRRT; PAM sequence: AGGGGT
gacagcaccctagaaaccca

SEQ ID NO: 12467 - DNA, 20 bp, Artificial Sequence
  Description of Artificial Sequence: Synthetic oligonucleotide
  Target: ATXN1; (-) strand; PAM type: NNGRRT; PAM sequence: ATGAGT
ttattttatgtccctccgta

SEQ ID NO: 12468 - DNA, 20 bp, Artificial Sequence
  Description of Artificial Sequence: Synthetic oligonucleotide
  Target: ATXN1; (-) strand; PAM type: NNGRRT; PAM sequence: TGGAAT
gtgagaaagtatgtttgaaa

SEQ ID NO: 12469 - DNA, 20 bp, Artificial Sequence
  Description of Artificial Sequence: Synthetic oligonucleotide
  Target: ATXN1; (-) strand; PAM type: NNGRRT; PAM sequence: AGGAGT
ttcctgacccgagaagtaac

SEQ ID NO: 12470 - DNA, 20 bp, Artificial Sequence
  Description of Artificial Sequence: Synthetic oligonucleotide
  Target: ATXN1; (-) strand; PAM type: NNGRRT; PAM sequence: ATGAAT
ttagttttggataattggat

SEQ ID NO: 12471 - DNA, 20 bp, Artificial Sequence
  Description of Artificial Sequence: Synthetic oligonucleotide
  Target: ATXN1; (-) strand; PAM type: NNGRRT; PAM sequence: TTGGAT
ctttaattagttttggataa

SEQ ID NO: 12472 - DNA, 20 bp, Artificial Sequence
  Description of Artificial Sequence: Synthetic oligonucleotide
  Target: ATXN1; (-) strand; PAM type: NNGRRT; PAM sequence: TTGGAT
aagacaatctttaattagtt

SEQ ID NO: 12473 - DNA, 20 bp, Artificial Sequence
  Description of Artificial Sequence: Synthetic oligonucleotide
  Target: ATXN1; (-) strand; PAM type: NNGRRT; PAM sequence: GAGAAT
aaacaaacatttattgcaga

SEQ ID NO: 12474 - DNA, 20 bp, Artificial Sequence
  Description of Artificial Sequence: Synthetic oligonucleotide
  Target: ATXN1; (-) strand; PAM type: NNGRRT; PAM sequence: GTGAGT
cagccacccattcaccgagt

SEQ ID NO: 12475 - DNA, 20 bp, Artificial Sequence
  Description of Artificial Sequence: Synthetic oligonucleotide
  Target: ATXN1; (-) strand; PAM type: NNGRRT; PAM sequence: CCGAGT
agaagtcagccacccattca

SEQ ID NO: 12476 - DNA, 20 bp, Artificial Sequence
  Description of Artificial Sequence: Synthetic oligonucleotide
  Target: ATXN1; (-) strand; PAM type: NNGRRT; PAM sequence: GAGGGT
aaatgagccattcatctttt

SEQ ID NO: 12477 - DNA, 20 bp, Artificial Sequence
  Description of Artificial Sequence: Synthetic oligonucleotide
  Target: ATXN1; (-) strand; PAM type: NNGRRT; PAM sequence: GCGAGT
attgaaaacagctgcaggta

SEQ ID NO: 12478 - DNA, 20 bp, Artificial Sequence
  Description of Artificial Sequence: Synthetic oligonucleotide
  Target: ATXN1; (-) strand; PAM type: NNGRRT; PAM sequence: ATGAAT
tgtcaatttttttttattga

SEQ ID NO: 12479 - DNA, 20 bp, Artificial Sequence
  Description of Artificial Sequence: Synthetic oligonucleotide
  Target: ATXN1; (-) strand; PAM type: NNGRRT; PAM sequence: TTGAAT
ggagtgtcaattttttttta

SEQ ID NO: 12480 - DNA, 20 bp, Artificial Sequence
  Description of Artificial Sequence: Synthetic oligonucleotide
  Target: ATXN1; (-) strand; PAM type: NNGRRT; PAM sequence: GGGAGT
gagggtgttgcctacatcca

SEQ ID NO: 12481 - DNA, 20 bp, Artificial Sequence
  Description of Artificial Sequence: Synthetic oligonucleotide
  Target: ATXN1; (-) strand; PAM type: NNGRRT; PAM sequence: GAGGGT
ttgacagtgtgcctcattca

SEQ ID NO: 12482 - DNA, 20 bp, Artificial Sequence
  Description of Artificial Sequence: Synthetic oligonucleotide
  Target: ATXN1; (-) strand; PAM type: NNGRRT; PAM sequence: CCGGAT
aaccgccctcacacttcctg

SEQ ID NO: 12483 - DNA, 20 bp, Artificial Sequence
  Description of Artificial Sequence: Synthetic oligonucleotide
  Target: ATXN1; (-) strand; PAM type: NNGRRT; PAM sequence: AAGAAT
ataaataaataaataattaa

SEQ ID NO: 12484 - DNA, 20 bp, Artificial Sequence
  Description of Artificial Sequence: Synthetic oligonucleotide
  Target: ATXN1; (-) strand; PAM type: NNGRRT; PAM sequence: TGGGAT
aggcggaggttgcagtgagc

SEQ ID NO: 12485 - DNA, 20 bp, Artificial Sequence
  Description of Artificial Sequence: Synthetic oligonucleotide
  Target: ATXN1; (-) strand; PAM type: NNGRRT; PAM sequence: GAGAAT
tactcaggaggctgaggcat

SEQ ID NO: 12486 - DNA, 20 bp, Artificial Sequence
  Description of Artificial Sequence: Synthetic oligonucleotide
  Target: ATXN1; (-) strand; PAM type: NNGRRT; PAM sequence: AGGAGT
tgggcggatcacctgaggtc

SEQ ID NO: 12487 - DNA, 20 bp, Artificial Sequence
  Description of Artificial Sequence: Synthetic oligonucleotide
  Target: ATXN1; (-) strand; PAM type: NNGRRT; PAM sequence: GCGGAT
actttgggaggccgagatgg

SEQ ID NO: 12488 - DNA, 20 bp, Artificial Sequence
  Description of Artificial Sequence: Synthetic oligonucleotide
  Target: ATXN1; (-) strand; PAM type: NNGRRT; PAM sequence: GAGGAT
ccaaggattactgcatagag

SEQ ID NO: 12489 - DNA, 20 bp, Artificial Sequence
  Description of Artificial Sequence: Synthetic oligonucleotide
  Target: ATXN1; (-) strand; PAM type: NNGRRT; PAM sequence: AAGGAT
ctctcttccactgcatgtcc

SEQ ID NO: 12490 - DNA, 20 bp, Artificial Sequence
  Description of Artificial Sequence: Synthetic oligonucleotide
  Target: ATXN1; (-) strand; PAM type: NNGRRT; PAM sequence: AGGAGT
caactatgtgcttcctgctc

SEQ ID NO: 12491 - DNA, 20 bp, Artificial Sequence
  Description of Artificial Sequence: Synthetic oligonucleotide
  Target: ATXN1; (-) strand; PAM type: NNGRRT; PAM sequence: CTGAAT
tagcccggtctaacatgaca

SEQ ID NO: 12492 - DNA, 20 bp, Artificial Sequence
  Description of Artificial Sequence: Synthetic oligonucleotide
  Target: ATXN1; (-) strand; PAM type: NNGRRT; PAM sequence: ACGAGT
tgaaagactttcctaaagtc

SEQ ID NO: 12493 - DNA, 20 bp, Artificial Sequence
  Description of Artificial Sequence: Synthetic oligonucleotide
  Target: ATXN1; (-) strand; PAM type: NNGRRT; PAM sequence: CAGAGT
ctacactccagcctgggtga

SEQ ID NO: 12494 - DNA, 20 bp, Artificial Sequence
  Description of Artificial Sequence: Synthetic oligonucleotide
  Target: ATXN1; (-) strand; PAM type: NNGRRT; PAM sequence: CTGGGT
acctctcactacactccagc

SEQ ID NO: 12495 - DNA, 20 bp, Artificial Sequence
  Description of Artificial Sequence: Synthetic oligonucleotide
  Target: ATXN1; (-) strand; PAM type: NNGRRT; PAM sequence: CGGGGT
gaggtcccacagtgcagcgg

SEQ ID NO: 12496 - DNA, 20 bp, Artificial Sequence
  Description of Artificial Sequence: Synthetic oligonucleotide
  Target: ATXN1; (-) strand; PAM type: NNGRRT; PAM sequence: CCGGGT
ccacaagcaacgcgcgcagc

SEQ ID NO: 12497 - DNA, 20 bp, Artificial Sequence
  Description of Artificial Sequence: Synthetic oligonucleotide
  Target: ATXN1; (-) strand; PAM type: NNGRRT; PAM sequence: CCGAGT
cggcggggtccgccgctgct

SEQ ID NO: 12498 - DNA, 20 bp, Artificial Sequence
  Description of Artificial Sequence: Synthetic oligonucleotide
  Target: ATXN1; (-) strand; PAM type: NNGRRT; PAM sequence: CGGGGT
cctcactgccctagggccgg

SEQ ID NO: 12499 - DNA, 20 bp, Artificial Sequence
  Description of Artificial Sequence: Synthetic oligonucleotide
  Target: ATXN1; (-) strand; PAM type: NNGRRT; PAM sequence: TTGGGT
gcgcccgcactcctcagtcc

SEQ ID NO: 12500 - DNA, 20 bp, Artificial Sequence
  Description of Artificial Sequence: Synthetic oligonucleotide
  Target: ATXN1; (-) strand; PAM type: NNGRRT; PAM sequence: GTGGAT
agcccagctggcttcaccta

SEQ ID NO: 12501 - DNA, 20 bp, Artificial Sequence
  Description of Artificial Sequence: Synthetic oligonucleotide
  Target: ATXN1; (-) strand; PAM type: NNGRRT; PAM sequence: TAGAGT
tacaaaccttgagctagata

SEQ ID NO: 12502 - DNA, 20 bp, Artificial Sequence
  Description of Artificial Sequence: Synthetic oligonucleotide
  Target: ATXN1; (-) strand; PAM type: NNGRRT; PAM sequence: CAGGGT
cacaaaccctgagctagaca

SEQ ID NO: 12503 - DNA, 20 bp, Artificial Sequence
  Description of Artificial Sequence: Synthetic oligonucleotide
  Target: ATXN1; (-) strand; PAM type: NNGRRT; PAM sequence: GTGGAT
agagtagctagttacagagt

SEQ ID NO: 12504 - DNA, 20 bp, Artificial Sequence
  Description of Artificial Sequence: Synthetic oligonucleotide
  Target: ATXN1; (-) strand; PAM type: NNGRRT; PAM sequence: CAGAGT
cccaccagagtagctagtta

SEQ ID NO: 12505 - DNA, 20 bp, Artificial Sequence
  Description of Artificial Sequence: Synthetic oligonucleotide
  Target: ATXN1; (-) strand; PAM type: NNGRRT; PAM sequence: CAGAGT
aaggttctccaagtccccac

SEQ ID NO: 12506 - DNA, 20 bp, Artificial Sequence
  Description of Artificial Sequence: Synthetic oligonucleotide
  Target: ATXN1; (-) strand; PAM type: NNGRRT; PAM sequence: CAGAGT
tacaaaccttgagctagata

SEQ ID NO: 12507 - DNA, 20 bp, Artificial Sequence
  Description of Artificial Sequence: Synthetic oligonucleotide
  Target: ATXN1; (-) strand; PAM type: NNGRRT; PAM sequence: CAGGGT
cacaaaccctgagctagaca

SEQ ID NO: 12508 - DNA, 20 bp, Artificial Sequence
  Description of Artificial Sequence: Synthetic oligonucleotide
  Target: ATXN1; (-) strand; PAM type: NNGRRT; PAM sequence: GTGGAT
agagtagctagatacagagt

SEQ ID NO: 12509 - DNA, 20 bp, Artificial Sequence
  Description of Artificial Sequence: Synthetic oligonucleotide
  Target: ATXN1; (-) strand; PAM type: NNGRRT; PAM sequence: CAGAGT
cccaccagagtagctagata

SEQ ID NO: 12510 - DNA, 20 bp, Artificial Sequence
  Description of Artificial Sequence: Synthetic oligonucleotide
  Target: ATXN1; (-) strand; PAM type: NNGRRT; PAM sequence: CAGAGT
aaggttctccaagtccccac

SEQ ID NO: 12511 - DNA, 20 bp, Artificial Sequence
  Description of Artificial Sequence: Synthetic oligonucleotide
  Target: ATXN1; (-) strand; PAM type: NNGRRT; PAM sequence: AAGAGT
cccactagattagctaaata

SEQ ID NO: 12512 - DNA, 20 bp, Artificial Sequence
  Description of Artificial Sequence: Synthetic oligonucleotide
  Target: ATXN1; (-) strand; PAM type: NNGRRT; PAM sequence: CAGGGT
agcccagtggtctgttttga

SEQ ID NO: 12513 - DNA, 20 bp, Artificial Sequence
  Description of Artificial Sequence: Synthetic oligonucleotide
  Target: ATXN1; (-) strand; PAM type: NNGRRT; PAM sequence: AGGGAT
aaagcttccacagtgtggaa

SEQ ID NO: 12514 - DNA, 20 bp, Artificial Sequence
  Description of Artificial Sequence: Synthetic oligonucleotide
  Target: ATXN1; (-) strand; PAM type: NNGRRT; PAM sequence: AAGAGT
atacaggcagtatagatcca

SEQ ID NO: 12515 - DNA, 20 bp, Artificial Sequence
  Description of Artificial Sequence: Synthetic oligonucleotide
  Target: ATXN1; (-) strand; PAM type: NNGRRT; PAM sequence: GTGAGT
tgaagctgcagacctttccg

SEQ ID NO: 12516 - DNA, 20 bp, Artificial Sequence
  Description of Artificial Sequence: Synthetic oligonucleotide
  Target: ATXN1; (-) strand; PAM type: NNGRRT; PAM sequence: AGGAAT
ttcatggtctcactggcttc

SEQ ID NO: 12517 - DNA, 20 bp, Artificial Sequence
  Description of Artificial Sequence: Synthetic oligonucleotide
  Target: ATXN1; (-) strand; PAM type: NNGRRT; PAM sequence: GTGGGT
ggagttgttcattcctccct

SEQ ID NO: 12518 - DNA, 20 bp, Artificial Sequence
  Description of Artificial Sequence: Synthetic oligonucleotide
  Target: ATXN1; (-) strand; PAM type: NNGRRT; PAM sequence: TGGAGT
agttcttaaagcggcatgtc

SEQ ID NO: 12519 - DNA, 20 bp, Artificial Sequence
  Description of Artificial Sequence: Synthetic oligonucleotide
  Target: ATXN1; (-) strand; PAM type: NNGRRT; PAM sequence: GTGAGT
ttaagccgtggacccttgcg

SEQ ID NO: 12520 - DNA, 20 bp, Artificial Sequence
  Description of Artificial Sequence: Synthetic oligonucleotide
  Target: ATXN1; (-) strand; PAM type: NNGRRT; PAM sequence: AAGAAT
ttcttggtctcactgacttc

SEQ ID NO: 12521 - DNA, 20 bp, Artificial Sequence
  Description of Artificial Sequence: Synthetic oligonucleotide
  Target: ATXN1; (-) strand; PAM type: NNGRRT; PAM sequence: CAGAAT
tatggttgtgctactgtgtc

SEQ ID NO: 12522 - DNA, 20 bp, Artificial Sequence
  Description of Artificial Sequence: Synthetic oligonucleotide
  Target: ATXN1; (-) strand; PAM type: NNGRRT; PAM sequence: GAGGAT
tcccagctactaaggaagct

SEQ ID NO: 12523 - DNA, 20 bp, Artificial Sequence
  Description of Artificial Sequence: Synthetic oligonucleotide
  Target: ATXN1; (-) strand; PAM type: NNGRRT; PAM sequence: CTGAAT
acagcgtgatgaaaccctat

SEQ ID NO: 12524 - DNA, 20 bp, Artificial Sequence
  Description of Artificial Sequence: Synthetic oligonucleotide
  Target: ATXN1; (-) strand; PAM type: NNGRRT; PAM sequence: AGGAGT
tgggaggatcgcttaagccc

SEQ ID NO: 12525 - DNA, 20 bp, Artificial Sequence
  Description of Artificial Sequence: Synthetic oligonucleotide
  Target: ATXN1; (-) strand; PAM type: NNGRRT; PAM sequence: GAGGAT
actatggaaagccaaaatgg

SEQ ID NO: 12526 - DNA, 20 bp, Artificial Sequence
  Description of Artificial Sequence: Synthetic oligonucleotide
  Target: ATXN1; (-) strand; PAM type: NNGRRT; PAM sequence: TTGAAT
ggaaatcaaagcttagaaag

SEQ ID NO: 12527 - DNA, 20 bp, Artificial Sequence
  Description of Artificial Sequence: Synthetic oligonucleotide
  Target: ATXN1; (-) strand; PAM type: NNGRRT; PAM sequence: TGGGAT
ccctcggcctctgaaagtgc

SEQ ID NO: 12528 - DNA, 20 bp, Artificial Sequence
  Description of Artificial Sequence: Synthetic oligonucleotide
  Target: ATXN1; (-) strand; PAM type: NNGRRT; PAM sequence: CTGGAT
gaccaggctggtctcgaact

SEQ ID NO: 12529 - DNA, 20 bp, Artificial Sequence
  Description of Artificial Sequence: Synthetic oligonucleotide
  Target: ATXN1; (-) strand; PAM type: NNGRRT; PAM sequence: TGGAAT
ttcttctgcctcagcctccc

SEQ ID NO: 12530 - DNA, 20 bp, Artificial Sequence
  Description of Artificial Sequence: Synthetic oligonucleotide
  Target: ATXN1; (-) strand; PAM type: NNGRRT; PAM sequence: GCGGGT
ttcgctgcaacctccacctc

SEQ ID NO: 12531 - DNA, 20 bp, Artificial Sequence
  Description of Artificial Sequence: Synthetic oligonucleotide
  Target: ATXN1; (-) strand; PAM type: NNGRRT; PAM sequence: TAGAGT
ttcactcctgtcgcccaggc

SEQ ID NO: 12532 - DNA, 20 bp, Artificial Sequence
  Description of Artificial Sequence: Synthetic oligonucleotide
  Target: ATXN1; (-) strand; PAM type: NNGRRT; PAM sequence: CAGAGT
tcatttttttttttctaagg

SEQ ID NO: 12533 - DNA, 20 bp, Artificial Sequence
  Description of Artificial Sequence: Synthetic oligonucleotide
  Target: ATXN1; (-) strand; PAM type: NNGRRT; PAM sequence: CTGAAT
gcctgcttgcatgctaggca

SEQ ID NO: 12534 - DNA, 20 bp, Artificial Sequence
  Description of Artificial Sequence: Synthetic oligonucleotide
  Target: ATXN1; (-) strand; PAM type: NNGRRT; PAM sequence: CAGGAT
cagctgaggagtaaggccac

SEQ ID NO: 12535 - DNA, 20 bp, Artificial Sequence
  Description of Artificial Sequence: Synthetic oligonucleotide
  Target: ATXN1; (-) strand; PAM type: NNGRRT; PAM sequence: AGGAGT
gcatcagatatacacagctg

SEQ ID NO: 12536 - DNA, 20 bp, Artificial Sequence
  Description of Artificial Sequence: Synthetic oligonucleotide
  Target: ATXN1; (-) strand; PAM type: NNGRRT; PAM sequence: ATGAAT
gcaaactgaggcacagagaa

SEQ ID NO: 12537 - DNA, 20 bp, Artificial Sequence
  Description of Artificial Sequence: Synthetic oligonucleotide
  Target: ATXN1; (-) strand; PAM type: NNGRRT; PAM sequence: TGGGGT
gtgaactcacagcaagcctg

SEQ ID NO: 12538 - DNA, 20 bp, Artificial Sequence
  Description of Artificial Sequence: Synthetic oligonucleotide
  Target: ATXN1; (-) strand; PAM type: NNGRRT; PAM sequence: TTGAGT
acagccagtaattgtaggtc

SEQ ID NO: 12539 - DNA, 20 bp, Artificial Sequence
  Description of Artificial Sequence: Synthetic oligonucleotide
  Target: ATXN1; (-) strand; PAM type: NNGRRT; PAM sequence: TGGGAT
gcctcagcctcccaaagtgc

SEQ ID NO: 12540 - DNA, 20 bp, Artificial Sequence
  Description of Artificial Sequence: Synthetic oligonucleotide
  Target: ATXN1; (-) strand; PAM type: NNGRRT; PAM sequence: CAGGAT
caagatgtcaccatgttggc

SEQ ID NO: 12541 - DNA, 20 bp, Artificial Sequence
  Description of Artificial Sequence: Synthetic oligonucleotide
  Target: ATXN1; (-) strand; PAM type: NNGRRT; PAM sequence: CCGAGT
gattcttctgcctcagcctc

SEQ ID NO: 12542 - DNA, 20 bp, Artificial Sequence
  Description of Artificial Sequence: Synthetic oligonucleotide
  Target: ATXN1; (-) strand; PAM type: NNGRRT; PAM sequence: CCGGGT
ctcactgcaacctctgcctc

SEQ ID NO: 12543 - DNA, 20 bp, Artificial Sequence
  Description of Artificial Sequence: Synthetic oligonucleotide
  Target: ATXN1; (-) strand; PAM type: NNGRRT; PAM sequence: TGGAGT
gtctcgctctgtcaccaggc

SEQ ID NO: 12544 - DNA, 20 bp, Artificial Sequence
  Description of Artificial Sequence: Synthetic oligonucleotide
  Target: ATXN1; (-) strand; PAM type: NNGRRT; PAM sequence: AAGAAT
atgcaggaagtaacctgaga

SEQ ID NO: 12545 - DNA, 20 bp, Artificial Sequence
  Description of Artificial Sequence: Synthetic oligonucleotide
  Target: ATXN1; (-) strand; PAM type: NNGRRT; PAM sequence: TGGAGT
aaaaaatcagtgcactagtg

SEQ ID NO: 12546 - DNA, 20 bp, Artificial Sequence
  Description of Artificial Sequence: Synthetic oligonucleotide
  Target: ATXN1; (-) strand; PAM type: NNGRRT; PAM sequence: TTGAAT
agcacatttgaattttattt

SEQ ID NO: 12547 - DNA, 20 bp, Artificial Sequence
  Description of Artificial Sequence: Synthetic oligonucleotide
  Target: ATXN1; (-) strand; PAM type: NNGRRT; PAM sequence: TTGAAT
aattgaaaacatgagcacat

SEQ ID NO: 12548 - DNA, 20 bp, Artificial Sequence
  Description of Artificial Sequence: Synthetic oligonucleotide
  Target: ATXN1; (-) strand; PAM type: NNGRRT; PAM sequence: AGGAAT
aaagcttctatttataccaa

SEQ ID NO: 12549 - DNA, 20 bp, Artificial Sequence
  Description of Artificial Sequence: Synthetic oligonucleotide
  Target: ATXN1; (-) strand; PAM type: NNGRRT; PAM sequence: ATGAAT
aagcattgatttaatttata

SEQ ID NO: 12550 - DNA, 20 bp, Artificial Sequence
  Description of Artificial Sequence: Synthetic oligonucleotide
  Target: ATXN1; (-) strand; PAM type: NNGRRT; PAM sequence: GGGAAT
agcattatttatctttcatt

SEQ ID NO: 12551 - DNA, 20 bp, Artificial Sequence
  Description of Artificial Sequence: Synthetic oligonucleotide
  Target: ATXN1; (-) strand; PAM type: NNGRRT; PAM sequence: CTGGAT
gttcaggaagaagaacacac

SEQ ID NO: 12552 - DNA, 20 bp, Artificial Sequence
  Description of Artificial Sequence: Synthetic oligonucleotide
  Target: ATXN1; (-) strand; PAM type: NNGRRT; PAM sequence: AGGGGT
ggagtgcatgctgatttgag

SEQ ID NO: 12553 - DNA, 20 bp, Artificial Sequence
  Description of Artificial Sequence: Synthetic oligonucleotide
  Target: ATXN1; (-) strand; PAM type: NNGRRT; PAM sequence: CGGAGT
cgttagcagaaatatggaac

SEQ ID NO: 12554 - DNA, 20 bp, Artificial Sequence
  Description of Artificial Sequence: Synthetic oligonucleotide
  Target: ATXN1; (-) strand; PAM type: NNGRRT; PAM sequence: AGGAGT
ttaggggagtcgctggatat

SEQ ID NO: 12555 - DNA, 20 bp, Artificial Sequence
  Description of Artificial Sequence: Synthetic oligonucleotide
  Target: ATXN1; (-) strand; PAM type: NNGRRT; PAM sequence: CTGGAT
tgacacaattaggggagtcg

SEQ ID NO: 12556 - DNA, 20 bp, Artificial Sequence
  Description of Artificial Sequence: Synthetic oligonucleotide
  Target: ATXN1; (-) strand; PAM type: NNGRRT; PAM sequence: GGGAGT
agaaagactgacacaattag

SEQ ID NO: 12557 - DNA, 20 bp, Artificial Sequence
  Description of Artificial Sequence: Synthetic oligonucleotide
  Target: ATXN1; (-) strand; PAM type: NNGRRT; PAM sequence: AAGAGT
gagacttcaagcttcacccc

SEQ ID NO: 12558 - DNA, 20 bp, Artificial Sequence
  Description of Artificial Sequence: Synthetic oligonucleotide
  Target: ATXN1; (-) strand; PAM type: NNGRRT; PAM sequence: TTGGGT
taaaatgaggaaaccaaggc

SEQ ID NO: 12559 - DNA, 20 bp, Artificial Sequence
  Description of Artificial Sequence: Synthetic oligonucleotide
  Target: ATXN1; (-) strand; PAM type: NNGRRT; PAM sequence: TGGGAT
gcctcggcctcctgaagtgc

SEQ ID NO: 12560 - DNA, 20 bp, Artificial Sequence
  Description of Artificial Sequence: Synthetic oligonucleotide
  Target: ATXN1; (-) strand; PAM type: NNGRRT; PAM sequence: TCGAAT
ctttgttacccaggctggtc

SEQ ID NO: 12561 - DNA, 20 bp, Artificial Sequence
  Description of Artificial Sequence: Synthetic oligonucleotide
  Target: ATXN1; (-) strand; PAM type: NNGRRT; PAM sequence: TGGAGT
tcttgttctgtctcccaggt

SEQ ID NO: 12562 - DNA, 20 bp, Artificial Sequence
  Description of Artificial Sequence: Synthetic oligonucleotide
  Target: ATXN1; (-) strand; PAM type: NNGRRT; PAM sequence: CAGGGT
attttctttattttttgaga

SEQ ID NO: 12563 - DNA, 20 bp, Artificial Sequence
  Description of Artificial Sequence: Synthetic oligonucleotide
  Target: ATXN1; (-) strand; PAM type: NNGRRT; PAM sequence: TAGGGT
tagtcatcaccctaaccctg

SEQ ID NO: 12564 - DNA, 20 bp, Artificial Sequence
  Description of Artificial Sequence: Synthetic oligonucleotide
  Target: ATXN1; (-) strand; PAM type: NNGRRT; PAM sequence: TTGAAT
ttttttctacctcacatttg

SEQ ID NO: 12565 - DNA, 20 bp, Artificial Sequence
  Description of Artificial Sequence: Synthetic oligonucleotide
  Target: ATXN1; (-) strand; PAM type: NNGRRT; PAM sequence: CTGAAT
gaacattgataaagttcctg

SEQ ID NO: 12566 - DNA, 20 bp, Artificial Sequence
  Description of Artificial Sequence: Synthetic oligonucleotide
  Target: ATXN1; (-) strand; PAM type: NNGRRT; PAM sequence: TGGAAT
aaatcttggcagaattctgc

SEQ ID NO: 12567 - DNA, 20 bp, Artificial Sequence
  Description of Artificial Sequence: Synthetic oligonucleotide
  Target: ATXN1; (-) strand; PAM type: NNGRRT; PAM sequence: CAGAAT
gaaaagactgaaaatcttgg

SEQ ID NO: 12568 - DNA, 20 bp, Artificial Sequence
  Description of Artificial Sequence: Synthetic oligonucleotide
  Target: ATXN1; (-) strand; PAM type: NNGRRT; PAM sequence: AAGAAT
aaaaattggtttcttagtag

SEQ ID NO: 12569 - DNA, 20 bp, Artificial Sequence
  Description of Artificial Sequence: Synthetic oligonucleotide
  Target: ATXN1; (-) strand; PAM type: NNGRRT; PAM sequence: CAGAGT
ctgcactccagcctgtatga

SEQ ID NO: 12570 - DNA, 20 bp, Artificial Sequence
  Description of Artificial Sequence: Synthetic oligonucleotide
  Target: ATXN1; (-) strand; PAM type: NNGRRT; PAM sequence: GTGGAT
aactcaagaggcagaggtgg

SEQ ID NO: 12571 - DNA, 20 bp, Artificial Sequence
  Description of Artificial Sequence: Synthetic oligonucleotide
  Target: ATXN1; (-) strand; PAM type: NNGRRT; PAM sequence: GTGGGT
cagcaactcaagaggcagag

SEQ ID NO: 12572 - DNA, 20 bp, Artificial Sequence
  Description of Artificial Sequence: Synthetic oligonucleotide
  Target: ATXN1; (-) strand; PAM type: NNGRRT; PAM sequence: AAGAGT
caggcagatctcttgagccc

SEQ ID NO: 12573 - DNA, 20 bp, Artificial Sequence
  Description of Artificial Sequence: Synthetic oligonucleotide
  Target: ATXN1; (-) strand; PAM type: NNGRRT; PAM sequence: CTGGGT
ccagcatactcaagaatggg

SEQ ID NO: 12574 - DNA, 20 bp, Artificial Sequence
  Description of Artificial Sequence: Synthetic oligonucleotide
  Target: ATXN1; (-) strand; PAM type: NNGRRT; PAM sequence: AAGAAT
aatattgatccagcatactc

SEQ ID NO: 12575 - DNA, 20 bp, Artificial Sequence
  Description of Artificial Sequence: Synthetic oligonucleotide
  Target: ATXN1; (-) strand; PAM type: NNGRRT; PAM sequence: TGGAAT
aggcctggtttcccttctgt

SEQ ID NO: 12576 - DNA, 20 bp, Artificial Sequence
  Description of Artificial Sequence: Synthetic oligonucleotide
  Target: ATXN1; (-) strand; PAM type: NNGRRT; PAM sequence: GGGGAT
tagcctacgttctgaaatca

SEQ ID NO: 12577 - DNA, 20 bp, Artificial Sequence
  Description of Artificial Sequence: Synthetic oligonucleotide
  Target: ATXN1; (-) strand; PAM type: NNGRRT; PAM sequence: AGGAAT
agtaaatgctgtgaaagacc

SEQ ID NO: 12578 - DNA, 20 bp, Artificial Sequence
  Description of Artificial Sequence: Synthetic oligonucleotide
  Target: ATXN1; (-) strand; PAM type: NNGRRT; PAM sequence: AGGGAT
ataaaatgtctcaatgttga

SEQ ID NO: 12579 - DNA, 20 bp, Artificial Sequence
  Description of Artificial Sequence: Synthetic oligonucleotide
  Target: ATXN1; (-) strand; PAM type: NNGRRT; PAM sequence: AAGAGT
acgtgtcctgatgaaaaaat

SEQ ID NO: 12580 - DNA, 20 bp, Artificial Sequence
  Description of Artificial Sequence: Synthetic oligonucleotide
  Target: ATXN1; (-) strand; PAM type: NNGRRT; PAM sequence: TTGGGT
atcatcccacccaccatccc

SEQ ID NO: 12581 - DNA, 20 bp, Artificial Sequence
  Description of Artificial Sequence: Synthetic oligonucleotide
  Target: ATXN1; (-) strand; PAM type: NNGRRT; PAM sequence: ATGGGT
ttttcccaaatatgtttatt

SEQ ID NO: 12582 - DNA, 20 bp, Artificial Sequence
  Description of Artificial Sequence: Synthetic oligonucleotide
  Target: ATXN1; (-) strand; PAM type: NNGRRT; PAM sequence: TTGAGT
tcgtgtgatgctctgtcggc

SEQ ID NO: 12583 - DNA, 20 bp, Artificial Sequence
  Description of Artificial Sequence: Synthetic oligonucleotide
  Target: ATXN1; (-) strand; PAM type: NNGRRT; PAM sequence: ATGGAT
ggtcttggaacctattcctc

SEQ ID NO: 12584 - DNA, 20 bp, Artificial Sequence
  Description of Artificial Sequence: Synthetic oligonucleotide
  Target: ATXN1; (-) strand; PAM type: NNGRRT; PAM sequence: GGGGGT
gtgggtttcaggaacccact

SEQ ID NO: 12585 - DNA, 20 bp, Artificial Sequence
  Description of Artificial Sequence: Synthetic oligonucleotide
  Target: ATXN1; (-) strand; PAM type: NNGRRT; PAM sequence: GTGGGT
atagggtttggtactatcca

SEQ ID NO: 12586 - DNA, 20 bp, Artificial Sequence
  Description of Artificial Sequence: Synthetic oligonucleotide
  Target: ATXN1; (-) strand; PAM type: NNGRRT; PAM sequence: TAGGGT
ggaaaaaaacatagcgtaca

SEQ ID NO: 12587 - DNA, 20 bp, Artificial Sequence
  Description of Artificial Sequence: Synthetic oligonucleotide
  Target: ATXN1; (-) strand; PAM type: NNGRRT; PAM sequence: TGGGAT
ggtgcttagatccactgtgg

SEQ ID NO: 12588 - DNA, 20 bp, Artificial Sequence
  Description of Artificial Sequence: Synthetic oligonucleotide
  Target: ATXN1; (-) strand; PAM type: NNGRRT; PAM sequence: GTGAGT
ctgcgcagcgctccccgccg

SEQ ID NO: 12589 - DNA, 20 bp, Artificial Sequence
  Description of Artificial Sequence: Synthetic oligonucleotide
  Target: ATXN1; (-) strand; PAM type: NNGRRT; PAM sequence: GTGAAT
taccccatcctaacgcagac

SEQ ID NO: 12590 - DNA, 20 bp, Artificial Sequence
  Description of Artificial Sequence: Synthetic oligonucleotide
  Target: ATXN1; (-) strand; PAM type: NNGRRT; PAM sequence: TGGAGT
acacctcctttagtttagtg

SEQ ID NO: 12591 - DNA, 20 bp, Artificial Sequence
  Description of Artificial Sequence: Synthetic oligonucleotide
  Target: ATXN1; (-) strand; PAM type: NNGRRT; PAM sequence: GAGAAT
ctcctgtaattgcttgttaa

SEQ ID NO: 12592 - DNA, 20 bp, Artificial Sequence
  Description of Artificial Sequence: Synthetic oligonucleotide
  Target: ATXN1; (-) strand; PAM type: NNGRRT; PAM sequence: GGGGGT
tttgtagttttagtagagac

SEQ ID NO: 12593 - DNA, 20 bp, Artificial Sequence
  Description of Artificial Sequence: Synthetic oligonucleotide
  Target: ATXN1; (-) strand; PAM type: NNGRRT; PAM sequence: AGGGAT
gcctcagcctcctgagtagc

SEQ ID NO: 12594 - DNA, 20 bp, Artificial Sequence
  Description of Artificial Sequence: Synthetic oligonucleotide
  Target: ATXN1; (-) strand; PAM type: NNGRRT; PAM sequence: CTGAGT
gattctcatgcctcagcctc

SEQ ID NO: 12595 - DNA, 20 bp, Artificial Sequence
  Description of Artificial Sequence: Synthetic oligonucleotide
  Target: ATXN1; (-) strand; PAM type: NNGRRT; PAM sequence: TGGAGT
tcttgctctgtcgtccaggc

SEQ ID NO: 12596 - DNA, 20 bp, Artificial Sequence
  Description of Artificial Sequence: Synthetic oligonucleotide
  Target: ATXN1; (-) strand; PAM type: NNGRRT; PAM sequence: GAGGAT
cacaatcttgggaaactaca

SEQ ID NO: 12597 - DNA, 20 bp, Artificial Sequence
  Description of Artificial Sequence: Synthetic oligonucleotide
  Target: ATXN1; (-) strand; PAM type: NNGRRT; PAM sequence: CAGAAT
tccccaacctagctgccaat

SEQ ID NO: 12598 - DNA, 20 bp, Artificial Sequence
  Description of Artificial Sequence: Synthetic oligonucleotide
  Target: ATXN1; (-) strand; PAM type: NNGRRT; PAM sequence: TGGAGT
aggttctgagttcagtggcc

SEQ ID NO: 12599 - DNA, 20 bp, Artificial Sequence
  Description of Artificial Sequence: Synthetic oligonucleotide
  Target: ATXN1; (-) strand; PAM type: NNGRRT; PAM sequence: CTGAGT
ccactccgaccctataggtt

SEQ ID NO: 12600 - DNA, 20 bp, Artificial Sequence
  Description of Artificial Sequence: Synthetic oligonucleotide
  Target: ATXN1; (-) strand; PAM type: NNGRRT; PAM sequence: GAGGGT
tgttcctccgtcagggaact

SEQ ID NO: 12601 - DNA, 20 bp, Artificial Sequence
  Description of Artificial Sequence: Synthetic oligonucleotide
  Target: ATXN1; (-) strand; PAM type: NNGRRT; PAM sequence: ATGAAT
tgttttagggaggtacatac

SEQ ID NO: 12602 - DNA, 20 bp, Artificial Sequence
  Description of Artificial Sequence: Synthetic oligonucleotide
  Target: ATXN1; (-) strand; PAM type: NNGRRT; PAM sequence: GGGGGT
gtgaaataagatagaaggaa

SEQ ID NO: 12603 - DNA, 20 bp, Artificial Sequence
  Description of Artificial Sequence: Synthetic oligonucleotide
  Target: ATXN1; (-) strand; PAM type: NNGRRT; PAM sequence: GAGAAT
tactagagaggctgaggcag

SEQ ID NO: 12604 - DNA, 20 bp, Artificial Sequence
  Description of Artificial Sequence: Synthetic oligonucleotide
  Target: ATXN1; (-) strand; PAM type: NNGRRT; PAM sequence: CCGAGT
gctttataaaatagaagggt

SEQ ID NO: 12605 - DNA, 20 bp, Artificial Sequence
  Description of Artificial Sequence: Synthetic oligonucleotide
  Target: ATXN1; (-) strand; PAM type: NNGRRT; PAM sequence: AAGGGT
aacccagctttataaaatag

SEQ ID NO: 12606 - DNA, 20 bp, Artificial Sequence
  Description of Artificial Sequence: Synthetic oligonucleotide
  Target: ATXN1; (-) strand; PAM type: NNGRRT; PAM sequence: GAGGAT
aatcagaagaacaacccaga

SEQ ID NO: 12607 - DNA, 20 bp, Artificial Sequence
  Description of Artificial Sequence: Synthetic oligonucleotide
  Target: ATXN1; (-) strand; PAM type: NNGRRT; PAM sequence: ATGAAT
tctgagacctgacatttgtg

SEQ ID NO: 12608 - DNA, 20 bp, Artificial Sequence
  Description of Artificial Sequence: Synthetic oligonucleotide
  Target: ATXN1; (-) strand; PAM type: NNGRRT; PAM sequence: TAGAGT
atggctgctgctccactctg

SEQ ID NO: 12609 - DNA, 20 bp, Artificial Sequence
  Description of Artificial Sequence: Synthetic oligonucleotide
  Target: ATXN1; (-) strand; PAM type: NNGRRT; PAM sequence: CAGAGT
ttgaggcagttcaactgccc

SEQ ID NO: 12610 - DNA, 20 bp, Artificial Sequence
  Description of Artificial Sequence: Synthetic oligonucleotide
  Target: ATXN1; (-) strand; PAM type: NNGRRT; PAM sequence: CTGGGT
ggcatctgtgggcatccaag

SEQ ID NO: 12611 - DNA, 20 bp, Artificial Sequence
  Description of Artificial Sequence: Synthetic oligonucleotide
  Target: ATXN1; (-) strand; PAM type: NNGRRT; PAM sequence: TTGGAT
tgctgcagttttccgtaaaa

SEQ ID NO: 12612 - DNA, 20 bp, Artificial Sequence
  Description of Artificial Sequence: Synthetic oligonucleotide
  Target: ATXN1; (-) strand; PAM type: NNGRRT; PAM sequence: ATGAGT
gcctgctagaagagtggcag

SEQ ID NO: 12613 - DNA, 20 bp, Artificial Sequence
  Description of Artificial Sequence: Synthetic oligonucleotide
  Target: ATXN1; (-) strand; PAM type: NNGRRT; PAM sequence: AAGAGT
cgcttagaagagcctgctag

SEQ ID NO: 12614 - DNA, 20 bp, Artificial Sequence
  Description of Artificial Sequence: Synthetic oligonucleotide
  Target: ATXN1; (-) strand; PAM type: NNGRRT; PAM sequence: CAGGGT
cccccaccaagctcatccat

SEQ ID NO: 12615 - DNA, 20 bp, Artificial Sequence
  Description of Artificial Sequence: Synthetic oligonucleotide
  Target: ATXN1; (-) strand; PAM type: NNGRRT; PAM sequence: GTGAGT
agaaaaaaaaaaaagggtgg

SEQ ID NO: 12616 - DNA, 20 bp, Artificial Sequence
  Description of Artificial Sequence: Synthetic oligonucleotide
  Target: ATXN1; (-) strand; PAM type: NNGRRT; PAM sequence: GTGGGT
aaaaagaaaaaaaaaaaagg

SEQ ID NO: 12617 - DNA, 20 bp, Artificial Sequence
  Description of Artificial Sequence: Synthetic oligonucleotide
  Target: ATXN1; (-) strand; PAM type: NNGRRT; PAM sequence: AAGGGT
ctcaaaaaagaaaaaaaaaa

SEQ ID NO: 12618 - DNA, 20 bp, Artificial Sequence
  Description of Artificial Sequence: Synthetic oligonucleotide
  Target: ATXN1; (-) strand; PAM type: NNGRRT; PAM sequence: GAGAAT
tactcaggaggctgaggcag

SEQ ID NO: 12619 - DNA, 20 bp, Artificial Sequence
  Description of Artificial Sequence: Synthetic oligonucleotide
  Target: ATXN1; (-) strand; PAM type: NNGRRT; PAM sequence: AGGAAT
cgggtggatcacctgaggtc

SEQ ID NO: 12620 - DNA, 20 bp, Artificial Sequence
  Description of Artificial Sequence: Synthetic oligonucleotide
  Target: ATXN1; (-) strand; PAM type: NNGRRT; PAM sequence: GTGGAT
actttgggaggccaaggcgg

SEQ ID NO: 12621 - DNA, 20 bp, Artificial Sequence
  Description of Artificial Sequence: Synthetic oligonucleotide
  Target: ATXN1; (-) strand; PAM type: NNGRRT; PAM sequence: GCGGGT
cagcactttgggaggccaag

SEQ ID NO: 12622 - DNA, 20 bp, Artificial Sequence
  Description of Artificial Sequence: Synthetic oligonucleotide
  Target: ATXN1; (-) strand; PAM type: NNGRRT; PAM sequence: GTGGGT
tcaagttgcccatcaaaagg

SEQ ID NO: 12623 - DNA, 20 bp, Artificial Sequence
  Description of Artificial Sequence: Synthetic oligonucleotide
  Target: ATXN1; (-) strand; PAM type: NNGRRT; PAM sequence: AAGGGT
cagctcaagttgcccatcaa

SEQ ID NO: 12624 - DNA, 20 bp, Artificial Sequence
  Description of Artificial Sequence: Synthetic oligonucleotide
  Target: ATXN1; (-) strand; PAM type: NNGRRT; PAM sequence: AGGAAT
caagacgtgtttgcagttac

SEQ ID NO: 12625 - DNA, 20 bp, Artificial Sequence
  Description of Artificial Sequence: Synthetic oligonucleotide
  Target: ATXN1; (-) strand; PAM type: NNGRRT; PAM sequence: CAGAGT
agcccaaccaatggcatgcc

SEQ ID NO: 12626 - DNA, 20 bp, Artificial Sequence
  Description of Artificial Sequence: Synthetic oligonucleotide
  Target: ATXN1; (-) strand; PAM type: NNGRRT; PAM sequence: GAGAAT
gacttcagagctctcaggag

SEQ ID NO: 12627 - DNA, 20 bp, Artificial Sequence
  Description of Artificial Sequence: Synthetic oligonucleotide
  Target: ATXN1; (-) strand; PAM type: NNGRRT; PAM sequence: AGGAAT
acttcacagatgtgagcaag

SEQ ID NO: 12628 - DNA, 20 bp, Artificial Sequence
  Description of Artificial Sequence: Synthetic oligonucleotide
  Target: ATXN1; (-) strand; PAM type: NNGRRT; PAM sequence: AAGAGT
ttttactgaggttttgtgca

SEQ ID NO: 12629 - DNA, 20 bp, Artificial Sequence
  Description of Artificial Sequence: Synthetic oligonucleotide
  Target: ATXN1; (-) strand; PAM type: NNGRRT; PAM sequence: TAGAAT
gctttgaaccttctgagtca

SEQ ID NO: 12630 - DNA, 20 bp, Artificial Sequence
  Description of Artificial Sequence: Synthetic oligonucleotide
  Target: ATXN1; (-) strand; PAM type: NNGRRT; PAM sequence: CTGAGT
aaacctttgctttgaacctt

SEQ ID NO: 12631 - DNA, 20 bp, Artificial Sequence
  Description of Artificial Sequence: Synthetic oligonucleotide
  Target: ATXN1; (-) strand; PAM type: NNGRRT; PAM sequence: CAGAAT
aacagcaaagagattatatt

SEQ ID NO: 12632 - DNA, 20 bp, Artificial Sequence
  Description of Artificial Sequence: Synthetic oligonucleotide
  Target: ATXN1; (-) strand; PAM type: NNGRRT; PAM sequence: AAGAAT
agttatatgcttttccccca

SEQ ID NO: 12633 - DNA, 20 bp, Artificial Sequence
  Description of Artificial Sequence: Synthetic oligonucleotide
  Target: ATXN1; (-) strand; PAM type: NNGRRT; PAM sequence: CAGGGT
tttttaaaaactggataacc

SEQ ID NO: 12634 - DNA, 20 bp, Artificial Sequence
  Description of Artificial Sequence: Synthetic oligonucleotide
  Target: ATXN1; (-) strand; PAM type: NNGRRT; PAM sequence: CTGGAT
tatgcagggatttttaaaaa

SEQ ID NO: 12635 - DNA, 20 bp, Artificial Sequence
  Description of Artificial Sequence: Synthetic oligonucleotide
  Target: ATXN1; (-) strand; PAM type: NNGRRT; PAM sequence: AGGGAT
aagaagtttgtctagtatgc

SEQ ID NO: 12636 - DNA, 20 bp, Artificial Sequence
  Description of Artificial Sequence: Synthetic oligonucleotide
  Target: ATXN1; (-) strand; PAM type: NNGRRT; PAM sequence: TTGAAT
cagaatttttttggtgtttt

SEQ ID NO: 12637 - DNA, 20 bp, Artificial Sequence
  Description of Artificial Sequence: Synthetic oligonucleotide
  Target: ATXN1; (-) strand; PAM type: NNGRRT; PAM sequence: CAGAAT
gctttcccaatctagatctc

SEQ ID NO: 12638 - DNA, 20 bp, Artificial Sequence
  Description of Artificial Sequence: Synthetic oligonucleotide
  Target: ATXN1; (-) strand; PAM type: NNGRRT; PAM sequence: AAGAAT
catttgagactgttggtgaa

SEQ ID NO: 12639 - DNA, 20 bp, Artificial Sequence
  Description of Artificial Sequence: Synthetic oligonucleotide
  Target: ATXN1; (-) strand; PAM type: NNGRRT; PAM sequence: TTGGGT
tgcataaattccatatagat

SEQ ID NO: 12640 - DNA, 20 bp, Artificial Sequence
  Description of Artificial Sequence: Synthetic oligonucleotide
  Target: ATXN1; (-) strand; PAM type: NNGRRT; PAM sequence: TGGAAT
taaatgaatataaatcgatg

SEQ ID NO: 12641 - DNA, 20 bp, Artificial Sequence
  Description of Artificial Sequence: Synthetic oligonucleotide
  Target: ATXN1; (-) strand; PAM type: NNGRRT; PAM sequence: ATGAAT
tataaatggaataactataa

SEQ ID NO: 12642 - DNA, 20 bp, Artificial Sequence
  Description of Artificial Sequence: Synthetic oligonucleotide
  Target: ATXN1; (-) strand; PAM type: NNGRRT; PAM sequence: TGGAAT
aataagctgcattttataaa

SEQ ID NO: 12643 - DNA, 20 bp, Artificial Sequence
  Description of Artificial Sequence: Synthetic oligonucleotide
  Target: ATXN1; (-) strand; PAM type: NNGRRT; PAM sequence: CAGAGT
ctgcactccagcctgggtga

SEQ ID NO: 12644 - DNA, 20 bp, Artificial Sequence
  Description of Artificial Sequence: Synthetic oligonucleotide
  Target: ATXN1; (-) strand; PAM type: NNGRRT; PAM sequence: CTGGGT
tcacgccactgcactccagc

SEQ ID NO: 12645 - DNA, 20 bp, Artificial Sequence
  Description of Artificial Sequence: Synthetic oligonucleotide
  Target: ATXN1; (-) strand; PAM type: NNGRRT; PAM sequence: CGGGGT
aggcagaggttgcagtgagc

SEQ ID NO: 12646 - DNA, 20 bp, Artificial Sequence
  Description of Artificial Sequence: Synthetic oligonucleotide
  Target: ATXN1; (-) strand; PAM type: NNGRRT; PAM sequence: AGGAGT
tgggtggatcatttgaggtc

SEQ ID NO: 12647 - DNA, 20 bp, Artificial Sequence
  Description of Artificial Sequence: Synthetic oligonucleotide
  Target: ATXN1; (-) strand; PAM type: NNGRRT; PAM sequence: GTGGAT
actttgggaggccgatgtgg

SEQ ID NO: 12648 - DNA, 20 bp, Artificial Sequence
  Description of Artificial Sequence: Synthetic oligonucleotide
  Target: ATXN1; (-) strand; PAM type: NNGRRT; PAM sequence: GTGGGT
cagcactttgggaggccgat

SEQ ID NO: 12649 - DNA, 20 bp, Artificial Sequence
  Description of Artificial Sequence: Synthetic oligonucleotide
  Target: ATXN1; (-) strand; PAM type: NNGRRT; PAM sequence: TGGAGT
agtggaaagtgtaatggatg

SEQ ID NO: 12650 - DNA, 20 bp, Artificial Sequence
  Description of Artificial Sequence: Synthetic oligonucleotide
  Target: ATXN1; (-) strand; PAM type: NNGRRT; PAM sequence: ATGGAT
ggtgtagagtggaaagtgta

SEQ ID NO: 12651 - DNA, 20 bp, Artificial Sequence
  Description of Artificial Sequence: Synthetic oligonucleotide
  Target: ATXN1; (-) strand; PAM type: NNGRRT; PAM sequence: TAGAGT
ctgcacggggagccatggtg

SEQ ID NO: 12652 - DNA, 20 bp, Artificial Sequence
  Description of Artificial Sequence: Synthetic oligonucleotide
  Target: ATXN1; (-) strand; PAM type: NNGRRT; PAM sequence: TTGGAT
ccctctgggaactgagctga

SEQ ID NO: 12653 - DNA, 20 bp, Artificial Sequence
  Description of Artificial Sequence: Synthetic oligonucleotide
  Target: ATXN1; (-) strand; PAM type: NNGRRT; PAM sequence: CTGAGT
tccatgtttattgtcgctac

SEQ ID NO: 12654 - DNA, 20 bp, Artificial Sequence
  Description of Artificial Sequence: Synthetic oligonucleotide
  Target: ATXN1; (-) strand; PAM type: NNGRRT; PAM sequence: ATGGGT
ttagagccacgtaaagctaa

SEQ ID NO: 12655 - DNA, 20 bp, Artificial Sequence
  Description of Artificial Sequence: Synthetic oligonucleotide
  Target: ATXN1; (-) strand; PAM type: NNGRRT; PAM sequence: GAGAGT
cctactcttggtcctttcag

SEQ ID NO: 12656 - DNA, 20 bp, Artificial Sequence
  Description of Artificial Sequence: Synthetic oligonucleotide
  Target: ATXN1; (-) strand; PAM type: NNGRRT; PAM sequence: CCGGGT
tcccagtgtcagcttccctc

SEQ ID NO: 12657 - DNA, 20 bp, Artificial Sequence
  Description of Artificial Sequence: Synthetic oligonucleotide
  Target: ATXN1; (-) strand; PAM type: NNGRRT; PAM sequence: TTGGAT
ttgccttttgattgcctttc

SEQ ID NO: 12658 - DNA, 20 bp, Artificial Sequence
  Description of Artificial Sequence: Synthetic oligonucleotide
  Target: ATXN1; (-) strand; PAM type: NNGRRT; PAM sequence: AGGAAT
gttctactttaagttcttta

SEQ ID NO: 12659 - DNA, 20 bp, Artificial Sequence
  Description of Artificial Sequence: Synthetic oligonucleotide
  Target: ATXN1; (-) strand; PAM type: NNGRRT; PAM sequence: TTGGAT
gatacccagtagtgggattg

SEQ ID NO: 12660 - DNA, 20 bp, Artificial Sequence
  Description of Artificial Sequence: Synthetic oligonucleotide
  Target: ATXN1; (-) strand; PAM type: NNGRRT; PAM sequence: TGGGAT
tctgggtagatacccagtag

SEQ ID NO: 12661 - DNA, 20 bp, Artificial Sequence
  Description of Artificial Sequence: Synthetic oligonucleotide
  Target: ATXN1; (-) strand; PAM type: NNGRRT; PAM sequence: CTGGGT
tttttcataagacgtctcct

SEQ ID NO: 12662 - DNA, 20 bp, Artificial Sequence
  Description of Artificial Sequence: Synthetic oligonucleotide
  Target: ATXN1; (-) strand; PAM type: NNGRRT; PAM sequence: GCGAAT
ggttccatatttctgcaatt

SEQ ID NO: 12663 - DNA, 20 bp, Artificial Sequence
  Description of Artificial Sequence: Synthetic oligonucleotide
  Target: ATXN1; (-) strand; PAM type: NNGRRT; PAM sequence: CTGAGT
tattttgttcctttttatgg

SEQ ID NO: 12664 - DNA, 20 bp, Artificial Sequence
  Description of Artificial Sequence: Synthetic oligonucleotide
  Target: ATXN1; (-) strand; PAM type: NNGRRT; PAM sequence: GTGAAT
ccagttccaaacaggttgct

SEQ ID NO: 12665 - DNA, 20 bp, Artificial Sequence
  Description of Artificial Sequence: Synthetic oligonucleotide
  Target: ATXN1; (-) strand; PAM type: NNGRRT; PAM sequence: TAGAAT
cattcctgagttacttcact

SEQ ID NO: 12666 - DNA, 20 bp, Artificial Sequence
  Description of Artificial Sequence: Synthetic oligonucleotide
  Target: ATXN1; (-) strand; PAM type: NNGRRT; PAM sequence: CTGAGT
cggtgttcagttttccattc

SEQ ID NO: 12667 - DNA, 20 bp, Artificial Sequence
  Description of Artificial Sequence: Synthetic oligonucleotide
  Target: ATXN1; (-) strand; PAM type: NNGRRT; PAM sequence: TGGAGT
cagggctgccaccagctcca

SEQ ID NO: 12668 - DNA, 20 bp, Artificial Sequence
  Description of Artificial Sequence: Synthetic oligonucleotide
  Target: ATXN1; (-) strand; PAM type: NNGRRT; PAM sequence: CGGAAT
gcggagctcccatcccaact

SEQ ID NO: 12669 - DNA, 20 bp, Artificial Sequence
  Description of Artificial Sequence: Synthetic oligonucleotide
  Target: ATXN1; (-) strand; PAM type: NNGRRT; PAM sequence: CTGGGT
tgctctgtggagcaggaggc

SEQ ID NO: 12670 - DNA, 20 bp, Artificial Sequence
  Description of Artificial Sequence: Synthetic oligonucleotide
  Target: ATXN1; (-) strand; PAM type: NNGRRT; PAM sequence: TTGGGT
ctcggatctacagctgcagt

SEQ ID NO: 12671 - DNA, 20 bp, Artificial Sequence
  Description of Artificial Sequence: Synthetic oligonucleotide
  Target: ATXN1; (-) strand; PAM type: NNGRRT; PAM sequence: TCGGAT
ccccaagagcacagggagac

SEQ ID NO: 12672 - DNA, 20 bp, Artificial Sequence
  Description of Artificial Sequence: Synthetic oligonucleotide
  Target: ATXN1; (-) strand; PAM type: NNGRRT; PAM sequence: GTGGGT
ggaggcccaggtctgcagcc

SEQ ID NO: 12673 - DNA, 20 bp, Artificial Sequence
  Description of Artificial Sequence: Synthetic oligonucleotide
  Target: ATXN1; (-) strand; PAM type: NNGRRT; PAM sequence: TGGAAT
cctggctcctgcctgcttcc

SEQ ID NO: 12674 - DNA, 20 bp, Artificial Sequence
  Description of Artificial Sequence: Synthetic oligonucleotide
  Target: ATXN1; (-) strand; PAM type: NNGRRT; PAM sequence: GAGGGT
cgcccaggtcctgtgcctgg

SEQ ID NO: 12675 - DNA, 20 bp, Artificial Sequence
  Description of Artificial Sequence: Synthetic oligonucleotide
  Target: ATXN1; (-) strand; PAM type: NNGRRT; PAM sequence: AAGGGT
gggtccttcctggggcgccc

SEQ ID NO: 12676 - DNA, 20 bp, Artificial Sequence
  Description of Artificial Sequence: Synthetic oligonucleotide
  Target: ATXN1; (-) strand; PAM type: NNGRRT; PAM sequence: GAGGGT
tctgagcatgcagagatggg

SEQ ID NO: 12677 - DNA, 20 bp, Artificial Sequence
  Description of Artificial Sequence: Synthetic oligonucleotide
  Target: ATXN1; (-) strand; PAM type: NNGRRT; PAM sequence: GTGGGT
aacccagctctgagatctga

SEQ ID NO: 12678 - DNA, 20 bp, Artificial Sequence
  Description of Artificial Sequence: Synthetic oligonucleotide
  Target: ATXN1; (-) strand; PAM type: NNGRRT; PAM sequence: CTGAGT
ccccaacccagctctgagat

SEQ ID NO: 12679 - DNA, 20 bp, Artificial Sequence
  Description of Artificial Sequence: Synthetic oligonucleotide
  Target: ATXN1; (-) strand; PAM type: NNGRRT; PAM sequence: ACGAGT
gggtggacggaagaggcacc

SEQ ID NO: 12680 - DNA, 20 bp, Artificial Sequence
  Description of Artificial Sequence: Synthetic oligonucleotide
  Target: ATXN1; (-) strand; PAM type: NNGRRT; PAM sequence: ATGGGT
caattggtccatgggtggcc

SEQ ID NO: 12681 - DNA, 20 bp, Artificial Sequence
  Description of Artificial Sequence: Synthetic oligonucleotide
  Target: ATXN1; (-) strand; PAM type: NNGRRT; PAM sequence: ATGGGT
aagtatgtgccaattggtcc

SEQ ID NO: 12682 - DNA, 20 bp, Artificial Sequence
  Description of Artificial Sequence: Synthetic oligonucleotide
  Target: ATXN1; (-) strand; PAM type: NNGRRT; PAM sequence: GAGGGT
cgtctccagctatcagcaga

SEQ ID NO: 12683 - DNA, 20 bp, Artificial Sequence
  Description of Artificial Sequence: Synthetic oligonucleotide
  Target: ATXN1; (-) strand; PAM type: NNGRRT; PAM sequence: GAGGGT
gaagcactcctcttagcaga

SEQ ID NO: 12684 - DNA, 20 bp, Artificial Sequence
  Description of Artificial Sequence: Synthetic oligonucleotide
  Target: ATXN1; (-) strand; PAM type: NNGRRT; PAM sequence: AAGGGT
agcagagaggaggccctgga

SEQ ID NO: 12685 - DNA, 20 bp, Artificial Sequence
  Description of Artificial Sequence: Synthetic oligonucleotide
  Target: ATXN1; (-) strand; PAM type: NNGRRT; PAM sequence: TTGAGT
tctataagcagatcgtccca

SEQ ID NO: 12686 - DNA, 20 bp, Artificial Sequence
  Description of Artificial Sequence: Synthetic oligonucleotide
  Target: ATXN1; (-) strand; PAM type: NNGRRT; PAM sequence: AGGAGT
ttagtgttagaacaactcgg

SEQ ID NO: 12687 - DNA, 20 bp, Artificial Sequence
  Description of Artificial Sequence: Synthetic oligonucleotide
  Target: ATXN1; (-) strand; PAM type: NNGRRT; PAM sequence: AAGAGT
acatgtgaagggtgaaaaag

SEQ ID NO: 12688 - DNA, 20 bp, Artificial Sequence
  Description of Artificial Sequence: Synthetic oligonucleotide
  Target: ATXN1; (-) strand; PAM type: NNGRRT; PAM sequence: AAGGGT
atgaggtacacagacatgtg

SEQ ID NO: 12689 - DNA, 20 bp, Artificial Sequence
  Description of Artificial Sequence: Synthetic oligonucleotide
  Target: ATXN1; (-) strand; PAM type: NNGRRT; PAM sequence: AAGAAT
gtttttgtcctgcgtccaga

SEQ ID NO: 12690 - DNA, 20 bp, Artificial Sequence
  Description of Artificial Sequence: Synthetic oligonucleotide
  Target: ATXN1; (-) strand; PAM type: NNGRRT; PAM sequence: TGGGGT
acatactgttataggatctc

SEQ ID NO: 12691 - DNA, 20 bp, Artificial Sequence
  Description of Artificial Sequence: Synthetic oligonucleotide
  Target: ATXN1; (-) strand; PAM type: NNGRRT; PAM sequence: TAGGAT
tgcgtgagaacatactgtta

SEQ ID NO: 12692 - DNA, 20 bp, Artificial Sequence
  Description of Artificial Sequence: Synthetic oligonucleotide
  Target: ATXN1; (-) strand; PAM type: NNGRRT; PAM sequence: ATGAAT
aacaggtggtgtttggttac

SEQ ID NO: 12693 - DNA, 20 bp, Artificial Sequence
  Description of Artificial Sequence: Synthetic oligonucleotide
  Target: ATXN1; (-) strand; PAM type: NNGRRT; PAM sequence: CTGGGT
agtgggcattaattcagatt

SEQ ID NO: 12694 - DNA, 20 bp, Artificial Sequence
  Description of Artificial Sequence: Synthetic oligonucleotide
  Target: ATXN1; (-) strand; PAM type: NNGRRT; PAM sequence: CTGGGT
aaaacacatttccgatgtca

SEQ ID NO: 12695 - DNA, 20 bp, Artificial Sequence
  Description of Artificial Sequence: Synthetic oligonucleotide
  Target: ATXN1; (-) strand; PAM type: NNGRRT; PAM sequence: GGGAAT
aaatttacatattgaatctt

SEQ ID NO: 12696 - DNA, 20 bp, Artificial Sequence
  Description of Artificial Sequence: Synthetic oligonucleotide
  Target: ATXN1; (-) strand; PAM type: NNGRRT; PAM sequence: TTGAAT
taataatgcaaatttacata

SEQ ID NO: 12697 - DNA, 20 bp, Artificial Sequence
  Description of Artificial Sequence: Synthetic oligonucleotide
  Target: ATXN1; (-) strand; PAM type: NNGRRT; PAM sequence: CTGAAT
aggcatgagatgttcaaatg

SEQ ID NO: 12698 - DNA, 20 bp, Artificial Sequence
  Description of Artificial Sequence: Synthetic oligonucleotide
  Target: ATXN1; (-) strand; PAM type: NNGRRT; PAM sequence: TGGAAT
aagattggctaaaggacttt

SEQ ID NO: 12699 - DNA, 20 bp, Artificial Sequence
  Description of Artificial Sequence: Synthetic oligonucleotide
  Target: ATXN1; (-) strand; PAM type: NNGRRT; PAM sequence: CTGAAT
ttataggatctcctttctca

SEQ ID NO: 12700 - DNA, 20 bp, Artificial Sequence
  Description of Artificial Sequence: Synthetic oligonucleotide
  Target: ATXN1; (-) strand; PAM type: NNGRRT; PAM sequence: TAGGAT
caacaatttgcctgacctta

SEQ ID NO: 12701 - DNA, 20 bp, Artificial Sequence
  Description of Artificial Sequence: Synthetic oligonucleotide
  Target: ATXN1; (-) strand; PAM type: NNGRRT; PAM sequence: CTGGAT
tttcttcaaacctaaagttg

SEQ ID NO: 12702 - DNA, 20 bp, Artificial Sequence
  Description of Artificial Sequence: Synthetic oligonucleotide
  Target: ATXN1; (-) strand; PAM type: NNGRRT; PAM sequence: CTGGAT
ttgtgtgtgtgttttctcca

SEQ ID NO: 12703 - DNA, 20 bp, Artificial Sequence
  Description of Artificial Sequence: Synthetic oligonucleotide
  Target: ATXN1; (-) strand; PAM type: NNGRRT; PAM sequence: CTGAAT
gataatggagacagacaggt

SEQ ID NO: 12704 - DNA, 20 bp, Artificial Sequence
  Description of Artificial Sequence: Synthetic oligonucleotide
  Target: ATXN1; (-) strand; PAM type: NNGRRT; PAM sequence: TGGGAT
gaaagaccccagtggtgtat

SEQ ID NO: 12705 - DNA, 20 bp, Artificial Sequence
  Description of Artificial Sequence: Synthetic oligonucleotide
  Target: ATXN1; (-) strand; PAM type: NNGRRT; PAM sequence: CTGAAT
gctgttctagaacccacttc

SEQ ID NO: 12706 - DNA, 20 bp, Artificial Sequence
  Description of Artificial Sequence: Synthetic oligonucleotide
  Target: ATXN1; (-) strand; PAM type: NNGRRT; PAM sequence: TAGAAT
gtccttgggagtcatttact

SEQ ID NO: 12707 - DNA, 20 bp, Artificial Sequence
  Description of Artificial Sequence: Synthetic oligonucleotide
  Target: ATXN1; (-) strand; PAM type: NNGRRT; PAM sequence: GGGAGT
gcgagctacatcttgtcctt

SEQ ID NO: 12708 - DNA, 20 bp, Artificial Sequence
  Description of Artificial Sequence: Synthetic oligonucleotide
  Target: ATXN1; (-) strand; PAM type: NNGRRT; PAM sequence: TTGGGT
tcagagacagttaaatgtct

SEQ ID NO: 12709 - DNA, 20 bp, Artificial Sequence
  Description of Artificial Sequence: Synthetic oligonucleotide
  Target: ATXN1; (-) strand; PAM type: NNGRRT; PAM sequence: ATGAAT
tcactattacccttttggct

SEQ ID NO: 12710 - DNA, 20 bp, Artificial Sequence
  Description of Artificial Sequence: Synthetic oligonucleotide
  Target: ATXN1; (-) strand; PAM type: NNGRRT; PAM sequence: CTGAAT
ctctttcacccttgttaccc

SEQ ID NO: 12711 - DNA, 20 bp, Artificial Sequence
  Description of Artificial Sequence: Synthetic oligonucleotide
  Target: ATXN1; (-) strand; PAM type: NNGRRT; PAM sequence: CAGAAT
cttgaatcctgtttcagaaa

SEQ ID NO: 12712 - DNA, 20 bp, Artificial Sequence
  Description of Artificial Sequence: Synthetic oligonucleotide
  Target: ATXN1; (-) strand; PAM type: NNGRRT; PAM sequence: TTGAAT
caaatggtacaatgtcctgc

SEQ ID NO: 12713 - DNA, 20 bp, Artificial Sequence
  Description of Artificial Sequence: Synthetic oligonucleotide
  Target: ATXN1; (-) strand; PAM type: NNGRRT; PAM sequence: ATGAAT
catgtgcgtgaacgaaaata

SEQ ID NO: 12714 - DNA, 20 bp, Artificial Sequence
  Description of Artificial Sequence: Synthetic oligonucleotide
  Target: ATXN1; (-) strand; PAM type: NNGRRT; PAM sequence: CTGAAT
catgtttgttttaaagagat

SEQ ID NO: 12715 - DNA, 20 bp, Artificial Sequence
  Description of Artificial Sequence: Synthetic oligonucleotide
  Target: ATXN1; (-) strand; PAM type: NNGRRT; PAM sequence: GGGGAT
ttcctcaaggctgtggaaaa

SEQ ID NO: 12716 - DNA, 20 bp, Artificial Sequence
  Description of Artificial Sequence: Synthetic oligonucleotide
  Target: ATXN1; (-) strand; PAM type: NNGRRT; PAM sequence: GAGAGT
aaagatctgcaagttaagtt

SEQ ID NO: 12717 - DNA, 20 bp, Artificial Sequence
  Description of Artificial Sequence: Synthetic oligonucleotide
  Target: ATXN1; (-) strand; PAM type: NNGRRT; PAM sequence: GGGAGT
agaggacagtgtaatcttct

SEQ ID NO: 12718 - DNA, 20 bp, Artificial Sequence
  Description of Artificial Sequence: Synthetic oligonucleotide
  Target: ATXN1; (-) strand; PAM type: NNGRRT; PAM sequence: GGGGAT
atctgacattaaaacaactg

SEQ ID NO: 12719 - DNA, 20 bp, Artificial Sequence
  Description of Artificial Sequence: Synthetic oligonucleotide
  Target: ATXN1; (-) strand; PAM type: NNGRRT; PAM sequence: CTGAAT
aatgagttcaagccagacaa

SEQ ID NO: 12720 - DNA, 20 bp, Artificial Sequence
  Description of Artificial Sequence: Synthetic oligonucleotide
  Target: ATXN1; (-) strand; PAM type: NNGRRT; PAM sequence: ATGAGT
caaatgtaatgattcccata

SEQ ID NO: 12721 - DNA, 20 bp, Artificial Sequence
  Description of Artificial Sequence: Synthetic oligonucleotide
  Target: ATXN1; (-) strand; PAM type: NNGRRT; PAM sequence: TAGAAT
ctacagaaacattgaccatt

SEQ ID NO: 12722 - DNA, 20 bp, Artificial Sequence
  Description of Artificial Sequence: Synthetic oligonucleotide
  Target: ATXN1; (-) strand; PAM type: NNGRRT; PAM sequence: GAGAAT
aagaaggtgaagcattttca

SEQ ID NO: 12723 - DNA, 20 bp, Artificial Sequence
  Description of Artificial Sequence: Synthetic oligonucleotide
  Target: ATXN1; (-) strand; PAM type: NNGRRT; PAM sequence: AGGAGT
acctcctagttcgctggatg

SEQ ID NO: 12724 - DNA, 20 bp, Artificial Sequence
  Description of Artificial Sequence: Synthetic oligonucleotide
  Target: ATXN1; (-) strand; PAM type: NNGRRT; PAM sequence: CTGGAT
acacagaacctcctagttcg

SEQ ID NO: 12725 - DNA, 20 bp, Artificial Sequence
  Description of Artificial Sequence: Synthetic oligonucleotide
  Target: ATXN1; (-) strand; PAM type: NNGRRT; PAM sequence: CGGAAT
agttacatgaacaccagtta

SEQ ID NO: 12726 - DNA, 20 bp, Artificial Sequence
  Description of Artificial Sequence: Synthetic oligonucleotide
  Target: ATXN1; (-) strand; PAM type: NNGRRT; PAM sequence: ACGGGT
caagaatggtctccatcgtc

SEQ ID NO: 12727 - DNA, 20 bp, Artificial Sequence
  Description of Artificial Sequence: Synthetic oligonucleotide
  Target: ATXN1; (-) strand; PAM type: NNGRRT; PAM sequence: AAGAAT
ggttaatgtgaggggaaggc

SEQ ID NO: 12728 - DNA, 20 bp, Artificial Sequence
  Description of Artificial Sequence: Synthetic oligonucleotide
  Target: ATXN1; (-) strand; PAM type: NNGRRT; PAM sequence: ATGGGT
tggaatctccctgctctgaa

SEQ ID NO: 12729 - DNA, 20 bp, Artificial Sequence
  Description of Artificial Sequence: Synthetic oligonucleotide
  Target: ATXN1; (-) strand; PAM type: NNGRRT; PAM sequence: TGGAAT
cgacacccaggtgacttctc

SEQ ID NO: 12730 - DNA, 20 bp, Artificial Sequence
  Description of Artificial Sequence: Synthetic oligonucleotide
  Target: ATXN1; (-) strand; PAM type: NNGRRT; PAM sequence: AGGAGT
gggtgggggccaggaacagg

SEQ ID NO: 12731 - DNA, 20 bp, Artificial Sequence
  Description of Artificial Sequence: Synthetic oligonucleotide
  Target: ATXN1; (-) strand; PAM type: NNGRRT; PAM sequence: GAGGGT
ggggtaactgctgagagcgg

SEQ ID NO: 12732 - DNA, 20 bp, Artificial Sequence
  Description of Artificial Sequence: Synthetic oligonucleotide
  Target: ATXN1; (-) strand; PAM type: NNGRRT; PAM sequence: GGGGGT
gaagtgatgatggtgataat

SEQ ID NO: 12733 - DNA, 20 bp, Artificial Sequence
  Description of Artificial Sequence: Synthetic oligonucleotide
  Target: ATXN1; (-) strand; PAM type: NNGRRT; PAM sequence: GGGGGT
cctttctttcactccggagc

SEQ ID NO: 12734 - DNA, 20 bp, Artificial Sequence
  Description of Artificial Sequence: Synthetic oligonucleotide
  Target: ATXN1; (-) strand; PAM type: NNGRRT; PAM sequence: AAGAAT
tgttcacattatattctgca

SEQ ID NO: 12735 - DNA, 20 bp, Artificial Sequence
  Description of Artificial Sequence: Synthetic oligonucleotide
  Target: ATXN1; (-) strand; PAM type: NNGRRT; PAM sequence: ATGAAT
aaactgaatatcacatctat

SEQ ID NO: 12736 - DNA, 20 bp, Artificial Sequence
  Description of Artificial Sequence: Synthetic oligonucleotide
  Target: ATXN1; (-) strand; PAM type: NNGRRT; PAM sequence: CTGAAT
aatgtaaacctatacataaa

SEQ ID NO: 12737 - DNA, 20 bp, Artificial Sequence
  Description of Artificial Sequence: Synthetic oligonucleotide
  Target: ATXN1; (-) strand; PAM type: NNGRRT; PAM sequence: GTGGGT
cataaaggtttgcgacatga

SEQ ID NO: 12738 - DNA, 20 bp, Artificial Sequence
  Description of Artificial Sequence: Synthetic oligonucleotide
  Target: ATXN1; (-) strand; PAM type: NNGRRT; PAM sequence: ATGAGT
actccataaaggtttgcgac

SEQ ID NO: 12739 - DNA, 20 bp, Artificial Sequence
  Description of Artificial Sequence: Synthetic oligonucleotide
  Target: ATXN1; (-) strand; PAM type: NNGRRT; PAM sequence: AAGAGT
gatggtatcatggcaactag

SEQ ID NO: 12740 - DNA, 20 bp, Artificial Sequence
  Description of Artificial Sequence: Synthetic oligonucleotide
  Target: ATXN1; (-) strand; PAM type: NNGRRT; PAM sequence: AGGGAT
ctgagaaaagtaggcagggt

SEQ ID NO: 12741 - DNA, 20 bp, Artificial Sequence
  Description of Artificial Sequence: Synthetic oligonucleotide
  Target: ATXN1; (-) strand; PAM type: NNGRRT; PAM sequence: CAGGGT
agggatctgagaaaagtagg

SEQ ID NO: 12742 - DNA, 20 bp, Artificial Sequence
  Description of Artificial Sequence: Synthetic oligonucleotide
  Target: ATXN1; (-) strand; PAM type: NNGRRT; PAM sequence: AGGGAT
tggggtgaaataacatgata

SEQ ID NO: 12743 - DNA, 20 bp, Artificial Sequence
  Description of Artificial Sequence: Synthetic oligonucleotide
  Target: ATXN1; (-) strand; PAM type: NNGRRT; PAM sequence: TGGGGT
tttttccagaaaaagtctgt

SEQ ID NO: 12744 - DNA, 20 bp, Artificial Sequence
  Description of Artificial Sequence: Synthetic oligonucleotide
  Target: ATXN1; (-) strand; PAM type: NNGRRT; PAM sequence: TAGGAT
caggcacagtgccacggcct

SEQ ID NO: 12745 - DNA, 20 bp, Artificial Sequence
  Description of Artificial Sequence: Synthetic oligonucleotide
  Target: ATXN1; (-) strand; PAM type: NNGRRT; PAM sequence: TGGAAT
tattagcatatggcacatca

SEQ ID NO: 12746 - DNA, 20 bp, Artificial Sequence
  Description of Artificial Sequence: Synthetic oligonucleotide
  Target: ATXN1; (-) strand; PAM type: NNGRRT; PAM sequence: CAGGAT
cctcagcagttattactaga

SEQ ID NO: 12747 - DNA, 20 bp, Artificial Sequence
  Description of Artificial Sequence: Synthetic oligonucleotide
  Target: ATXN1; (-) strand; PAM type: NNGRRT; PAM sequence: TGGAGT
aattttgttttgtccttcag

SEQ ID NO: 12748 - DNA, 20 bp, Artificial Sequence
  Description of Artificial Sequence: Synthetic oligonucleotide
  Target: ATXN1; (-) strand; PAM type: NNGRRT; PAM sequence: TTGAAT
tatttactcttagtggaacc

SEQ ID NO: 12749 - DNA, 20 bp, Artificial Sequence
  Description of Artificial Sequence: Synthetic oligonucleotide
  Target: ATXN1; (-) strand; PAM type: NNGRRT; PAM sequence: ACGGGT
atcaactagttttaaacggt

SEQ ID NO: 12750 - DNA, 20 bp, Artificial Sequence
  Description of Artificial Sequence: Synthetic oligonucleotide
  Target: ATXN1; (-) strand; PAM type: NNGRRT; PAM sequence: GAGAAT
ggggaagataggtgaaattg

SEQ ID NO: 12751 - DNA, 20 bp, Artificial Sequence
  Description of Artificial Sequence: Synthetic oligonucleotide
  Target: ATXN1; (-) strand; PAM type: NNGRRT; PAM sequence: GGGGAT
caatcatcttaccctttact

SEQ ID NO: 12752 - DNA, 20 bp, Artificial Sequence
  Description of Artificial Sequence: Synthetic oligonucleotide
  Target: ATXN1; (-) strand; PAM type: NNGRRT; PAM sequence: TAGAGT
tttaggttgggattttattt

SEQ ID NO: 12753 - DNA, 20 bp, Artificial Sequence
  Description of Artificial Sequence: Synthetic oligonucleotide
  Target: ATXN1; (-) strand; PAM type: NNGRRT; PAM sequence: TGGGAT
ctgactcagcaattttaggt

SEQ ID NO: 12754 - DNA, 20 bp, Artificial Sequence
  Description of Artificial Sequence: Synthetic oligonucleotide
  Target: ATXN1; (-) strand; PAM type: NNGRRT; PAM sequence: ATGGAT
atttctagagccagcggaac

SEQ ID NO: 12755 - DNA, 20 bp, Artificial Sequence
  Description of Artificial Sequence: Synthetic oligonucleotide
  Target: ATXN1; (-) strand; PAM type: NNGRRT; PAM sequence: CAGGGT
ggggtccttaaggcatcatt

SEQ ID NO: 12756 - DNA, 20 bp, Artificial Sequence
  Description of Artificial Sequence: Synthetic oligonucleotide
  Target: ATXN1; (-) strand; PAM type: NNGRRT; PAM sequence: GGGGGT
agtgtaatgaaaatacagtg

SEQ ID NO: 12757 - DNA, 20 bp, Artificial Sequence
  Description of Artificial Sequence: Synthetic oligonucleotide
  Target: ATXN1; (-) strand; PAM type: NNGRRT; PAM sequence: CAGAGT
gtaaatgaggtgctctgaat

SEQ ID NO: 12758 - DNA, 20 bp, Artificial Sequence
  Description of Artificial Sequence: Synthetic oligonucleotide
  Target: ATXN1; (-) strand; PAM type: NNGRRT; PAM sequence: CTGAAT
ttttctgtaaatgaggtgct

SEQ ID NO: 12759 - DNA, 20 bp, Artificial Sequence
  Description of Artificial Sequence: Synthetic oligonucleotide
  Target: ATXN1; (-) strand; PAM type: NNGRRT; PAM sequence: GGGAAT
aattcaggcaattcagtttg

SEQ ID NO: 12760 - DNA, 20 bp, Artificial Sequence
  Description of Artificial Sequence: Synthetic oligonucleotide
  Target: ATXN1; (-) strand; PAM type: NNGRRT; PAM sequence: GAGAAT
tactcgggaggctgaggcag

SEQ ID NO: 12761 - DNA, 20 bp, Artificial Sequence
  Description of Artificial Sequence: Synthetic oligonucleotide
  Target: ATXN1; (-) strand; PAM type: NNGRRT; PAM sequence: GCGGGT
aaaattagccaggcgtggtg

SEQ ID NO: 12762 - DNA, 20 bp, Artificial Sequence
  Description of Artificial Sequence: Synthetic oligonucleotide
  Target: ATXN1; (-) strand; PAM type: NNGRRT; PAM sequence: CTGGGT
ctcaaaatatctagaactgg

SEQ ID NO: 12763 - DNA, 20 bp, Artificial Sequence
  Description of Artificial Sequence: Synthetic oligonucleotide
  Target: ATXN1; (-) strand; PAM type: NNGRRT; PAM sequence: CTGGGT
ctttctattgggctcaatgc

SEQ ID NO: 12764 - DNA, 20 bp, Artificial Sequence
  Description of Artificial Sequence: Synthetic oligonucleotide
  Target: ATXN1; (-) strand; PAM type: NNGRRT; PAM sequence: ATGAAT
ttaaggagactgtgacattc

SEQ ID NO: 12765 - DNA, 20 bp, Artificial Sequence
  Description of Artificial Sequence: Synthetic oligonucleotide
  Target: ATXN1; (-) strand; PAM type: NNGRRT; PAM sequence: TGGGGT
ccctgaacagtttaataaaa

SEQ ID NO: 12766 - DNA, 20 bp, Artificial Sequence
  Description of Artificial Sequence: Synthetic oligonucleotide
  Target: ATXN1; (-) strand; PAM type: NNGRRT; PAM sequence: GTGGAT
atgttgaataatctgaacga

SEQ ID NO: 12767 - DNA, 20 bp, Artificial Sequence
  Description of Artificial Sequence: Synthetic oligonucleotide
  Target: ATXN1; (-) strand; PAM type: NNGRRT; PAM sequence: ACGAGT
gtaaatgttgaataatctga

SEQ ID NO: 12768 - DNA, 20 bp, Artificial Sequence
  Description of Artificial Sequence: Synthetic oligonucleotide
  Target: ATXN1; (-) strand; PAM type: NNGRRT; PAM sequence: TTGAAT
atgtgcctggcacgtaaatg

SEQ ID NO: 12769 - DNA, 20 bp, Artificial Sequence
  Description of Artificial Sequence: Synthetic oligonucleotide
  Target: ATXN1; (-) strand; PAM type: NNGRRT; PAM sequence: CTGGGT
acttttgctggttgtctctc

SEQ ID NO: 12770 - DNA, 20 bp, Artificial Sequence
  Description of Artificial Sequence: Synthetic oligonucleotide
  Target: ATXN1; (-) strand; PAM type: NNGRRT; PAM sequence: CAGAGT
ctgcactccagcctgggcaa

SEQ ID NO: 12771 - DNA, 20 bp, Artificial Sequence
  Description of Artificial Sequence: Synthetic oligonucleotide
  Target: ATXN1; (-) strand; PAM type: NNGRRT; PAM sequence: AAGAAT
tactcaggaggctgaggcag

SEQ ID NO: 12772 - DNA, 20 bp, Artificial Sequence
  Description of Artificial Sequence: Synthetic oligonucleotide
  Target: ATXN1; (-) strand; PAM type: NNGRRT; PAM sequence: AGGAGT
tgggtggatcacctgaggtc

SEQ ID NO: 12773 - DNA, 20 bp, Artificial Sequence
  Description of Artificial Sequence: Synthetic oligonucleotide
  Target: ATXN1; (-) strand; PAM type: NNGRRT; PAM sequence: GTGGAT
actttgggaggccaatgtgg

SEQ ID NO: 12774 - DNA, 20 bp, Artificial Sequence
  Description of Artificial Sequence: Synthetic oligonucleotide
  Target: ATXN1; (-) strand; PAM type: NNGRRT; PAM sequence: GTGGGT
cagcactttgggaggccaat

SEQ ID NO: 12775 - DNA, 20 bp, Artificial Sequence
  Description of Artificial Sequence: Synthetic oligonucleotide
  Target: ATXN1; (-) strand; PAM type: NNGRRT; PAM sequence: TTGAAT
gttaagcccccaaatgtcat

SEQ ID NO: 12776 - DNA, 20 bp, Artificial Sequence
  Description of Artificial Sequence: Synthetic oligonucleotide
  Target: ATXN1; (-) strand; PAM type: NNGRRT; PAM sequence: AGGGGT
gacacatctggctaaagcca

SEQ ID NO: 12777 - DNA, 20 bp, Artificial Sequence
  Description of Artificial Sequence: Synthetic oligonucleotide
  Target: ATXN1; (-) strand; PAM type: NNGRRT; PAM sequence: CTGAAT
gcttgtaaacagttttggga

SEQ ID NO: 12778 - DNA, 20 bp, Artificial Sequence
  Description of Artificial Sequence: Synthetic oligonucleotide
  Target: ATXN1; (-) strand; PAM type: NNGRRT; PAM sequence: TTGGGT
atgaggtcattacaggttgt

SEQ ID NO: 12779 - DNA, 20 bp, Artificial Sequence
  Description of Artificial Sequence: Synthetic oligonucleotide
  Target: ATXN1; (-) strand; PAM type: NNGRRT; PAM sequence: CTGAAT
ctatatagatatataggact

SEQ ID NO: 12780 - DNA, 20 bp, Artificial Sequence
  Description of Artificial Sequence: Synthetic oligonucleotide
  Target: ATXN1; (-) strand; PAM type: NNGRRT; PAM sequence: GGGGAT
aattttacaatagtagatat

SEQ ID NO: 12781 - DNA, 20 bp, Artificial Sequence
  Description of Artificial Sequence: Synthetic oligonucleotide
  Target: ATXN1; (-) strand; PAM type: NNGRRT; PAM sequence: ATGAGT
gatgctgagaagagatcaga

SEQ ID NO: 12782 - DNA, 20 bp, Artificial Sequence
  Description of Artificial Sequence: Synthetic oligonucleotide
  Target: ATXN1; (-) strand; PAM type: NNGRRT; PAM sequence: CAGAAT
ctctgatgctgagaagagat

SEQ ID NO: 12783 - DNA, 20 bp, Artificial Sequence
  Description of Artificial Sequence: Synthetic oligonucleotide
  Target: ATXN1; (-) strand; PAM type: NNGRRT; PAM sequence: CTGGGT
ttctgaattaatgtggtatt

SEQ ID NO: 12784 - DNA, 20 bp, Artificial Sequence
  Description of Artificial Sequence: Synthetic oligonucleotide
  Target: ATXN1; (-) strand; PAM type: NNGRRT; PAM sequence: CTGAAT
agttagctaggtggcaggtt

SEQ ID NO: 12785 - DNA, 20 bp, Artificial Sequence
  Description of Artificial Sequence: Synthetic oligonucleotide
  Target: ATXN1; (-) strand; PAM type: NNGRRT; PAM sequence: TAGGGT
gttgcaaaggggtcagcgga

SEQ ID NO: 12786 - DNA, 20 bp, Artificial Sequence
  Description of Artificial Sequence: Synthetic oligonucleotide
  Target: ATXN1; (-) strand; PAM type: NNGRRT; PAM sequence: GCGGAT
tgattgttgcaaaggggtca

SEQ ID NO: 12787 - DNA, 20 bp, Artificial Sequence
  Description of Artificial Sequence: Synthetic oligonucleotide
  Target: ATXN1; (-) strand; PAM type: NNGRRT; PAM sequence: AGGGGT
cctgcttctgattgttgcaa

SEQ ID NO: 12788 - DNA, 20 bp, Artificial Sequence
  Description of Artificial Sequence: Synthetic oligonucleotide
  Target: ATXN1; (-) strand; PAM type: NNGRRT; PAM sequence: TGGGAT
gcctcggcctcccaaagtgc

SEQ ID NO: 12789 - DNA, 20 bp, Artificial Sequence
  Description of Artificial Sequence: Synthetic oligonucleotide
  Target: ATXN1; (-) strand; PAM type: NNGRRT; PAM sequence: AGGGGT
ttttgtatttttaatagaga

SEQ ID NO: 12790 - DNA, 20 bp, Artificial Sequence
  Description of Artificial Sequence: Synthetic oligonucleotide
  Target: ATXN1; (-) strand; PAM type: NNGRRT; PAM sequence: TGGGAT
gtctcagcctcccgagtagc

SEQ ID NO: 12791 - DNA, 20 bp, Artificial Sequence
  Description of Artificial Sequence: Synthetic oligonucleotide
  Target: ATXN1; (-) strand; PAM type: NNGRRT; PAM sequence: CCGAGT
gattctcctgtctcagcctc

SEQ ID NO: 12792 - DNA, 20 bp, Artificial Sequence
  Description of Artificial Sequence: Synthetic oligonucleotide
  Target: ATXN1; (-) strand; PAM type: NNGRRT; PAM sequence: CCGGGT
ctcactgcaacctccacctc

SEQ ID NO: 12793 - DNA, 20 bp, Artificial Sequence
  Description of Artificial Sequence: Synthetic oligonucleotide
  Target: ATXN1; (-) strand; PAM type: NNGRRT; PAM sequence: TGGAGT
tctcactctgtcacccaggc

SEQ ID NO: 12794 - DNA, 20 bp, Artificial Sequence
  Description of Artificial Sequence: Synthetic oligonucleotide
  Target: ATXN1; (-) strand; PAM type: NNGRRT; PAM sequence: CAGAGT
ctttttttttttttttcaga

SEQ ID NO: 12795 - DNA, 20 bp, Artificial Sequence
  Description of Artificial Sequence: Synthetic oligonucleotide
  Target: ATXN1; (-) strand; PAM type: NNGRRT; PAM sequence: GTGGGT
tttttgtgaacatgtaacat

SEQ ID NO: 12796 - DNA, 20 bp, Artificial Sequence
  Description of Artificial Sequence: Synthetic oligonucleotide
  Target: ATXN1; (-) strand; PAM type: NNGRRT; PAM sequence: TTGGAT
attctgggtcagaaccccca

SEQ ID NO: 12797 - DNA, 20 bp, Artificial Sequence
  Description of Artificial Sequence: Synthetic oligonucleotide
  Target: ATXN1; (-) strand; PAM type: NNGRRT; PAM sequence: CTGGGT
aaaaccaggactttaatatt

SEQ ID NO: 12798 - DNA, 20 bp, Artificial Sequence
  Description of Artificial Sequence: Synthetic oligonucleotide
  Target: ATXN1; (-) strand; PAM type: NNGRRT; PAM sequence: CAGGGT
acaggggaggaaacttcccc

SEQ ID NO: 12799 - DNA, 20 bp, Artificial Sequence
  Description of Artificial Sequence: Synthetic oligonucleotide
  Target: ATXN1; (-) strand; PAM type: NNGRRT; PAM sequence: TTGAAT
tgctaataacagcagcacta

SEQ ID NO: 12800 - DNA, 20 bp, Artificial Sequence
  Description of Artificial Sequence: Synthetic oligonucleotide
  Target: ATXN1; (-) strand; PAM type: NNGRRT; PAM sequence: TCGGGT
agacttgtatgcaaggttac

SEQ ID NO: 12801 - DNA, 20 bp, Artificial Sequence
  Description of Artificial Sequence: Synthetic oligonucleotide
  Target: ATXN1; (-) strand; PAM type: NNGRRT; PAM sequence: CTGAAT
aatcttggctgcaagatgtg

SEQ ID NO: 12802 - DNA, 20 bp, Artificial Sequence
  Description of Artificial Sequence: Synthetic oligonucleotide
  Target: ATXN1; (-) strand; PAM type: NNGRRT; PAM sequence: CAGAAT
gagagagagagagagagaaa

SEQ ID NO: 12803 - DNA, 20 bp, Artificial Sequence
  Description of Artificial Sequence: Synthetic oligonucleotide
  Target: ATXN1; (-) strand; PAM type: NNGRRT; PAM sequence: CAGAAT
ttgtatttccaggcataggt

SEQ ID NO: 12804 - DNA, 20 bp, Artificial Sequence
  Description of Artificial Sequence: Synthetic oligonucleotide
  Target: ATXN1; (-) strand; PAM type: NNGRRT; PAM sequence: TAGGAT
ctctcccctttatctagact

SEQ ID NO: 12805 - DNA, 20 bp, Artificial Sequence
  Description of Artificial Sequence: Synthetic oligonucleotide
  Target: ATXN1; (-) strand; PAM type: NNGRRT; PAM sequence: CTGGGT
caatcgagtctgaatgtgtg

SEQ ID NO: 12806 - DNA, 20 bp, Artificial Sequence
  Description of Artificial Sequence: Synthetic oligonucleotide
  Target: ATXN1; (-) strand; PAM type: NNGRRT; PAM sequence: CTGAAT
tttgacctatacaatcgagt

SEQ ID NO: 12807 - DNA, 20 bp, Artificial Sequence
  Description of Artificial Sequence: Synthetic oligonucleotide
  Target: ATXN1; (-) strand; PAM type: NNGRRT; PAM sequence: TCGAGT
ggaaaatttgacctatacaa

SEQ ID NO: 12808 - DNA, 20 bp, Artificial Sequence
  Description of Artificial Sequence: Synthetic oligonucleotide
  Target: ATXN1; (-) strand; PAM type: NNGRRT; PAM sequence: TGGGGT
aaagaaggaaagtgggatat

SEQ ID NO: 12809 - DNA, 20 bp, Artificial Sequence
  Description of Artificial Sequence: Synthetic oligonucleotide
  Target: ATXN1; (-) strand; PAM type: NNGRRT; PAM sequence: TGGGAT
tctaaggaaaagaaggaaag

SEQ ID NO: 12810 - DNA, 20 bp, Artificial Sequence
  Description of Artificial Sequence: Synthetic oligonucleotide
  Target: ATXN1; (-) strand; PAM type: NNGRRT; PAM sequence: AAGAAT
tttgtttacttcatgtcaac

SEQ ID NO: 12811 - DNA, 20 bp, Artificial Sequence
  Description of Artificial Sequence: Synthetic oligonucleotide
  Target: ATXN1; (-) strand; PAM type: NNGRRT; PAM sequence: CAGGGT
tatgtattttttagtagaga

SEQ ID NO: 12812 - DNA, 20 bp, Artificial Sequence
  Description of Artificial Sequence: Synthetic oligonucleotide
  Target: ATXN1; (-) strand; PAM type: NNGRRT; PAM sequence: CCGAGT
aattgtcctgcctcaggctc

SEQ ID NO: 12813 - DNA, 20 bp, Artificial Sequence
  Description of Artificial Sequence: Synthetic oligonucleotide
  Target: ATXN1; (-) strand; PAM type: NNGRRT; PAM sequence: TTGGGT
ctcactgcaacctcttcctc

SEQ ID NO: 12814 - DNA, 20 bp, Artificial Sequence
  Description of Artificial Sequence: Synthetic oligonucleotide
  Target: ATXN1; (-) strand; PAM type: NNGRRT; PAM sequence: TGGAGT
tcttgctctgtctcccaggc

SEQ ID NO: 12815 - DNA, 20 bp, Artificial Sequence
  Description of Artificial Sequence: Synthetic oligonucleotide
  Target: ATXN1; (-) strand; PAM type: NNGRRT; PAM sequence: CAGGGT
gttttgagaggtaagcagtc

SEQ ID NO: 12816 - DNA, 20 bp, Artificial Sequence
  Description of Artificial Sequence: Synthetic oligonucleotide
  Target: ATXN1; (-) strand; PAM type: NNGRRT; PAM sequence: TAGGAT
taaggtctatttgtaacagt

SEQ ID NO: 12817 - DNA, 20 bp, Artificial Sequence
  Description of Artificial Sequence: Synthetic oligonucleotide
  Target: ATXN1; (-) strand; PAM type: NNGRRT; PAM sequence: TGGGAT
ttccttgaatatgtgtgact

SEQ ID NO: 12818 - DNA, 20 bp, Artificial Sequence
  Description of Artificial Sequence: Synthetic oligonucleotide
  Target: ATXN1; (-) strand; PAM type: NNGRRT; PAM sequence: TTGAAT
attatttaatagcttattcc

SEQ ID NO: 12819 - DNA, 20 bp, Artificial Sequence
  Description of Artificial Sequence: Synthetic oligonucleotide
  Target: ATXN1; (-) strand; PAM type: NNGRRT; PAM sequence: TGGAAT
aagatgcagattaagacatg

SEQ ID NO: 12820 - DNA, 20 bp, Artificial Sequence
  Description of Artificial Sequence: Synthetic oligonucleotide
  Target: ATXN1; (-) strand; PAM type: NNGRRT; PAM sequence: AGGGAT
attattctgtaaaagcatcc

SEQ ID NO: 12821 - DNA, 20 bp, Artificial Sequence
  Description of Artificial Sequence: Synthetic oligonucleotide
  Target: ATXN1; (-) strand; PAM type: NNGRRT; PAM sequence: GAGAGT
agcaatatccattagtttca

SEQ ID NO: 12822 - DNA, 20 bp, Artificial Sequence
  Description of Artificial Sequence: Synthetic oligonucleotide
  Target: ATXN1; (-) strand; PAM type: NNGRRT; PAM sequence: GTGAGT
ccattaattgaatttaataa

SEQ ID NO: 12823 - DNA, 20 bp, Artificial Sequence
  Description of Artificial Sequence: Synthetic oligonucleotide
  Target: ATXN1; (-) strand; PAM type: NNGRRT; PAM sequence: TTGAAT
aatttattggtccccattaa

SEQ ID NO: 12824 - DNA, 20 bp, Artificial Sequence
  Description of Artificial Sequence: Synthetic oligonucleotide
  Target: ATXN1; (-) strand; PAM type: NNGRRT; PAM sequence: GGGAGT
atggctagtgcatgatttgt

SEQ ID NO: 12825 - DNA, 20 bp, Artificial Sequence
  Description of Artificial Sequence: Synthetic oligonucleotide
  Target: ATXN1; (-) strand; PAM type: NNGRRT; PAM sequence: AGGAGT
tatttagaaagcaacaagag

SEQ ID NO: 12826 - DNA, 20 bp, Artificial Sequence
  Description of Artificial Sequence: Synthetic oligonucleotide
  Target: ATXN1; (-) strand; PAM type: NNGRRT; PAM sequence: TTGGAT
cctccaggatcattttccat

SEQ ID NO: 12827 - DNA, 20 bp, Artificial Sequence
  Description of Artificial Sequence: Synthetic oligonucleotide
  Target: ATXN1; (-) strand; PAM type: NNGRRT; PAM sequence: CAGGAT
ccacatactgcccattcctc

SEQ ID NO: 12828 - DNA, 20 bp, Artificial Sequence
  Description of Artificial Sequence: Synthetic oligonucleotide
  Target: ATXN1; (-) strand; PAM type: NNGRRT; PAM sequence: TAGAAT
ctgtgtgggttggagactag

SEQ ID NO: 12829 - DNA, 20 bp, Artificial Sequence
  Description of Artificial Sequence: Synthetic oligonucleotide
  Target: ATXN1; (-) strand; PAM type: NNGRRT; PAM sequence: GTGGGT
tatcgggtttctttgtctgt

SEQ ID NO: 12830 - DNA, 20 bp, Artificial Sequence
  Description of Artificial Sequence: Synthetic oligonucleotide
  Target: ATXN1; (-) strand; PAM type: NNGRRT; PAM sequence: TCGGGT
ggaagaacctctgttggata

SEQ ID NO: 12831 - DNA, 20 bp, Artificial Sequence
  Description of Artificial Sequence: Synthetic oligonucleotide
  Target: ATXN1; (-) strand; PAM type: NNGRRT; PAM sequence: TTGGAT
gaaggagggaagaacctctg

SEQ ID NO: 12832 - DNA, 20 bp, Artificial Sequence
  Description of Artificial Sequence: Synthetic oligonucleotide
  Target: ATXN1; (-) strand; PAM type: NNGRRT; PAM sequence: GTGGGT
gatcaggtttattcatccat

SEQ ID NO: 12833 - DNA, 20 bp, Artificial Sequence
  Description of Artificial Sequence: Synthetic oligonucleotide
  Target: ATXN1; (-) strand; PAM type: NNGRRT; PAM sequence: AAGGAT
tagcgtatttctttatctga

SEQ ID NO: 12834 - DNA, 20 bp, Artificial Sequence
  Description of Artificial Sequence: Synthetic oligonucleotide
  Target: ATXN1; (-) strand; PAM type: NNGRRT; PAM sequence: CAGAGT
gcatgagtaaaaatttattg

SEQ ID NO: 12835 - DNA, 20 bp, Artificial Sequence
  Description of Artificial Sequence: Synthetic oligonucleotide
  Target: ATXN1; (-) strand; PAM type: NNGRRT; PAM sequence: ATGAGT
tgtccatgggcatttaccgc

SEQ ID NO: 12836 - DNA, 20 bp, Artificial Sequence
  Description of Artificial Sequence: Synthetic oligonucleotide
  Target: ATXN1; (-) strand; PAM type: NNGRRT; PAM sequence: ACGGGT
ttaccaggagccaagagcga

SEQ ID NO: 12837 - DNA, 20 bp, Artificial Sequence
  Description of Artificial Sequence: Synthetic oligonucleotide
  Target: ATXN1; (-) strand; PAM type: NNGRRT; PAM sequence: TTGGAT
agctagcatttaagtagatg

SEQ ID NO: 12838 - DNA, 20 bp, Artificial Sequence
  Description of Artificial Sequence: Synthetic oligonucleotide
  Target: ATXN1; (-) strand; PAM type: NNGRRT; PAM sequence: GAGAGT
ggtggaatgaaataaagaag

SEQ ID NO: 12839 - DNA, 20 bp, Artificial Sequence
  Description of Artificial Sequence: Synthetic oligonucleotide
  Target: ATXN1; (-) strand; PAM type: NNGRRT; PAM sequence: TGGAAT
aagtcagggttcagtcctgg

SEQ ID NO: 12840 - DNA, 20 bp, Artificial Sequence
  Description of Artificial Sequence: Synthetic oligonucleotide
  Target: ATXN1; (-) strand; PAM type: NNGRRT; PAM sequence: CAGGGT
caaggcaaatagtcccaagt

SEQ ID NO: 12841 - DNA, 20 bp, Artificial Sequence
  Description of Artificial Sequence: Synthetic oligonucleotide
  Target: ATXN1; (-) strand; PAM type: NNGRRT; PAM sequence: AAGAGT
ctgctttaccctccagcatg

SEQ ID NO: 12842 - DNA, 20 bp, Artificial Sequence
  Description of Artificial Sequence: Synthetic oligonucleotide
  Target: ATXN1; (-) strand; PAM type: NNGRRT; PAM sequence: CAGGAT
ttcatgatatccacctcatg

SEQ ID NO: 12843 - DNA, 20 bp, Artificial Sequence
  Description of Artificial Sequence: Synthetic oligonucleotide
  Target: ATXN1; (-) strand; PAM type: NNGRRT; PAM sequence: CGGGGT
gcagccctgccaggctctgt

SEQ ID NO: 12844 - DNA, 20 bp, Artificial Sequence
  Description of Artificial Sequence: Synthetic oligonucleotide
  Target: ATXN1; (-) strand; PAM type: NNGRRT; PAM sequence: CAGGGT
agaacaattcctctcaactc

SEQ ID NO: 12845 - DNA, 20 bp, Artificial Sequence
  Description of Artificial Sequence: Synthetic oligonucleotide
  Target: ATXN1; (-) strand; PAM type: NNGRRT; PAM sequence: GGGGGT
atttttgaaatatgtccggc

SEQ ID NO: 12846 - DNA, 20 bp, Artificial Sequence
  Description of Artificial Sequence: Synthetic oligonucleotide
  Target: ATXN1; (-) strand; PAM type: NNGRRT; PAM sequence: GTGGAT
atacaatcaaaatgtaaata

SEQ ID NO: 12847 - DNA, 20 bp, Artificial Sequence
  Description of Artificial Sequence: Synthetic oligonucleotide
  Target: ATXN1; (-) strand; PAM type: NNGRRT; PAM sequence: CAGAAT
ctgattcaaaattatatatt

SEQ ID NO: 12848 - DNA, 20 bp, Artificial Sequence
  Description of Artificial Sequence: Synthetic oligonucleotide
  Target: ATXN1; (-) strand; PAM type: NNGRRT; PAM sequence: TTGGAT
ttaccatttgccaagtgctt

SEQ ID NO: 12849 - DNA, 20 bp, Artificial Sequence
  Description of Artificial Sequence: Synthetic oligonucleotide
  Target: ATXN1; (-) strand; PAM type: NNGRRT; PAM sequence: TAGAAT
gacatcccaggcatggctcc

SEQ ID NO: 12850 - DNA, 20 bp, Artificial Sequence
  Description of Artificial Sequence: Synthetic oligonucleotide
  Target: ATXN1; (-) strand; PAM type: NNGRRT; PAM sequence: TGGAAT
caaattgagcccatctctac

SEQ ID NO: 12851 - DNA, 20 bp, Artificial Sequence
  Description of Artificial Sequence: Synthetic oligonucleotide
  Target: ATXN1; (-) strand; PAM type: NNGRRT; PAM sequence: GTGAGT
taacaaaatatttgtgtgta

SEQ ID NO: 12852 - DNA, 20 bp, Artificial Sequence
  Description of Artificial Sequence: Synthetic oligonucleotide
  Target: ATXN1; (-) strand; PAM type: NNGRRT; PAM sequence: GAGGAT
tactcaggaagctgagatgg

SEQ ID NO: 12853 - DNA, 20 bp, Artificial Sequence
  Description of Artificial Sequence: Synthetic oligonucleotide
  Target: ATXN1; (-) strand; PAM type: NNGRRT; PAM sequence: CAGGAT
gcaggaggatcacttgagcc

SEQ ID NO: 12854 - DNA, 20 bp, Artificial Sequence
  Description of Artificial Sequence: Synthetic oligonucleotide
  Target: ATXN1; (-) strand; PAM type: NNGRRT; PAM sequence: GAGGAT
actttgggaggctaaggcag

SEQ ID NO: 12855 - DNA, 20 bp, Artificial Sequence
  Description of Artificial Sequence: Synthetic oligonucleotide
  Target: ATXN1; (-) strand; PAM type: NNGRRT; PAM sequence: TGGGAT
ctgtgacctctgtagacatt

SEQ ID NO: 12856 - DNA, 20 bp, Artificial Sequence
  Description of Artificial Sequence: Synthetic oligonucleotide
  Target: ATXN1; (-) strand; PAM type: NNGRRT; PAM sequence: CTGGGT
tttattgactctggcttgcc

SEQ ID NO: 12857 - DNA, 20 bp, Artificial Sequence
  Description of Artificial Sequence: Synthetic oligonucleotide
  Target: ATXN1; (-) strand; PAM type: NNGRRT; PAM sequence: TTGGAT
ttttataaaagaaaaataga

SEQ ID NO: 12858 - DNA, 20 bp, Artificial Sequence
  Description of Artificial Sequence: Synthetic oligonucleotide
  Target: ATXN1; (-) strand; PAM type: NNGRRT; PAM sequence: AAGGAT
tggtgagaccaagggcacag

SEQ ID NO: 12859 - DNA, 20 bp, Artificial Sequence
  Description of Artificial Sequence: Synthetic oligonucleotide
  Target: ATXN1; (-) strand; PAM type: NNGRRT; PAM sequence: CTGGGT
tctttcttattggtctggcc

SEQ ID NO: 12860 - DNA, 20 bp, Artificial Sequence
  Description of Artificial Sequence: Synthetic oligonucleotide
  Target: ATXN1; (-) strand; PAM type: NNGRRT; PAM sequence: TGGAGT
ggttggggctgagcatggga

SEQ ID NO: 12861 - DNA, 20 bp, Artificial Sequence
  Description of Artificial Sequence: Synthetic oligonucleotide
  Target: ATXN1; (-) strand; PAM type: NNGRRT; PAM sequence: TGGGAT
ggcatggttggggctgagca

SEQ ID NO: 12862 - DNA, 20 bp, Artificial Sequence
  Description of Artificial Sequence: Synthetic oligonucleotide
  Target: ATXN1; (-) strand; PAM type: NNGRRT; PAM sequence: TGGAAT
tattgccaaccattaccaaa

SEQ ID NO: 12863 - DNA, 20 bp, Artificial Sequence
  Description of Artificial Sequence: Synthetic oligonucleotide
  Target: ATXN1; (-) strand; PAM type: NNGRRT; PAM sequence: TTGGAT
gcctcagactcccaaagagc

SEQ ID NO: 12864 - DNA, 20 bp, Artificial Sequence
  Description of Artificial Sequence: Synthetic oligonucleotide
  Target: ATXN1; (-) strand; PAM type: NNGRRT; PAM sequence: CTGGGT
tttgtagagatgagttctca

SEQ ID NO: 12865 - DNA, 20 bp, Artificial Sequence
  Description of Artificial Sequence: Synthetic oligonucleotide
  Target: ATXN1; (-) strand; PAM type: NNGRRT; PAM sequence: ATGAGT
tttaccttttttttgtagag

SEQ ID NO: 12866 - DNA, 20 bp, Artificial Sequence
  Description of Artificial Sequence: Synthetic oligonucleotide
  Target: ATXN1; (-) strand; PAM type: NNGRRT; PAM sequence: TGGAGT
gtctcactttgctgtccagc

SEQ ID NO: 12867 - DNA, 20 bp, Artificial Sequence
  Description of Artificial Sequence: Synthetic oligonucleotide
  Target: ATXN1; (-) strand; PAM type: NNGRRT; PAM sequence: TGGAGT
atccccagaaacctcctcca

SEQ ID NO: 12868 - DNA, 20 bp, Artificial Sequence
  Description of Artificial Sequence: Synthetic oligonucleotide
  Target: ATXN1; (-) strand; PAM type: NNGRRT; PAM sequence: ATGAGT
ttcagactttcaggaataga

SEQ ID NO: 12869 - DNA, 20 bp, Artificial Sequence
  Description of Artificial Sequence: Synthetic oligonucleotide
  Target: ATXN1; (-) strand; PAM type: NNGRRT; PAM sequence: TAGAAT
tggtttcagactttcaggaa

SEQ ID NO: 12870 - DNA, 20 bp, Artificial Sequence
  Description of Artificial Sequence: Synthetic oligonucleotide
  Target: ATXN1; (-) strand; PAM type: NNGRRT; PAM sequence: AGGAAT
actgatggtttcagactttc

SEQ ID NO: 12871 - DNA, 20 bp, Artificial Sequence
  Description of Artificial Sequence: Synthetic oligonucleotide
  Target: ATXN1; (-) strand; PAM type: NNGRRT; PAM sequence: AAGAAT
cattgaaccataatcaatgt

SEQ ID NO: 12872 - DNA, 20 bp, Artificial Sequence
  Description of Artificial Sequence: Synthetic oligonucleotide
  Target: ATXN1; (-) strand; PAM type: NNGRRT; PAM sequence: ATGGAT
taagacccaaacaagaaatt

SEQ ID NO: 12873 - DNA, 20 bp, Artificial Sequence
  Description of Artificial Sequence: Synthetic oligonucleotide
  Target: ATXN1; (-) strand; PAM type: NNGRRT; PAM sequence: CTGAAT
agactggcccctggagtggc

SEQ ID NO: 12874 - DNA, 20 bp, Artificial Sequence
  Description of Artificial Sequence: Synthetic oligonucleotide
  Target: ATXN1; (-) strand; PAM type: NNGRRT; PAM sequence: TGGAGT
atggcttccagactggcccc

SEQ ID NO: 12875 - DNA, 20 bp, Artificial Sequence
  Description of Artificial Sequence: Synthetic oligonucleotide
  Target: ATXN1; (-) strand; PAM type: NNGRRT; PAM sequence: TTGGGT
gctacgattcaggatgacac

SEQ ID NO: 12876 - DNA, 20 bp, Artificial Sequence
  Description of Artificial Sequence: Synthetic oligonucleotide
  Target: ATXN1; (-) strand; PAM type: NNGRRT; PAM sequence: CAGGAT
gaattgtgggagctacgatt

SEQ ID NO: 12877 - DNA, 20 bp, Artificial Sequence
  Description of Artificial Sequence: Synthetic oligonucleotide
  Target: ATXN1; (-) strand; PAM type: NNGRRT; PAM sequence: GGGAAT
aggtccctcctacaatatgt

SEQ ID NO: 12878 - DNA, 20 bp, Artificial Sequence
  Description of Artificial Sequence: Synthetic oligonucleotide
  Target: ATXN1; (-) strand; PAM type: NNGRRT; PAM sequence: TTGGGT
agaggagaaacaggtctaat

SEQ ID NO: 12879 - DNA, 20 bp, Artificial Sequence
  Description of Artificial Sequence: Synthetic oligonucleotide
  Target: ATXN1; (-) strand; PAM type: NNGRRT; PAM sequence: CAGAGT
cagcaataggaaaagcatta

SEQ ID NO: 12880 - DNA, 20 bp, Artificial Sequence
  Description of Artificial Sequence: Synthetic oligonucleotide
  Target: ATXN1; (-) strand; PAM type: NNGRRT; PAM sequence: TAGAGT
ttgagtgattactacatttt

SEQ ID NO: 12881 - DNA, 20 bp, Artificial Sequence
  Description of Artificial Sequence: Synthetic oligonucleotide
  Target: ATXN1; (-) strand; PAM type: NNGRRT; PAM sequence: TTGAGT
agcagatgctaaggatttta

SEQ ID NO: 12882 - DNA, 20 bp, Artificial Sequence
  Description of Artificial Sequence: Synthetic oligonucleotide
  Target: ATXN1; (-) strand; PAM type: NNGRRT; PAM sequence: AAGGAT
cgaggtatatagcagatgct

SEQ ID NO: 12883 - DNA, 20 bp, Artificial Sequence
  Description of Artificial Sequence: Synthetic oligonucleotide
  Target: ATXN1; (-) strand; PAM type: NNGRRT; PAM sequence: CAGGGT
gattgtaagttcctttttag

SEQ ID NO: 12884 - DNA, 20 bp, Artificial Sequence
  Description of Artificial Sequence: Synthetic oligonucleotide
  Target: ATXN1; (-) strand; PAM type: NNGRRT; PAM sequence: CTGGAT
gtgggctttatttcttcaag

SEQ ID NO: 12885 - DNA, 20 bp, Artificial Sequence
  Description of Artificial Sequence: Synthetic oligonucleotide
  Target: ATXN1; (-) strand; PAM type: NNGRRT; PAM sequence: CTGAAT
ttttcaatttttgcacttaa

SEQ ID NO: 12886 - DNA, 20 bp, Artificial Sequence
  Description of Artificial Sequence: Synthetic oligonucleotide
  Target: ATXN1; (-) strand; PAM type: NNGRRT; PAM sequence: AAGGAT
atttataggttgttaaatta

SEQ ID NO: 12887 - DNA, 20 bp, Artificial Sequence
  Description of Artificial Sequence: Synthetic oligonucleotide
  Target: ATXN1; (-) strand; PAM type: NNGRRT; PAM sequence: ATGAAT
ggtagatgcaggttatcatt

SEQ ID NO: 12888 - DNA, 20 bp, Artificial Sequence
  Description of Artificial Sequence: Synthetic oligonucleotide
  Target: ATXN1; (-) strand; PAM type: NNGRRT; PAM sequence: TTGGAT
ggtgctcattaaaatgaaca

SEQ ID NO: 12889 - DNA, 20 bp, Artificial Sequence
  Description of Artificial Sequence: Synthetic oligonucleotide
  Target: ATXN1; (-) strand; PAM type: NNGRRT; PAM sequence: CAGAAT
cagatgtatttctcttcttt

SEQ ID NO: 12890 - DNA, 20 bp, Artificial Sequence
  Description of Artificial Sequence: Synthetic oligonucleotide
  Target: ATXN1; (-) strand; PAM type: NNGRRT; PAM sequence: AAGAAT
tcttgtccttggaaaactgt

SEQ ID NO: 12891 - DNA, 20 bp, Artificial Sequence
  Description of Artificial Sequence: Synthetic oligonucleotide
  Target: ATXN1; (-) strand; PAM type: NNGRRT; PAM sequence: TCGGGT
aattagacatattcaggggc

SEQ ID NO: 12892 - DNA, 20 bp, Artificial Sequence
  Description of Artificial Sequence: Synthetic oligonucleotide
  Target: ATXN1; (-) strand; PAM type: NNGRRT; PAM sequence: CAGAAT
aattctcatttgcatgccta

SEQ ID NO: 12893 - DNA, 20 bp, Artificial Sequence
  Description of Artificial Sequence: Synthetic oligonucleotide
  Target: ATXN1; (-) strand; PAM type: NNGRRT; PAM sequence: CTGAGT
cttttctttgctagcccaag

SEQ ID NO: 12894 - DNA, 20 bp, Artificial Sequence
  Description of Artificial Sequence: Synthetic oligonucleotide
  Target: ATXN1; (-) strand; PAM type: NNGRRT; PAM sequence: GTGAGT
aaagctgctggggtaggtgg

SEQ ID NO: 12895 - DNA, 20 bp, Artificial Sequence
  Description of Artificial Sequence: Synthetic oligonucleotide
  Target: ATXN1; (-) strand; PAM type: NNGRRT; PAM sequence: GTGGGT
ctgcaaagctgctggggtag

SEQ ID NO: 12896 - DNA, 20 bp, Artificial Sequence
  Description of Artificial Sequence: Synthetic oligonucleotide
  Target: ATXN1; (-) strand; PAM type: NNGRRT; PAM sequence: TGGGGT
cagcacttctgcaaagctgc

SEQ ID NO: 12897 - DNA, 20 bp, Artificial Sequence
  Description of Artificial Sequence: Synthetic oligonucleotide
  Target: ATXN1; (-) strand; PAM type: NNGRRT; PAM sequence: CAGAAT
ctgtctttgctgggagaggg

SEQ ID NO: 12898 - DNA, 20 bp, Artificial Sequence
  Description of Artificial Sequence: Synthetic oligonucleotide
  Target: ATXN1; (-) strand; PAM type: NNGRRT; PAM sequence: TAGGGT
ttcttcttttgatgcggcga

SEQ ID NO: 12899 - DNA, 20 bp, Artificial Sequence
  Description of Artificial Sequence: Synthetic oligonucleotide
  Target: ATXN1; (-) strand; PAM type: NNGRRT; PAM sequence: AGGAGT
taaagtttaaattgaaaaaa

SEQ ID NO: 12900 - DNA, 20 bp, Artificial Sequence
  Description of Artificial Sequence: Synthetic oligonucleotide
  Target: ATXN1; (-) strand; PAM type: NNGRRT; PAM sequence: TTGGAT
ttgtcctgatgatatttgct

SEQ ID NO: 12901 - DNA, 20 bp, Artificial Sequence
  Description of Artificial Sequence: Synthetic oligonucleotide
  Target: ATXN1; (-) strand; PAM type: NNGRRT; PAM sequence: CAGAGT
tgtagtggataaaggaattg

SEQ ID NO: 12902 - DNA, 20 bp, Artificial Sequence
  Description of Artificial Sequence: Synthetic oligonucleotide
  Target: ATXN1; (-) strand; PAM type: NNGRRT; PAM sequence: AGGAAT
tgttagcatgtagtggataa

SEQ ID NO: 12903 - DNA, 20 bp, Artificial Sequence
  Description of Artificial Sequence: Synthetic oligonucleotide
  Target: ATXN1; (-) strand; PAM type: NNGRRT; PAM sequence: GTGGAT
aggatgggtgttagcatgta

SEQ ID NO: 12904 - DNA, 20 bp, Artificial Sequence
  Description of Artificial Sequence: Synthetic oligonucleotide
  Target: ATXN1; (-) strand; PAM type: NNGRRT; PAM sequence: ATGGGT
ggacattcgctgggctcagg

SEQ ID NO: 12905 - DNA, 20 bp, Artificial Sequence
  Description of Artificial Sequence: Synthetic oligonucleotide
  Target: ATXN1; (-) strand; PAM type: NNGRRT; PAM sequence: CAGGAT
agaaggacattcgctgggct

SEQ ID NO: 12906 - DNA, 20 bp, Artificial Sequence
  Description of Artificial Sequence: Synthetic oligonucleotide
  Target: ATXN1; (-) strand; PAM type: NNGRRT; PAM sequence: ATGAAT
gggtgagagaagggggaatg

SEQ ID NO: 12907 - DNA, 20 bp, Artificial Sequence
  Description of Artificial Sequence: Synthetic oligonucleotide
  Target: ATXN1; (-) strand; PAM type: NNGRRT; PAM sequence: GGGAAT
attatcagggtgagagaagg

SEQ ID NO: 12908 - DNA, 20 bp, Artificial Sequence
  Description of Artificial Sequence: Synthetic oligonucleotide
  Target: ATXN1; (-) strand; PAM type: NNGRRT; PAM sequence: CAGGGT
ccagaaactactgtgattat

SEQ ID NO: 12909 - DNA, 20 bp, Artificial Sequence
  Description of Artificial Sequence: Synthetic oligonucleotide
  Target: ATXN1; (-) strand; PAM type: NNGRRT; PAM sequence: AAGGGT
tcatgttccaaaatttaata

SEQ ID NO: 12910 - DNA, 20 bp, Artificial Sequence
  Description of Artificial Sequence: Synthetic oligonucleotide
  Target: ATXN1; (-) strand; PAM type: NNGRRT; PAM sequence: GTGGGT
cactcacttacaaatgacaa

SEQ ID NO: 12911 - DNA, 20 bp, Artificial Sequence
  Description of Artificial Sequence: Synthetic oligonucleotide
  Target: ATXN1; (-) strand; PAM type: NNGRRT; PAM sequence: TTGGGT
gtgggcacacagagctaaat

SEQ ID NO: 12912 - DNA, 20 bp, Artificial Sequence
  Description of Artificial Sequence: Synthetic oligonucleotide
  Target: ATXN1; (-) strand; PAM type: NNGRRT; PAM sequence: TGGAGT
cataggcctttcattcacaa

SEQ ID NO: 12913 - DNA, 20 bp, Artificial Sequence
  Description of Artificial Sequence: Synthetic oligonucleotide
  Target: ATXN1; (-) strand; PAM type: NNGRRT; PAM sequence: GTGGAT
ggcaccagtgcccagggctt

SEQ ID NO: 12914 - DNA, 20 bp, Artificial Sequence
  Description of Artificial Sequence: Synthetic oligonucleotide
  Target: ATXN1; (-) strand; PAM type: NNGRRT; PAM sequence: TTGAAT
accgcatgaagaatatcttc

SEQ ID NO: 12915 - DNA, 20 bp, Artificial Sequence
  Description of Artificial Sequence: Synthetic oligonucleotide
  Target: ATXN1; (-) strand; PAM type: NNGRRT; PAM sequence: AAGAAT
gatttcatgagaaccgcatg

SEQ ID NO: 12916 - DNA, 20 bp, Artificial Sequence
  Description of Artificial Sequence: Synthetic oligonucleotide
  Target: ATXN1; (-) strand; PAM type: NNGRRT; PAM sequence: GAGAGT
aattgatcgtatcttgccag

SEQ ID NO: 12917 - DNA, 20 bp, Artificial Sequence
  Description of Artificial Sequence: Synthetic oligonucleotide
  Target: ATXN1; (-) strand; PAM type: NNGRRT; PAM sequence: CAGAGT
ccttggggttttgttcagtc

SEQ ID NO: 12918 - DNA, 20 bp, Artificial Sequence
  Description of Artificial Sequence: Synthetic oligonucleotide
  Target: ATXN1; (-) strand; PAM type: NNGRRT; PAM sequence: TGGGGT
ggatttagtccaaagtgcct

SEQ ID NO: 12919 - DNA, 20 bp, Artificial Sequence
  Description of Artificial Sequence: Synthetic oligonucleotide
  Target: ATXN1; (-) strand; PAM type: NNGRRT; PAM sequence: AAGGAT
atatgctgtgggtacaaaga

SEQ ID NO: 12920 - DNA, 20 bp, Artificial Sequence
  Description of Artificial Sequence: Synthetic oligonucleotide
  Target: ATXN1; (-) strand; PAM type: NNGRRT; PAM sequence: GTGGGT
cttctcctttcagatatgct

SEQ ID NO: 12921 - DNA, 20 bp, Artificial Sequence
  Description of Artificial Sequence: Synthetic oligonucleotide
  Target: ATXN1; (-) strand; PAM type: NNGRRT; PAM sequence: GTGGGT
cctagattaaatgaaattct

SEQ ID NO: 12922 - DNA, 20 bp, Artificial Sequence
  Description of Artificial Sequence: Synthetic oligonucleotide
  Target: ATXN1; (-) strand; PAM type: NNGRRT; PAM sequence: GAGGGT
tcatatcattgcaatgcttt

SEQ ID NO: 12923 - DNA, 20 bp, Artificial Sequence
  Description of Artificial Sequence: Synthetic oligonucleotide
  Target: ATXN1; (-) strand; PAM type: NNGRRT; PAM sequence: CAGAGT
aggtttaaaagaagtgattt

SEQ ID NO: 12924 - DNA, 20 bp, Artificial Sequence
  Description of Artificial Sequence: Synthetic oligonucleotide
  Target: ATXN1; (-) strand; PAM type: NNGRRT; PAM sequence: TAGAAT
gtttttttgagtccaaaaag

SEQ ID NO: 12925 - DNA, 20 bp, Artificial Sequence
  Description of Artificial Sequence: Synthetic oligonucleotide
  Target: ATXN1; (-) strand; PAM type: NNGRRT; PAM sequence: TTGAGT
caattctaaagactgttttt

SEQ ID NO: 12926 - DNA, 20 bp, Artificial Sequence
  Description of Artificial Sequence: Synthetic oligonucleotide
  Target: ATXN1; (-) strand; PAM type: NNGRRT; PAM sequence: TTGAGT
ctctgcatacaataacttcc

SEQ ID NO: 12927 - DNA, 20 bp, Artificial Sequence
  Description of Artificial Sequence: Synthetic oligonucleotide
  Target: ATXN1; (-) strand; PAM type: NNGRRT; PAM sequence: AAGAAT
ttgtatactccttacctttc

SEQ ID NO: 12928 - DNA, 20 bp, Artificial Sequence
  Description of Artificial Sequence: Synthetic oligonucleotide
  Target: ATXN1; (-) strand; PAM type: NNGRRT; PAM sequence: ATGAAT
gtgctcgtgtgaatgaatga

SEQ ID NO: 12929 - DNA, 20 bp, Artificial Sequence
  Description of Artificial Sequence: Synthetic oligonucleotide
  Target: ATXN1; (-) strand; PAM type: NNGRRT; PAM sequence: ATGAAT
ggaagtgctcgtgtgaatga

SEQ ID NO: 12930 - DNA, 20 bp, Artificial Sequence
  Description of Artificial Sequence: Synthetic oligonucleotide
  Target: ATXN1; (-) strand; PAM type: NNGRRT; PAM sequence: ATGAAT
tgatggaagtgctcgtgtga

SEQ ID NO: 12931 - DNA, 20 bp, Artificial Sequence
  Description of Artificial Sequence: Synthetic oligonucleotide
  Target: ATXN1; (-) strand; PAM type: NNGRRT; PAM sequence: GTGAAT
aaattgatggaagtgctcgt

SEQ ID NO: 12932 - DNA, 20 bp, Artificial Sequence
  Description of Artificial Sequence: Synthetic oligonucleotide
  Target: ATXN1; (-) strand; PAM type: NNGRRT; PAM sequence: AGGGAT
gggcactaatcccatatatg

SEQ ID NO: 12933 - DNA, 20 bp, Artificial Sequence
  Description of Artificial Sequence: Synthetic oligonucleotide
  Target: ATXN1; (-) strand; PAM type: NNGRRT; PAM sequence: TGGGGT
gaaggagcaaggtcgctctc

SEQ ID NO: 12934 - DNA, 20 bp, Artificial Sequence
  Description of Artificial Sequence: Synthetic oligonucleotide
  Target: ATXN1; (-) strand; PAM type: NNGRRT; PAM sequence: CAGGAT
gatcaaggtgccagcagctt

SEQ ID NO: 12935 - DNA, 20 bp, Artificial Sequence
  Description of Artificial Sequence: Synthetic oligonucleotide
  Target: ATXN1; (-) strand; PAM type: NNGRRT; PAM sequence: GTGGAT
caaacttttcttcctttgag

SEQ ID NO: 12936 - DNA, 20 bp, Artificial Sequence
  Description of Artificial Sequence: Synthetic oligonucleotide
  Target: ATXN1; (-) strand; PAM type: NNGRRT; PAM sequence: TTGAAT
gtgtgccacattcactccag

SEQ ID NO: 12937 - DNA, 20 bp, Artificial Sequence
  Description of Artificial Sequence: Synthetic oligonucleotide
  Target: ATXN1; (-) strand; PAM type: NNGRRT; PAM sequence: AAGAGT
tgttctcccaggcagagaac

SEQ ID NO: 12938 - DNA, 20 bp, Artificial Sequence
  Description of Artificial Sequence: Synthetic oligonucleotide
  Target: ATXN1; (-) strand; PAM type: NNGRRT; PAM sequence: AAGGAT
gggaaggatgagggaagaag

SEQ ID NO: 12939 - DNA, 20 bp, Artificial Sequence
  Description of Artificial Sequence: Synthetic oligonucleotide
  Target: ATXN1; (-) strand; PAM type: NNGRRT; PAM sequence: AAGGAT
tgaaggtgcacagcaatggg

SEQ ID NO: 12940 - DNA, 20 bp, Artificial Sequence
  Description of Artificial Sequence: Synthetic oligonucleotide
  Target: ATXN1; (-) strand; PAM type: NNGRRT; PAM sequence: CAGGAT
taactgctttgctcatcttt

SEQ ID NO: 12941 - DNA, 20 bp, Artificial Sequence
  Description of Artificial Sequence: Synthetic oligonucleotide
  Target: ATXN1; (-) strand; PAM type: NNGRRT; PAM sequence: GAGGAT
cacaggttgtggtgggccag

SEQ ID NO: 12942 - DNA, 20 bp, Artificial Sequence
  Description of Artificial Sequence: Synthetic oligonucleotide
  Target: ATXN1; (-) strand; PAM type: NNGRRT; PAM sequence: CTGAGT
acaaagggaagcagtgtggc

SEQ ID NO: 12943 - DNA, 20 bp, Artificial Sequence
  Description of Artificial Sequence: Synthetic oligonucleotide
  Target: ATXN1; (-) strand; PAM type: NNGRRT; PAM sequence: AAGAAT
agaacttggccagagctttg

SEQ ID NO: 12944 - DNA, 20 bp, Artificial Sequence
  Description of Artificial Sequence: Synthetic oligonucleotide
  Target: ATXN1; (-) strand; PAM type: NNGRRT; PAM sequence: AAGAAT
ttagcaagtaaggcacgtgc

SEQ ID NO: 12945 - DNA, 20 bp, Artificial Sequence
  Description of Artificial Sequence: Synthetic oligonucleotide
  Target: ATXN1; (-) strand; PAM type: NNGRRT; PAM sequence: AGGAGT
aatgttctgagttgctgggt

SEQ ID NO: 12946 - DNA, 20 bp, Artificial Sequence
  Description of Artificial Sequence: Synthetic oligonucleotide
  Target: ATXN1; (-) strand; PAM type: NNGRRT; PAM sequence: CTGGGT
tcagttaatgttctgagttg

SEQ ID NO: 12947 - DNA, 20 bp, Artificial Sequence
  Description of Artificial Sequence: Synthetic oligonucleotide
  Target: ATXN1; (-) strand; PAM type: NNGRRT; PAM sequence: CTGAGT
tggtacaatcagttaatgtt

SEQ ID NO: 12948 - DNA, 20 bp, Artificial Sequence
  Description of Artificial Sequence: Synthetic oligonucleotide
  Target: ATXN1; (-) strand; PAM type: NNGRRT; PAM sequence: GGGAGT
tctgagttaggacagaccag

SEQ ID NO: 12949 - DNA, 20 bp, Artificial Sequence
  Description of Artificial Sequence: Synthetic oligonucleotide
  Target: ATXN1; (-) strand; PAM type: NNGRRT; PAM sequence: CTGAGT
tttatgacacaaggcagtat

SEQ ID NO: 12950 - DNA, 20 bp, Artificial Sequence
  Description of Artificial Sequence: Synthetic oligonucleotide
  Target: ATXN1; (-) strand; PAM type: NNGRRT; PAM sequence: AAGGGT
aaagaattactggggatatt

SEQ ID NO: 12951 - DNA, 20 bp, Artificial Sequence
  Description of Artificial Sequence: Synthetic oligonucleotide
  Target: ATXN1; (-) strand; PAM type: NNGRRT; PAM sequence: GGGGAT
gcctatctgaaagaattact

SEQ ID NO: 12952 - DNA, 20 bp, Artificial Sequence
  Description of Artificial Sequence: Synthetic oligonucleotide
  Target: ATXN1; (-) strand; PAM type: NNGRRT; PAM sequence: AAGAAT
tgggcctaacgcctatctga

SEQ ID NO: 12953 - DNA, 20 bp, Artificial Sequence
  Description of Artificial Sequence: Synthetic oligonucleotide
  Target: ATXN1; (-) strand; PAM type: NNGRRT; PAM sequence: CTGAGT
ttcccttaacctacatgagc

SEQ ID NO: 12954 - DNA, 20 bp, Artificial Sequence
  Description of Artificial Sequence: Synthetic oligonucleotide
  Target: ATXN1; (-) strand; PAM type: NNGRRT; PAM sequence: TAGAAT
taatggaagagcactgttca

SEQ ID NO: 12955 - DNA, 20 bp, Artificial Sequence
  Description of Artificial Sequence: Synthetic oligonucleotide
  Target: ATXN1; (-) strand; PAM type: NNGRRT; PAM sequence: CAGAGT
ctgcactccagcctcggtga

SEQ ID NO: 12956 - DNA, 20 bp, Artificial Sequence
  Description of Artificial Sequence: Synthetic oligonucleotide
  Target: ATXN1; (-) strand; PAM type: NNGRRT; PAM sequence: GAGGAT
tactcaggaggctgaggtgg

SEQ ID NO: 12957 - DNA, 20 bp, Artificial Sequence
  Description of Artificial Sequence: Synthetic oligonucleotide
  Target: ATXN1; (-) strand; PAM type: NNGRRT; PAM sequence: AGGGGT
aaaaagttaaaaaattagcc

SEQ ID NO: 12958 - DNA, 20 bp, Artificial Sequence
  Description of Artificial Sequence: Synthetic oligonucleotide
  Target: ATXN1; (-) strand; PAM type: NNGRRT; PAM sequence: AGGAGT
tgggaggactgcttgaaccc

SEQ ID NO: 12959 - DNA, 20 bp, Artificial Sequence
  Description of Artificial Sequence: Synthetic oligonucleotide
  Target: ATXN1; (-) strand; PAM type: NNGRRT; PAM sequence: CTGAAT
gatacccagtagtgggcttg

SEQ ID NO: 12960 - DNA, 20 bp, Artificial Sequence
  Description of Artificial Sequence: Synthetic oligonucleotide
  Target: ATXN1; (-) strand; PAM type: NNGRRT; PAM sequence: CTGGGT
gaataatgacttattttcct

SEQ ID NO: 12961 - DNA, 20 bp, Artificial Sequence
  Description of Artificial Sequence: Synthetic oligonucleotide
  Target: ATXN1; (-) strand; PAM type: NNGRRT; PAM sequence: TCGAAT
tgcgtgtgcaagtatctttt

SEQ ID NO: 12962 - DNA, 20 bp, Artificial Sequence
  Description of Artificial Sequence: Synthetic oligonucleotide
  Target: ATXN1; (-) strand; PAM type: NNGRRT; PAM sequence: GTGAAT
ggttccatgattttgcaatt

SEQ ID NO: 12963 - DNA, 20 bp, Artificial Sequence
  Description of Artificial Sequence: Synthetic oligonucleotide
  Target: ATXN1; (-) strand; PAM type: NNGRRT; PAM sequence: TTGGGT
tccactcaattgatgggcat

SEQ ID NO: 12964 - DNA, 20 bp, Artificial Sequence
  Description of Artificial Sequence: Synthetic oligonucleotide
  Target: ATXN1; (-) strand; PAM type: NNGRRT; PAM sequence: CTGAGT
taattcattcctttttatgg

SEQ ID NO: 12965 - DNA, 20 bp, Artificial Sequence
  Description of Artificial Sequence: Synthetic oligonucleotide
  Target: ATXN1; (-) strand; PAM type: NNGRRT; PAM sequence: TAGAAT
cattcttgagttacttcact

SEQ ID NO: 12966 - DNA, 20 bp, Artificial Sequence
  Description of Artificial Sequence: Synthetic oligonucleotide
  Target: ATXN1; (-) strand; PAM type: NNGRRT; PAM sequence: TTGAGT
tgatgtttggttttccattc

SEQ ID NO: 12967 - DNA, 20 bp, Artificial Sequence
  Description of Artificial Sequence: Synthetic oligonucleotide
  Target: ATXN1; (-) strand; PAM type: NNGRRT; PAM sequence: TGGGAT
tttatttttccgtaagttat

SEQ ID NO: 12968 - DNA, 20 bp, Artificial Sequence
  Description of Artificial Sequence: Synthetic oligonucleotide
  Target: ATXN1; (-) strand; PAM type: NNGRRT; PAM sequence: AAGGGT
cttcagttgcgttgcatcac

SEQ ID NO: 12969 - DNA, 20 bp, Artificial Sequence
  Description of Artificial Sequence: Synthetic oligonucleotide
  Target: ATXN1; (-) strand; PAM type: NNGRRT; PAM sequence: TAGAAT
tcatggaggacacaaaggaa

SEQ ID NO: 12970 - DNA, 20 bp, Artificial Sequence
  Description of Artificial Sequence: Synthetic oligonucleotide
  Target: ATXN1; (-) strand; PAM type: NNGRRT; PAM sequence: AGGAAT
gagtgtcatggaggacacaa

SEQ ID NO: 12971 - DNA, 20 bp, Artificial Sequence
  Description of Artificial Sequence: Synthetic oligonucleotide
  Target: ATXN1; (-) strand; PAM type: NNGRRT; PAM sequence: TAGAGT
ctgcttgcatagcactgttc

SEQ ID NO: 12972 - DNA, 20 bp, Artificial Sequence
  Description of Artificial Sequence: Synthetic oligonucleotide
  Target: ATXN1; (-) strand; PAM type: NNGRRT; PAM sequence: ATGAAT
tatggttattgaatgaatga

SEQ ID NO: 12973 - DNA, 20 bp, Artificial Sequence
  Description of Artificial Sequence: Synthetic oligonucleotide
  Target: ATXN1; (-) strand; PAM type: NNGRRT; PAM sequence: ATGAAT
agtgtatggttattgaatga

SEQ ID NO: 12974 - DNA, 20 bp, Artificial Sequence
  Description of Artificial Sequence: Synthetic oligonucleotide
  Target: ATXN1; (-) strand; PAM type: NNGRRT; PAM sequence: ATGAAT
gttcagtgtatggttattga

SEQ ID NO: 12975 - DNA, 20 bp, Artificial Sequence
  Description of Artificial Sequence: Synthetic oligonucleotide
  Target: ATXN1; (-) strand; PAM type: NNGRRT; PAM sequence: TTGAAT
ggatgttcagtgtatggtta

SEQ ID NO: 12976 - DNA, 20 bp, Artificial Sequence
  Description of Artificial Sequence: Synthetic oligonucleotide
  Target: ATXN1; (-) strand; PAM type: NNGRRT; PAM sequence: CTGGAT
cagtacctggttagcacttc

SEQ ID NO: 12977 - DNA, 20 bp, Artificial Sequence
  Description of Artificial Sequence: Synthetic oligonucleotide
  Target: ATXN1; (-) strand; PAM type: NNGRRT; PAM sequence: CTGAAT
aacaagacatggagtctcaa

SEQ ID NO: 12978 - DNA, 20 bp, Artificial Sequence
  Description of Artificial Sequence: Synthetic oligonucleotide
  Target: ATXN1; (-) strand; PAM type: NNGRRT; PAM sequence: TGGAGT
gcctggttcccaacaagaca

SEQ ID NO: 12979 - DNA, 20 bp, Artificial Sequence
  Description of Artificial Sequence: Synthetic oligonucleotide
  Target: ATXN1; (-) strand; PAM type: NNGRRT; PAM sequence: AAGAGT
gagtcatttattacctgcgt

SEQ ID NO: 12980 - DNA, 20 bp, Artificial Sequence
  Description of Artificial Sequence: Synthetic oligonucleotide
  Target: ATXN1; (-) strand; PAM type: NNGRRT; PAM sequence: TAGAGT
gcgtcttgctgatgcctctg

SEQ ID NO: 12981 - DNA, 20 bp, Artificial Sequence
  Description of Artificial Sequence: Synthetic oligonucleotide
  Target: ATXN1; (-) strand; PAM type: NNGRRT; PAM sequence: GTGAGT
cctgtacacttctttgcaga

SEQ ID NO: 12982 - DNA, 20 bp, Artificial Sequence
  Description of Artificial Sequence: Synthetic oligonucleotide
  Target: ATXN1; (-) strand; PAM type: NNGRRT; PAM sequence: CAGAGT
gcttcctgtacacttctttg

SEQ ID NO: 12983 - DNA, 20 bp, Artificial Sequence
  Description of Artificial Sequence: Synthetic oligonucleotide
  Target: ATXN1; (-) strand; PAM type: NNGRRT; PAM sequence: GAGGAT
atcctttcaaaactcatctt

SEQ ID NO: 12984 - DNA, 20 bp, Artificial Sequence
  Description of Artificial Sequence: Synthetic oligonucleotide
  Target: ATXN1; (-) strand; PAM type: NNGRRT; PAM sequence: TTGAGT
cttactttttaagccactta

SEQ ID NO: 12985 - DNA, 20 bp, Artificial Sequence
  Description of Artificial Sequence: Synthetic oligonucleotide
  Target: ATXN1; (-) strand; PAM type: NNGRRT; PAM sequence: GTGGAT
aacattctatagcctgctgg

SEQ ID NO: 12986 - DNA, 20 bp, Artificial Sequence
  Description of Artificial Sequence: Synthetic oligonucleotide
  Target: ATXN1; (-) strand; PAM type: NNGRRT; PAM sequence: CTGGGT
gagaaacattctatagcctg

SEQ ID NO: 12987 - DNA, 20 bp, Artificial Sequence
  Description of Artificial Sequence: Synthetic oligonucleotide
  Target: ATXN1; (-) strand; PAM type: NNGRRT; PAM sequence: CTGGAT
cacaagccagtgatgtacac

SEQ ID NO: 12988 - DNA, 20 bp, Artificial Sequence
  Description of Artificial Sequence: Synthetic oligonucleotide
  Target: ATXN1; (-) strand; PAM type: NNGRRT; PAM sequence: GGGAAT
tggcttctgttctaagcaga

SEQ ID NO: 12989 - DNA, 20 bp, Artificial Sequence
  Description of Artificial Sequence: Synthetic oligonucleotide
  Target: ATXN1; (-) strand; PAM type: NNGRRT; PAM sequence: ATGAAT
agagtctctgttccgtgggt

SEQ ID NO: 12990 - DNA, 20 bp, Artificial Sequence
  Description of Artificial Sequence: Synthetic oligonucleotide
  Target: ATXN1; (-) strand; PAM type: NNGRRT; PAM sequence: GTGGGT
actaggagagtctctgttcc

SEQ ID NO: 12991 - DNA, 20 bp, Artificial Sequence
  Description of Artificial Sequence: Synthetic oligonucleotide
  Target: ATXN1; (-) strand; PAM type: NNGRRT; PAM sequence: GAGAGT
gtttgtgaacagatgactag

SEQ ID NO: 12992 - DNA, 20 bp, Artificial Sequence
  Description of Artificial Sequence: Synthetic oligonucleotide
  Target: ATXN1; (-) strand; PAM type: NNGRRT; PAM sequence: AAGGGT
ggaaccagagaatgatattt

SEQ ID NO: 12993 - DNA, 20 bp, Artificial Sequence
  Description of Artificial Sequence: Synthetic oligonucleotide
  Target: ATXN1; (-) strand; PAM type: NNGRRT; PAM sequence: GAGAAT
tctgaagaggcctggaacca

SEQ ID NO: 12994 - DNA, 20 bp, Artificial Sequence
  Description of Artificial Sequence: Synthetic oligonucleotide
  Target: ATXN1; (-) strand; PAM type: NNGRRT; PAM sequence: AAGAAT
atccagacacaggaactcac

SEQ ID NO: 12995 - DNA, 20 bp, Artificial Sequence
  Description of Artificial Sequence: Synthetic oligonucleotide
  Target: ATXN1; (-) strand; PAM type: NNGRRT; PAM sequence: ATGGAT
taaaaaaaaaaaaaagtcac

SEQ ID NO: 12996 - DNA, 20 bp, Artificial Sequence
  Description of Artificial Sequence: Synthetic oligonucleotide
  Target: ATXN1; (-) strand; PAM type: NNGRRT; PAM sequence: CTGAAT
acatggatcagtcacccacc

SEQ ID NO: 12997 - DNA, 20 bp, Artificial Sequence
  Description of Artificial Sequence: Synthetic oligonucleotide
  Target: ATXN1; (-) strand; PAM type: NNGRRT; PAM sequence: ATGGAT
acccacttaagagcactcac

SEQ ID NO: 12998 - DNA, 20 bp, Artificial Sequence
  Description of Artificial Sequence: Synthetic oligonucleotide
  Target: ATXN1; (-) strand; PAM type: NNGRRT; PAM sequence: TTGAAT
gcctacaagcctgtgcacat

SEQ ID NO: 12999 - DNA, 20 bp, Artificial Sequence
  Description of Artificial Sequence: Synthetic oligonucleotide
  Target: ATXN1; (-) strand; PAM type: NNGRRT; PAM sequence: TTGAGT
tttgaggtaacggggccctc

SEQ ID NO: 13000 - DNA, 20 bp, Artificial Sequence
  Description of Artificial Sequence: Synthetic oligonucleotide
  Target: ATXN1; (-) strand; PAM type: NNGRRT; PAM sequence: ATGAGT
cagcatgcctttttggggag

SEQ ID NO: 13001 - DNA, 20 bp, Artificial Sequence
  Description of Artificial Sequence: Synthetic oligonucleotide
  Target: ATXN1; (-) strand; PAM type: NNGRRT; PAM sequence: GTGAGT
gtagttttttgggggtcagg

SEQ ID NO: 13002 - DNA, 20 bp, Artificial Sequence
  Description of Artificial Sequence: Synthetic oligonucleotide
  Target: ATXN1; (-) strand; PAM type: NNGRRT; PAM sequence: CAGGGT
agtggtagttttttgggggt

SEQ ID NO: 13003 - DNA, 20 bp, Artificial Sequence
  Description of Artificial Sequence: Synthetic oligonucleotide
  Target: ATXN1; (-) strand; PAM type: NNGRRT; PAM sequence: GGGGGT
cctgccagtggtagtttttt

SEQ ID NO: 13004 - DNA, 20 bp, Artificial Sequence
  Description of Artificial Sequence: Synthetic oligonucleotide
  Target: ATXN1; (-) strand; PAM type: NNGRRT; PAM sequence: CAGAAT
aatatataaatttggaggga

SEQ ID NO: 13005 - DNA, 20 bp, Artificial Sequence
  Description of Artificial Sequence: Synthetic oligonucleotide
  Target: ATXN1; (-) strand; PAM type: NNGRRT; PAM sequence: CAGGAT
cattcagaggtattaggggt

SEQ ID NO: 13006 - DNA, 20 bp, Artificial Sequence
  Description of Artificial Sequence: Synthetic oligonucleotide
  Target: ATXN1; (-) strand; PAM type: NNGRRT; PAM sequence: AGGGGT
agttcacattcagaggtatt

SEQ ID NO: 13007 - DNA, 20 bp, Artificial Sequence
  Description of Artificial Sequence: Synthetic oligonucleotide
  Target: ATXN1; (-) strand; PAM type: NNGRRT; PAM sequence: CAGGAT
gattaggaacccctctcctc

SEQ ID NO: 13008 - DNA, 20 bp, Artificial Sequence
  Description of Artificial Sequence: Synthetic oligonucleotide
  Target: ATXN1; (-) strand; PAM type: NNGRRT; PAM sequence: TGGGAT
gcctcgacctcccaaagtgc

SEQ ID NO: 13009 - DNA, 20 bp, Artificial Sequence
  Description of Artificial Sequence: Synthetic oligonucleotide
  Target: ATXN1; (-) strand; PAM type: NNGRRT; PAM sequence: CAGGGT
aatttttgtaatagtagaga

SEQ ID NO: 13010 - DNA, 20 bp, Artificial Sequence
  Description of Artificial Sequence: Synthetic oligonucleotide
  Target: ATXN1; (-) strand; PAM type: NNGRRT; PAM sequence: TGGAAT
ccctcattctcccgagtagc

SEQ ID NO: 13011 - DNA, 20 bp, Artificial Sequence
  Description of Artificial Sequence: Synthetic oligonucleotide
  Target: ATXN1; (-) strand; PAM type: NNGRRT; PAM sequence: CCGAGT
gattctcctccctcattctc

SEQ ID NO: 13012 - DNA, 20 bp, Artificial Sequence
  Description of Artificial Sequence: Synthetic oligonucleotide
  Target: ATXN1; (-) strand; PAM type: NNGRRT; PAM sequence: TGGGGT
tcttgctctgtcacccaggc

SEQ ID NO: 13013 - DNA, 20 bp, Artificial Sequence
  Description of Artificial Sequence: Synthetic oligonucleotide
  Target: ATXN1; (-) strand; PAM type: NNGRRT; PAM sequence: TGGAGT
tccccctttttttttcatga

SEQ ID NO: 13014 - DNA, 20 bp, Artificial Sequence
  Description of Artificial Sequence: Synthetic oligonucleotide
  Target: ATXN1; (-) strand; PAM type: NNGRRT; PAM sequence: CTGAGT
agagcactctgcctgtgtgc

SEQ ID NO: 13015 - DNA, 20 bp, Artificial Sequence
  Description of Artificial Sequence: Synthetic oligonucleotide
  Target: ATXN1; (-) strand; PAM type: NNGRRT; PAM sequence: AAGGAT
tccctgtgaagatgctcggg

SEQ ID NO: 13016 - DNA, 20 bp, Artificial Sequence
  Description of Artificial Sequence: Synthetic oligonucleotide
  Target: ATXN1; (-) strand; PAM type: NNGRRT; PAM sequence: TTGAGT
actgggtgacttaacagaca

SEQ ID NO: 13017 - DNA, 20 bp, Artificial Sequence
  Description of Artificial Sequence: Synthetic oligonucleotide
  Target: ATXN1; (-) strand; PAM type: NNGRRT; PAM sequence: CTGGGT
ccattacaaagtgccagaaa

SEQ ID NO: 13018 - DNA, 20 bp, Artificial Sequence
  Description of Artificial Sequence: Synthetic oligonucleotide
  Target: ATXN1; (-) strand; PAM type: NNGRRT; PAM sequence: CTGGAT
tcataattaaattccagcca

SEQ ID NO: 13019 - DNA, 20 bp, Artificial Sequence
  Description of Artificial Sequence: Synthetic oligonucleotide
  Target: ATXN1; (-) strand; PAM type: NNGRRT; PAM sequence: GTGAAT
acaatatatgtgaagaggaa

SEQ ID NO: 13020 - DNA, 20 bp, Artificial Sequence
  Description of Artificial Sequence: Synthetic oligonucleotide
  Target: ATXN1; (-) strand; PAM type: NNGRRT; PAM sequence: GGGAAT
cacctgtcttaacttgcaat

SEQ ID NO: 13021 - DNA, 20 bp, Artificial Sequence
  Description of Artificial Sequence: Synthetic oligonucleotide
  Target: ATXN1; (-) strand; PAM type: NNGRRT; PAM sequence: CAGAGT
actgtggataacctgactgg

SEQ ID NO: 13022 - DNA, 20 bp, Artificial Sequence
  Description of Artificial Sequence: Synthetic oligonucleotide
  Target: ATXN1; (-) strand; PAM type: NNGRRT; PAM sequence: GTGGAT
agtctgctgtaatgttcact

SEQ ID NO: 13023 - DNA, 20 bp, Artificial Sequence
  Description of Artificial Sequence: Synthetic oligonucleotide
  Target: ATXN1; (-) strand; PAM type: NNGRRT; PAM sequence: TGGAGT
cgtagatacctgagaaatag

SEQ ID NO: 13024 - DNA, 20 bp, Artificial Sequence
  Description of Artificial Sequence: Synthetic oligonucleotide
  Target: ATXN1; (-) strand; PAM type: NNGRRT; PAM sequence: TTGGGT
aaacgtcagtggctcttaga

SEQ ID NO: 13025 - DNA, 20 bp, Artificial Sequence
  Description of Artificial Sequence: Synthetic oligonucleotide
  Target: ATXN1; (-) strand; PAM type: NNGRRT; PAM sequence: TTGAAT
tttgggatgtttttatctat

SEQ ID NO: 13026 - DNA, 20 bp, Artificial Sequence
  Description of Artificial Sequence: Synthetic oligonucleotide
  Target: ATXN1; (-) strand; PAM type: NNGRRT; PAM sequence: TGGGAT
tagttagtggaacttcaatt

SEQ ID NO: 13027 - DNA, 20 bp, Artificial Sequence
  Description of Artificial Sequence: Synthetic oligonucleotide
  Target: ATXN1; (-) strand; PAM type: NNGRRT; PAM sequence: TAGAAT
aattattaatttgttttggg

SEQ ID NO: 13028 - DNA, 20 bp, Artificial Sequence
  Description of Artificial Sequence: Synthetic oligonucleotide
  Target: ATXN1; (-) strand; PAM type: NNGRRT; PAM sequence: TTGGGT
aaatgaattattaatttgtt

SEQ ID NO: 13029 - DNA, 20 bp, Artificial Sequence
  Description of Artificial Sequence: Synthetic oligonucleotide
  Target: ATXN1; (-) strand; PAM type: NNGRRT; PAM sequence: ATGAAT
agccaccaggcctggcccaa

SEQ ID NO: 13030 - DNA, 20 bp, Artificial Sequence
  Description of Artificial Sequence: Synthetic oligonucleotide
  Target: ATXN1; (-) strand; PAM type: NNGRRT; PAM sequence: AGGGAT
gtcttaaactcctggcctca

SEQ ID NO: 13031 - DNA, 20 bp, Artificial Sequence
  Description of Artificial Sequence: Synthetic oligonucleotide
  Target: ATXN1; (-) strand; PAM type: NNGRRT; PAM sequence: TGGGGT
ttttaagcttcttgtataga

SEQ ID NO: 13032 - DNA, 20 bp, Artificial Sequence
  Description of Artificial Sequence: Synthetic oligonucleotide
  Target: ATXN1; (-) strand; PAM type: NNGRRT; PAM sequence: TGGAGT
tctcgctctgttgcccaggc

SEQ ID NO: 13033 - DNA, 20 bp, Artificial Sequence
  Description of Artificial Sequence: Synthetic oligonucleotide
  Target: ATXN1; (-) strand; PAM type: NNGRRT; PAM sequence: TGGAAT
atttttttttttttttgaga

SEQ ID NO: 13034 - DNA, 20 bp, Artificial Sequence
  Description of Artificial Sequence: Synthetic oligonucleotide
  Target: ATXN1; (-) strand; PAM type: NNGRRT; PAM sequence: CTGGGT
ataagtgcacaccaccgtac

SEQ ID NO: 13035 - DNA, 20 bp, Artificial Sequence
  Description of Artificial Sequence: Synthetic oligonucleotide
  Target: ATXN1; (-) strand; PAM type: NNGRRT; PAM sequence: GAGAGT
ctttttcttttctttaggga

SEQ ID NO: 13036 - DNA, 20 bp, Artificial Sequence
  Description of Artificial Sequence: Synthetic oligonucleotide
  Target: ATXN1; (-) strand; PAM type: NNGRRT; PAM sequence: GGGAAT
aaaaaagcaaaaccttccaa

SEQ ID NO: 13037 - DNA, 20 bp, Artificial Sequence
  Description of Artificial Sequence: Synthetic oligonucleotide
  Target: ATXN1; (-) strand; PAM type: NNGRRT; PAM sequence: TTGGAT
taaactattttaaaacaatt

SEQ ID NO: 13038 - DNA, 20 bp, Artificial Sequence
  Description of Artificial Sequence: Synthetic oligonucleotide
  Target: ATXN1; (-) strand; PAM type: NNGRRT; PAM sequence: TGGGAT
ttgttatggaggaatggaaa

SEQ ID NO: 13039 - DNA, 20 bp, Artificial Sequence
  Description of Artificial Sequence: Synthetic oligonucleotide
  Target: ATXN1; (-) strand; PAM type: NNGRRT; PAM sequence: AGGAAT
cagcatcttcattgttatgg

SEQ ID NO: 13040 - DNA, 20 bp, Artificial Sequence
  Description of Artificial Sequence: Synthetic oligonucleotide
  Target: ATXN1; (-) strand; PAM type: NNGRRT; PAM sequence: TTGGAT
ccctgctctagatgtgagtc

SEQ ID NO: 13041 - DNA, 20 bp, Artificial Sequence
  Description of Artificial Sequence: Synthetic oligonucleotide
  Target: ATXN1; (-) strand; PAM type: NNGRRT; PAM sequence: GTGAGT
tggacacccctgctctagat

SEQ ID NO: 13042 - DNA, 20 bp, Artificial Sequence
  Description of Artificial Sequence: Synthetic oligonucleotide
  Target: ATXN1; (-) strand; PAM type: NNGRRT; PAM sequence: GGGAGT
gaggagtaacaaggctttca

SEQ ID NO: 13043 - DNA, 20 bp, Artificial Sequence
  Description of Artificial Sequence: Synthetic oligonucleotide
  Target: ATXN1; (-) strand; PAM type: NNGRRT; PAM sequence: AGGAGT
aaagggaacttgggacagag

SEQ ID NO: 13044 - DNA, 20 bp, Artificial Sequence
  Description of Artificial Sequence: Synthetic oligonucleotide
  Target: ATXN1; (-) strand; PAM type: NNGRRT; PAM sequence: GGGAGT
agaagatatggtgcggggta

SEQ ID NO: 13045 - DNA, 20 bp, Artificial Sequence
  Description of Artificial Sequence: Synthetic oligonucleotide
  Target: ATXN1; (-) strand; PAM type: NNGRRT; PAM sequence: CGGGGT
ccttaagagaagatatggtg

SEQ ID NO: 13046 - DNA, 20 bp, Artificial Sequence
  Description of Artificial Sequence: Synthetic oligonucleotide
  Target: ATXN1; (-) strand; PAM type: NNGRRT; PAM sequence: ATGAAT
acattaatataaaatgttcc

SEQ ID NO: 13047 - DNA, 20 bp, Artificial Sequence
  Description of Artificial Sequence: Synthetic oligonucleotide
  Target: ATXN1; (-) strand; PAM type: NNGRRT; PAM sequence: CAGAGT
gtggaatgatgctggtatga

SEQ ID NO: 13048 - DNA, 20 bp, Artificial Sequence
  Description of Artificial Sequence: Synthetic oligonucleotide
  Target: ATXN1; (-) strand; PAM type: NNGRRT; PAM sequence: TGGAAT
tatagcataaagggctcaag

SEQ ID NO: 13049 - DNA, 20 bp, Artificial Sequence
  Description of Artificial Sequence: Synthetic oligonucleotide
  Target: ATXN1; (-) strand; PAM type: NNGRRT; PAM sequence: GTGAAT
gaattgtgttttaataagtg

SEQ ID NO: 13050 - DNA, 20 bp, Artificial Sequence
  Description of Artificial Sequence: Synthetic oligonucleotide
  Target: ATXN1; (-) strand; PAM type: NNGRRT; PAM sequence: AAGAAT
ggaagggcaacttatatttt

SEQ ID NO: 13051 - DNA, 20 bp, Artificial Sequence
  Description of Artificial Sequence: Synthetic oligonucleotide
  Target: ATXN1; (-) strand; PAM type: NNGRRT; PAM sequence: ATGAAT
gcctggtgtgtagatgttaa

SEQ ID NO: 13052 - DNA, 20 bp, Artificial Sequence
  Description of Artificial Sequence: Synthetic oligonucleotide
  Target: ATXN1; (-) strand; PAM type: NNGRRT; PAM sequence: CTGGGT
cgtttttgtccccagactag

SEQ ID NO: 13053 - DNA, 20 bp, Artificial Sequence
  Description of Artificial Sequence: Synthetic oligonucleotide
  Target: ATXN1; (-) strand; PAM type: NNGRRT; PAM sequence: AGGAGT
acctttacttcattggccaa

SEQ ID NO: 13054 - DNA, 20 bp, Artificial Sequence
  Description of Artificial Sequence: Synthetic oligonucleotide
  Target: ATXN1; (-) strand; PAM type: NNGRRT; PAM sequence: ACGGAT
gctcctgattttctctttac

SEQ ID NO: 13055 - DNA, 20 bp, Artificial Sequence
  Description of Artificial Sequence: Synthetic oligonucleotide
  Target: ATXN1; (-) strand; PAM type: NNGRRT; PAM sequence: CAGGGT
gtgcaaaatagaattcaaga

SEQ ID NO: 13056 - DNA, 20 bp, Artificial Sequence
  Description of Artificial Sequence: Synthetic oligonucleotide
  Target: ATXN1; (-) strand; PAM type: NNGRRT; PAM sequence: TAGAAT
gctttcctggatgtgcaaaa

SEQ ID NO: 13057 - DNA, 20 bp, Artificial Sequence
  Description of Artificial Sequence: Synthetic oligonucleotide
  Target: ATXN1; (-) strand; PAM type: NNGRRT; PAM sequence: CTGGAT
gcatgcgtttcttggctttc

SEQ ID NO: 13058 - DNA, 20 bp, Artificial Sequence
  Description of Artificial Sequence: Synthetic oligonucleotide
  Target: ATXN1; (-) strand; PAM type: NNGRRT; PAM sequence: TTGAAT
ctctctgataggaaaaagga

SEQ ID NO: 13059 - DNA, 20 bp, Artificial Sequence
  Description of Artificial Sequence: Synthetic oligonucleotide
  Target: ATXN1; (-) strand; PAM type: NNGRRT; PAM sequence: AAGGAT
tgaagctctctgataggaaa

SEQ ID NO: 13060 - DNA, 20 bp, Artificial Sequence
  Description of Artificial Sequence: Synthetic oligonucleotide
  Target: ATXN1; (-) strand; PAM type: NNGRRT; PAM sequence: GTGGAT
tttttaaagcattgactgtt

SEQ ID NO: 13061 - DNA, 20 bp, Artificial Sequence
  Description of Artificial Sequence: Synthetic oligonucleotide
  Target: ATXN1; (-) strand; PAM type: NNGRRT; PAM sequence: CTGAGT
tttttgtattggtccatgtc

SEQ ID NO: 13062 - DNA, 20 bp, Artificial Sequence
  Description of Artificial Sequence: Synthetic oligonucleotide
  Target: ATXN1; (-) strand; PAM type: NNGRRT; PAM sequence: ATGAAT
taggctgaactgaagtggga

SEQ ID NO: 13063 - DNA, 20 bp, Artificial Sequence
  Description of Artificial Sequence: Synthetic oligonucleotide
  Target: ATXN1; (-) strand; PAM type: NNGRRT; PAM sequence: GGGAAT
gtgttaggctgaactgaagt

SEQ ID NO: 13064 - DNA, 20 bp, Artificial Sequence
  Description of Artificial Sequence: Synthetic oligonucleotide
  Target: ATXN1; (-) strand; PAM type: NNGRRT; PAM sequence: GTGAAT
agttggtgatcactcatttg

SEQ ID NO: 13065 - DNA, 20 bp, Artificial Sequence
  Description of Artificial Sequence: Synthetic oligonucleotide
  Target: ATXN1; (-) strand; PAM type: NNGRRT; PAM sequence: TTGGGT
attacaatttgacatgagat

SEQ ID NO: 13066 - DNA, 20 bp, Artificial Sequence
  Description of Artificial Sequence: Synthetic oligonucleotide
  Target: ATXN1; (-) strand; PAM type: NNGRRT; PAM sequence: GGGGAT
aggcccttcctccaaacact

SEQ ID NO: 13067 - DNA, 20 bp, Artificial Sequence
  Description of Artificial Sequence: Synthetic oligonucleotide
  Target: ATXN1; (-) strand; PAM type: NNGRRT; PAM sequence: CTGGAT
gctatgagaactacctgaga

SEQ ID NO: 13068 - DNA, 20 bp, Artificial Sequence
  Description of Artificial Sequence: Synthetic oligonucleotide
  Target: ATXN1; (-) strand; PAM type: NNGRRT; PAM sequence: CTGGAT
ctcttgaccatctctgcaca

SEQ ID NO: 13069 - DNA, 20 bp, Artificial Sequence
  Description of Artificial Sequence: Synthetic oligonucleotide
  Target: ATXN1; (-) strand; PAM type: NNGRRT; PAM sequence: CTGAAT
catgccatacttgtgcttcc

SEQ ID NO: 13070 - DNA, 20 bp, Artificial Sequence
  Description of Artificial Sequence: Synthetic oligonucleotide
  Target: ATXN1; (-) strand; PAM type: NNGRRT; PAM sequence: CAGAGT
tccatcttctactctatgac

SEQ ID NO: 13071 - DNA, 20 bp, Artificial Sequence
  Description of Artificial Sequence: Synthetic oligonucleotide
  Target: ATXN1; (-) strand; PAM type: NNGRRT; PAM sequence: CTGAGT
gccattcagcagccttggtg

SEQ ID NO: 13072 - DNA, 20 bp, Artificial Sequence
  Description of Artificial Sequence: Synthetic oligonucleotide
  Target: ATXN1; (-) strand; PAM type: NNGRRT; PAM sequence: CTGAGT
taaaacgagaaattaaggca

SEQ ID NO: 13073 - DNA, 20 bp, Artificial Sequence
  Description of Artificial Sequence: Synthetic oligonucleotide
  Target: ATXN1; (-) strand; PAM type: NNGRRT; PAM sequence: GGGGAT
cgagtacctactgcatgtag

SEQ ID NO: 13074 - DNA, 20 bp, Artificial Sequence
  Description of Artificial Sequence: Synthetic oligonucleotide
  Target: ATXN1; (-) strand; PAM type: NNGRRT; PAM sequence: TCGAGT
gttgaatcaactggtatgta

SEQ ID NO: 13075 - DNA, 20 bp, Artificial Sequence
  Description of Artificial Sequence: Synthetic oligonucleotide
  Target: ATXN1; (-) strand; PAM type: NNGRRT; PAM sequence: TTGAAT
ttgtgtgtttgtttcagttg

SEQ ID NO: 13076 - DNA, 20 bp, Artificial Sequence
  Description of Artificial Sequence: Synthetic oligonucleotide
  Target: ATXN1; (-) strand; PAM type: NNGRRT; PAM sequence: TTGAAT
gtttgcacttatcttattct

SEQ ID NO: 13077 - DNA, 20 bp, Artificial Sequence
  Description of Artificial Sequence: Synthetic oligonucleotide
  Target: ATXN1; (-) strand; PAM type: NNGRRT; PAM sequence: AGGAAT
agagtaagataggaatgatt

SEQ ID NO: 13078 - DNA, 20 bp, Artificial Sequence
  Description of Artificial Sequence: Synthetic oligonucleotide
  Target: ATXN1; (-) strand; PAM type: NNGRRT; PAM sequence: AGGAAT
accctaacccagagtaagat

SEQ ID NO: 13079 - DNA, 20 bp, Artificial Sequence
  Description of Artificial Sequence: Synthetic oligonucleotide
  Target: ATXN1; (-) strand; PAM type: NNGRRT; PAM sequence: CAGAGT
agaggacagagaccctaacc

SEQ ID NO: 13080 - DNA, 20 bp, Artificial Sequence
  Description of Artificial Sequence: Synthetic oligonucleotide
  Target: ATXN1; (-) strand; PAM type: NNGRRT; PAM sequence: AAGGGT
tcgtgaagactaatagcctt

SEQ ID NO: 13081 - DNA, 20 bp, Artificial Sequence
  Description of Artificial Sequence: Synthetic oligonucleotide
  Target: ATXN1; (-) strand; PAM type: NNGRRT; PAM sequence: GAGGAT
tggaatgtgtcatcgtatgt

SEQ ID NO: 13082 - DNA, 20 bp, Artificial Sequence
  Description of Artificial Sequence: Synthetic oligonucleotide
  Target: ATXN1; (-) strand; PAM type: NNGRRT; PAM sequence: TGGAAT
atgcagactgctttagaggc

SEQ ID NO: 13083 - DNA, 20 bp, Artificial Sequence
  Description of Artificial Sequence: Synthetic oligonucleotide
  Target: ATXN1; (-) strand; PAM type: NNGRRT; PAM sequence: CTGAAT
aattatttttgcatagattc

SEQ ID NO: 13084 - DNA, 20 bp, Artificial Sequence
  Description of Artificial Sequence: Synthetic oligonucleotide
  Target: ATXN1; (-) strand; PAM type: NNGRRT; PAM sequence: AGGAGT
ggaagggcagaatggcaagg

SEQ ID NO: 13085 - DNA, 20 bp, Artificial Sequence
  Description of Artificial Sequence: Synthetic oligonucleotide
  Target: ATXN1; (-) strand; PAM type: NNGRRT; PAM sequence: CAGAAT
tgttgtcatctcaggaaggg

SEQ ID NO: 13086 - DNA, 20 bp, Artificial Sequence
  Description of Artificial Sequence: Synthetic oligonucleotide
  Target: ATXN1; (-) strand; PAM type: NNGRRT; PAM sequence: AAGAGT
ttctttcatgtaaaagtgtt

SEQ ID NO: 13087 - DNA, 20 bp, Artificial Sequence
  Description of Artificial Sequence: Synthetic oligonucleotide
  Target: ATXN1; (-) strand; PAM type: NNGRRT; PAM sequence: CAGAAT
ggtggccttgtgcagcagat

SEQ ID NO: 13088 - DNA, 20 bp, Artificial Sequence
  Description of Artificial Sequence: Synthetic oligonucleotide
  Target: ATXN1; (-) strand; PAM type: NNGRRT; PAM sequence: AGGAGT
gcattcagcctatgagccca

SEQ ID NO: 13089 - DNA, 20 bp, Artificial Sequence
  Description of Artificial Sequence: Synthetic oligonucleotide
  Target: ATXN1; (-) strand; PAM type: NNGRRT; PAM sequence: AGGAGT
atttttaaaaagtgatttga

SEQ ID NO: 13090 - DNA, 20 bp, Artificial Sequence
  Description of Artificial Sequence: Synthetic oligonucleotide
  Target: ATXN1; (-) strand; PAM type: NNGRRT; PAM sequence: AGGAGT
caggcagattgcttgagccc

SEQ ID NO: 13091 - DNA, 20 bp, Artificial Sequence
  Description of Artificial Sequence: Synthetic oligonucleotide
  Target: ATXN1; (-) strand; PAM type: NNGRRT; PAM sequence: GGGAGT
ctcaaagaaatagtagccct

SEQ ID NO: 13092 - DNA, 20 bp, Artificial Sequence
  Description of Artificial Sequence: Synthetic oligonucleotide
  Target: ATXN1; (-) strand; PAM type: NNGRRT; PAM sequence: TTGAGT
gtgctgatccgtgaccacca

SEQ ID NO: 13093 - DNA, 20 bp, Artificial Sequence
  Description of Artificial Sequence: Synthetic oligonucleotide
  Target: ATXN1; (-) strand; PAM type: NNGRRT; PAM sequence: GAGAGT
ccgggttctcatggttagtt

SEQ ID NO: 13094 - DNA, 20 bp, Artificial Sequence
  Description of Artificial Sequence: Synthetic oligonucleotide
  Target: ATXN1; (-) strand; PAM type: NNGRRT; PAM sequence: CCGGGT
taacctagcttctacttcat

SEQ ID NO: 13095 - DNA, 20 bp, Artificial Sequence
  Description of Artificial Sequence: Synthetic oligonucleotide
  Target: ATXN1; (-) strand; PAM type: NNGRRT; PAM sequence: CTGAGT
gaatcacgagcaagcatagt

SEQ ID NO: 13096 - DNA, 20 bp, Artificial Sequence
  Description of Artificial Sequence: Synthetic oligonucleotide
  Target: ATXN1; (-) strand; PAM type: NNGRRT; PAM sequence: GAGAAT
gggtaacccctgccttgttt

SEQ ID NO: 13097 - DNA, 20 bp, Artificial Sequence
  Description of Artificial Sequence: Synthetic oligonucleotide
  Target: ATXN1; (-) strand; PAM type: NNGRRT; PAM sequence: GAGGGT
tccttttcagatgtccctgg

SEQ ID NO: 13098 - DNA, 20 bp, Artificial Sequence
  Description of Artificial Sequence: Synthetic oligonucleotide
  Target: ATXN1; (-) strand; PAM type: NNGRRT; PAM sequence: CAGAAT
tccaagttgttttaaggatt

SEQ ID NO: 13099 - DNA, 20 bp, Artificial Sequence
  Description of Artificial Sequence: Synthetic oligonucleotide
  Target: ATXN1; (-) strand; PAM type: NNGRRT; PAM sequence: AAGGAT
caatgtttccaagttgtttt

SEQ ID NO: 13100 - DNA, 20 bp, Artificial Sequence
  Description of Artificial Sequence: Synthetic oligonucleotide
  Target: ATXN1; (-) strand; PAM type: NNGRRT; PAM sequence: GAGAGT
agacaatgctatctgttcta

SEQ ID NO: 13101 - DNA, 20 bp, Artificial Sequence
  Description of Artificial Sequence: Synthetic oligonucleotide
  Target: ATXN1; (-) strand; PAM type: NNGRRT; PAM sequence: AAGAAT
tcgatattttatgtggaagg

SEQ ID NO: 13102 - DNA, 20 bp, Artificial Sequence
  Description of Artificial Sequence: Synthetic oligonucleotide
  Target: ATXN1; (-) strand; PAM type: NNGRRT; PAM sequence: GTGGAT
tgtacactacctggcatgta

SEQ ID NO: 13103 - DNA, 20 bp, Artificial Sequence
  Description of Artificial Sequence: Synthetic oligonucleotide
  Target: ATXN1; (-) strand; PAM type: NNGRRT; PAM sequence: GGGAGT
ctggctgaatttatgcaatt

SEQ ID NO: 13104 - DNA, 20 bp, Artificial Sequence
  Description of Artificial Sequence: Synthetic oligonucleotide
  Target: ATXN1; (-) strand; PAM type: NNGRRT; PAM sequence: CTGAAT
gttgcttttttcctctctgg

SEQ ID NO: 13105 - DNA, 20 bp, Artificial Sequence
  Description of Artificial Sequence: Synthetic oligonucleotide
  Target: ATXN1; (-) strand; PAM type: NNGRRT; PAM sequence: CTGGAT
ggacttggggtcggaggaac

SEQ ID NO: 13106 - DNA, 20 bp, Artificial Sequence
  Description of Artificial Sequence: Synthetic oligonucleotide
  Target: ATXN1; (-) strand; PAM type: NNGRRT; PAM sequence: TGGGGT
aatgatcacatctatggact

SEQ ID NO: 13107 - DNA, 20 bp, Artificial Sequence
  Description of Artificial Sequence: Synthetic oligonucleotide
  Target: ATXN1; (-) strand; PAM type: NNGRRT; PAM sequence: TTGGGT
tcccctgtgcatagtaggct

SEQ ID NO: 13108 - DNA, 20 bp, Artificial Sequence
  Description of Artificial Sequence: Synthetic oligonucleotide
  Target: ATXN1; (-) strand; PAM type: NNGRRT; PAM sequence: CGGGAT
aaggctctgccccggcttct

SEQ ID NO: 13109 - DNA, 20 bp, Artificial Sequence
  Description of Artificial Sequence: Synthetic oligonucleotide
  Target: ATXN1; (-) strand; PAM type: NNGRRT; PAM sequence: AAGAAT
atttcatgtgtttttatgtg

SEQ ID NO: 13110 - DNA, 20 bp, Artificial Sequence
  Description of Artificial Sequence: Synthetic oligonucleotide
  Target: ATXN1; (-) strand; PAM type: NNGRRT; PAM sequence: AGGAAT
cttgatcctcagtttttttg

SEQ ID NO: 13111 - DNA, 20 bp, Artificial Sequence
  Description of Artificial Sequence: Synthetic oligonucleotide
  Target: ATXN1; (-) strand; PAM type: NNGRRT; PAM sequence: GAGAGT
gtggtcttcccgggtcttag

SEQ ID NO: 13112 - DNA, 20 bp, Artificial Sequence
  Description of Artificial Sequence: Synthetic oligonucleotide
  Target: ATXN1; (-) strand; PAM type: NNGRRT; PAM sequence: CCGGGT
catacctgcctgtggtcttc

SEQ ID NO: 13113 - DNA, 20 bp, Artificial Sequence
  Description of Artificial Sequence: Synthetic oligonucleotide
  Target: ATXN1; (-) strand; PAM type: NNGRRT; PAM sequence: CAGAAT
atacactttatttgacgtag

SEQ ID NO: 13114 - DNA, 20 bp, Artificial Sequence
  Description of Artificial Sequence: Synthetic oligonucleotide
  Target: ATXN1; (-) strand; PAM type: NNGRRT; PAM sequence: TTGAAT
ctcatcttttctgaatctta

SEQ ID NO: 13115 - DNA, 20 bp, Artificial Sequence
  Description of Artificial Sequence: Synthetic oligonucleotide
  Target: ATXN1; (-) strand; PAM type: NNGRRT; PAM sequence: CTGAAT
ctcctggggtctcatctttt

SEQ ID NO: 13116 - DNA, 20 bp, Artificial Sequence
  Description of Artificial Sequence: Synthetic oligonucleotide
  Target: ATXN1; (-) strand; PAM type: NNGRRT; PAM sequence: TGGGGT
ggttagcactcatgacctcc

SEQ ID NO: 13117 - DNA, 20 bp, Artificial Sequence
  Description of Artificial Sequence: Synthetic oligonucleotide
  Target: ATXN1; (-) strand; PAM type: NNGRRT; PAM sequence: GAGAAT
taacccatgagcagaggcat

SEQ ID NO: 13118 - DNA, 20 bp, Artificial Sequence
  Description of Artificial Sequence: Synthetic oligonucleotide
  Target: ATXN1; (-) strand; PAM type: NNGRRT; PAM sequence: TTGGAT
actgtaggatgcagagaccc

SEQ ID NO: 13119 - DNA, 20 bp, Artificial Sequence
  Description of Artificial Sequence: Synthetic oligonucleotide
  Target: ATXN1; (-) strand; PAM type: NNGRRT; PAM sequence: TAGGAT
tgaattagctttacagactg

SEQ ID NO: 13120 - DNA, 20 bp, Artificial Sequence
  Description of Artificial Sequence: Synthetic oligonucleotide
  Target: ATXN1; (-) strand; PAM type: NNGRRT; PAM sequence: ATGAAT
tttatctttgcagcaagcct

SEQ ID NO: 13121 - DNA, 20 bp, Artificial Sequence
  Description of Artificial Sequence: Synthetic oligonucleotide
  Target: ATXN1; (-) strand; PAM type: NNGRRT; PAM sequence: TTGAAT
cagtcatatccagagcttac

SEQ ID NO: 13122 - DNA, 20 bp, Artificial Sequence
  Description of Artificial Sequence: Synthetic oligonucleotide
  Target: ATXN1; (-) strand; PAM type: NNGRRT; PAM sequence: ATGGAT
ctcaggaaaagacaaggatg

SEQ ID NO: 13123 - DNA, 20 bp, Artificial Sequence
  Description of Artificial Sequence: Synthetic oligonucleotide
  Target: ATXN1; (-) strand; PAM type: NNGRRT; PAM sequence: AAGGAT
catagtgctcaggaaaagac

SEQ ID NO: 13124 - DNA, 20 bp, Artificial Sequence
  Description of Artificial Sequence: Synthetic oligonucleotide
  Target: ATXN1; (-) strand; PAM type: NNGRRT; PAM sequence: TGGGAT
gccttggcctcccaaagtgc

SEQ ID NO: 13125 - DNA, 20 bp, Artificial Sequence
  Description of Artificial Sequence: Synthetic oligonucleotide
  Target: ATXN1; (-) strand; PAM type: NNGRRT; PAM sequence: CCGAGT
gattctcctgcctcagcctc

SEQ ID NO: 13126 - DNA, 20 bp, Artificial Sequence
  Description of Artificial Sequence: Synthetic oligonucleotide
  Target: ATXN1; (-) strand; PAM type: NNGRRT; PAM sequence: CCGGGT
ctcactacaacctccgcctc

SEQ ID NO: 13127 - DNA, 20 bp, Artificial Sequence
  Description of Artificial Sequence: Synthetic oligonucleotide
  Target: ATXN1; (-) strand; PAM type: NNGRRT; PAM sequence: TGGAGT
tctcgctctgtcactcaggc

SEQ ID NO: 13128 - DNA, 20 bp, Artificial Sequence
  Description of Artificial Sequence: Synthetic oligonucleotide
  Target: ATXN1; (-) strand; PAM type: NNGRRT; PAM sequence: TGGAGT
tttttctttttttttggaga

SEQ ID NO: 13129 - DNA, 20 bp, Artificial Sequence
  Description of Artificial Sequence: Synthetic oligonucleotide
  Target: ATXN1; (-) strand; PAM type: NNGRRT; PAM sequence: AGGGAT
tccgtgtatatttgctacca

SEQ ID NO: 13130 - DNA, 20 bp, Artificial Sequence
  Description of Artificial Sequence: Synthetic oligonucleotide
  Target: ATXN1; (-) strand; PAM type: NNGRRT; PAM sequence: GTGGGT
aagtcaaatgaaattgggaa

SEQ ID NO: 13131 - DNA, 20 bp, Artificial Sequence
  Description of Artificial Sequence: Synthetic oligonucleotide
  Target: ATXN1; (-) strand; PAM type: NNGRRT; PAM sequence: AAGGAT
ctgcgtagttcttgtagtga

SEQ ID NO: 13132 - DNA, 20 bp, Artificial Sequence
  Description of Artificial Sequence: Synthetic oligonucleotide
  Target: ATXN1; (-) strand; PAM type: NNGRRT; PAM sequence: CTGAAT
ctatgtgagtcagggtacac

SEQ ID NO: 13133 - DNA, 20 bp, Artificial Sequence
  Description of Artificial Sequence: Synthetic oligonucleotide
  Target: ATXN1; (-) strand; PAM type: NNGRRT; PAM sequence: CAGGGT
attgcagtgcctatgtgagt

SEQ ID NO: 13134 - DNA, 20 bp, Artificial Sequence
  Description of Artificial Sequence: Synthetic oligonucleotide
  Target: ATXN1; (-) strand; PAM type: NNGRRT; PAM sequence: GTGAGT
agaacgattgcagtgcctat

SEQ ID NO: 13135 - DNA, 20 bp, Artificial Sequence
  Description of Artificial Sequence: Synthetic oligonucleotide
  Target: ATXN1; (-) strand; PAM type: NNGRRT; PAM sequence: GAGGAT
ttggtgcagtgagtcagtga

SEQ ID NO: 13136 - DNA, 20 bp, Artificial Sequence
  Description of Artificial Sequence: Synthetic oligonucleotide
  Target: ATXN1; (-) strand; PAM type: NNGRRT; PAM sequence: GTGAGT
caagaacatagcttggtgca

SEQ ID NO: 13137 - DNA, 20 bp, Artificial Sequence
  Description of Artificial Sequence: Synthetic oligonucleotide
  Target: ATXN1; (-) strand; PAM type: NNGRRT; PAM sequence: ATGAAT
aggaaatctaattttgggaa

SEQ ID NO: 13138 - DNA, 20 bp, Artificial Sequence
  Description of Artificial Sequence: Synthetic oligonucleotide
  Target: ATXN1; (-) strand; PAM type: NNGRRT; PAM sequence: AGGAGT
ctatccttatatttaaaata

SEQ ID NO: 13139 - DNA, 20 bp, Artificial Sequence
  Description of Artificial Sequence: Synthetic oligonucleotide
  Target: ATXN1; (-) strand; PAM type: NNGRRT; PAM sequence: TTGAGT
ctagtagcagtagggtggac

SEQ ID NO: 13140 - DNA, 20 bp, Artificial Sequence
  Description of Artificial Sequence: Synthetic oligonucleotide
  Target: ATXN1; (-) strand; PAM type: NNGRRT; PAM sequence: TAGGGT
agttagagtactagtagcag

SEQ ID NO: 13141 - DNA, 20 bp, Artificial Sequence
  Description of Artificial Sequence: Synthetic oligonucleotide
  Target: ATXN1; (-) strand; PAM type: NNGRRT; PAM sequence: TAGAGT
tgggtcaaggatctcacagt

SEQ ID NO: 13142 - DNA, 20 bp, Artificial Sequence
  Description of Artificial Sequence: Synthetic oligonucleotide
  Target: ATXN1; (-) strand; PAM type: NNGRRT; PAM sequence: AAGGAT
caagtacagagctatgggtc

SEQ ID NO: 13143 - DNA, 20 bp, Artificial Sequence
  Description of Artificial Sequence: Synthetic oligonucleotide
  Target: ATXN1; (-) strand; PAM type: NNGRRT; PAM sequence: ATGGGT
agtaaaacaagtacagagct

SEQ ID NO: 13144 - DNA, 20 bp, Artificial Sequence
  Description of Artificial Sequence: Synthetic oligonucleotide
  Target: ATXN1; (-) strand; PAM type: NNGRRT; PAM sequence: GAGAAT
aaacatcagcattcagaggt

SEQ ID NO: 13145 - DNA, 20 bp, Artificial Sequence
  Description of Artificial Sequence: Synthetic oligonucleotide
  Target: ATXN1; (-) strand; PAM type: NNGRRT; PAM sequence: GAGGGT
ggcccaagatgcagggcatg

SEQ ID NO: 13146 - DNA, 20 bp, Artificial Sequence
  Description of Artificial Sequence: Synthetic oligonucleotide
  Target: ATXN1; (-) strand; PAM type: NNGRRT; PAM sequence: AGGGAT
ggccactgttcatctatttc

SEQ ID NO: 13147 - DNA, 20 bp, Artificial Sequence
  Description of Artificial Sequence: Synthetic oligonucleotide
  Target: ATXN1; (-) strand; PAM type: NNGRRT; PAM sequence: AGGAGT
gagaagctaagatagaccca

SEQ ID NO: 13148 - DNA, 20 bp, Artificial Sequence
  Description of Artificial Sequence: Synthetic oligonucleotide
  Target: ATXN1; (-) strand; PAM type: NNGRRT; PAM sequence: ACGGAT
aatggattaacgccactacc

SEQ ID NO: 13149 - DNA, 20 bp, Artificial Sequence
  Description of Artificial Sequence: Synthetic oligonucleotide
  Target: ATXN1; (-) strand; PAM type: NNGRRT; PAM sequence: ATGGAT
tgttgtcttgtttttcgtaa

SEQ ID NO: 13150 - DNA, 20 bp, Artificial Sequence
  Description of Artificial Sequence: Synthetic oligonucleotide
  Target: ATXN1; (-) strand; PAM type: NNGRRT; PAM sequence: TTGAAT
tgatgtgtttatttgactcc

SEQ ID NO: 13151 - DNA, 20 bp, Artificial Sequence
  Description of Artificial Sequence: Synthetic oligonucleotide
  Target: ATXN1; (-) strand; PAM type: NNGRRT; PAM sequence: AGGAAT
tctgagatgctgcagtggag

SEQ ID NO: 13152 - DNA, 20 bp, Artificial Sequence
  Description of Artificial Sequence: Synthetic oligonucleotide
  Target: ATXN1; (-) strand; PAM type: NNGRRT; PAM sequence: GTGGAT
tttgacaattttcctgggag

SEQ ID NO: 13153 - DNA, 20 bp, Artificial Sequence
  Description of Artificial Sequence: Synthetic oligonucleotide
  Target: ATXN1; (-) strand; PAM type: NNGRRT; PAM sequence: TGGGAT
gcctcggcctcccaaagtgg

SEQ ID NO: 13154 - DNA, 20 bp, Artificial Sequence
  Description of Artificial Sequence: Synthetic oligonucleotide
  Target: ATXN1; (-) strand; PAM type: NNGRRT; PAM sequence: TGGGGT
ttttatatttttagtagaga

SEQ ID NO: 13155 - DNA, 20 bp, Artificial Sequence
  Description of Artificial Sequence: Synthetic oligonucleotide
  Target: ATXN1; (-) strand; PAM type: NNGRRT; PAM sequence: TGGGAT
gcctcagcctcctgattagc

SEQ ID NO: 13156 - DNA, 20 bp, Artificial Sequence
  Description of Artificial Sequence: Synthetic oligonucleotide
  Target: ATXN1; (-) strand; PAM type: NNGRRT; PAM sequence: TGGAGT
tcttgctgtgtcacccaggc

SEQ ID NO: 13157 - DNA, 20 bp, Artificial Sequence
  Description of Artificial Sequence: Synthetic oligonucleotide
  Target: ATXN1; (-) strand; PAM type: NNGRRT; PAM sequence: TGGAGT
ttttttttttttttttgaga

SEQ ID NO: 13158 - DNA, 20 bp, Artificial Sequence
  Description of Artificial Sequence: Synthetic oligonucleotide
  Target: ATXN1; (-) strand; PAM type: NNGRRT; PAM sequence: CTGAAT
ataaatataatagttttcat

SEQ ID NO: 13159 - DNA, 20 bp, Artificial Sequence
  Description of Artificial Sequence: Synthetic oligonucleotide
  Target: ATXN1; (-) strand; PAM type: NNGRRT; PAM sequence: TTGAAT
ccatgtttgagaacctctga

SEQ ID NO: 13160 - DNA, 20 bp, Artificial Sequence
  Description of Artificial Sequence: Synthetic oligonucleotide
  Target: ATXN1; (-) strand; PAM type: NNGRRT; PAM sequence: GAGAAT
attagagactgcaaatgtct

SEQ ID NO: 13161 - DNA, 20 bp, Artificial Sequence
  Description of Artificial Sequence: Synthetic oligonucleotide
  Target: ATXN1; (-) strand; PAM type: NNGRRT; PAM sequence: CAGAAT
ggatcccaaacctaactgat

SEQ ID NO: 13162 - DNA, 20 bp, Artificial Sequence
  Description of Artificial Sequence: Synthetic oligonucleotide
  Target: ATXN1; (-) strand; PAM type: NNGRRT; PAM sequence: GTGGAT
aaacatgttatttttagaaa

SEQ ID NO: 13163 - DNA, 20 bp, Artificial Sequence
  Description of Artificial Sequence: Synthetic oligonucleotide
  Target: ATXN1; (-) strand; PAM type: NNGRRT; PAM sequence: ATGAAT
aaaaaacagataacaaattc

SEQ ID NO: 13164 - DNA, 20 bp, Artificial Sequence
  Description of Artificial Sequence: Synthetic oligonucleotide
  Target: ATXN1; (-) strand; PAM type: NNGRRT; PAM sequence: CAGAGT
tcttgccagttgtttgcctt

SEQ ID NO: 13165 - DNA, 20 bp, Artificial Sequence
  Description of Artificial Sequence: Synthetic oligonucleotide
  Target: ATXN1; (-) strand; PAM type: NNGRRT; PAM sequence: TGGAGT
actgaaagggattagaggcc

SEQ ID NO: 13166 - DNA, 20 bp, Artificial Sequence
  Description of Artificial Sequence: Synthetic oligonucleotide
  Target: ATXN1; (-) strand; PAM type: NNGRRT; PAM sequence: AGGGAT
agagaaataaaaagactgaa

SEQ ID NO: 13167 - DNA, 20 bp, Artificial Sequence
  Description of Artificial Sequence: Synthetic oligonucleotide
  Target: ATXN1; (-) strand; PAM type: NNGRRT; PAM sequence: CTGGAT
tgatcctggtaacctgactg

SEQ ID NO: 13168 - DNA, 20 bp, Artificial Sequence
  Description of Artificial Sequence: Synthetic oligonucleotide
  Target: ATXN1; (-) strand; PAM type: NNGRRT; PAM sequence: TAGAGT
atgtttcctttggggtatca

SEQ ID NO: 13169 - DNA, 20 bp, Artificial Sequence
  Description of Artificial Sequence: Synthetic oligonucleotide
  Target: ATXN1; (-) strand; PAM type: NNGRRT; PAM sequence: TGGGGT
agaagagttgatgtttcctt

SEQ ID NO: 13170 - DNA, 20 bp, Artificial Sequence
  Description of Artificial Sequence: Synthetic oligonucleotide
  Target: ATXN1; (-) strand; PAM type: NNGRRT; PAM sequence: AAGAGT
tgttcttgaccacctctgag

SEQ ID NO: 13171 - DNA, 20 bp, Artificial Sequence
  Description of Artificial Sequence: Synthetic oligonucleotide
  Target: ATXN1; (-) strand; PAM type: NNGRRT; PAM sequence: ACGAGT
gtaaagaaggcagcaaggtt

SEQ ID NO: 13172 - DNA, 20 bp, Artificial Sequence
  Description of Artificial Sequence: Synthetic oligonucleotide
  Target: ATXN1; (-) strand; PAM type: NNGRRT; PAM sequence: TGGAAT
catgtctctgctgatgacat

SEQ ID NO: 13173 - DNA, 20 bp, Artificial Sequence
  Description of Artificial Sequence: Synthetic oligonucleotide
  Target: ATXN1; (-) strand; PAM type: NNGRRT; PAM sequence: ATGGGT
actagcctgtttctgtatcc

SEQ ID NO: 13174 - DNA, 20 bp, Artificial Sequence
  Description of Artificial Sequence: Synthetic oligonucleotide
  Target: ATXN1; (-) strand; PAM type: NNGRRT; PAM sequence: CAGGAT
taaatagcattacaagcatc

SEQ ID NO: 13175 - DNA, 20 bp, Artificial Sequence
  Description of Artificial Sequence: Synthetic oligonucleotide
  Target: ATXN1; (-) strand; PAM type: NNGRRT; PAM sequence: ATGGGT
catctcaaaaaaaaaaaaga

SEQ ID NO: 13176 - DNA, 20 bp, Artificial Sequence
  Description of Artificial Sequence: Synthetic oligonucleotide
  Target: ATXN1; (-) strand; PAM type: NNGRRT; PAM sequence: AAGAAT
actccatctcaaaaaaaaaa

SEQ ID NO: 13177 - DNA, 20 bp, Artificial Sequence
  Description of Artificial Sequence: Synthetic oligonucleotide
  Target: ATXN1; (-) strand; PAM type: NNGRRT; PAM sequence: GAGAAT
tactcaggaggctgaggcag

SEQ ID NO: 13178 - DNA, 20 bp, Artificial Sequence
  Description of Artificial Sequence: Synthetic oligonucleotide
  Target: ATXN1; (-) strand; PAM type: NNGRRT; PAM sequence: AGGAGT
cgggtggatcacctgaggtc

SEQ ID NO: 13179 - DNA, 20 bp, Artificial Sequence
  Description of Artificial Sequence: Synthetic oligonucleotide
  Target: ATXN1; (-) strand; PAM type: NNGRRT; PAM sequence: GTGGAT
actttgggaggccaaagcgg

SEQ ID NO: 13180 - DNA, 20 bp, Artificial Sequence
  Description of Artificial Sequence: Synthetic oligonucleotide
  Target: ATXN1; (-) strand; PAM type: NNGRRT; PAM sequence: GCGGGT
tagcactttgggaggccaaa

SEQ ID NO: 13181 - DNA, 20 bp, Artificial Sequence
  Description of Artificial Sequence: Synthetic oligonucleotide
  Target: ATXN1; (-) strand; PAM type: NNGRRT; PAM sequence: AAGAAT
gtcttgtgagtttagagata

SEQ ID NO: 13182 - DNA, 20 bp, Artificial Sequence
  Description of Artificial Sequence: Synthetic oligonucleotide
  Target: ATXN1; (-) strand; PAM type: NNGRRT; PAM sequence: GTGAGT
actttgagaaccactgtctt

SEQ ID NO: 13183 - DNA, 20 bp, Artificial Sequence
  Description of Artificial Sequence: Synthetic oligonucleotide
  Target: ATXN1; (-) strand; PAM type: NNGRRT; PAM sequence: CTGGGT
tgatcatgatgccgctttcc

SEQ ID NO: 13184 - DNA, 20 bp, Artificial Sequence
  Description of Artificial Sequence: Synthetic oligonucleotide
  Target: ATXN1; (-) strand; PAM type: NNGRRT; PAM sequence: AAGAAT
cacagattgctggaaagccc

SEQ ID NO: 13185 - DNA, 20 bp, Artificial Sequence
  Description of Artificial Sequence: Synthetic oligonucleotide
  Target: ATXN1; (-) strand; PAM type: NNGRRT; PAM sequence: GAGAGT
ggagccatgtgacctcttat

SEQ ID NO: 13186 - DNA, 20 bp, Artificial Sequence
  Description of Artificial Sequence: Synthetic oligonucleotide
  Target: ATXN1; (-) strand; PAM type: NNGRRT; PAM sequence: TCGAAT
tgttttgcttatgaatttac

SEQ ID NO: 13187 - DNA, 20 bp, Artificial Sequence
  Description of Artificial Sequence: Synthetic oligonucleotide
  Target: ATXN1; (-) strand; PAM type: NNGRRT; PAM sequence: ATGAAT
tatgtgcttgtgttttgctt

SEQ ID NO: 13188 - DNA, 20 bp, Artificial Sequence
  Description of Artificial Sequence: Synthetic oligonucleotide
  Target: ATXN1; (-) strand; PAM type: NNGRRT; PAM sequence: GTGGGT
gtgaaacatgtgatctgtta

SEQ ID NO: 13189 - DNA, 20 bp, Artificial Sequence
  Description of Artificial Sequence: Synthetic oligonucleotide
  Target: ATXN1; (-) strand; PAM type: NNGRRT; PAM sequence: GTGGGT
taagtcatacactattttgt

SEQ ID NO: 13190 - DNA, 20 bp, Artificial Sequence
  Description of Artificial Sequence: Synthetic oligonucleotide
  Target: ATXN1; (-) strand; PAM type: NNGRRT; PAM sequence: ATGGAT
gtttgaggctgcagtgagct

SEQ ID NO: 13191 - DNA, 20 bp, Artificial Sequence
  Description of Artificial Sequence: Synthetic oligonucleotide
  Target: ATXN1; (-) strand; PAM type: NNGRRT; PAM sequence: AGGAGT
tgggaggattgcttgagccc

SEQ ID NO: 13192 - DNA, 20 bp, Artificial Sequence
  Description of Artificial Sequence: Synthetic oligonucleotide
  Target: ATXN1; (-) strand; PAM type: NNGRRT; PAM sequence: GAGGAT
tactcaggaggctgatgtgg

SEQ ID NO: 13193 - DNA, 20 bp, Artificial Sequence
  Description of Artificial Sequence: Synthetic oligonucleotide
  Target: ATXN1; (-) strand; PAM type: NNGRRT; PAM sequence: CCGGGT
caaaaaaatttaaaaattag

SEQ ID NO: 13194 - DNA, 20 bp, Artificial Sequence
  Description of Artificial Sequence: Synthetic oligonucleotide
  Target: ATXN1; (-) strand; PAM type: NNGRRT; PAM sequence: AGGAAT
taggaagatcacttgaggtc

SEQ ID NO: 13195 - DNA, 20 bp, Artificial Sequence
  Description of Artificial Sequence: Synthetic oligonucleotide
  Target: ATXN1; (-) strand; PAM type: NNGRRT; PAM sequence: TAGAGT
gtaggcaaataatgtagaga

SEQ ID NO: 13196 - DNA, 20 bp, Artificial Sequence
  Description of Artificial Sequence: Synthetic oligonucleotide
  Target: ATXN1; (-) strand; PAM type: NNGRRT; PAM sequence: ATGAAT
agacacactggtcatatgtc

SEQ ID NO: 13197 - DNA, 20 bp, Artificial Sequence
  Description of Artificial Sequence: Synthetic oligonucleotide
  Target: ATXN1; (-) strand; PAM type: NNGRRT; PAM sequence: TGGGAT
accttggcctcccaaagtgc

SEQ ID NO: 13198 - DNA, 20 bp, Artificial Sequence
  Description of Artificial Sequence: Synthetic oligonucleotide
  Target: ATXN1; (-) strand; PAM type: NNGRRT; PAM sequence: TAGAAT
aaaaaaaggtgattccatgt

SEQ ID NO: 13199 - DNA, 20 bp, Artificial Sequence
  Description of Artificial Sequence: Synthetic oligonucleotide
  Target: ATXN1; (-) strand; PAM type: NNGRRT; PAM sequence: ACGAAT
taaaactaggggagggaggc

SEQ ID NO: 13200 - DNA, 20 bp, Artificial Sequence
  Description of Artificial Sequence: Synthetic oligonucleotide
  Target: ATXN1; (-) strand; PAM type: NNGRRT; PAM sequence: CAGAAT
agccaaagaaaccagtattt

SEQ ID NO: 13201 - DNA, 20 bp, Artificial Sequence
  Description of Artificial Sequence: Synthetic oligonucleotide
  Target: ATXN1; (-) strand; PAM type: NNGRRT; PAM sequence: GAGGGT
ccataatcacaggttgaggt

SEQ ID NO: 13202 - DNA, 20 bp, Artificial Sequence
  Description of Artificial Sequence: Synthetic oligonucleotide
  Target: ATXN1; (-) strand; PAM type: NNGRRT; PAM sequence: AGGAGT
catgatgcacgtgaccggga

SEQ ID NO: 13203 - DNA, 20 bp, Artificial Sequence
  Description of Artificial Sequence: Synthetic oligonucleotide
  Target: ATXN1; (-) strand; PAM type: NNGRRT; PAM sequence: AAGGGT
ttttctggctatctatcctt

SEQ ID NO: 13204 - DNA, 20 bp, Artificial Sequence
  Description of Artificial Sequence: Synthetic oligonucleotide
  Target: ATXN1; (-) strand; PAM type: NNGRRT; PAM sequence: TGGAAT
tatcagatgtcaattaacaa

SEQ ID NO: 13205 - DNA, 20 bp, Artificial Sequence
  Description of Artificial Sequence: Synthetic oligonucleotide
  Target: ATXN1; (-) strand; PAM type: NNGRRT; PAM sequence: GTGAAT
tgaaaaatatgctaattacc

SEQ ID NO: 13206 - DNA, 20 bp, Artificial Sequence
  Description of Artificial Sequence: Synthetic oligonucleotide
  Target: ATXN1; (-) strand; PAM type: NNGRRT; PAM sequence: TTGAAT
gaaaactagacaagaggaat

SEQ ID NO: 13207 - DNA, 20 bp, Artificial Sequence
  Description of Artificial Sequence: Synthetic oligonucleotide
  Target: ATXN1; (-) strand; PAM type: NNGRRT; PAM sequence: AGGAAT
actgcagaaaactagacaag

SEQ ID NO: 13208 - DNA, 20 bp, Artificial Sequence
  Description of Artificial Sequence: Synthetic oligonucleotide
  Target: ATXN1; (-) strand; PAM type: NNGRRT; PAM sequence: TAGGGT
ttaaacagagctgaatttta

SEQ ID NO: 13209 - DNA, 20 bp, Artificial Sequence
  Description of Artificial Sequence: Synthetic oligonucleotide
  Target: ATXN1; (-) strand; PAM type: NNGRRT; PAM sequence: CTGAAT
aagataggacttaaacagag

SEQ ID NO: 13210 - DNA, 20 bp, Artificial Sequence
  Description of Artificial Sequence: Synthetic oligonucleotide
  Target: ATXN1; (-) strand; PAM type: NNGRRT; PAM sequence: ATGGAT
ttagtattgaaaaatggttt

SEQ ID NO: 13211 - DNA, 20 bp, Artificial Sequence
  Description of Artificial Sequence: Synthetic oligonucleotide
  Target: ATXN1; (-) strand; PAM type: NNGRRT; PAM sequence: ATGGAT
cgtggaaaatgcagtcataa

SEQ ID NO: 13212 - DNA, 20 bp, Artificial Sequence
  Description of Artificial Sequence: Synthetic oligonucleotide
  Target: ATXN1; (-) strand; PAM type: NNGRRT; PAM sequence: ATGAAT
ttacagtacaaagttatacc

SEQ ID NO: 13213 - DNA, 20 bp, Artificial Sequence
  Description of Artificial Sequence: Synthetic oligonucleotide
  Target: ATXN1; (-) strand; PAM type: NNGRRT; PAM sequence: AGGAGT
cgggtgatccgcctcgcctc

SEQ ID NO: 13214 - DNA, 20 bp, Artificial Sequence
  Description of Artificial Sequence: Synthetic oligonucleotide
  Target: ATXN1; (-) strand; PAM type: NNGRRT; PAM sequence: TCGGGT
tggtctcgaactccccgatc

SEQ ID NO: 13215 - DNA, 20 bp, Artificial Sequence
  Description of Artificial Sequence: Synthetic oligonucleotide
  Target: ATXN1; (-) strand; PAM type: NNGRRT; PAM sequence: CGGGAT
ttttgtatttttagtagaga

SEQ ID NO: 13216 - DNA, 20 bp, Artificial Sequence
  Description of Artificial Sequence: Synthetic oligonucleotide
  Target: ATXN1; (-) strand; PAM type: NNGRRT; PAM sequence: CTGAGT
gattctcctgcctcagcctc

SEQ ID NO: 13217 - DNA, 20 bp, Artificial Sequence
  Description of Artificial Sequence: Synthetic oligonucleotide
  Target: ATXN1; (-) strand; PAM type: NNGRRT; PAM sequence: CCGGGT
ctcaccgcaacctccacctc

SEQ ID NO: 13218 - DNA, 20 bp, Artificial Sequence
  Description of Artificial Sequence: Synthetic oligonucleotide
  Target: ATXN1; (-) strand; PAM type: NNGRRT; PAM sequence: TGGAAT
ttcgctcttgttggccaggc

SEQ ID NO: 13219 - DNA, 20 bp, Artificial Sequence
  Description of Artificial Sequence: Synthetic oligonucleotide
  Target: ATXN1; (-) strand; PAM type: NNGRRT; PAM sequence: CGGAGT
ttttttttttttttttgaga

SEQ ID NO: 13220 - DNA, 20 bp, Artificial Sequence
  Description of Artificial Sequence: Synthetic oligonucleotide
  Target: ATXN1; (-) strand; PAM type: NNGRRT; PAM sequence: ATGAGT
gagtaaaatgagggatgatg

SEQ ID NO: 13221 - DNA, 20 bp, Artificial Sequence
  Description of Artificial Sequence: Synthetic oligonucleotide
  Target: ATXN1; (-) strand; PAM type: NNGRRT; PAM sequence: AGGGAT
tagtaaaatagagtaaaatg

SEQ ID NO: 13222 - DNA, 20 bp, Artificial Sequence
  Description of Artificial Sequence: Synthetic oligonucleotide
  Target: ATXN1; (-) strand; PAM type: NNGRRT; PAM sequence: TAGAGT
tcatacagataatagtaaaa

SEQ ID NO: 13223 - DNA, 20 bp, Artificial Sequence
  Description of Artificial Sequence: Synthetic oligonucleotide
  Target: ATXN1; (-) strand; PAM type: NNGRRT; PAM sequence: ATGAGT
accagcatcaccacaaacat

SEQ ID NO: 13224 - DNA, 20 bp, Artificial Sequence
  Description of Artificial Sequence: Synthetic oligonucleotide
  Target: ATXN1; (-) strand; PAM type: NNGRRT; PAM sequence: AAGAGT
gttaatttcttataggtaga

SEQ ID NO: 13225 - DNA, 20 bp, Artificial Sequence
  Description of Artificial Sequence: Synthetic oligonucleotide
  Target: ATXN1; (-) strand; PAM type: NNGRRT; PAM sequence: TGGGAT
accttggcctcccaaagtgc

SEQ ID NO: 13226 - DNA, 20 bp, Artificial Sequence
  Description of Artificial Sequence: Synthetic oligonucleotide
  Target: ATXN1; (-) strand; PAM type: NNGRRT; PAM sequence: CAGGAT
atgggtttcaccatgttggc

SEQ ID NO: 13227 - DNA, 20 bp, Artificial Sequence
  Description of Artificial Sequence: Synthetic oligonucleotide
  Target: ATXN1; (-) strand; PAM type: NNGRRT; PAM sequence: ATGGGT
tttttgtatttttagtagag

SEQ ID NO: 13228 - DNA, 20 bp, Artificial Sequence
  Description of Artificial Sequence: Synthetic oligonucleotide
  Target: ATXN1; (-) strand; PAM type: NNGRRT; PAM sequence: TGGAGT
gtctcgctctgtcaccaggc

SEQ ID NO: 13229 - DNA, 20 bp, Artificial Sequence
  Description of Artificial Sequence: Synthetic oligonucleotide
  Target: ATXN1; (-) strand; PAM type: NNGRRT; PAM sequence: CGGAGT
ttttttttttttttttgaga

SEQ ID NO: 13230 - DNA, 20 bp, Artificial Sequence
  Description of Artificial Sequence: Synthetic oligonucleotide
  Target: ATXN1; (-) strand; PAM type: NNGRRT; PAM sequence: ATGAAT
aggtcttcagaggcaatacc

SEQ ID NO: 13231 - DNA, 20 bp, Artificial Sequence
  Description of Artificial Sequence: Synthetic oligonucleotide
  Target: ATXN1; (-) strand; PAM type: NNGRRT; PAM sequence: CAGGGT
tacattagcctagccccaca

SEQ ID NO: 13232 - DNA, 20 bp, Artificial Sequence
  Description of Artificial Sequence: Synthetic oligonucleotide
  Target: ATXN1; (-) strand; PAM type: NNGRRT; PAM sequence: TGGGAT
gcctcagcctcccaaaatgc

SEQ ID NO: 13233 - DNA, 20 bp, Artificial Sequence
  Description of Artificial Sequence: Synthetic oligonucleotide
  Target: ATXN1; (-) strand; PAM type: NNGRRT; PAM sequence: AAGAAT
aacacattttacagctgtac

SEQ ID NO: 13234 - DNA, 20 bp, Artificial Sequence
  Description of Artificial Sequence: Synthetic oligonucleotide
  Target: ATXN1; (-) strand; PAM type: NNGRRT; PAM sequence: GTGAAT
agtcagtgagtgggtggtga

SEQ ID NO: 13235 - DNA, 20 bp, Artificial Sequence
  Description of Artificial Sequence: Synthetic oligonucleotide
  Target: ATXN1; (-) strand; PAM type: NNGRRT; PAM sequence: GTGAGT
ggtgagtcagtgagtgggtg

SEQ ID NO: 13236 - DNA, 20 bp, Artificial Sequence
  Description of Artificial Sequence: Synthetic oligonucleotide
  Target: ATXN1; (-) strand; PAM type: NNGRRT; PAM sequence: GTGGGT
tgctctgggtgagtcagtga

SEQ ID NO: 13237 - DNA, 20 bp, Artificial Sequence
  Description of Artificial Sequence: Synthetic oligonucleotide
  Target: ATXN1; (-) strand; PAM type: NNGRRT; PAM sequence: GTGAGT
aagttgctctgggtgagtca

SEQ ID NO: 13238 - DNA, 20 bp, Artificial Sequence
  Description of Artificial Sequence: Synthetic oligonucleotide
  Target: ATXN1; (-) strand; PAM type: NNGRRT; PAM sequence: GTGAGT
aggactggaagttgctctgg

SEQ ID NO: 13239 - DNA, 20 bp, Artificial Sequence
  Description of Artificial Sequence: Synthetic oligonucleotide
  Target: ATXN1; (-) strand; PAM type: NNGRRT; PAM sequence: CTGGGT
ttgcaggactggaagttgct

SEQ ID NO: 13240 - DNA, 20 bp, Artificial Sequence
  Description of Artificial Sequence: Synthetic oligonucleotide
  Target: ATXN1; (-) strand; PAM type: NNGRRT; PAM sequence: ATGAAT
acctatatagggcacttacc

SEQ ID NO: 13241 - DNA, 20 bp, Artificial Sequence
  Description of Artificial Sequence: Synthetic oligonucleotide
  Target: ATXN1; (-) strand; PAM type: NNGRRT; PAM sequence: TAGAAT
agtttttgtgcatctagaca

SEQ ID NO: 13242 - DNA, 20 bp, Artificial Sequence
  Description of Artificial Sequence: Synthetic oligonucleotide
  Target: ATXN1; (-) strand; PAM type: NNGRRT; PAM sequence: CTGAAT
gcactcagcaccttactgta

SEQ ID NO: 13243 - DNA, 20 bp, Artificial Sequence
  Description of Artificial Sequence: Synthetic oligonucleotide
  Target: ATXN1; (-) strand; PAM type: NNGRRT; PAM sequence: TAGGGT
ctaggatacaaacttggaca

SEQ ID NO: 13244 - DNA, 20 bp, Artificial Sequence
  Description of Artificial Sequence: Synthetic oligonucleotide
  Target: ATXN1; (-) strand; PAM type: NNGRRT; PAM sequence: TAGGAT
ataatgcagcctgttgctcc

SEQ ID NO: 13245 - DNA, 20 bp, Artificial Sequence
  Description of Artificial Sequence: Synthetic oligonucleotide
  Target: ATXN1; (-) strand; PAM type: NNGRRT; PAM sequence: GGGAAT
gtcgtgcatcacttaataat

SEQ ID NO: 13246 - DNA, 20 bp, Artificial Sequence
  Description of Artificial Sequence: Synthetic oligonucleotide
  Target: ATXN1; (-) strand; PAM type: NNGRRT; PAM sequence: GGGAAT
aaaagtttagctactggctc

SEQ ID NO: 13247 - DNA, 20 bp, Artificial Sequence
  Description of Artificial Sequence: Synthetic oligonucleotide
  Target: ATXN1; (-) strand; PAM type: NNGRRT; PAM sequence: CTGGAT
tcgtgccattgcactccagc

SEQ ID NO: 13248 - DNA, 20 bp, Artificial Sequence
  Description of Artificial Sequence: Synthetic oligonucleotide
  Target: ATXN1; (-) strand; PAM type: NNGRRT; PAM sequence: GAGAAT
tactcgggaggctgaagcag

SEQ ID NO: 13249 - DNA, 20 bp, Artificial Sequence
  Description of Artificial Sequence: Synthetic oligonucleotide
  Target: ATXN1; (-) strand; PAM type: NNGRRT; PAM sequence: AGGAGT
caggcagatcacctgaggtc

SEQ ID NO: 13250 - DNA, 20 bp, Artificial Sequence
  Description of Artificial Sequence: Synthetic oligonucleotide
  Target: ATXN1; (-) strand; PAM type: NNGRRT; PAM sequence: ATGGAT
tcacttaagaaaaagttgga

SEQ ID NO: 13251 - DNA, 20 bp, Artificial Sequence
  Description of Artificial Sequence: Synthetic oligonucleotide
  Target: ATXN1; (-) strand; PAM type: NNGRRT; PAM sequence: TGGAAT
tatttcacttaagaaaaagt

SEQ ID NO: 13252 - DNA, 20 bp, Artificial Sequence
  Description of Artificial Sequence: Synthetic oligonucleotide
  Target: ATXN1; (-) strand; PAM type: NNGRRT; PAM sequence: GGGAGT
ttcagtagcagataaacaga

SEQ ID NO: 13253 - DNA, 20 bp, Artificial Sequence
  Description of Artificial Sequence: Synthetic oligonucleotide
  Target: ATXN1; (-) strand; PAM type: NNGRRT; PAM sequence: CTGAGT
acacacatacaattacattt

SEQ ID NO: 13254 - DNA, 20 bp, Artificial Sequence
  Description of Artificial Sequence: Synthetic oligonucleotide
  Target: ATXN1; (-) strand; PAM type: NNGRRT; PAM sequence: GTGAGT
cttgaagatagtattcttgt

SEQ ID NO: 13255 - DNA, 20 bp, Artificial Sequence
  Description of Artificial Sequence: Synthetic oligonucleotide
  Target: ATXN1; (-) strand; PAM type: NNGRRT; PAM sequence: AAGGAT
caaattctgtggccgtggtg

SEQ ID NO: 13256 - DNA, 20 bp, Artificial Sequence
  Description of Artificial Sequence: Synthetic oligonucleotide
  Target: ATXN1; (-) strand; PAM type: NNGRRT; PAM sequence: AGGAGT
tcaacatagcaatggttgcg

SEQ ID NO: 13257 - DNA, 20 bp, Artificial Sequence
  Description of Artificial Sequence: Synthetic oligonucleotide
  Target: ATXN1; (-) strand; PAM type: NNGRRT; PAM sequence: TTGAGT
caagatttggatttctggat

SEQ ID NO: 13258 - DNA, 20 bp, Artificial Sequence
  Description of Artificial Sequence: Synthetic oligonucleotide
  Target: ATXN1; (-) strand; PAM type: NNGRRT; PAM sequence: CTGGAT
agaatacaagatttggattt

SEQ ID NO: 13259 - DNA, 20 bp, Artificial Sequence
  Description of Artificial Sequence: Synthetic oligonucleotide
  Target: ATXN1; (-) strand; PAM type: NNGRRT; PAM sequence: TTGGAT
aagtctaaagaatacaagat

SEQ ID NO: 13260 - DNA, 20 bp, Artificial Sequence
  Description of Artificial Sequence: Synthetic oligonucleotide
  Target: ATXN1; (-) strand; PAM type: NNGRRT; PAM sequence: AAGAAT
ataacctgtggtaaagtcta

SEQ ID NO: 13261 - DNA, 20 bp, Artificial Sequence
  Description of Artificial Sequence: Synthetic oligonucleotide
  Target: ATXN1; (-) strand; PAM type: NNGRRT; PAM sequence: GTGGGT
tcgtatttgtaaacgtagat

SEQ ID NO: 13262 - DNA, 20 bp, Artificial Sequence
  Description of Artificial Sequence: Synthetic oligonucleotide
  Target: ATXN1; (-) strand; PAM type: NNGRRT; PAM sequence: TGGAGT
caggaagggagcttagatgg

SEQ ID NO: 13263 - DNA, 20 bp, Artificial Sequence
  Description of Artificial Sequence: Synthetic oligonucleotide
  Target: ATXN1; (-) strand; PAM type: NNGRRT; PAM sequence: GGGGAT
atctaagacgttgcagcagt

SEQ ID NO: 13264 - DNA, 20 bp, Artificial Sequence
  Description of Artificial Sequence: Synthetic oligonucleotide
  Target: ATXN1; (-) strand; PAM type: NNGRRT; PAM sequence: AGGAAT
cacctgcctaggacatcttt

SEQ ID NO: 13265 - DNA, 20 bp, Artificial Sequence
  Description of Artificial Sequence: Synthetic oligonucleotide
  Target: ATXN1; (-) strand; PAM type: NNGRRT; PAM sequence: TTGAAT
ccttaggcttctctttgggt

SEQ ID NO: 13266 - DNA, 20 bp, Artificial Sequence
  Description of Artificial Sequence: Synthetic oligonucleotide
  Target: ATXN1; (-) strand; PAM type: NNGRRT; PAM sequence: TTGGGT
tagatgccttaggcttctct

SEQ ID NO: 13267 - DNA, 20 bp, Artificial Sequence
  Description of Artificial Sequence: Synthetic oligonucleotide
  Target: ATXN1; (-) strand; PAM type: NNGRRT; PAM sequence: TTGAAT
ttattcacgattacttctat

SEQ ID NO: 13268 - DNA, 20 bp, Artificial Sequence
  Description of Artificial Sequence: Synthetic oligonucleotide
  Target: ATXN1; (-) strand; PAM type: NNGRRT; PAM sequence: TTGGAT
tcaccattaagtgcaagaac

SEQ ID NO: 13269 - DNA, 20 bp, Artificial Sequence
  Description of Artificial Sequence: Synthetic oligonucleotide
  Target: ATXN1; (-) strand; PAM type: NNGRRT; PAM sequence: GAGAGT
tgcatatgtatgtgtatata

SEQ ID NO: 13270 - DNA, 20 bp, Artificial Sequence
  Description of Artificial Sequence: Synthetic oligonucleotide
  Target: ATXN1; (-) strand; PAM type: NNGRRT; PAM sequence: AGGGAT
gtacatatctgataaaaggc

SEQ ID NO: 13271 - DNA, 20 bp, Artificial Sequence
  Description of Artificial Sequence: Synthetic oligonucleotide
  Target: ATXN1; (-) strand; PAM type: NNGRRT; PAM sequence: AAGGAT
aatcattttagacatattgc

SEQ ID NO: 13272 - DNA, 20 bp, Artificial Sequence
  Description of Artificial Sequence: Synthetic oligonucleotide
  Target: ATXN1; (-) strand; PAM type: NNGRRT; PAM sequence: CAGGAT
agcattcttcacatttttcc

SEQ ID NO: 13273 - DNA, 20 bp, Artificial Sequence
  Description of Artificial Sequence: Synthetic oligonucleotide
  Target: ATXN1; (-) strand; PAM type: NNGRRT; PAM sequence: CAGGAT
aaagaaaacctacctccaaa

SEQ ID NO: 13274 - DNA, 20 bp, Artificial Sequence
  Description of Artificial Sequence: Synthetic oligonucleotide
  Target: ATXN1; (-) strand; PAM type: NNGRRT; PAM sequence: GTGAGT
cacacgatcgtcctctcatg

SEQ ID NO: 13275 - DNA, 20 bp, Artificial Sequence
  Description of Artificial Sequence: Synthetic oligonucleotide
  Target: ATXN1; (-) strand; PAM type: NNGRRT; PAM sequence: TGGAAT
tgagacggaggcatgtttaa

SEQ ID NO: 13276 - DNA, 20 bp, Artificial Sequence
  Description of Artificial Sequence: Synthetic oligonucleotide
  Target: ATXN1; (-) strand; PAM type: NNGRRT; PAM sequence: TGGAGT
ctgaaggttttaaccctggc

SEQ ID NO: 13277 - DNA, 20 bp, Artificial Sequence
  Description of Artificial Sequence: Synthetic oligonucleotide
  Target: ATXN1; (-) strand; PAM type: NNGRRT; PAM sequence: ATGGGT
aaatcctgacaaggggacag

SEQ ID NO: 13278 - DNA, 20 bp, Artificial Sequence
  Description of Artificial Sequence: Synthetic oligonucleotide
  Target: ATXN1; (-) strand; PAM type: NNGRRT; PAM sequence: AAGAAT
gtaattcactagtgacctct

SEQ ID NO: 13279 - DNA, 20 bp, Artificial Sequence
  Description of Artificial Sequence: Synthetic oligonucleotide
  Target: ATXN1; (-) strand; PAM type: NNGRRT; PAM sequence: CAGGGT
gaaactccatcatctcttgc

SEQ ID NO: 13280 - DNA, 20 bp, Artificial Sequence
  Description of Artificial Sequence: Synthetic oligonucleotide
  Target: ATXN1; (-) strand; PAM type: NNGRRT; PAM sequence: GAGAAT
gagagccagagggttagaag

SEQ ID NO: 13281 - DNA, 20 bp, Artificial Sequence
  Description of Artificial Sequence: Synthetic oligonucleotide
  Target: ATXN1; (-) strand; PAM type: NNGRRT; PAM sequence: GAGGGT
ttgcttccggttgagagcca

SEQ ID NO: 13282 - DNA, 20 bp, Artificial Sequence
  Description of Artificial Sequence: Synthetic oligonucleotide
  Target: ATXN1; (-) strand; PAM type: NNGRRT; PAM sequence: CTGGAT
gcattcctggcctctatgcg

SEQ ID NO: 13283 - DNA, 20 bp, Artificial Sequence
  Description of Artificial Sequence: Synthetic oligonucleotide
  Target: ATXN1; (-) strand; PAM type: NNGRRT; PAM sequence: GGGGGT
tggggaagcagggagatgga

SEQ ID NO: 13284 - DNA, 20 bp, Artificial Sequence
  Description of Artificial Sequence: Synthetic oligonucleotide
  Target: ATXN1; (-) strand; PAM type: NNGRRT; PAM sequence: GGGAAT
ttctgcttccctttagagca

SEQ ID NO: 13285 - DNA, 20 bp, Artificial Sequence
  Description of Artificial Sequence: Synthetic oligonucleotide
  Target: ATXN1; (-) strand; PAM type: NNGRRT; PAM sequence: GAGGAT
caaggaaacaagcatcttca

SEQ ID NO: 13286 - DNA, 20 bp, Artificial Sequence
  Description of Artificial Sequence: Synthetic oligonucleotide
  Target: ATXN1; (-) strand; PAM type: NNGRRT; PAM sequence: CTGGGT
cacattctggttctgtcagt

SEQ ID NO: 13287 - DNA, 20 bp, Artificial Sequence
  Description of Artificial Sequence: Synthetic oligonucleotide
  Target: ATXN1; (-) strand; PAM type: NNGRRT; PAM sequence: AAGGAT
atagaaggacagacagacct

SEQ ID NO: 13288 - DNA, 20 bp, Artificial Sequence
  Description of Artificial Sequence: Synthetic oligonucleotide
  Target: ATXN1; (-) strand; PAM type: NNGRRT; PAM sequence: GTGAAT
gtggaaataattaatactga

SEQ ID NO: 13289 - DNA, 20 bp, Artificial Sequence
  Description of Artificial Sequence: Synthetic oligonucleotide
  Target: ATXN1; (-) strand; PAM type: NNGRRT; PAM sequence: CTGAGT
cagagtggaaataattaata

SEQ ID NO: 13290 - DNA, 20 bp, Artificial Sequence
  Description of Artificial Sequence: Synthetic oligonucleotide
  Target: ATXN1; (-) strand; PAM type: NNGRRT; PAM sequence: CAGAGT
attactgtgtattcagaggg

SEQ ID NO: 13291 - DNA, 20 bp, Artificial Sequence
  Description of Artificial Sequence: Synthetic oligonucleotide
  Target: ATXN1; (-) strand; PAM type: NNGRRT; PAM sequence: GAGAAT
aggttacagtctgggttgga

SEQ ID NO: 13292 - DNA, 20 bp, Artificial Sequence
  Description of Artificial Sequence: Synthetic oligonucleotide
  Target: ATXN1; (-) strand; PAM type: NNGRRT; PAM sequence: CTGGGT
cagggagccaaggttacagt

SEQ ID NO: 13293 - DNA, 20 bp, Artificial Sequence
  Description of Artificial Sequence: Synthetic oligonucleotide
  Target: ATXN1; (-) strand; PAM type: NNGRRT; PAM sequence: GAGGAT
aagagaaggaattttcgaat

SEQ ID NO: 13294 - DNA, 20 bp, Artificial Sequence
  Description of Artificial Sequence: Synthetic oligonucleotide
  Target: ATXN1; (-) strand; PAM type: NNGRRT; PAM sequence: TCGAAT
ggtcagaagagaaggaattt

SEQ ID NO: 13295 - DNA, 20 bp, Artificial Sequence
  Description of Artificial Sequence: Synthetic oligonucleotide
  Target: ATXN1; (-) strand; PAM type: NNGRRT; PAM sequence: AGGAAT
ggccacgtggtcagaagaga

SEQ ID NO: 13296 - DNA, 20 bp, Artificial Sequence
  Description of Artificial Sequence: Synthetic oligonucleotide
  Target: ATXN1; (-) strand; PAM type: NNGRRT; PAM sequence: AGGAAT
cagttgggttgagggcaaat

SEQ ID NO: 13297 - DNA, 20 bp, Artificial Sequence
  Description of Artificial Sequence: Synthetic oligonucleotide
  Target: ATXN1; (-) strand; PAM type: NNGRRT; PAM sequence: TTGGGT
gtcactggagaattccacag

SEQ ID NO: 13298 - DNA, 20 bp, Artificial Sequence
  Description of Artificial Sequence: Synthetic oligonucleotide
  Target: ATXN1; (-) strand; PAM type: NNGRRT; PAM sequence: GAGAAT
tgtcatccacatagtcactg

SEQ ID NO: 13299 - DNA, 20 bp, Artificial Sequence
  Description of Artificial Sequence: Synthetic oligonucleotide
  Target: ATXN1; (-) strand; PAM type: NNGRRT; PAM sequence: AGGAAT
gtagaaaaggttcaggaacc

SEQ ID NO: 13300 - DNA, 20 bp, Artificial Sequence
  Description of Artificial Sequence: Synthetic oligonucleotide
  Target: ATXN1; (-) strand; PAM type: NNGRRT; PAM sequence: GGGAAT
aacaaatgaatgttctgaag

SEQ ID NO: 13301 - DNA, 20 bp, Artificial Sequence
  Description of Artificial Sequence: Synthetic oligonucleotide
  Target: ATXN1; (-) strand; PAM type: NNGRRT; PAM sequence: ATGAAT
cataaatattggattaacaa

SEQ ID NO: 13302 - DNA, 20 bp, Artificial Sequence
  Description of Artificial Sequence: Synthetic oligonucleotide
  Target: ATXN1; (-) strand; PAM type: NNGRRT; PAM sequence: TTGGAT
aaagagacacatcataaata

SEQ ID NO: 13303 - DNA, 20 bp, Artificial Sequence
  Description of Artificial Sequence: Synthetic oligonucleotide
  Target: ATXN1; (-) strand; PAM type: NNGRRT; PAM sequence: TGGAGT
gcatgtgggaactactgggt

SEQ ID NO: 13304 - DNA, 20 bp, Artificial Sequence
  Description of Artificial Sequence: Synthetic oligonucleotide
  Target: ATXN1; (-) strand; PAM type: NNGRRT; PAM sequence: CTGGGT
agaccagcatgtgggaacta

SEQ ID NO: 13305 - DNA, 20 bp, Artificial Sequence
  Description of Artificial Sequence: Synthetic oligonucleotide
  Target: ATXN1; (-) strand; PAM type: NNGRRT; PAM sequence: ACGGAT
ctttatttttcttcatttcc

SEQ ID NO: 13306 - DNA, 20 bp, Artificial Sequence
  Description of Artificial Sequence: Synthetic oligonucleotide
  Target: ATXN1; (-) strand; PAM type: NNGRRT; PAM sequence: CAGAGT
aagtgaaaataatataatat

SEQ ID NO: 13307 - DNA, 20 bp, Artificial Sequence
  Description of Artificial Sequence: Synthetic oligonucleotide
  Target: ATXN1; (-) strand; PAM type: NNGRRT; PAM sequence: AGGGAT
tctaatctttttaaaaagga

SEQ ID NO: 13308 - DNA, 20 bp, Artificial Sequence
  Description of Artificial Sequence: Synthetic oligonucleotide
  Target: ATXN1; (-) strand; PAM type: NNGRRT; PAM sequence: GTGGGT
ttaatggggtactagcatat

SEQ ID NO: 13309 - DNA, 20 bp, Artificial Sequence
  Description of Artificial Sequence: Synthetic oligonucleotide
  Target: ATXN1; (-) strand; PAM type: NNGRRT; PAM sequence: TGGGGT
gatgagttttagaaaattaa

SEQ ID NO: 13310 - DNA, 20 bp, Artificial Sequence
  Description of Artificial Sequence: Synthetic oligonucleotide
  Target: ATXN1; (-) strand; PAM type: NNGRRT; PAM sequence: ATGAGT
gccacttccaggtttcaagg

SEQ ID NO: 13311 - DNA, 20 bp, Artificial Sequence
  Description of Artificial Sequence: Synthetic oligonucleotide
  Target: ATXN1; (-) strand; PAM type: NNGRRT; PAM sequence: AAGGAT
gaaagccacttccaggtttc

SEQ ID NO: 13312 - DNA, 20 bp, Artificial Sequence
  Description of Artificial Sequence: Synthetic oligonucleotide
  Target: ATXN1; (-) strand; PAM type: NNGRRT; PAM sequence: TTGAAT
cccaggcttgacttggcaca

SEQ ID NO: 13313 - DNA, 20 bp, Artificial Sequence
  Description of Artificial Sequence: Synthetic oligonucleotide
  Target: ATXN1; (-) strand; PAM type: NNGRRT; PAM sequence: CAGGAT
gcctcagcttcccaaaacac

SEQ ID NO: 13314 - DNA, 20 bp, Artificial Sequence
  Description of Artificial Sequence: Synthetic oligonucleotide
  Target: ATXN1; (-) strand; PAM type: NNGRRT; PAM sequence: AAGGGT
aaattatgttttttagagtc

SEQ ID NO: 13315 - DNA, 20 bp, Artificial Sequence
  Description of Artificial Sequence: Synthetic oligonucleotide
  Target: ATXN1; (-) strand; PAM type: NNGRRT; PAM sequence: TAGAGT
aatttttaaattatgttttt

SEQ ID NO: 13316 - DNA, 20 bp, Artificial Sequence
  Description of Artificial Sequence: Synthetic oligonucleotide
  Target: ATXN1; (-) strand; PAM type: NNGRRT; PAM sequence: CTGAGT
cgattctccaccctcagcct

SEQ ID NO: 13317 - DNA, 20 bp, Artificial Sequence
  Description of Artificial Sequence: Synthetic oligonucleotide
  Target: ATXN1; (-) strand; PAM type: NNGRRT; PAM sequence: TCGGGT
cttttgtaaattgctcagtc

SEQ ID NO: 13318 - DNA, 20 bp, Artificial Sequence
  Description of Artificial Sequence: Synthetic oligonucleotide
  Target: ATXN1; (-) strand; PAM type: NNGRRT; PAM sequence: ATGGAT
cccatgctgttctcgtggta

SEQ ID NO: 13319 - DNA, 20 bp, Artificial Sequence
  Description of Artificial Sequence: Synthetic oligonucleotide
  Target: ATXN1; (-) strand; PAM type: NNGRRT; PAM sequence: TTGAAT
gagggacctggtgggaggta

SEQ ID NO: 13320 - DNA, 20 bp, Artificial Sequence
  Description of Artificial Sequence: Synthetic oligonucleotide
  Target: ATXN1; (-) strand; PAM type: NNGRRT; PAM sequence: CTGAGT
taatgtgcatcaaatatatt

SEQ ID NO: 13321 - DNA, 20 bp, Artificial Sequence
  Description of Artificial Sequence: Synthetic oligonucleotide
  Target: ATXN1; (-) strand; PAM type: NNGRRT; PAM sequence: AAGGGT
cctgttttgtgaaaacatta

SEQ ID NO: 13322 - DNA, 20 bp, Artificial Sequence
  Description of Artificial Sequence: Synthetic oligonucleotide
  Target: ATXN1; (-) strand; PAM type: NNGRRT; PAM sequence: ACGAAT
ttgtctcgtaagttttaaaa

SEQ ID NO: 13323 - DNA, 20 bp, Artificial Sequence
  Description of Artificial Sequence: Synthetic oligonucleotide
  Target: ATXN1; (-) strand; PAM type: NNGRRT; PAM sequence: GTGGGT
tcttctgttgttcttggctt

SEQ ID NO: 13324 - DNA, 20 bp, Artificial Sequence
  Description of Artificial Sequence: Synthetic oligonucleotide
  Target: ATXN1; (-) strand; PAM type: NNGRRT; PAM sequence: AGGAGT
gaagttgaataaatgagaac

SEQ ID NO: 13325 - DNA, 20 bp, Artificial Sequence
  Description of Artificial Sequence: Synthetic oligonucleotide
  Target: ATXN1; (-) strand; PAM type: NNGRRT; PAM sequence: TTGAAT
atgtcagtgagggctggaag

SEQ ID NO: 13326 - DNA, 20 bp, Artificial Sequence
  Description of Artificial Sequence: Synthetic oligonucleotide
  Target: ATXN1; (-) strand; PAM type: NNGRRT; PAM sequence: GGGAGT
acaacagccctgggcacagc

SEQ ID NO: 13327 - DNA, 20 bp, Artificial Sequence
  Description of Artificial Sequence: Synthetic oligonucleotide
  Target: ATXN1; (-) strand; PAM type: NNGRRT; PAM sequence: TGGAGT
gagttcgtgaattttttctg

SEQ ID NO: 13328 - DNA, 20 bp, Artificial Sequence
  Description of Artificial Sequence: Synthetic oligonucleotide
  Target: ATXN1; (-) strand; PAM type: NNGRRT; PAM sequence: GTGAAT
agaggaaggttttggagttc

SEQ ID NO: 13329 - DNA, 20 bp, Artificial Sequence
  Description of Artificial Sequence: Synthetic oligonucleotide
  Target: ATXN1; (-) strand; PAM type: NNGRRT; PAM sequence: TGGAGT
ggttgtcaagaggaaggttt

SEQ ID NO: 13330 - DNA, 20 bp, Artificial Sequence
  Description of Artificial Sequence: Synthetic oligonucleotide
  Target: ATXN1; (-) strand; PAM type: NNGRRT; PAM sequence: CTGGGT
tctacagatttgaattcaga

SEQ ID NO: 13331 - DNA, 20 bp, Artificial Sequence
  Description of Artificial Sequence: Synthetic oligonucleotide
  Target: ATXN1; (-) strand; PAM type: NNGRRT; PAM sequence: TTGAAT
aaaattcactatctacagat

SEQ ID NO: 13332 - DNA, 20 bp, Artificial Sequence
  Description of Artificial Sequence: Synthetic oligonucleotide
  Target: ATXN1; (-) strand; PAM type: NNGRRT; PAM sequence: GAGAGT
aattcaaagcgctgttttaa

SEQ ID NO: 13333 - DNA, 20 bp, Artificial Sequence
  Description of Artificial Sequence: Synthetic oligonucleotide
  Target: ATXN1; (-) strand; PAM type: NNGRRT; PAM sequence: CTGAGT
ctgccagagtcccagtcttt

SEQ ID NO: 13334 - DNA, 20 bp, Artificial Sequence
  Description of Artificial Sequence: Synthetic oligonucleotide
  Target: ATXN1; (-) strand; PAM type: NNGRRT; PAM sequence: CAGAGT
ggcagaattctggttcctgc

SEQ ID NO: 13335 - DNA, 20 bp, Artificial Sequence
  Description of Artificial Sequence: Synthetic oligonucleotide
  Target: ATXN1; (-) strand; PAM type: NNGRRT; PAM sequence: CAGAAT
ctgctaggtttgggatgtgg

SEQ ID NO: 13336 - DNA, 20 bp, Artificial Sequence
  Description of Artificial Sequence: Synthetic oligonucleotide
  Target: ATXN1; (-) strand; PAM type: NNGRRT; PAM sequence: TGGGAT
tgaacttggtctgctaggtt

SEQ ID NO: 13337 - DNA, 20 bp, Artificial Sequence
  Description of Artificial Sequence: Synthetic oligonucleotide
  Target: ATXN1; (-) strand; PAM type: NNGRRT; PAM sequence: TGGGAT
cagctgagaagccgaggacc

SEQ ID NO: 13338 - DNA, 20 bp, Artificial Sequence
  Description of Artificial Sequence: Synthetic oligonucleotide
  Target: ATXN1; (-) strand; PAM type: NNGRRT; PAM sequence: TTGAAT
aaaatttttttttaaagagc

SEQ ID NO: 13339 - DNA, 20 bp, Artificial Sequence
  Description of Artificial Sequence: Synthetic oligonucleotide
  Target: ATXN1; (-) strand; PAM type: NNGRRT; PAM sequence: CTGAGT
ttacaccactgcactccaac

SEQ ID NO: 13340 - DNA, 20 bp, Artificial Sequence
  Description of Artificial Sequence: Synthetic oligonucleotide
  Target: ATXN1; (-) strand; PAM type: NNGRRT; PAM sequence: GAGAAT
tacttaaggggctgaagcag

SEQ ID NO: 13341 - DNA, 20 bp, Artificial Sequence
  Description of Artificial Sequence: Synthetic oligonucleotide
  Target: ATXN1; (-) strand; PAM type: NNGRRT; PAM sequence: AAGAGT
tgtgaggatcacttgagctc

SEQ ID NO: 13342 - DNA, 20 bp, Artificial Sequence
  Description of Artificial Sequence: Synthetic oligonucleotide
  Target: ATXN1; (-) strand; PAM type: NNGRRT; PAM sequence: GAGGAT
acttttggaggccaaggtgt

SEQ ID NO: 13343 - DNA, 20 bp, Artificial Sequence
  Description of Artificial Sequence: Synthetic oligonucleotide
  Target: ATXN1; (-) strand; PAM type: NNGRRT; PAM sequence: CAGGGT
ggatgggactcaggagggga

SEQ ID NO: 13344 - DNA, 20 bp, Artificial Sequence
  Description of Artificial Sequence: Synthetic oligonucleotide
  Target: ATXN1; (-) strand; PAM type: NNGRRT; PAM sequence: GAGGAT
agaagaagatgaagtggtca

SEQ ID NO: 13345 - DNA, 20 bp, Artificial Sequence
  Description of Artificial Sequence: Synthetic oligonucleotide
  Target: ATXN1; (-) strand; PAM type: NNGRRT; PAM sequence: GAGAGT
gtgctttttttcaggatgag

SEQ ID NO: 13346 - DNA, 20 bp, Artificial Sequence
  Description of Artificial Sequence: Synthetic oligonucleotide
  Target: ATXN1; (-) strand; PAM type: NNGRRT; PAM sequence: CAGGAT
ctgctgtctgtgcttttttt

SEQ ID NO: 13347 - DNA, 20 bp, Artificial Sequence
  Description of Artificial Sequence: Synthetic oligonucleotide
  Target: ATXN1; (-) strand; PAM type: NNGRRT; PAM sequence: GAGAGT
attcttttaaccatagcagg

SEQ ID NO: 13348 - DNA, 20 bp, Artificial Sequence
  Description of Artificial Sequence: Synthetic oligonucleotide
  Target: ATXN1; (-) strand; PAM type: NNGRRT; PAM sequence: AAGAAT
ttttttttcccaaagatcct

SEQ ID NO: 13349 - DNA, 20 bp, Artificial Sequence
  Description of Artificial Sequence: Synthetic oligonucleotide
  Target: ATXN1; (-) strand; PAM type: NNGRRT; PAM sequence: TAGGAT
aagcagtaacttttcaattt

SEQ ID NO: 13350 - DNA, 20 bp, Artificial Sequence
  Description of Artificial Sequence: Synthetic oligonucleotide
  Target: ATXN1; (-) strand; PAM type: NNGRRT; PAM sequence: CAGAAT
gcacagagatgactaaaagc

SEQ ID NO: 13351 - DNA, 20 bp, Artificial Sequence
  Description of Artificial Sequence: Synthetic oligonucleotide
  Target: ATXN1; (-) strand; PAM type: NNGRRT; PAM sequence: AAGAAT
ttctgctctgaatcagtatt

SEQ ID NO: 13352 - DNA, 20 bp, Artificial Sequence
  Description of Artificial Sequence: Synthetic oligonucleotide
  Target: ATXN1; (-) strand; PAM type: NNGRRT; PAM sequence: CTGAAT
atggttaactatcttctgct

SEQ ID NO: 13353 - DNA, 20 bp, Artificial Sequence
  Description of Artificial Sequence: Synthetic oligonucleotide
  Target: ATXN1; (-) strand; PAM type: NNGRRT; PAM sequence: AAGAGT
atggcctccttttttgggta

SEQ ID NO: 13354 - DNA, 20 bp, Artificial Sequence
  Description of Artificial Sequence: Synthetic oligonucleotide
  Target: ATXN1; (-) strand; PAM type: NNGRRT; PAM sequence: TTGGGT
agaataaatggcctcctttt

SEQ ID NO: 13355 - DNA, 20 bp, Artificial Sequence
  Description of Artificial Sequence: Synthetic oligonucleotide
  Target: ATXN1; (-) strand; PAM type: NNGRRT; PAM sequence: AAGAAT
tcagaggccctgtggaagcc

SEQ ID NO: 13356 - DNA, 20 bp, Artificial Sequence
  Description of Artificial Sequence: Synthetic oligonucleotide
  Target: ATXN1; (-) strand; PAM type: NNGRRT; PAM sequence: CAGAGT
actctccaagaaaatatttt

SEQ ID NO: 13357 - DNA, 20 bp, Artificial Sequence
  Description of Artificial Sequence: Synthetic oligonucleotide
  Target: ATXN1; (-) strand; PAM type: NNGRRT; PAM sequence: TGGGAT
ggggctctgggagggaaagg

SEQ ID NO: 13358 - DNA, 20 bp, Artificial Sequence
  Description of Artificial Sequence: Synthetic oligonucleotide
  Target: ATXN1; (-) strand; PAM type: NNGRRT; PAM sequence: TTGAGT
gccccctcactcagcatctc

SEQ ID NO: 13359 - DNA, 20 bp, Artificial Sequence
  Description of Artificial Sequence: Synthetic oligonucleotide
  Target: ATXN1; (-) strand; PAM type: NNGRRT; PAM sequence: AAGGGT
ctgagcgtgacaggaacccc

SEQ ID NO: 13360 - DNA, 20 bp, Artificial Sequence
  Description of Artificial Sequence: Synthetic oligonucleotide
  Target: ATXN1; (-) strand; PAM type: NNGRRT; PAM sequence: TTGAAT
tggtgggggctggggacagc

SEQ ID NO: 13361 - DNA, 20 bp, Artificial Sequence
  Description of Artificial Sequence: Synthetic oligonucleotide
  Target: ATXN1; (-) strand; PAM type: NNGRRT; PAM sequence: GCGAGT
gtgtgcgtgtgtgcgcgcgc

SEQ ID NO: 13362 - DNA, 20 bp, Artificial Sequence
  Description of Artificial Sequence: Synthetic oligonucleotide
  Target: ATXN1; (-) strand; PAM type: NNGRRT; PAM sequence: TGGAGT
gacccagaaaactaacaacg

SEQ ID NO: 13363 - DNA, 20 bp, Artificial Sequence
  Description of Artificial Sequence: Synthetic oligonucleotide
  Target: ATXN1; (-) strand; PAM type: NNGRRT; PAM sequence: GGGGGT
tacaaaatctggtgtgaggt

SEQ ID NO: 13364 - DNA, 20 bp, Artificial Sequence
  Description of Artificial Sequence: Synthetic oligonucleotide
  Target: ATXN1; (-) strand; PAM type: NNGRRT; PAM sequence: GTGAGT
gtttcccaggctagaaacag

SEQ ID NO: 13365 - DNA, 20 bp, Artificial Sequence
  Description of Artificial Sequence: Synthetic oligonucleotide
  Target: ATXN1; (-) strand; PAM type: NNGRRT; PAM sequence: CTGAAT
taggtgtgcaataaatagtg

SEQ ID NO: 13366 - DNA, 20 bp, Artificial Sequence
  Description of Artificial Sequence: Synthetic oligonucleotide
  Target: ATXN1; (-) strand; PAM type: NNGRRT; PAM sequence: CAGAGT
ctttaatcaaaagttggcta

SEQ ID NO: 13367 - DNA, 20 bp, Artificial Sequence
  Description of Artificial Sequence: Synthetic oligonucleotide
  Target: ATXN1; (-) strand; PAM type: NNGRRT; PAM sequence: CAGAAT
ttaggataaaatacagaatc

SEQ ID NO: 13368 - DNA, 20 bp, Artificial Sequence
  Description of Artificial Sequence: Synthetic oligonucleotide
  Target: ATXN1; (-) strand; PAM type: NNGRRT; PAM sequence: CAGAAT
aaggtctttaggataaaata

SEQ ID NO: 13369 - DNA, 20 bp, Artificial Sequence
  Description of Artificial Sequence: Synthetic oligonucleotide
  Target: ATXN1; (-) strand; PAM type: NNGRRT; PAM sequence: TAGGAT
aaaatttaaataaaggtctt

SEQ ID NO: 13370 - DNA, 20 bp, Artificial Sequence
  Description of Artificial Sequence: Synthetic oligonucleotide
  Target: ATXN1; (-) strand; PAM type: NNGRRT; PAM sequence: TGGAAT
caatgtcaaatgagactgag

SEQ ID NO: 13371 - DNA, 20 bp, Artificial Sequence
  Description of Artificial Sequence: Synthetic oligonucleotide
  Target: ATXN1; (-) strand; PAM type: NNGRRT; PAM sequence: CTGAGT
ggaagcaatgtcaaatgaga

SEQ ID NO: 13372 - DNA, 20 bp, Artificial Sequence
  Description of Artificial Sequence: Synthetic oligonucleotide
  Target: ATXN1; (-) strand; PAM type: NNGRRT; PAM sequence: TTGAAT
cccagctccctgagagcatt

SEQ ID NO: 13373 - DNA, 20 bp, Artificial Sequence
  Description of Artificial Sequence: Synthetic oligonucleotide
  Target: ATXN1; (-) strand; PAM type: NNGRRT; PAM sequence: AAGAGT
tcggccgccagagtgcttgc

SEQ ID NO: 13374 - DNA, 20 bp, Artificial Sequence
  Description of Artificial Sequence: Synthetic oligonucleotide
  Target: ATXN1; (-) strand; PAM type: NNGRRT; PAM sequence: CAGAGT
aatttggatgcttcggccgc

SEQ ID NO: 13375 - DNA, 20 bp, Artificial Sequence
  Description of Artificial Sequence: Synthetic oligonucleotide
  Target: ATXN1; (-) strand; PAM type: NNGRRT; PAM sequence: TTGGAT
caaccacagcaaccaggaat

SEQ ID NO: 13376 - DNA, 20 bp, Artificial Sequence
  Description of Artificial Sequence: Synthetic oligonucleotide
  Target: ATXN1; (-) strand; PAM type: NNGRRT; PAM sequence: AGGAAT
tccagccaaccacagcaacc

SEQ ID NO: 13377 - DNA, 20 bp, Artificial Sequence
  Description of Artificial Sequence: Synthetic oligonucleotide
  Target: ATXN1; (-) strand; PAM type: NNGRRT; PAM sequence: TGGGGT
taagagtcaaaggcaggagt

SEQ ID NO: 13378 - DNA, 20 bp, Artificial Sequence
  Description of Artificial Sequence: Synthetic oligonucleotide
  Target: ATXN1; (-) strand; PAM type: NNGRRT; PAM sequence: AGGAGT
ctatgataagagtcaaaggc

SEQ ID NO: 13379 - DNA, 20 bp, Artificial Sequence
  Description of Artificial Sequence: Synthetic oligonucleotide
  Target: ATXN1; (-) strand; PAM type: NNGRRT; PAM sequence: AAGAGT
agctgcaagcagtctatgat

SEQ ID NO: 13380 - DNA, 20 bp, Artificial Sequence
  Description of Artificial Sequence: Synthetic oligonucleotide
  Target: ATXN1; (-) strand; PAM type: NNGRRT; PAM sequence: CAGGAT
atattaggcaagtccaagga

SEQ ID NO: 13381 - DNA, 20 bp, Artificial Sequence
  Description of Artificial Sequence: Synthetic oligonucleotide
  Target: ATXN1; (-) strand; PAM type: NNGRRT; PAM sequence: CAGAGT
tttcatgaagcagtagggag

SEQ ID NO: 13382 - DNA, 20 bp, Artificial Sequence
  Description of Artificial Sequence: Synthetic oligonucleotide
  Target: ATXN1; (-) strand; PAM type: NNGRRT; PAM sequence: GAGAGT
gtttatagtattttctttct

SEQ ID NO: 13383 - DNA, 20 bp, Artificial Sequence
  Description of Artificial Sequence: Synthetic oligonucleotide
  Target: ATXN1; (-) strand; PAM type: NNGRRT; PAM sequence: GAGGGT
aagataaggctgtgaagaga

SEQ ID NO: 13384 - DNA, 20 bp, Artificial Sequence
  Description of Artificial Sequence: Synthetic oligonucleotide
  Target: ATXN1; (-) strand; PAM type: NNGRRT; PAM sequence: GAGAAT
atttagagagaaaggaatct

SEQ ID NO: 13385 - DNA, 20 bp, Artificial Sequence
  Description of Artificial Sequence: Synthetic oligonucleotide
  Target: ATXN1; (-) strand; PAM type: NNGRRT; PAM sequence: AGGAAT
tatgattaatttagagagaa

SEQ ID NO: 13386 - DNA, 20 bp, Artificial Sequence
  Description of Artificial Sequence: Synthetic oligonucleotide
  Target: ATXN1; (-) strand; PAM type: NNGRRT; PAM sequence: TTGGGT
tcttgaaaaaattatttaac

SEQ ID NO: 13387 - DNA, 20 bp, Artificial Sequence
  Description of Artificial Sequence: Synthetic oligonucleotide
  Target: ATXN1; (-) strand; PAM type: NNGRRT; PAM sequence: GTGAGT
gactcaattattggttggct

SEQ ID NO: 13388 - DNA, 20 bp, Artificial Sequence
  Description of Artificial Sequence: Synthetic oligonucleotide
  Target: ATXN1; (-) strand; PAM type: NNGRRT; PAM sequence: ATGAAT
tagtaatgccctcaaaagtt

SEQ ID NO: 13389 - DNA, 20 bp, Artificial Sequence
  Description of Artificial Sequence: Synthetic oligonucleotide
  Target: ATXN1; (-) strand; PAM type: NNGRRT; PAM sequence: TAGGGT
tactttttacattaaggaaa

SEQ ID NO: 13390 - DNA, 20 bp, Artificial Sequence
  Description of Artificial Sequence: Synthetic oligonucleotide
  Target: ATXN1; (-) strand; PAM type: NNGRRT; PAM sequence: TTGAAT
aagaatgttagcacaggtct

SEQ ID NO: 13391 - DNA, 20 bp, Artificial Sequence
  Description of Artificial Sequence: Synthetic oligonucleotide
  Target: ATXN1; (-) strand; PAM type: NNGRRT; PAM sequence: AAGAAT
attacagctagcagatattt

SEQ ID NO: 13392 - DNA, 20 bp, Artificial Sequence
  Description of Artificial Sequence: Synthetic oligonucleotide
  Target: ATXN1; (-) strand; PAM type: NNGRRT; PAM sequence: TAGGGT
ttggaccagtataagcatgc

SEQ ID NO: 13393 - DNA, 20 bp, Artificial Sequence
  Description of Artificial Sequence: Synthetic oligonucleotide
  Target: ATXN1; (-) strand; PAM type: NNGRRT; PAM sequence: CCGAAT
cctcacattctgtatttgtc

SEQ ID NO: 13394 - DNA, 20 bp, Artificial Sequence
  Description of Artificial Sequence: Synthetic oligonucleotide
  Target: ATXN1; (-) strand; PAM type: NNGRRT; PAM sequence: TGGAAT
tatgtccagtttccattggc

SEQ ID NO: 13395 - DNA, 20 bp, Artificial Sequence
  Description of Artificial Sequence: Synthetic oligonucleotide
  Target: ATXN1; (-) strand; PAM type: NNGRRT; PAM sequence: CAGGGT
agtacacggaacaaaggaga

SEQ ID NO: 13396 - DNA, 20 bp, Artificial Sequence
  Description of Artificial Sequence: Synthetic oligonucleotide
  Target: ATXN1; (-) strand; PAM type: NNGRRT; PAM sequence: AAGAGT
cttgccagcagttttgccac

SEQ ID NO: 13397 - DNA, 20 bp, Artificial Sequence
  Description of Artificial Sequence: Synthetic oligonucleotide
  Target: ATXN1; (-) strand; PAM type: NNGRRT; PAM sequence: AAGGGT
ccatttttactttctgcaga

SEQ ID NO: 13398 - DNA, 20 bp, Artificial Sequence
  Description of Artificial Sequence: Synthetic oligonucleotide
  Target: ATXN1; (-) strand; PAM type: NNGRRT; PAM sequence: ATGGAT
ctctgagctataacttcctc

SEQ ID NO: 13399 - DNA, 20 bp, Artificial Sequence
  Description of Artificial Sequence: Synthetic oligonucleotide
  Target: ATXN1; (-) strand; PAM type: NNGRRT; PAM sequence: AAGGGT
tgaagttaagactttaagat

SEQ ID NO: 13400 - DNA, 20 bp, Artificial Sequence
  Description of Artificial Sequence: Synthetic oligonucleotide
  Target: ATXN1; (-) strand; PAM type: NNGRRT; PAM sequence: TTGAAT
ttcattccgaccatattatt

SEQ ID NO: 13401 - DNA, 20 bp, Artificial Sequence
  Description of Artificial Sequence: Synthetic oligonucleotide
  Target: ATXN1; (-) strand; PAM type: NNGRRT; PAM sequence: GTGAGT
atataagcaaaccagatgtt

SEQ ID NO: 13402 - DNA, 20 bp, Artificial Sequence
  Description of Artificial Sequence: Synthetic oligonucleotide
  Target: ATXN1; (-) strand; PAM type: NNGRRT; PAM sequence: TTGAAT
aagtaccttttaatatctaa

SEQ ID NO: 13403 - DNA, 20 bp, Artificial Sequence
  Description of Artificial Sequence: Synthetic oligonucleotide
  Target: ATXN1; (-) strand; PAM type: NNGRRT; PAM sequence: GGGAAT
aactccacaactgtgcccct

SEQ ID NO: 13404 - DNA, 20 bp, Artificial Sequence
  Description of Artificial Sequence: Synthetic oligonucleotide
  Target: ATXN1; (-) strand; PAM type: NNGRRT; PAM sequence: TGGGAT
atgatgaaaagctactggcc

SEQ ID NO: 13405 - DNA, 20 bp, Artificial Sequence
  Description of Artificial Sequence: Synthetic oligonucleotide
  Target: ATXN1; (-) strand; PAM type: NNGRRT; PAM sequence: CTGGGT
ccagatgagacctgatttgc

SEQ ID NO: 13406 - DNA, 20 bp, Artificial Sequence
  Description of Artificial Sequence: Synthetic oligonucleotide
  Target: ATXN1; (-) strand; PAM type: NNGRRT; PAM sequence: AAGAAT
gcaagctgctaagaaggttg

SEQ ID NO: 13407 - DNA, 20 bp, Artificial Sequence
  Description of Artificial Sequence: Synthetic oligonucleotide
  Target: ATXN1; (-) strand; PAM type: NNGRRT; PAM sequence: CTGGGT
tgcaccttaacccaaccact

SEQ ID NO: 13408 - DNA, 20 bp, Artificial Sequence
  Description of Artificial Sequence: Synthetic oligonucleotide
  Target: ATXN1; (-) strand; PAM type: NNGRRT; PAM sequence: CTGGGT
ctgcacccctccccaagggg

SEQ ID NO: 13409 - DNA, 20 bp, Artificial Sequence
  Description of Artificial Sequence: Synthetic oligonucleotide
  Target: ATXN1; (-) strand; PAM type: NNGRRT; PAM sequence: CTGAGT
gatatgtgtcctctctattc

SEQ ID NO: 13410 - DNA, 20 bp, Artificial Sequence
  Description of Artificial Sequence: Synthetic oligonucleotide
  Target: ATXN1; (-) strand; PAM type: NNGRRT; PAM sequence: AGGGAT
attttgttgccaagtacagc

SEQ ID NO: 13411 - DNA, 20 bp, Artificial Sequence
  Description of Artificial Sequence: Synthetic oligonucleotide
  Target: ATXN1; (-) strand; PAM type: NNGRRT; PAM sequence: GAGGGT
tttctgccctgtgatgtcat

SEQ ID NO: 13412 - DNA, 20 bp, Artificial Sequence
  Description of Artificial Sequence: Synthetic oligonucleotide
  Target: ATXN1; (-) strand; PAM type: NNGRRT; PAM sequence: TCGAAT
caaggccccagacccccttc

SEQ ID NO: 13413 - DNA, 20 bp, Artificial Sequence
  Description of Artificial Sequence: Synthetic oligonucleotide
  Target: ATXN1; (-) strand; PAM type: NNGRRT; PAM sequence: ATGGAT
ttaacatacttaataatgga

SEQ ID NO: 13414 - DNA, 20 bp, Artificial Sequence
  Description of Artificial Sequence: Synthetic oligonucleotide
  Target: ATXN1; (-) strand; PAM type: NNGRRT; PAM sequence: TGGAAT
ttctttaacatacttaataa

SEQ ID NO: 13415 - DNA, 20 bp, Artificial Sequence
  Description of Artificial Sequence: Synthetic oligonucleotide
  Target: ATXN1; (-) strand; PAM type: NNGRRT; PAM sequence: CAGGGT
tcctcattctcatcttcttc

SEQ ID NO: 13416 - DNA, 20 bp, Artificial Sequence
  Description of Artificial Sequence: Synthetic oligonucleotide
  Target: ATXN1; (-) strand; PAM type: NNGRRT; PAM sequence: CTGAGT
gtgcctgtcagatgataggc

SEQ ID NO: 13417 - DNA, 20 bp, Artificial Sequence
  Description of Artificial Sequence: Synthetic oligonucleotide
  Target: ATXN1; (-) strand; PAM type: NNGRRT; PAM sequence: TTGGGT
aaaattggaattaaacacac

SEQ ID NO: 13418 - DNA, 20 bp, Artificial Sequence
  Description of Artificial Sequence: Synthetic oligonucleotide
  Target: ATXN1; (-) strand; PAM type: NNGRRT; PAM sequence: TGGAAT
aaaaacaggttttttaaaat

SEQ ID NO: 13419 - DNA, 20 bp, Artificial Sequence
  Description of Artificial Sequence: Synthetic oligonucleotide
  Target: ATXN1; (-) strand; PAM type: NNGRRT; PAM sequence: CTGGAT
acatgccactaccctccagc

SEQ ID NO: 13420 - DNA, 20 bp, Artificial Sequence
  Description of Artificial Sequence: Synthetic oligonucleotide
  Target: ATXN1; (-) strand; PAM type: NNGRRT; PAM sequence: GAGGAT
tactcagcagactgagacag

SEQ ID NO: 13421 - DNA, 20 bp, Artificial Sequence
  Description of Artificial Sequence: Synthetic oligonucleotide
  Target: ATXN1; (-) strand; PAM type: NNGRRT; PAM sequence: TGGAAT
ccaaggtaagaattaaattt

SEQ ID NO: 13422 - DNA, 20 bp, Artificial Sequence
  Description of Artificial Sequence: Synthetic oligonucleotide
  Target: ATXN1; (-) strand; PAM type: NNGRRT; PAM sequence: AAGAAT
accctcttgggtgccaaggt

SEQ ID NO: 13423 - DNA, 20 bp, Artificial Sequence
  Description of Artificial Sequence: Synthetic oligonucleotide
  Target: ATXN1; (-) strand; PAM type: NNGRRT; PAM sequence: TTGGGT
actgtgtgccaaacaccctc

SEQ ID NO: 13424 - DNA, 20 bp, Artificial Sequence
  Description of Artificial Sequence: Synthetic oligonucleotide
  Target: ATXN1; (-) strand; PAM type: NNGRRT; PAM sequence: AAGAAT
atacttaaccagtttaggtg

SEQ ID NO: 13425 - DNA, 20 bp, Artificial Sequence
  Description of Artificial Sequence: Synthetic oligonucleotide
  Target: ATXN1; (-) strand; PAM type: NNGRRT; PAM sequence: CCGAGT
aaataaatgtcaaagcaagt

SEQ ID NO: 13426 - DNA, 20 bp, Artificial Sequence
  Description of Artificial Sequence: Synthetic oligonucleotide
  Target: ATXN1; (-) strand; PAM type: NNGRRT; PAM sequence: CTGAGT
gtataaatatcggggcaaaa

SEQ ID NO: 13427 - DNA, 20 bp, Artificial Sequence
  Description of Artificial Sequence: Synthetic oligonucleotide
  Target: ATXN1; (-) strand; PAM type: NNGRRT; PAM sequence: CGGGGT
tgtggaacagagcagcttct

SEQ ID NO: 13428 - DNA, 20 bp, Artificial Sequence
  Description of Artificial Sequence: Synthetic oligonucleotide
  Target: ATXN1; (-) strand; PAM type: NNGRRT; PAM sequence: CCGAGT
tattcccctgcctcagcctc

SEQ ID NO: 13429 - DNA, 20 bp, Artificial Sequence
  Description of Artificial Sequence: Synthetic oligonucleotide
  Target: ATXN1; (-) strand; PAM type: NNGRRT; PAM sequence: TGGAAT
tcttactctattgcccaggc

SEQ ID NO: 13430 - DNA, 20 bp, Artificial Sequence
  Description of Artificial Sequence: Synthetic oligonucleotide
  Target: ATXN1; (-) strand; PAM type: NNGRRT; PAM sequence: TCGAGT
gaaattgcataaacggcaag

SEQ ID NO: 13431 - DNA, 20 bp, Artificial Sequence
  Description of Artificial Sequence: Synthetic oligonucleotide
  Target: ATXN1; (-) strand; PAM type: NNGRRT; PAM sequence: TGGGGT
aaccaagacatgtgaggctg

SEQ ID NO: 13432 - DNA, 20 bp, Artificial Sequence
  Description of Artificial Sequence: Synthetic oligonucleotide
  Target: ATXN1; (-) strand; PAM type: NNGRRT; PAM sequence: AAGGGT
tggacacatgcccagtcttg

SEQ ID NO: 13433 - DNA, 20 bp, Artificial Sequence
  Description of Artificial Sequence: Synthetic oligonucleotide
  Target: ATXN1; (-) strand; PAM type: NNGRRT; PAM sequence: CAGAGT
gatgtcaattaagtacacag

SEQ ID NO: 13434 - DNA, 20 bp, Artificial Sequence
  Description of Artificial Sequence: Synthetic oligonucleotide
  Target: ATXN1; (-) strand; PAM type: NNGRRT; PAM sequence: CTGGAT
agtgggtcttacatcatcaa

SEQ ID NO: 13435 - DNA, 20 bp, Artificial Sequence
  Description of Artificial Sequence: Synthetic oligonucleotide
  Target: ATXN1; (-) strand; PAM type: NNGRRT; PAM sequence: GTGGGT
tctctaattggcttatgata

SEQ ID NO: 13436 - DNA, 20 bp, Artificial Sequence
  Description of Artificial Sequence: Synthetic oligonucleotide
  Target: ATXN1; (-) strand; PAM type: NNGRRT; PAM sequence: AGGGGT
ttcaggttctctgcctccat

SEQ ID NO: 13437 - DNA, 20 bp, Artificial Sequence
  Description of Artificial Sequence: Synthetic oligonucleotide
  Target: ATXN1; (-) strand; PAM type: NNGRRT; PAM sequence: AAGAAT
gaagggaatgatatgttaga

SEQ ID NO: 13438 - DNA, 20 bp, Artificial Sequence
  Description of Artificial Sequence: Synthetic oligonucleotide
  Target: ATXN1; (-) strand; PAM type: NNGRRT; PAM sequence: GGGAAT
tattatctttatgtagggaa

SEQ ID NO: 13439 - DNA, 20 bp, Artificial Sequence
  Description of Artificial Sequence: Synthetic oligonucleotide
  Target: ATXN1; (-) strand; PAM type: NNGRRT; PAM sequence: TTGGAT
aaacaaatgattgcaccctt

SEQ ID NO: 13440 - DNA, 20 bp, Artificial Sequence
  Description of Artificial Sequence: Synthetic oligonucleotide
  Target: ATXN1; (-) strand; PAM type: NNGRRT; PAM sequence: CTGAAT
ccacggatgttgtatatgac

SEQ ID NO: 13441 - DNA, 20 bp, Artificial Sequence
  Description of Artificial Sequence: Synthetic oligonucleotide
  Target: ATXN1; (-) strand; PAM type: NNGRRT; PAM sequence: ACGGAT
cttcaaattcactttgctcc

SEQ ID NO: 13442 - DNA, 20 bp, Artificial Sequence
  Description of Artificial Sequence: Synthetic oligonucleotide
  Target: ATXN1; (-) strand; PAM type: NNGRRT; PAM sequence: TGGGAT
gcattggcctcccaaagagc

SEQ ID NO: 13443 - DNA, 20 bp, Artificial Sequence
  Description of Artificial Sequence: Synthetic oligonucleotide
  Target: ATXN1; (-) strand; PAM type: NNGRRT; PAM sequence: CAGGAT
cgtggtttcagcatgttggc

SEQ ID NO: 13444 - DNA, 20 bp, Artificial Sequence
  Description of Artificial Sequence: Synthetic oligonucleotide
  Target: ATXN1; (-) strand; PAM type: NNGRRT; PAM sequence: TGGAGT
tctcactctgtcacccaggc

SEQ ID NO: 13445 - DNA, 20 bp, Artificial Sequence
  Description of Artificial Sequence: Synthetic oligonucleotide
  Target: ATXN1; (-) strand; PAM type: NNGRRT; PAM sequence: TAGAGT
aaatagagatagccatacct

SEQ ID NO: 13446 - DNA, 20 bp, Artificial Sequence
  Description of Artificial Sequence: Synthetic oligonucleotide
  Target: ATXN1; (-) strand; PAM type: NNGRRT; PAM sequence: CTGAGT
ccaacaaccctgggccttct

SEQ ID NO: 13447 - DNA, 20 bp, Artificial Sequence
  Description of Artificial Sequence: Synthetic oligonucleotide
  Target: ATXN1; (-) strand; PAM type: NNGRRT; PAM sequence: GTGAAT
aggtatatctcaacagggct

SEQ ID NO: 13448 - DNA, 20 bp, Artificial Sequence
  Description of Artificial Sequence: Synthetic oligonucleotide
  Target: ATXN1; (-) strand; PAM type: NNGRRT; PAM sequence: AGGAAT
tgttggacttcagagggtga

SEQ ID NO: 13449 - DNA, 20 bp, Artificial Sequence
  Description of Artificial Sequence: Synthetic oligonucleotide
  Target: ATXN1; (-) strand; PAM type: NNGRRT; PAM sequence: GAGGGT
ttaaataatgttggacttca

SEQ ID NO: 13450 - DNA, 20 bp, Artificial Sequence
  Description of Artificial Sequence: Synthetic oligonucleotide
  Target: ATXN1; (-) strand; PAM type: NNGRRT; PAM sequence: CTGAGT
agatagtgcgagagagagag

SEQ ID NO: 13451 - DNA, 20 bp, Artificial Sequence
  Description of Artificial Sequence: Synthetic oligonucleotide
  Target: ATXN1; (-) strand; PAM type: NNGRRT; PAM sequence: TTGGGT
atgtcttcaactaatattta

SEQ ID NO: 13452 - DNA, 20 bp, Artificial Sequence
  Description of Artificial Sequence: Synthetic oligonucleotide
  Target: ATXN1; (-) strand; PAM type: NNGRRT; PAM sequence: CAGAAT
aatttcatccgttacaacct

SEQ ID NO: 13453 - DNA, 20 bp, Artificial Sequence
  Description of Artificial Sequence: Synthetic oligonucleotide
  Target: ATXN1; (-) strand; PAM type: NNGRRT; PAM sequence: GTGAAT
attctatagttcacaattca

SEQ ID NO: 13454 - DNA, 20 bp, Artificial Sequence
  Description of Artificial Sequence: Synthetic oligonucleotide
  Target: ATXN1; (-) strand; PAM type: NNGRRT; PAM sequence: CAGGGT
agaaaggtttctcctattga

SEQ ID NO: 13455 - DNA, 20 bp, Artificial Sequence
  Description of Artificial Sequence: Synthetic oligonucleotide
  Target: ATXN1; (-) strand; PAM type: NNGRRT; PAM sequence: CTGAAT
ttccgggtgaaagttctgga

SEQ ID NO: 13456 - DNA, 20 bp, Artificial Sequence
  Description of Artificial Sequence: Synthetic oligonucleotide
  Target: ATXN1; (-) strand; PAM type: NNGRRT; PAM sequence: CCGGGT
aaatttcttgttttgagttt

SEQ ID NO: 13457 - DNA, 20 bp, Artificial Sequence
  Description of Artificial Sequence: Synthetic oligonucleotide
  Target: ATXN1; (-) strand; PAM type: NNGRRT; PAM sequence: TTGAGT
ttcaaactaaatttcttgtt

SEQ ID NO: 13458 - DNA, 20 bp, Artificial Sequence
  Description of Artificial Sequence: Synthetic oligonucleotide
  Target: ATXN1; (-) strand; PAM type: NNGRRT; PAM sequence: AAGGAT
gcctctgagataaagcagaa

SEQ ID NO: 13459 - DNA, 20 bp, Artificial Sequence
  Description of Artificial Sequence: Synthetic oligonucleotide
  Target: ATXN1; (-) strand; PAM type: NNGRRT; PAM sequence: ATGAAT
aaagagaaaattagtatagt

SEQ ID NO: 13460 - DNA, 20 bp, Artificial Sequence
  Description of Artificial Sequence: Synthetic oligonucleotide
  Target: ATXN1; (-) strand; PAM type: NNGRRT; PAM sequence: TGGAGT
aatttagtttagtcacttgg

SEQ ID NO: 13461 - DNA, 20 bp, Artificial Sequence
  Description of Artificial Sequence: Synthetic oligonucleotide
  Target: ATXN1; (-) strand; PAM type: NNGRRT; PAM sequence: TTGAAT
ggatagaattgtatggatat

SEQ ID NO: 13462 - DNA, 20 bp, Artificial Sequence
  Description of Artificial Sequence: Synthetic oligonucleotide
  Target: ATXN1; (-) strand; PAM type: NNGRRT; PAM sequence: ATGGAT
gttgccgtggatagaattgt

SEQ ID NO: 13463 - DNA, 20 bp, Artificial Sequence
  Description of Artificial Sequence: Synthetic oligonucleotide
  Target: ATXN1; (-) strand; PAM type: NNGRRT; PAM sequence: TAGAAT
actgacgctgttgccgtgga

SEQ ID NO: 13464 - DNA, 20 bp, Artificial Sequence
  Description of Artificial Sequence: Synthetic oligonucleotide
  Target: ATXN1; (-) strand; PAM type: NNGRRT; PAM sequence: GTGGAT
gagaaactgacgctgttgcc

SEQ ID NO: 13465 - DNA, 20 bp, Artificial Sequence
  Description of Artificial Sequence: Synthetic oligonucleotide
  Target: ATXN1; (-) strand; PAM type: NNGRRT; PAM sequence: GTGGGT
cccttcaaatttcttagggt

SEQ ID NO: 13466 - DNA, 20 bp, Artificial Sequence
  Description of Artificial Sequence: Synthetic oligonucleotide
  Target: ATXN1; (-) strand; PAM type: NNGRRT; PAM sequence: TAGGGT
tgcgtacccttcaaatttct

SEQ ID NO: 13467 - DNA, 20 bp, Artificial Sequence
  Description of Artificial Sequence: Synthetic oligonucleotide
  Target: ATXN1; (-) strand; PAM type: NNGRRT; PAM sequence: TTGGAT
ttaatggtgttgaattgagt

SEQ ID NO: 13468 - DNA, 20 bp, Artificial Sequence
  Description of Artificial Sequence: Synthetic oligonucleotide
  Target: ATXN1; (-) strand; PAM type: NNGRRT; PAM sequence: TTGAGT
tttattttaatggtgttgaa

SEQ ID NO: 13469 - DNA, 20 bp, Artificial Sequence
  Description of Artificial Sequence: Synthetic oligonucleotide
  Target: ATXN1; (-) strand; PAM type: NNGRRT; PAM sequence: TTGAAT
ggccttttattttaatggtg

SEQ ID NO: 13470 - DNA, 20 bp, Artificial Sequence
  Description of Artificial Sequence: Synthetic oligonucleotide
  Target: ATXN1; (-) strand; PAM type: NNGRRT; PAM sequence: GGGAAT
tgccaaactcatgacctttg

SEQ ID NO: 13471 - DNA, 20 bp, Artificial Sequence
  Description of Artificial Sequence: Synthetic oligonucleotide
  Target: ATXN1; (-) strand; PAM type: NNGRRT; PAM sequence: GGGGAT
ctccccaaggcagtcactct

SEQ ID NO: 13472 - DNA, 20 bp, Artificial Sequence
  Description of Artificial Sequence: Synthetic oligonucleotide
  Target: ATXN1; (-) strand; PAM type: NNGRRT; PAM sequence: GTGAAT
ggatgactctttttcttctt

SEQ ID NO: 13473 - DNA, 20 bp, Artificial Sequence
  Description of Artificial Sequence: Synthetic oligonucleotide
  Target: ATXN1; (-) strand; PAM type: NNGRRT; PAM sequence: TAGGAT
aacatagtttgggaatggtt

SEQ ID NO: 13474 - DNA, 20 bp, Artificial Sequence
  Description of Artificial Sequence: Synthetic oligonucleotide
  Target: ATXN1; (-) strand; PAM type: NNGRRT; PAM sequence: GGGAAT
cttcatttctaacatagttt

SEQ ID NO: 13475 - DNA, 20 bp, Artificial Sequence
  Description of Artificial Sequence: Synthetic oligonucleotide
  Target: ATXN1; (-) strand; PAM type: NNGRRT; PAM sequence: GAGGAT
tctactttgtagggttgtgt

SEQ ID NO: 13476 - DNA, 20 bp, Artificial Sequence
  Description of Artificial Sequence: Synthetic oligonucleotide
  Target: ATXN1; (-) strand; PAM type: NNGRRT; PAM sequence: TAGGGT
gagtcatcatttctactttg

SEQ ID NO: 13477 - DNA, 20 bp, Artificial Sequence
  Description of Artificial Sequence: Synthetic oligonucleotide
  Target: ATXN1; (-) strand; PAM type: NNGRRT; PAM sequence: TAGAGT
agtttcagtttgtctttaaa

SEQ ID NO: 13478 - DNA, 20 bp, Artificial Sequence
  Description of Artificial Sequence: Synthetic oligonucleotide
  Target: ATXN1; (-) strand; PAM type: NNGRRT; PAM sequence: TTGAGT
atcatttcgaggaagttctt

SEQ ID NO: 13479 - DNA, 20 bp, Artificial Sequence
  Description of Artificial Sequence: Synthetic oligonucleotide
  Target: ATXN1; (-) strand; PAM type: NNGRRT; PAM sequence: TTGAAT
agaactagacaggcctgggt

SEQ ID NO: 13480 - DNA, 20 bp, Artificial Sequence
  Description of Artificial Sequence: Synthetic oligonucleotide
  Target: ATXN1; (-) strand; PAM type: NNGRRT; PAM sequence: CTGGGT
gatttaagaactagacaggc

SEQ ID NO: 13481 - DNA, 20 bp, Artificial Sequence
  Description of Artificial Sequence: Synthetic oligonucleotide
  Target: ATXN1; (-) strand; PAM type: NNGRRT; PAM sequence: ACGGAT
gcatggtatatgggaagaac

SEQ ID NO: 13482 - DNA, 20 bp, Artificial Sequence
  Description of Artificial Sequence: Synthetic oligonucleotide
  Target: ATXN1; (-) strand; PAM type: NNGRRT; PAM sequence: ATGGGT
acaagcctataacaaaaaga

SEQ ID NO: 13483 - DNA, 20 bp, Artificial Sequence
  Description of Artificial Sequence: Synthetic oligonucleotide
  Target: ATXN1; (-) strand; PAM type: NNGRRT; PAM sequence: AAGAAT
tagcacaagcctataacaaa

SEQ ID NO: 13484 - DNA, 20 bp, Artificial Sequence
  Description of Artificial Sequence: Synthetic oligonucleotide
  Target: ATXN1; (-) strand; PAM type: NNGRRT; PAM sequence: ATGGAT
aaggtcaaactaagagtaag

SEQ ID NO: 13485 - DNA, 20 bp, Artificial Sequence
  Description of Artificial Sequence: Synthetic oligonucleotide
  Target: ATXN1; (-) strand; PAM type: NNGRRT; PAM sequence: AAGAGT
cacggcacaaaggtcaaact

SEQ ID NO: 13486 - DNA, 20 bp, Artificial Sequence
  Description of Artificial Sequence: Synthetic oligonucleotide
  Target: ATXN1; (-) strand; PAM type: NNGRRT; PAM sequence: TTGGGT
agacagactttcagaaatga

SEQ ID NO: 13487 - DNA, 20 bp, Artificial Sequence
  Description of Artificial Sequence: Synthetic oligonucleotide
  Target: ATXN1; (-) strand; PAM type: NNGRRT; PAM sequence: CAGGAT
aagcccagaccaccaccaca

SEQ ID NO: 13488 - DNA, 20 bp, Artificial Sequence
  Description of Artificial Sequence: Synthetic oligonucleotide
  Target: ATXN1; (-) strand; PAM type: NNGRRT; PAM sequence: CTGAAT
ttattatctgttcccctaag

SEQ ID NO: 13489 - DNA, 20 bp, Artificial Sequence
  Description of Artificial Sequence: Synthetic oligonucleotide
  Target: ATXN1; (-) strand; PAM type: NNGRRT; PAM sequence: AGGAAT
catttttagaaatatgttat

SEQ ID NO: 13490 - DNA, 20 bp, Artificial Sequence
  Description of Artificial Sequence: Synthetic oligonucleotide
  Target: ATXN1; (-) strand; PAM type: NNGRRT; PAM sequence: GAGAAT
tttccttactttccagcttt

SEQ ID NO: 13491 - DNA, 20 bp, Artificial Sequence
  Description of Artificial Sequence: Synthetic oligonucleotide
  Target: ATXN1; (-) strand; PAM type: NNGRRT; PAM sequence: TAGGGT
tgctgtctcatcacctcatt

SEQ ID NO: 13492 - DNA, 20 bp, Artificial Sequence
  Description of Artificial Sequence: Synthetic oligonucleotide
  Target: ATXN1; (-) strand; PAM type: NNGRRT; PAM sequence: ATGGGT
atcataccaaaatgggttgg

SEQ ID NO: 13493 - DNA, 20 bp, Artificial Sequence
  Description of Artificial Sequence: Synthetic oligonucleotide
  Target: ATXN1; (-) strand; PAM type: NNGRRT; PAM sequence: TTGGAT
aagaatcataccaaaatggg

SEQ ID NO: 13494 - DNA, 20 bp, Artificial Sequence
  Description of Artificial Sequence: Synthetic oligonucleotide
  Target: ATXN1; (-) strand; PAM type: NNGRRT; PAM sequence: ATGGGT
actgcaagaatcataccaaa

SEQ ID NO: 13495 - DNA, 20 bp, Artificial Sequence
  Description of Artificial Sequence: Synthetic oligonucleotide
  Target: ATXN1; (-) strand; PAM type: NNGRRT; PAM sequence: AAGAAT
ggccaggccttagtaactgc

SEQ ID NO: 13496 - DNA, 20 bp, Artificial Sequence
  Description of Artificial Sequence: Synthetic oligonucleotide
  Target: ATXN1; (-) strand; PAM type: NNGRRT; PAM sequence: GAGAAT
aagtgaattctgagtggaga

SEQ ID NO: 13497 - DNA, 20 bp, Artificial Sequence
  Description of Artificial Sequence: Synthetic oligonucleotide
  Target: ATXN1; (-) strand; PAM type: NNGRRT; PAM sequence: CTGAGT
ataatagcttaaagtgaatt

SEQ ID NO: 13498 - DNA, 20 bp, Artificial Sequence
  Description of Artificial Sequence: Synthetic oligonucleotide
  Target: ATXN1; (-) strand; PAM type: NNGRRT; PAM sequence: GTGAAT
ctttcttataatagcttaaa

SEQ ID NO: 13499 - DNA, 20 bp, Artificial Sequence
  Description of Artificial Sequence: Synthetic oligonucleotide
  Target: ATXN1; (-) strand; PAM type: NNGRRT; PAM sequence: GGGGAT
tgtcgtgggcgtcacactct

SEQ ID NO: 13500 - DNA, 20 bp, Artificial Sequence
  Description of Artificial Sequence: Synthetic oligonucleotide
  Target: ATXN1; (-) strand; PAM type: NNGRRT; PAM sequence: TTGAAT
ttgaactatgagaagcaggt

SEQ ID NO: 13501 - DNA, 20 bp, Artificial Sequence
  Description of Artificial Sequence: Synthetic oligonucleotide
  Target: ATXN1; (-) strand; PAM type: NNGRRT; PAM sequence: GTGAGT
gttcataagctgatgaagca

SEQ ID NO: 13502 - DNA, 20 bp, Artificial Sequence
  Description of Artificial Sequence: Synthetic oligonucleotide
  Target: ATXN1; (-) strand; PAM type: NNGRRT; PAM sequence: CTGGGT
gcctgagtgaagaggctcta

SEQ ID NO: 13503 - DNA, 20 bp, Artificial Sequence
  Description of Artificial Sequence: Synthetic oligonucleotide
  Target: ATXN1; (-) strand; PAM type: NNGRRT; PAM sequence: CTGAGT
ataaactcaaataaaaaggc

SEQ ID NO: 13504 - DNA, 20 bp, Artificial Sequence
  Description of Artificial Sequence: Synthetic oligonucleotide
  Target: ATXN1; (-) strand; PAM type: NNGRRT; PAM sequence: TCGGAT
ttaaggaggcattactgcat

SEQ ID NO: 13505 - DNA, 20 bp, Artificial Sequence
  Description of Artificial Sequence: Synthetic oligonucleotide
  Target: ATXN1; (-) strand; PAM type: NNGRRT; PAM sequence: TTGAGT
cattccagtccaccaacata

SEQ ID NO: 13506 - DNA, 20 bp, Artificial Sequence
  Description of Artificial Sequence: Synthetic oligonucleotide
  Target: ATXN1; (-) strand; PAM type: NNGRRT; PAM sequence: TAGAAT
ttataagtgacattttgttc

SEQ ID NO: 13507 - DNA, 20 bp, Artificial Sequence
  Description of Artificial Sequence: Synthetic oligonucleotide
  Target: ATXN1; (-) strand; PAM type: NNGRRT; PAM sequence: GTGGGT
taggtatcctagctaggaaa

SEQ ID NO: 13508 - DNA, 20 bp, Artificial Sequence
  Description of Artificial Sequence: Synthetic oligonucleotide
  Target: ATXN1; (-) strand; PAM type: NNGRRT; PAM sequence: CAGAGT
tttcactccagtctgggcga

SEQ ID NO: 13509 - DNA, 20 bp, Artificial Sequence
  Description of Artificial Sequence: Synthetic oligonucleotide
  Target: ATXN1; (-) strand; PAM type: NNGRRT; PAM sequence: GAGAAT
tactcgggaggctgaggcag

SEQ ID NO: 13510 - DNA, 20 bp, Artificial Sequence
  Description of Artificial Sequence: Synthetic oligonucleotide
  Target: ATXN1; (-) strand; PAM type: NNGRRT; PAM sequence: AGGAGT
agggtggagcatctgaggtc

SEQ ID NO: 13511 - DNA, 20 bp, Artificial Sequence
  Description of Artificial Sequence: Synthetic oligonucleotide
  Target: ATXN1; (-) strand; PAM type: NNGRRT; PAM sequence: GAGGGT
cagcactttgggaggccaag

SEQ ID NO: 13512 - DNA, 20 bp, Artificial Sequence
  Description of Artificial Sequence: Synthetic oligonucleotide
  Target: ATXN1; (-) strand; PAM type: NNGRRT; PAM sequence: TCGGGT
agccctatttcccagctgct

SEQ ID NO: 13513 - DNA, 20 bp, Artificial Sequence
  Description of Artificial Sequence: Synthetic oligonucleotide
  Target: ATXN1; (-) strand; PAM type: NNGRRT; PAM sequence: AAGGGT
ttgtcttcgccagacaggca

SEQ ID NO: 13514 - DNA, 20 bp, Artificial Sequence
  Description of Artificial Sequence: Synthetic oligonucleotide
  Target: ATXN1; (-) strand; PAM type: NNGRRT; PAM sequence: ATGAAT
aggatccagataaccgcaga

SEQ ID NO: 13515 - DNA, 20 bp, Artificial Sequence
  Description of Artificial Sequence: Synthetic oligonucleotide
  Target: ATXN1; (-) strand; PAM type: NNGRRT; PAM sequence: CAGAAT
atgaaggatccagataaccg

SEQ ID NO: 13516 - DNA, 20 bp, Artificial Sequence
  Description of Artificial Sequence: Synthetic oligonucleotide
  Target: ATXN1; (-) strand; PAM type: NNGRRT; PAM sequence: AAGGAT
tgttccctacctacagcatg

SEQ ID NO: 13517 - DNA, 20 bp, Artificial Sequence
  Description of Artificial Sequence: Synthetic oligonucleotide
  Target: ATXN1; (-) strand; PAM type: NNGRRT; PAM sequence: GTGAAT
aaagcttggtagttcttctt

SEQ ID NO: 13518 - DNA, 20 bp, Artificial Sequence
  Description of Artificial Sequence: Synthetic oligonucleotide
  Target: ATXN1; (-) strand; PAM type: NNGRRT; PAM sequence: CTGGGT
aaatggatgatgaagaaagc

SEQ ID NO: 13519 - DNA, 20 bp, Artificial Sequence
  Description of Artificial Sequence: Synthetic oligonucleotide
  Target: ATXN1; (-) strand; PAM type: NNGRRT; PAM sequence: ATGGAT
atcagcacactgactgcaaa

SEQ ID NO: 13520 - DNA, 20 bp, Artificial Sequence
  Description of Artificial Sequence: Synthetic oligonucleotide
  Target: ATXN1; (-) strand; PAM type: NNGRRT; PAM sequence: AGGGAT
ctttgtctgtaaaaggccac

SEQ ID NO: 13521 - DNA, 20 bp, Artificial Sequence
  Description of Artificial Sequence: Synthetic oligonucleotide
  Target: ATXN1; (-) strand; PAM type: NNGRRT; PAM sequence: ATGAAT
aataattacagttgatattt

SEQ ID NO: 13522 - DNA, 20 bp, Artificial Sequence
  Description of Artificial Sequence: Synthetic oligonucleotide
  Target: ATXN1; (-) strand; PAM type: NNGRRT; PAM sequence: AGGAAT
gaaataaaagtttatataaa

SEQ ID NO: 13523 - DNA, 20 bp, Artificial Sequence
  Description of Artificial Sequence: Synthetic oligonucleotide
  Target: ATXN1; (-) strand; PAM type: NNGRRT; PAM sequence: ATGAGT
gtttagggtgtacgagcaag

SEQ ID NO: 13524 - DNA, 20 bp, Artificial Sequence
  Description of Artificial Sequence: Synthetic oligonucleotide
  Target: ATXN1; (-) strand; PAM type: NNGRRT; PAM sequence: TAGGGT
gtgagattattttaaacgtt

SEQ ID NO: 13525 - DNA, 20 bp, Artificial Sequence
  Description of Artificial Sequence: Synthetic oligonucleotide
  Target: ATXN1; (-) strand; PAM type: NNGRRT; PAM sequence: TTGGAT
attcagaggggtcagaggta

SEQ ID NO: 13526 - DNA, 20 bp, Artificial Sequence
  Description of Artificial Sequence: Synthetic oligonucleotide
  Target: ATXN1; (-) strand; PAM type: NNGRRT; PAM sequence: AGGGGT
gaaaatgtgatgggattcag

SEQ ID NO: 13527 - DNA, 20 bp, Artificial Sequence
  Description of Artificial Sequence: Synthetic oligonucleotide
  Target: ATXN1; (-) strand; PAM type: NNGRRT; PAM sequence: TGGGAT
actaagcggtgaaaatgtga

SEQ ID NO: 13528 - DNA, 20 bp, Artificial Sequence
  Description of Artificial Sequence: Synthetic oligonucleotide
  Target: ATXN1; (-) strand; PAM type: NNGRRT; PAM sequence: AGGAAT
aaggcctactagaggaattc

SEQ ID NO: 13529 - DNA, 20 bp, Artificial Sequence
  Description of Artificial Sequence: Synthetic oligonucleotide
  Target: ATXN1; (-) strand; PAM type: NNGRRT; PAM sequence: AGGAAT
ggaaactaaaggcctactag

SEQ ID NO: 13530 - DNA, 20 bp, Artificial Sequence
  Description of Artificial Sequence: Synthetic oligonucleotide
  Target: ATXN1; (-) strand; PAM type: NNGRRT; PAM sequence: TGGGGT
gtatgcaatgatacacggta

SEQ ID NO: 13531 - DNA, 20 bp, Artificial Sequence
  Description of Artificial Sequence: Synthetic oligonucleotide
  Target: ATXN1; (-) strand; PAM type: NNGRRT; PAM sequence: CTGAGT
aagataaaagccacattcta

SEQ ID NO: 13532 - DNA, 20 bp, Artificial Sequence
  Description of Artificial Sequence: Synthetic oligonucleotide
  Target: ATXN1; (-) strand; PAM type: NNGRRT; PAM sequence: CAGGAT
gttaggtgcctgttgagccc

SEQ ID NO: 13533 - DNA, 20 bp, Artificial Sequence
  Description of Artificial Sequence: Synthetic oligonucleotide
  Target: ATXN1; (-) strand; PAM type: NNGRRT; PAM sequence: TAGGGT
acaaaacattagaaatattg

SEQ ID NO: 13534 - DNA, 20 bp, Artificial Sequence
  Description of Artificial Sequence: Synthetic oligonucleotide
  Target: ATXN1; (-) strand; PAM type: NNGRRT; PAM sequence: GAGAAT
tactggggaagctgaggtgg

SEQ ID NO: 13535 - DNA, 20 bp, Artificial Sequence
  Description of Artificial Sequence: Synthetic oligonucleotide
  Target: ATXN1; (-) strand; PAM type: NNGRRT; PAM sequence: GAGGAT
gacttgggaggctgaggcag

SEQ ID NO: 13536 - DNA, 20 bp, Artificial Sequence
  Description of Artificial Sequence: Synthetic oligonucleotide
  Target: ATXN1; (-) strand; PAM type: NNGRRT; PAM sequence: CTGGGT
tcgtgccactgctctccagc

SEQ ID NO: 13537 - DNA, 20 bp, Artificial Sequence
  Description of Artificial Sequence: Synthetic oligonucleotide
  Target: ATXN1; (-) strand; PAM type: NNGRRT; PAM sequence: GGGGAT
actttgggaggccgaggcag

SEQ ID NO: 13538 - DNA, 20 bp, Artificial Sequence
  Description of Artificial Sequence: Synthetic oligonucleotide
  Target: ATXN1; (-) strand; PAM type: NNGRRT; PAM sequence: GGGAGT
atgaatggcatcagttgtct

SEQ ID NO: 13539 - DNA, 20 bp, Artificial Sequence
  Description of Artificial Sequence: Synthetic oligonucleotide
  Target: ATXN1; (-) strand; PAM type: NNGRRT; PAM sequence: ATGAAT
catggatttcttcttcaagc

SEQ ID NO: 13540 - DNA, 20 bp, Artificial Sequence
  Description of Artificial Sequence: Synthetic oligonucleotide
  Target: ATXN1; (-) strand; PAM type: NNGRRT; PAM sequence: ATGGAT
gccttctttggtacctggtc

SEQ ID NO: 13541 - DNA, 20 bp, Artificial Sequence
  Description of Artificial Sequence: Synthetic oligonucleotide
  Target: ATXN1; (-) strand; PAM type: NNGRRT; PAM sequence: TAGGGT
ccaaatcttcgaggatgaac

SEQ ID NO: 13542 - DNA, 20 bp, Artificial Sequence
  Description of Artificial Sequence: Synthetic oligonucleotide
  Target: ATXN1; (-) strand; PAM type: NNGRRT; PAM sequence: GAGGAT
aacttttgaaccaaatcttc

SEQ ID NO: 13543 - DNA, 20 bp, Artificial Sequence
  Description of Artificial Sequence: Synthetic oligonucleotide
  Target: ATXN1; (-) strand; PAM type: NNGRRT; PAM sequence: TGGAAT
aagagctctgaggttcaggg

SEQ ID NO: 13544 - DNA, 20 bp, Artificial Sequence
  Description of Artificial Sequence: Synthetic oligonucleotide
  Target: ATXN1; (-) strand; PAM type: NNGRRT; PAM sequence: CAGGGT
acctcaagagctctgaggtt

SEQ ID NO: 13545 - DNA, 20 bp, Artificial Sequence
  Description of Artificial Sequence: Synthetic oligonucleotide
  Target: ATXN1; (-) strand; PAM type: NNGRRT; PAM sequence: AAGGGT
agacacaaacattcagtagg

SEQ ID NO: 13546 - DNA, 20 bp, Artificial Sequence
  Description of Artificial Sequence: Synthetic oligonucleotide
  Target: ATXN1; (-) strand; PAM type: NNGRRT; PAM sequence: GGGAAT
acaatatttacttttataat

SEQ ID NO: 13547 - DNA, 20 bp, Artificial Sequence
  Description of Artificial Sequence: Synthetic oligonucleotide
  Target: ATXN1; (-) strand; PAM type: NNGRRT; PAM sequence: AGGGAT
aggagtttttgccaggagcc

SEQ ID NO: 13548 - DNA, 20 bp, Artificial Sequence
  Description of Artificial Sequence: Synthetic oligonucleotide
  Target: ATXN1; (-) strand; PAM type: NNGRRT; PAM sequence: AGGAGT
tccatttctgtacaaatgca

SEQ ID NO: 13549 - DNA, 20 bp, Artificial Sequence
  Description of Artificial Sequence: Synthetic oligonucleotide
  Target: ATXN1; (-) strand; PAM type: NNGRRT; PAM sequence: GGGAGT
gcattcctgaaagccacaga

SEQ ID NO: 13550 - DNA, 20 bp, Artificial Sequence
  Description of Artificial Sequence: Synthetic oligonucleotide
  Target: ATXN1; (-) strand; PAM type: NNGRRT; PAM sequence: GTGGAT
gtgccaggccatgtattcca

SEQ ID NO: 13551 - DNA, 20 bp, Artificial Sequence
  Description of Artificial Sequence: Synthetic oligonucleotide
  Target: ATXN1; (-) strand; PAM type: NNGRRT; PAM sequence: ATGAAT
ggtcagactgttcagatctc

SEQ ID NO: 13552 - DNA, 20 bp, Artificial Sequence
  Description of Artificial Sequence: Synthetic oligonucleotide
  Target: ATXN1; (-) strand; PAM type: NNGRRT; PAM sequence: AGGAGT
aataaaataaaataaaaaaa

SEQ ID NO: 13553 - DNA, 20 bp, Artificial Sequence
  Description of Artificial Sequence: Synthetic oligonucleotide
  Target: ATXN1; (-) strand; PAM type: NNGRRT; PAM sequence: ATGGGT
taatgctaaatgacgagtta

SEQ ID NO: 13554 - DNA, 20 bp, Artificial Sequence
  Description of Artificial Sequence: Synthetic oligonucleotide
  Target: ATXN1; (-) strand; PAM type: NNGRRT; PAM sequence: ACGAGT
gatatacctaatgctaaatg

SEQ ID NO: 13555 - DNA, 20 bp, Artificial Sequence
  Description of Artificial Sequence: Synthetic oligonucleotide
  Target: ATXN1; (-) strand; PAM type: NNGRRT; PAM sequence: TGGGGT
tcacactctggggactgttg

SEQ ID NO: 13556 - DNA, 20 bp, Artificial Sequence
  Description of Artificial Sequence: Synthetic oligonucleotide
  Target: ATXN1; (-) strand; PAM type: NNGRRT; PAM sequence: GGGAAT
agcgttaggagtattgcggt

SEQ ID NO: 13557 - DNA, 20 bp, Artificial Sequence
  Description of Artificial Sequence: Synthetic oligonucleotide
  Target: ATXN1; (-) strand; PAM type: NNGRRT; PAM sequence: AGGAGT
cacctacaattattagcgtt

SEQ ID NO: 13558 - DNA, 20 bp, Artificial Sequence
  Description of Artificial Sequence: Synthetic oligonucleotide
  Target: ATXN1; (-) strand; PAM type: NNGRRT; PAM sequence: GCGAAT
atttcagaccatgacatcaa

SEQ ID NO: 13559 - DNA, 20 bp, Artificial Sequence
  Description of Artificial Sequence: Synthetic oligonucleotide
  Target: ATXN1; (-) strand; PAM type: NNGRRT; PAM sequence: AAGGAT
gtggaggagttggttcaatg

SEQ ID NO: 13560 - DNA, 20 bp, Artificial Sequence
  Description of Artificial Sequence: Synthetic oligonucleotide
  Target: ATXN1; (-) strand; PAM type: NNGRRT; PAM sequence: AGGAGT
gtcacacagctagtaagtgg

SEQ ID NO: 13561 - DNA, 20 bp, Artificial Sequence
  Description of Artificial Sequence: Synthetic oligonucleotide
  Target: ATXN1; (-) strand; PAM type: NNGRRT; PAM sequence: GTGGGT
aaaggaaattggggcttagg

SEQ ID NO: 13562 - DNA, 20 bp, Artificial Sequence
  Description of Artificial Sequence: Synthetic oligonucleotide
  Target: ATXN1; (-) strand; PAM type: NNGRRT; PAM sequence: TAGGGT
cagaaaaggaaattggggct

SEQ ID NO: 13563 - DNA, 20 bp, Artificial Sequence
  Description of Artificial Sequence: Synthetic oligonucleotide
  Target: ATXN1; (-) strand; PAM type: NNGRRT; PAM sequence: CAGAGT
caggaggatcacttgagccc

SEQ ID NO: 13564 - DNA, 20 bp, Artificial Sequence
  Description of Artificial Sequence: Synthetic oligonucleotide
  Target: ATXN1; (-) strand; PAM type: NNGRRT; PAM sequence: GAGGAT
tacttgggtggctgaggcag

SEQ ID NO: 13565 - DNA, 20 bp, Artificial Sequence
  Description of Artificial Sequence: Synthetic oligonucleotide
  Target: ATXN1; (-) strand; PAM type: NNGRRT; PAM sequence: TTGGGT
gcacctgtactcccagctac

SEQ ID NO: 13566 - DNA, 20 bp, Artificial Sequence
  Description of Artificial Sequence: Synthetic oligonucleotide
  Target: ATXN1; (-) strand; PAM type: NNGRRT; PAM sequence: TGGAAT
ctattaattataataatgat

SEQ ID NO: 13567 - DNA, 20 bp, Artificial Sequence
  Description of Artificial Sequence: Synthetic oligonucleotide
  Target: ATXN1; (-) strand; PAM type: NNGRRT; PAM sequence: TAGGAT
tgatagaactatcataagaa

SEQ ID NO: 13568 - DNA, 20 bp, Artificial Sequence
  Description of Artificial Sequence: Synthetic oligonucleotide
  Target: ATXN1; (-) strand; PAM type: NNGRRT; PAM sequence: AAGAAT
gacagtgatagaactatcat

SEQ ID NO: 13569 - DNA, 20 bp, Artificial Sequence
  Description of Artificial Sequence: Synthetic oligonucleotide
  Target: ATXN1; (-) strand; PAM type: NNGRRT; PAM sequence: ATGAGT
agtatatgattaccaggcaa

SEQ ID NO: 13570 - DNA, 20 bp, Artificial Sequence
  Description of Artificial Sequence: Synthetic oligonucleotide
  Target: ATXN1; (-) strand; PAM type: NNGRRT; PAM sequence: AAGAGT
gtatatatttataaaataca

SEQ ID NO: 13571 - DNA, 20 bp, Artificial Sequence
  Description of Artificial Sequence: Synthetic oligonucleotide
  Target: ATXN1; (-) strand; PAM type: NNGRRT; PAM sequence: TGGGAT
gatttcttcaaagggaaata

SEQ ID NO: 13572 - DNA, 20 bp, Artificial Sequence
  Description of Artificial Sequence: Synthetic oligonucleotide
  Target: ATXN1; (-) strand; PAM type: NNGRRT; PAM sequence: GAGAGT
caaatgatgacagcagccct

SEQ ID NO: 13573 - DNA, 20 bp, Artificial Sequence
  Description of Artificial Sequence: Synthetic oligonucleotide
  Target: ATXN1; (-) strand; PAM type: NNGRRT; PAM sequence: AAGGAT
gtgaggttgggttggagtag

SEQ ID NO: 13574 - DNA, 20 bp, Artificial Sequence
  Description of Artificial Sequence: Synthetic oligonucleotide
  Target: ATXN1; (-) strand; PAM type: NNGRRT; PAM sequence: TGGAGT
ccctgagagtgaggttgggt

SEQ ID NO: 13575 - DNA, 20 bp, Artificial Sequence
  Description of Artificial Sequence: Synthetic oligonucleotide
  Target: ATXN1; (-) strand; PAM type: NNGRRT; PAM sequence: TTGGGT
tcccctccctgagagtgagg

SEQ ID NO: 13576 - DNA, 20 bp, Artificial Sequence
  Description of Artificial Sequence: Synthetic oligonucleotide
  Target: ATXN1; (-) strand; PAM type: NNGRRT; PAM sequence: GAGAGT
tcctcatccgtcccctccct

SEQ ID NO: 13577 - DNA, 20 bp, Artificial Sequence
  Description of Artificial Sequence: Synthetic oligonucleotide
  Target: ATXN1; (-) strand; PAM type: NNGRRT; PAM sequence: TAGGAT
tttaaaaaccctgtagatga

SEQ ID NO: 13578 - DNA, 20 bp, Artificial Sequence
  Description of Artificial Sequence: Synthetic oligonucleotide
  Target: ATXN1; (-) strand; PAM type: NNGRRT; PAM sequence: GAGAAT
gatcatggccacccaggcca

SEQ ID NO: 13579 - DNA, 20 bp, Artificial Sequence
  Description of Artificial Sequence: Synthetic oligonucleotide
  Target: ATXN1; (-) strand; PAM type: NNGRRT; PAM sequence: TCGGAT
tgcaccagaacaaaatgccc

SEQ ID NO: 13580 - DNA, 20 bp, Artificial Sequence
  Description of Artificial Sequence: Synthetic oligonucleotide
  Target: ATXN1; (-) strand; PAM type: NNGRRT; PAM sequence: CAGAGT
ttcgatcacttatgctgcag

SEQ ID NO: 13581 - DNA, 20 bp, Artificial Sequence
  Description of Artificial Sequence: Synthetic oligonucleotide
  Target: ATXN1; (-) strand; PAM type: NNGRRT; PAM sequence: GAGGAT
ttctattcaaatcatttagt

SEQ ID NO: 13582 - DNA, 20 bp, Artificial Sequence
  Description of Artificial Sequence: Synthetic oligonucleotide
  Target: ATXN1; (-) strand; PAM type: NNGRRT; PAM sequence: CAGAGT
cgagttttatccattttagg

SEQ ID NO: 13583 - DNA, 20 bp, Artificial Sequence
  Description of Artificial Sequence: Synthetic oligonucleotide
  Target: ATXN1; (-) strand; PAM type: NNGRRT; PAM sequence: CCGAGT
taaatgtggattgttttgtt

SEQ ID NO: 13584 - DNA, 20 bp, Artificial Sequence
  Description of Artificial Sequence: Synthetic oligonucleotide
  Target: ATXN1; (-) strand; PAM type: NNGRRT; PAM sequence: GTGGAT
gcttcagggtattactaaat

SEQ ID NO: 13585 - DNA, 20 bp, Artificial Sequence
  Description of Artificial Sequence: Synthetic oligonucleotide
  Target: ATXN1; (-) strand; PAM type: NNGRRT; PAM sequence: CAGGGT
atacaaattagagtcagctt

SEQ ID NO: 13586 - DNA, 20 bp, Artificial Sequence
  Description of Artificial Sequence: Synthetic oligonucleotide
  Target: ATXN1; (-) strand; PAM type: NNGRRT; PAM sequence: TAGAGT
ttgtcacagtgaatacaaat

SEQ ID NO: 13587 - DNA, 20 bp, Artificial Sequence
  Description of Artificial Sequence: Synthetic oligonucleotide
  Target: ATXN1; (-) strand; PAM type: NNGRRT; PAM sequence: GTGAAT
gaaagtaaggagttgtcaca

SEQ ID NO: 13588 - DNA, 20 bp, Artificial Sequence
  Description of Artificial Sequence: Synthetic oligonucleotide
  Target: ATXN1; (-) strand; PAM type: NNGRRT; PAM sequence: AGGAGT
ttacttcagatttgaaagta

SEQ ID NO: 13589 - DNA, 20 bp, Artificial Sequence
  Description of Artificial Sequence: Synthetic oligonucleotide
  Target: ATXN1; (-) strand; PAM type: NNGRRT; PAM sequence: ATGGGT
tagccttccaagtaattttt

SEQ ID NO: 13590 - DNA, 20 bp, Artificial Sequence
  Description of Artificial Sequence: Synthetic oligonucleotide
  Target: ATXN1; (-) strand; PAM type: NNGRRT; PAM sequence: GAGAAT
gagagacagagagagagaga

SEQ ID NO: 13591 - DNA, 20 bp, Artificial Sequence
  Description of Artificial Sequence: Synthetic oligonucleotide
  Target: ATXN1; (-) strand; PAM type: NNGRRT; PAM sequence: TTGGAT
cgcagagacattatgcaaaa

SEQ ID NO: 13592 - DNA, 20 bp, Artificial Sequence
  Description of Artificial Sequence: Synthetic oligonucleotide
  Target: ATXN1; (-) strand; PAM type: NNGRRT; PAM sequence: CAGGGT
tgtgtgtatcacatgtaagt

SEQ ID NO: 13593 - DNA, 20 bp, Artificial Sequence
  Description of Artificial Sequence: Synthetic oligonucleotide
  Target: ATXN1; (-) strand; PAM type: NNGRRT; PAM sequence: GCGAGT
ttcatgcctgaatcacaaag

SEQ ID NO: 13594 - DNA, 20 bp, Artificial Sequence
  Description of Artificial Sequence: Synthetic oligonucleotide
  Target: ATXN1; (-) strand; PAM type: NNGRRT; PAM sequence: CTGAAT
ggcacctcatggtttcatgc

SEQ ID NO: 13595 - DNA, 20 bp, Artificial Sequence
  Description of Artificial Sequence: Synthetic oligonucleotide
  Target: ATXN1; (-) strand; PAM type: NNGRRT; PAM sequence: CTGAAT
tctgtcctaatgtacttctt

SEQ ID NO: 13596 - DNA, 20 bp, Artificial Sequence
  Description of Artificial Sequence: Synthetic oligonucleotide
  Target: ATXN1; (-) strand; PAM type: NNGRRT; PAM sequence: TTGAAT
tatgtggggttggtttcagt

SEQ ID NO: 13597 - DNA, 20 bp, Artificial Sequence
  Description of Artificial Sequence: Synthetic oligonucleotide
  Target: ATXN1; (-) strand; PAM type: NNGRRT; PAM sequence: TGGGGT
tgacaccacggtttgatatg

SEQ ID NO: 13598 - DNA, 20 bp, Artificial Sequence
  Description of Artificial Sequence: Synthetic oligonucleotide
  Target: ATXN1; (-) strand; PAM type: NNGRRT; PAM sequence: TGGGAT
gctatctttgcaccaggtcc

SEQ ID NO: 13599 - DNA, 20 bp, Artificial Sequence
  Description of Artificial Sequence: Synthetic oligonucleotide
  Target: ATXN1; (-) strand; PAM type: NNGRRT; PAM sequence: AGGAAT
tgctccaacttggaatgaag

SEQ ID NO: 13600 - DNA, 20 bp, Artificial Sequence
  Description of Artificial Sequence: Synthetic oligonucleotide
  Target: ATXN1; (-) strand; PAM type: NNGRRT; PAM sequence: TGGAAT
aaggctgttctgctccaact

SEQ ID NO: 13601 - DNA, 20 bp, Artificial Sequence
  Description of Artificial Sequence: Synthetic oligonucleotide
  Target: ATXN1; (-) strand; PAM type: NNGRRT; PAM sequence: AAGGAT
caaaatatgtggccctctcg

SEQ ID NO: 13602 - DNA, 20 bp, Artificial Sequence
  Description of Artificial Sequence: Synthetic oligonucleotide
  Target: ATXN1; (-) strand; PAM type: NNGRRT; PAM sequence: CAGAAT
gtgtctgatatttctcaagg

SEQ ID NO: 13603 - DNA, 20 bp, Artificial Sequence
  Description of Artificial Sequence: Synthetic oligonucleotide
  Target: ATXN1; (-) strand; PAM type: NNGRRT; PAM sequence: TTGAGT
tcagtgtgtcgccggagtac

SEQ ID NO: 13604 - DNA, 20 bp, Artificial Sequence
  Description of Artificial Sequence: Synthetic oligonucleotide
  Target: ATXN1; (-) strand; PAM type: NNGRRT; PAM sequence: CGGAGT
acatttgctcagtgtgtcgc

SEQ ID NO: 13605 - DNA, 20 bp, Artificial Sequence
  Description of Artificial Sequence: Synthetic oligonucleotide
  Target: ATXN1; (-) strand; PAM type: NNGRRT; PAM sequence: CAGGAT
aatgggaactactgtggcac

SEQ ID NO: 13606 - DNA, 20 bp, Artificial Sequence
  Description of Artificial Sequence: Synthetic oligonucleotide
  Target: ATXN1; (-) strand; PAM type: NNGRRT; PAM sequence: GAGAAT
agaagttacagaagaggaga

SEQ ID NO: 13607 - DNA, 20 bp, Artificial Sequence
  Description of Artificial Sequence: Synthetic oligonucleotide
  Target: ATXN1; (-) strand; PAM type: NNGRRT; PAM sequence: GAGGAT
tgcagttatggctgtcttag

SEQ ID NO: 13608 - DNA, 20 bp, Artificial Sequence
  Description of Artificial Sequence: Synthetic oligonucleotide
  Target: ATXN1; (-) strand; PAM type: NNGRRT; PAM sequence: AAGGGT
ccaagtctctctctccaaga

SEQ ID NO: 13609 - DNA, 20 bp, Artificial Sequence
  Description of Artificial Sequence: Synthetic oligonucleotide
  Target: ATXN1; (-) strand; PAM type: NNGRRT; PAM sequence: CAGAAT
agaagtcggattcactgagg

SEQ ID NO: 13610 - DNA, 20 bp, Artificial Sequence
  Description of Artificial Sequence: Synthetic oligonucleotide
  Target: ATXN1; (-) strand; PAM type: NNGRRT; PAM sequence: TCGGAT
tttcactgtggaggtagaag

SEQ ID NO: 13611 - DNA, 20 bp, Artificial Sequence
  Description of Artificial Sequence: Synthetic oligonucleotide
  Target: ATXN1; (-) strand; PAM type: NNGRRT; PAM sequence: GTGGAT
aaggcataggtgtgtcttgg

SEQ ID NO: 13612 - DNA, 20 bp, Artificial Sequence
  Description of Artificial Sequence: Synthetic oligonucleotide
  Target: ATXN1; (-) strand; PAM type: NNGRRT; PAM sequence: TTGGGT
gtaaaaggcataggtgtgtc

SEQ ID NO: 13613 - DNA, 20 bp, Artificial Sequence
  Description of Artificial Sequence: Synthetic oligonucleotide
  Target: ATXN1; (-) strand; PAM type: NNGRRT; PAM sequence: CTGAAT
gtgaagggcaggattcttca

SEQ ID NO: 13614 - DNA, 20 bp, Artificial Sequence
  Description of Artificial Sequence: Synthetic oligonucleotide
  Target: ATXN1; (-) strand; PAM type: NNGRRT; PAM sequence: CAGGAT
gaggaggctgttgtgaaggg

SEQ ID NO: 13615 - DNA, 20 bp, Artificial Sequence
  Description of Artificial Sequence: Synthetic oligonucleotide
  Target: ATXN1; (-) strand; PAM type: NNGRRT; PAM sequence: AGGAGT
aaacatctctctgtgggtga

SEQ ID NO: 13616 - DNA, 20 bp, Artificial Sequence
  Description of Artificial Sequence: Synthetic oligonucleotide
  Target: ATXN1; (-) strand; PAM type: NNGRRT; PAM sequence: GTGGGT
gatcaaagaaacatctctct

SEQ ID NO: 13617 - DNA, 20 bp, Artificial Sequence
  Description of Artificial Sequence: Synthetic oligonucleotide
  Target: ATXN1; (-) strand; PAM type: NNGRRT; PAM sequence: CTGAAT
ccctttctgaaatttcttac

SEQ ID NO: 13618 - DNA, 20 bp, Artificial Sequence
  Description of Artificial Sequence: Synthetic oligonucleotide
  Target: ATXN1; (-) strand; PAM type: NNGRRT; PAM sequence: TAGAGT
cctttatgaaaaatgaattc

SEQ ID NO: 13619 - DNA, 20 bp, Artificial Sequence
  Description of Artificial Sequence: Synthetic oligonucleotide
  Target: ATXN1; (-) strand; PAM type: NNGRRT; PAM sequence: ATGAAT
tgactgtccctttatgaaaa

SEQ ID NO: 13620 - DNA, 20 bp, Artificial Sequence
  Description of Artificial Sequence: Synthetic oligonucleotide
  Target: ATXN1; (-) strand; PAM type: NNGRRT; PAM sequence: CAGGGT
aaaatgacaaagaagaattt

SEQ ID NO: 13621 - DNA, 20 bp, Artificial Sequence
  Description of Artificial Sequence: Synthetic oligonucleotide
  Target: ATXN1; (-) strand; PAM type: NNGRRT; PAM sequence: AAGAAT
cctgatgcaaaatgacaaag

SEQ ID NO: 13622 - DNA, 20 bp, Artificial Sequence
  Description of Artificial Sequence: Synthetic oligonucleotide
  Target: ATXN1; (-) strand; PAM type: NNGRRT; PAM sequence: GAGGAT
cttgcgtagtagaaggccgt

SEQ ID NO: 13623 - DNA, 20 bp, Artificial Sequence
  Description of Artificial Sequence: Synthetic oligonucleotide
  Target: ATXN1; (-) strand; PAM type: NNGRRT; PAM sequence: AGGAGT
tgtaggagatttctgtaaag

SEQ ID NO: 13624 - DNA, 20 bp, Artificial Sequence
  Description of Artificial Sequence: Synthetic oligonucleotide
  Target: ATXN1; (-) strand; PAM type: NNGRRT; PAM sequence: CAGAAT
aaaacaccattgtttgtgat

SEQ ID NO: 13625 - DNA, 20 bp, Artificial Sequence
  Description of Artificial Sequence: Synthetic oligonucleotide
  Target: ATXN1; (-) strand; PAM type: NNGRRT; PAM sequence: AGGGGT
aaggatgtaaaagtgctcca

SEQ ID NO: 13626 - DNA, 20 bp, Artificial Sequence
  Description of Artificial Sequence: Synthetic oligonucleotide
  Target: ATXN1; (-) strand; PAM type: NNGRRT; PAM sequence: AAGGAT
ctggaggatcatgtgatgcg

SEQ ID NO: 13627 - DNA, 20 bp, Artificial Sequence
  Description of Artificial Sequence: Synthetic oligonucleotide
  Target: ATXN1; (-) strand; PAM type: NNGRRT; PAM sequence: GAGGAT
cagtcttataggattacctg

SEQ ID NO: 13628 - DNA, 20 bp, Artificial Sequence
  Description of Artificial Sequence: Synthetic oligonucleotide
  Target: ATXN1; (-) strand; PAM type: NNGRRT; PAM sequence: TAGGAT
cacctgttcttccagtctta

SEQ ID NO: 13629 - DNA, 20 bp, Artificial Sequence
  Description of Artificial Sequence: Synthetic oligonucleotide
  Target: ATXN1; (-) strand; PAM type: NNGRRT; PAM sequence: CTGGGT
agacagatcacttaggccca

SEQ ID NO: 13630 - DNA, 20 bp, Artificial Sequence
  Description of Artificial Sequence: Synthetic oligonucleotide
  Target: ATXN1; (-) strand; PAM type: NNGRRT; PAM sequence: CCGAAT
gcgtaaatggctccaaatca

SEQ ID NO: 13631 - DNA, 20 bp, Artificial Sequence
  Description of Artificial Sequence: Synthetic oligonucleotide
  Target: ATXN1; (-) strand; PAM type: NNGRRT; PAM sequence: AGGGGT
gcagcctggagcaaagagag

SEQ ID NO: 13632 - DNA, 20 bp, Artificial Sequence
  Description of Artificial Sequence: Synthetic oligonucleotide
  Target: ATXN1; (-) strand; PAM type: NNGRRT; PAM sequence: CTGGAT
cactagaaccctgggcaacc

SEQ ID NO: 13633 - DNA, 20 bp, Artificial Sequence
  Description of Artificial Sequence: Synthetic oligonucleotide
  Target: ATXN1; (-) strand; PAM type: NNGRRT; PAM sequence: GAGAAT
ggcagacagagacagcaatg

SEQ ID NO: 13634 - DNA, 20 bp, Artificial Sequence
  Description of Artificial Sequence: Synthetic oligonucleotide
  Target: ATXN1; (-) strand; PAM type: NNGRRT; PAM sequence: CTGAGT
agcattccttccaccgtctt

SEQ ID NO: 13635 - DNA, 20 bp, Artificial Sequence
  Description of Artificial Sequence: Synthetic oligonucleotide
  Target: ATXN1; (-) strand; PAM type: NNGRRT; PAM sequence: GAGAGT
cagcccttggactcccttca

SEQ ID NO: 13636 - DNA, 20 bp, Artificial Sequence
  Description of Artificial Sequence: Synthetic oligonucleotide
  Target: ATXN1; (-) strand; PAM type: NNGRRT; PAM sequence: CTGAAT
tctgagtcttcctgaaggtt

SEQ ID NO: 13637 - DNA, 20 bp, Artificial Sequence
  Description of Artificial Sequence: Synthetic oligonucleotide
  Target: ATXN1; (-) strand; PAM type: NNGRRT; PAM sequence: CTGAGT
tcaggcaggctggagctgtt

SEQ ID NO: 13638 - DNA, 20 bp, Artificial Sequence
  Description of Artificial Sequence: Synthetic oligonucleotide
  Target: ATXN1; (-) strand; PAM type: NNGRRT; PAM sequence: CTGAGT
actgccattcatggaaggcc

SEQ ID NO: 13639 - DNA, 20 bp, Artificial Sequence
  Description of Artificial Sequence: Synthetic oligonucleotide
  Target: ATXN1; (-) strand; PAM type: NNGRRT; PAM sequence: GGGAAT
tatgtgtaaagggcatgtta

SEQ ID NO: 13640 - DNA, 20 bp, Artificial Sequence
  Description of Artificial Sequence: Synthetic oligonucleotide
  Target: ATXN1; (-) strand; PAM type: NNGRRT; PAM sequence: CTGAAT
attgctctgatttcagttgg

SEQ ID NO: 13641 - DNA, 20 bp, Artificial Sequence
  Description of Artificial Sequence: Synthetic oligonucleotide
  Target: ATXN1; (-) strand; PAM type: NNGRRT; PAM sequence: CAGAAT
ttaatttgtgctctgtttca

SEQ ID NO: 13642 - DNA, 20 bp, Artificial Sequence
  Description of Artificial Sequence: Synthetic oligonucleotide
  Target: ATXN1; (-) strand; PAM type: NNGRRT; PAM sequence: AGGGGT
tgtgaagttagtagctacag

SEQ ID NO: 13643 - DNA, 20 bp, Artificial Sequence
  Description of Artificial Sequence: Synthetic oligonucleotide
  Target: ATXN1; (-) strand; PAM type: NNGRRT; PAM sequence: TAGGGT
cgtggcacagtgggatggag

SEQ ID NO: 13644 - DNA, 20 bp, Artificial Sequence
  Description of Artificial Sequence: Synthetic oligonucleotide
  Target: ATXN1; (-) strand; PAM type: NNGRRT; PAM sequence: TGGAGT
aacaacgtggcacagtggga

SEQ ID NO: 13645 - DNA, 20 bp, Artificial Sequence
  Description of Artificial Sequence: Synthetic oligonucleotide
  Target: ATXN1; (-) strand; PAM type: NNGRRT; PAM sequence: TGGGAT
tggtaaacaacgtggcacag

SEQ ID NO: 13646 - DNA, 20 bp, Artificial Sequence
  Description of Artificial Sequence: Synthetic oligonucleotide
  Target: ATXN1; (-) strand; PAM type: NNGRRT; PAM sequence: TGGGAT
tgaggaatacaagtgcctgg

SEQ ID NO: 13647 - DNA, 20 bp, Artificial Sequence
  Description of Artificial Sequence: Synthetic oligonucleotide
  Target: ATXN1; (-) strand; PAM type: NNGRRT; PAM sequence: AGGAAT
taaagtaatacacgtgggtg

SEQ ID NO: 13648 - DNA, 20 bp, Artificial Sequence
  Description of Artificial Sequence: Synthetic oligonucleotide
  Target: ATXN1; (-) strand; PAM type: NNGRRT; PAM sequence: GTGGGT
ggcattttaaagtaatacac

SEQ ID NO: 13649 - DNA, 20 bp, Artificial Sequence
  Description of Artificial Sequence: Synthetic oligonucleotide
  Target: ATXN1; (-) strand; PAM type: NNGRRT; PAM sequence: GTGAAT
atccgcaggctccaaggtgt

SEQ ID NO: 13650 - DNA, 20 bp, Artificial Sequence
  Description of Artificial Sequence: Synthetic oligonucleotide
  Target: ATXN1; (-) strand; PAM type: NNGRRT; PAM sequence: GAGAAT
agaatgattaagaaggctta

SEQ ID NO: 13651 - DNA, 20 bp, Artificial Sequence
  Description of Artificial Sequence: Synthetic oligonucleotide
  Target: ATXN1; (-) strand; PAM type: NNGRRT; PAM sequence: AAGAAT
gaaggacaaagtaatacctg

SEQ ID NO: 13652 - DNA, 20 bp, Artificial Sequence
  Description of Artificial Sequence: Synthetic oligonucleotide
  Target: ATXN1; (-) strand; PAM type: NNGRRT; PAM sequence: CTGAAT
tttagggacccagattacaa

SEQ ID NO: 13653 - DNA, 20 bp, Artificial Sequence
  Description of Artificial Sequence: Synthetic oligonucleotide
  Target: ATXN1; (-) strand; PAM type: NNGRRT; PAM sequence: TGGGAT
tgagtaacacaagcaggagg

SEQ ID NO: 13654 - DNA, 20 bp, Artificial Sequence
  Description of Artificial Sequence: Synthetic oligonucleotide
  Target: ATXN1; (-) strand; PAM type: NNGRRT; PAM sequence: GTGAGT
ttattcttaaattttgaata

SEQ ID NO: 13655 - DNA, 20 bp, Artificial Sequence
  Description of Artificial Sequence: Synthetic oligonucleotide
  Target: ATXN1; (-) strand; PAM type: NNGRRT; PAM sequence: TTGAAT
tgacttcttattcttaaatt

SEQ ID NO: 13656 - DNA, 20 bp, Artificial Sequence
  Description of Artificial Sequence: Synthetic oligonucleotide
  Target: ATXN1; (-) strand; PAM type: NNGRRT; PAM sequence: AGGGAT
caagccctgagccgtgtttc

SEQ ID NO: 13657 - DNA, 20 bp, Artificial Sequence
  Description of Artificial Sequence: Synthetic oligonucleotide
  Target: ATXN1; (-) strand; PAM type: NNGRRT; PAM sequence: TTGAGT
tattgcagccgtgtttgtgg

SEQ ID NO: 13658 - DNA, 20 bp, Artificial Sequence
  Description of Artificial Sequence: Synthetic oligonucleotide
  Target: ATXN1; (-) strand; PAM type: NNGRRT; PAM sequence: CGGGAT
gaacagagggtcatctgcta

SEQ ID NO: 13659 - DNA, 20 bp, Artificial Sequence
  Description of Artificial Sequence: Synthetic oligonucleotide
  Target: ATXN1; (-) strand; PAM type: NNGRRT; PAM sequence: GAGGGT
actttgtttgttctggaaca

SEQ ID NO: 13660 - DNA, 20 bp, Artificial Sequence
  Description of Artificial Sequence: Synthetic oligonucleotide
  Target: ATXN1; (-) strand; PAM type: NNGRRT; PAM sequence: TAGGGT
ttctaatgtcatcatgctta

SEQ ID NO: 13661 - DNA, 20 bp, Artificial Sequence
  Description of Artificial Sequence: Synthetic oligonucleotide
  Target: ATXN1; (-) strand; PAM type: NNGRRT; PAM sequence: ACGAGT
tattgtgggccaatatgcca

SEQ ID NO: 13662 - DNA, 20 bp, Artificial Sequence
  Description of Artificial Sequence: Synthetic oligonucleotide
  Target: ATXN1; (-) strand; PAM type: NNGRRT; PAM sequence: ATGAAT
tttccagagtgaaatagcgg

SEQ ID NO: 13663 - DNA, 20 bp, Artificial Sequence
  Description of Artificial Sequence: Synthetic oligonucleotide
  Target: ATXN1; (-) strand; PAM type: NNGRRT; PAM sequence: GCGGAT
cccctttccagagtgaaata

SEQ ID NO: 13664 - DNA, 20 bp, Artificial Sequence
  Description of Artificial Sequence: Synthetic oligonucleotide
  Target: ATXN1; (-) strand; PAM type: NNGRRT; PAM sequence: CAGAGT
cccccaactgatcccctttc

SEQ ID NO: 13665 - DNA, 20 bp, Artificial Sequence
  Description of Artificial Sequence: Synthetic oligonucleotide
  Target: ATXN1; (-) strand; PAM type: NNGRRT; PAM sequence: CAGAAT
agccctgtcaaaatgaatga

SEQ ID NO: 13666 - DNA, 20 bp, Artificial Sequence
  Description of Artificial Sequence: Synthetic oligonucleotide
  Target: ATXN1; (-) strand; PAM type: NNGRRT; PAM sequence: ATGAAT
tgttaataagccctgtcaaa

SEQ ID NO: 13667 - DNA, 20 bp, Artificial Sequence
  Description of Artificial Sequence: Synthetic oligonucleotide
  Target: ATXN1; (-) strand; PAM type: NNGRRT; PAM sequence: CAGGGT
aatcaacattttcctttggc

SEQ ID NO: 13668 - DNA, 20 bp, Artificial Sequence
  Description of Artificial Sequence: Synthetic oligonucleotide
  Target: ATXN1; (-) strand; PAM type: NNGRRT; PAM sequence: TGGAGT
gctgcttggttaaagtgtcc

SEQ ID NO: 13669 - DNA, 20 bp, Artificial Sequence
  Description of Artificial Sequence: Synthetic oligonucleotide
  Target: ATXN1; (-) strand; PAM type: NNGRRT; PAM sequence: CTGGAT
gttaaagcagcaaggggatg

SEQ ID NO: 13670 - DNA, 20 bp, Artificial Sequence
  Description of Artificial Sequence: Synthetic oligonucleotide
  Target: ATXN1; (-) strand; PAM type: NNGRRT; PAM sequence: GGGGAT
ggaaaaggttaaagcagcaa

SEQ ID NO: 13671 - DNA, 20 bp, Artificial Sequence
  Description of Artificial Sequence: Synthetic oligonucleotide
  Target: ATXN1; (-) strand; PAM type: NNGRRT; PAM sequence: TTGGAT
ttttttctttcccccagttt

SEQ ID NO: 13672 - DNA, 20 bp, Artificial Sequence
  Description of Artificial Sequence: Synthetic oligonucleotide
  Target: ATXN1; (-) strand; PAM type: NNGRRT; PAM sequence: GAGAAT
cgacatacaatctggtccat

SEQ ID NO: 13673 - DNA, 20 bp, Artificial Sequence
  Description of Artificial Sequence: Synthetic oligonucleotide
  Target: ATXN1; (-) strand; PAM type: NNGRRT; PAM sequence: CTGGAT
ggacatggagagttccatgt

SEQ ID NO: 13674 - DNA, 20 bp, Artificial Sequence
  Description of Artificial Sequence: Synthetic oligonucleotide
  Target: ATXN1; (-) strand; PAM type: NNGRRT; PAM sequence: GAGAGT
ggcccccagtcaaggacatg

SEQ ID NO: 13675 - DNA, 20 bp, Artificial Sequence
  Description of Artificial Sequence: Synthetic oligonucleotide
  Target: ATXN1; (-) strand; PAM type: NNGRRT; PAM sequence: AGGGAT
aacaattcgaatgcttggga

SEQ ID NO: 13676 - DNA, 20 bp, Artificial Sequence
  Description of Artificial Sequence: Synthetic oligonucleotide
  Target: ATXN1; (-) strand; PAM type: NNGRRT; PAM sequence: TCGAAT
cttaaccttaaaagaacaat

SEQ ID NO: 13677 - DNA, 20 bp, Artificial Sequence
  Description of Artificial Sequence: Synthetic oligonucleotide
  Target: ATXN1; (-) strand; PAM type: NNGRRT; PAM sequence: AAGAAT
acaggacagcccccaccaca

SEQ ID NO: 13678 - DNA, 20 bp, Artificial Sequence
  Description of Artificial Sequence: Synthetic oligonucleotide
  Target: ATXN1; (-) strand; PAM type: NNGRRT; PAM sequence: AGGAAT
gcatctagtgagtagaagtg

SEQ ID NO: 13679 - DNA, 20 bp, Artificial Sequence
  Description of Artificial Sequence: Synthetic oligonucleotide
  Target: ATXN1; (-) strand; PAM type: NNGRRT; PAM sequence: GTGAGT
ggaggagctaccagcatcta

SEQ ID NO: 13680 - DNA, 20 bp, Artificial Sequence
  Description of Artificial Sequence: Synthetic oligonucleotide
  Target: ATXN1; (-) strand; PAM type: NNGRRT; PAM sequence: CTGAAT
cgtgggcaagttggcaatgt

SEQ ID NO: 13681 - DNA, 20 bp, Artificial Sequence
  Description of Artificial Sequence: Synthetic oligonucleotide
  Target: ATXN1; (-) strand; PAM type: NNGRRT; PAM sequence: GAGAGT
atttaaccttcatgcaataa

SEQ ID NO: 13682 - DNA, 20 bp, Artificial Sequence
  Description of Artificial Sequence: Synthetic oligonucleotide
  Target: ATXN1; (-) strand; PAM type: NNGRRT; PAM sequence: GTGAGT
aatgtgagtgtgtgtcacat

SEQ ID NO: 13683 - DNA, 20 bp, Artificial Sequence
  Description of Artificial Sequence: Synthetic oligonucleotide
  Target: ATXN1; (-) strand; PAM type: NNGRRT; PAM sequence: GTGAGT
tcgtgtgtgtgtttatgaat

SEQ ID NO: 13684 - DNA, 20 bp, Artificial Sequence
  Description of Artificial Sequence: Synthetic oligonucleotide
  Target: ATXN1; (-) strand; PAM type: NNGRRT; PAM sequence: ATGAAT
attgtatcgtgtgtgtgttt

SEQ ID NO: 13685 - DNA, 20 bp, Artificial Sequence
  Description of Artificial Sequence: Synthetic oligonucleotide
  Target: ATXN1; (-) strand; PAM type: NNGRRT; PAM sequence: AGGGAT
aacgaggaccactctgtctt

SEQ ID NO: 13686 - DNA, 20 bp, Artificial Sequence
  Description of Artificial Sequence: Synthetic oligonucleotide
  Target: ATXN1; (-) strand; PAM type: NNGRRT; PAM sequence: GGGAGT
tagaagctgaatgaaagcct

SEQ ID NO: 13687 - DNA, 20 bp, Artificial Sequence
  Description of Artificial Sequence: Synthetic oligonucleotide
  Target: ATXN1; (-) strand; PAM type: NNGRRT; PAM sequence: CTGAAT
gcactgttgttttatagaag

SEQ ID NO: 13688 - DNA, 20 bp, Artificial Sequence
  Description of Artificial Sequence: Synthetic oligonucleotide
  Target: ATXN1; (-) strand; PAM type: NNGRRT; PAM sequence: TTGGGT
ttctgcgtctgctttctttt

SEQ ID NO: 13689 - DNA, 20 bp, Artificial Sequence
  Description of Artificial Sequence: Synthetic oligonucleotide
  Target: ATXN1; (-) strand; PAM type: NNGRRT; PAM sequence: TGGAAT
aagacaaccctagagcccta

SEQ ID NO: 13690 - DNA, 20 bp, Artificial Sequence
  Description of Artificial Sequence: Synthetic oligonucleotide
  Target: ATXN1; (-) strand; PAM type: NNGRRT; PAM sequence: TAGAGT
aaatctgtgaggaattttta

SEQ ID NO: 13691 - DNA, 20 bp, Artificial Sequence
  Description of Artificial Sequence: Synthetic oligonucleotide
  Target: ATXN1; (-) strand; PAM type: NNGRRT; PAM sequence: AGGAAT
ctagtcactgaaaatctgtg

SEQ ID NO: 13692 - DNA, 20 bp, Artificial Sequence
  Description of Artificial Sequence: Synthetic oligonucleotide
  Target: ATXN1; (-) strand; PAM type: NNGRRT; PAM sequence: AAGAGT
ttgaatcagctcaataataa

SEQ ID NO: 13693 - DNA, 20 bp, Artificial Sequence
  Description of Artificial Sequence: Synthetic oligonucleotide
  Target: ATXN1; (-) strand; PAM type: NNGRRT; PAM sequence: TTGAAT
tcaacataaaatctgttcct

SEQ ID NO: 13694 - DNA, 20 bp, Artificial Sequence
  Description of Artificial Sequence: Synthetic oligonucleotide
  Target: ATXN1; (-) strand; PAM type: NNGRRT; PAM sequence: CTGGGT
ttgccccattgcactccagc

SEQ ID NO: 13695 - DNA, 20 bp, Artificial Sequence
  Description of Artificial Sequence: Synthetic oligonucleotide
  Target: ATXN1; (-) strand; PAM type: NNGRRT; PAM sequence: GAGAAT
tactccagaggctgaggcag

SEQ ID NO: 13696 - DNA, 20 bp, Artificial Sequence
  Description of Artificial Sequence: Synthetic oligonucleotide
  Target: ATXN1; (-) strand; PAM type: NNGRRT; PAM sequence: AGGAGT
caggtggatcgcctgaggtc

SEQ ID NO: 13697 - DNA, 20 bp, Artificial Sequence
  Description of Artificial Sequence: Synthetic oligonucleotide
  Target: ATXN1; (-) strand; PAM type: NNGRRT; PAM sequence: GTGGAT
actttgggaggccgaggcag

SEQ ID NO: 13698 - DNA, 20 bp, Artificial Sequence
  Description of Artificial Sequence: Synthetic oligonucleotide
  Target: ATXN1; (-) strand; PAM type: NNGRRT; PAM sequence: ATGAAT
aaagttgttgtgataattaa

SEQ ID NO: 13699 - DNA, 20 bp, Artificial Sequence
  Description of Artificial Sequence: Synthetic oligonucleotide
  Target: ATXN1; (-) strand; PAM type: NNGRRT; PAM sequence: TGGGGT
gcatcagcttgtgctgtaat

SEQ ID NO: 13700 - DNA, 20 bp, Artificial Sequence
  Description of Artificial Sequence: Synthetic oligonucleotide
  Target: ATXN1; (-) strand; PAM type: NNGRRT; PAM sequence: CTGGGT
gttagctggagtgagccagc

SEQ ID NO: 13701 - DNA, 20 bp, Artificial Sequence
  Description of Artificial Sequence: Synthetic oligonucleotide
  Target: ATXN1; (-) strand; PAM type: NNGRRT; PAM sequence: TGGAGT
tgtgatggttgggtgttagc

SEQ ID NO: 13702 - DNA, 20 bp, Artificial Sequence
  Description of Artificial Sequence: Synthetic oligonucleotide
  Target: ATXN1; (-) strand; PAM type: NNGRRT; PAM sequence: TTGGGT
ggtggccctgcatgtgatgg

SEQ ID NO: 13703 - DNA, 20 bp, Artificial Sequence
  Description of Artificial Sequence: Synthetic oligonucleotide
  Target: ATXN1; (-) strand; PAM type: NNGRRT; PAM sequence: CAGGGT
gtgtgaatgtgttagcagag

SEQ ID NO: 13704 - DNA, 20 bp, Artificial Sequence
  Description of Artificial Sequence: Synthetic oligonucleotide
  Target: ATXN1; (-) strand; PAM type: NNGRRT; PAM sequence: GTGAAT
ggtgatgtgtagtgagttgt

SEQ ID NO: 13705 - DNA, 20 bp, Artificial Sequence
  Description of Artificial Sequence: Synthetic oligonucleotide
  Target: ATXN1; (-) strand; PAM type: NNGRRT; PAM sequence: GTGAGT
cgtcggtctggtgatgtgta

SEQ ID NO: 13706 - DNA, 20 bp, Artificial Sequence
  Description of Artificial Sequence: Synthetic oligonucleotide
  Target: ATXN1; (-) strand; PAM type: NNGRRT; PAM sequence: CTGAGT
cctctccccacttggggctt

SEQ ID NO: 13707 - DNA, 20 bp, Artificial Sequence
  Description of Artificial Sequence: Synthetic oligonucleotide
  Target: ATXN1; (-) strand; PAM type: NNGRRT; PAM sequence: CAGGGT
caggtgcaggaacaggtcgc

SEQ ID NO: 13708 - DNA, 20 bp, Artificial Sequence
  Description of Artificial Sequence: Synthetic oligonucleotide
  Target: ATXN1; (-) strand; PAM type: NNGRRT; PAM sequence: TAGGGT
tagggcagagaatttaaatt

SEQ ID NO: 13709 - DNA, 20 bp, Artificial Sequence
  Description of Artificial Sequence: Synthetic oligonucleotide
  Target: ATXN1; (-) strand; PAM type: NNGRRT; PAM sequence: GAGAAT
ggggaagaaatagtagggca

SEQ ID NO: 13710 - DNA, 20 bp, Artificial Sequence
  Description of Artificial Sequence: Synthetic oligonucleotide
  Target: ATXN1; (-) strand; PAM type: NNGRRT; PAM sequence: AGGGAT
aaaggagtttgaaagaacta

SEQ ID NO: 13711 - DNA, 20 bp, Artificial Sequence
  Description of Artificial Sequence: Synthetic oligonucleotide
  Target: ATXN1; (-) strand; PAM type: NNGRRT; PAM sequence: AGGAGT
tctacagtcagtaaggaaaa

SEQ ID NO: 13712 - DNA, 20 bp, Artificial Sequence
  Description of Artificial Sequence: Synthetic oligonucleotide
  Target: ATXN1; (-) strand; PAM type: NNGRRT; PAM sequence: TGGGGT
tgcagtgccagtgagaaact

SEQ ID NO: 13713 - DNA, 20 bp, Artificial Sequence
  Description of Artificial Sequence: Synthetic oligonucleotide
  Target: ATXN1; (-) strand; PAM type: NNGRRT; PAM sequence: GAGAAT
tacttgggaggctaaggcat

SEQ ID NO: 13714 - DNA, 20 bp, Artificial Sequence
  Description of Artificial Sequence: Synthetic oligonucleotide
  Target: ATXN1; (-) strand; PAM type: NNGRRT; PAM sequence: AGGAGT
tgggtggatcacctgaggcc

SEQ ID NO: 13715 - DNA, 20 bp, Artificial Sequence
  Description of Artificial Sequence: Synthetic oligonucleotide
  Target: ATXN1; (-) strand; PAM type: NNGRRT; PAM sequence: GTGGAT
attttgggaggccgagatgg

SEQ ID NO: 13716 - DNA, 20 bp, Artificial Sequence
  Description of Artificial Sequence: Synthetic oligonucleotide
  Target: ATXN1; (-) strand; PAM type: NNGRRT; PAM sequence: ATGGGT
cagcattttgggaggccgag

SEQ ID NO: 13717 - DNA, 20 bp, Artificial Sequence
  Description of Artificial Sequence: Synthetic oligonucleotide
  Target: ATXN1; (-) strand; PAM type: NNGRRT; PAM sequence: CAGAAT
gcctaaaactcatagaaaca

SEQ ID NO: 13718 - DNA, 20 bp, Artificial Sequence
  Description of Artificial Sequence: Synthetic oligonucleotide
  Target: ATXN1; (-) strand; PAM type: NNGRRT; PAM sequence: TCGAAT
tgctgcggtttttatgtgga

SEQ ID NO: 13719 - DNA, 20 bp, Artificial Sequence
  Description of Artificial Sequence: Synthetic oligonucleotide
  Target: ATXN1; (-) strand; PAM type: NNGRRT; PAM sequence: GTGGAT
atacctgctgcggtttttat

SEQ ID NO: 13720 - DNA, 20 bp, Artificial Sequence
  Description of Artificial Sequence: Synthetic oligonucleotide
  Target: ATXN1; (-) strand; PAM type: NNGRRT; PAM sequence: AAGAAT
tcaccacgtgatcttcagaa

SEQ ID NO: 13721 - DNA, 20 bp, Artificial Sequence
  Description of Artificial Sequence: Synthetic oligonucleotide
  Target: ATXN1; (-) strand; PAM type: NNGRRT; PAM sequence: TTGGGT
ccagctaggaatccacagac

SEQ ID NO: 13722 - DNA, 20 bp, Artificial Sequence
  Description of Artificial Sequence: Synthetic oligonucleotide
  Target: ATXN1; (-) strand; PAM type: NNGRRT; PAM sequence: AGGAAT
ggtagaatttgcctccagct

SEQ ID NO: 13723 - DNA, 20 bp, Artificial Sequence
  Description of Artificial Sequence: Synthetic oligonucleotide
  Target: ATXN1; (-) strand; PAM type: NNGRRT; PAM sequence: TAGAAT
tacttaaaaatgtgatgtgg

SEQ ID NO: 13724 - DNA, 20 bp, Artificial Sequence
  Description of Artificial Sequence: Synthetic oligonucleotide
  Target: ATXN1; (-) strand; PAM type: NNGRRT; PAM sequence: CTGAGT
gagtcttattgtgattttgc

SEQ ID NO: 13725 - DNA, 20 bp, Artificial Sequence
  Description of Artificial Sequence: Synthetic oligonucleotide
  Target: ATXN1; (-) strand; PAM type: NNGRRT; PAM sequence: CTGAGT
aatttagtcgcttacggatt

SEQ ID NO: 13726 - DNA, 20 bp, Artificial Sequence
  Description of Artificial Sequence: Synthetic oligonucleotide
  Target: ATXN1; (-) strand; PAM type: NNGRRT; PAM sequence: ACGGAT
ccaggcaaatttagtcgctt

SEQ ID NO: 13727 - DNA, 20 bp, Artificial Sequence
  Description of Artificial Sequence: Synthetic oligonucleotide
  Target: ATXN1; (-) strand; PAM type: NNGRRT; PAM sequence: CAGAAT
agcaatgtatcagtaaactt

SEQ ID NO: 13728 - DNA, 20 bp, Artificial Sequence
  Description of Artificial Sequence: Synthetic oligonucleotide
  Target: ATXN1; (-) strand; PAM type: NNGRRT; PAM sequence: TGGGGT
tctaaggagtgcagggactt

SEQ ID NO: 13729 - DNA, 20 bp, Artificial Sequence
  Description of Artificial Sequence: Synthetic oligonucleotide
  Target: ATXN1; (-) strand; PAM type: NNGRRT; PAM sequence: AGGAGT
ttccctccaacacttgtcta

SEQ ID NO: 13730 - DNA, 20 bp, Artificial Sequence
  Description of Artificial Sequence: Synthetic oligonucleotide
  Target: ATXN1; (-) strand; PAM type: NNGRRT; PAM sequence: GTGGAT
cgacatcttggagtatacta

SEQ ID NO: 13731 - DNA, 20 bp, Artificial Sequence
  Description of Artificial Sequence: Synthetic oligonucleotide
  Target: ATXN1; (-) strand; PAM type: NNGRRT; PAM sequence: TGGAGT
ttcagggactcgcgacatct

SEQ ID NO: 13732 - DNA, 20 bp, Artificial Sequence
  Description of Artificial Sequence: Synthetic oligonucleotide
  Target: ATXN1; (-) strand; PAM type: NNGRRT; PAM sequence: GGGGAT
aagaccaaatcagagatgtg

SEQ ID NO: 13733 - DNA, 20 bp, Artificial Sequence
  Description of Artificial Sequence: Synthetic oligonucleotide
  Target: ATXN1; (-) strand; PAM type: NNGRRT; PAM sequence: GGGAAT
atggttggcaagattgggtg

SEQ ID NO: 13734 - DNA, 20 bp, Artificial Sequence
  Description of Artificial Sequence: Synthetic oligonucleotide
  Target: ATXN1; (-) strand; PAM type: NNGRRT; PAM sequence: TTGGGT
atgaaatatggttggcaaga

SEQ ID NO: 13735 - DNA, 20 bp, Artificial Sequence
  Description of Artificial Sequence: Synthetic oligonucleotide
  Target: ATXN1; (-) strand; PAM type: NNGRRT; PAM sequence: GAGAGT
cataggaatgactcagtcaa

SEQ ID NO: 13736 - DNA, 20 bp, Artificial Sequence
  Description of Artificial Sequence: Synthetic oligonucleotide
  Target: ATXN1; (-) strand; PAM type: NNGRRT; PAM sequence: AGGAAT
gcagtactccctaatcccat

SEQ ID NO: 13737 - DNA, 20 bp, Artificial Sequence
  Description of Artificial Sequence: Synthetic oligonucleotide
  Target: ATXN1; (-) strand; PAM type: NNGRRT; PAM sequence: TTGGAT
ctcagcaaacaccacgaacc

SEQ ID NO: 13738 - DNA, 20 bp, Artificial Sequence
  Description of Artificial Sequence: Synthetic oligonucleotide
  Target: ATXN1; (-) strand; PAM type: NNGRRT; PAM sequence: TTGGAT
attctaaaaacctggtatgc

SEQ ID NO: 13739 - DNA, 20 bp, Artificial Sequence
  Description of Artificial Sequence: Synthetic oligonucleotide
  Target: ATXN1; (-) strand; PAM type: NNGRRT; PAM sequence: CAGAAT
ttggcagacatcccccccag

SEQ ID NO: 13740 - DNA, 20 bp, Artificial Sequence
  Description of Artificial Sequence: Synthetic oligonucleotide
  Target: ATXN1; (-) strand; PAM type: NNGRRT; PAM sequence: CTGAAT
aataaaacgggtggaacaaa

SEQ ID NO: 13741 - DNA, 20 bp, Artificial Sequence
  Description of Artificial Sequence: Synthetic oligonucleotide
  Target: ATXN1; (-) strand; PAM type: NNGRRT; PAM sequence: ACGGGT
cactcgagtttaaaaataaa

SEQ ID NO: 13742 - DNA, 20 bp, Artificial Sequence
  Description of Artificial Sequence: Synthetic oligonucleotide
  Target: ATXN1; (-) strand; PAM type: NNGRRT; PAM sequence: TCGAGT
tccaggaataaaatctgcac

SEQ ID NO: 13743 - DNA, 20 bp, Artificial Sequence
  Description of Artificial Sequence: Synthetic oligonucleotide
  Target: ATXN1; (-) strand; PAM type: NNGRRT; PAM sequence: AGGAAT
caccaatcttataacattcc

SEQ ID NO: 13744 - DNA, 20 bp, Artificial Sequence
  Description of Artificial Sequence: Synthetic oligonucleotide
  Target: ATXN1; (-) strand; PAM type: NNGRRT; PAM sequence: GTGAAT
tgttataaagcacttctgaa

SEQ ID NO: 13745 - DNA, 20 bp, Artificial Sequence
  Description of Artificial Sequence: Synthetic oligonucleotide
  Target: ATXN1; (-) strand; PAM type: NNGRRT; PAM sequence: GAGGGT
aatgtacttggagaatttta

SEQ ID NO: 13746 - DNA, 20 bp, Artificial Sequence
  Description of Artificial Sequence: Synthetic oligonucleotide
  Target: ATXN1; (-) strand; PAM type: NNGRRT; PAM sequence: GAGAAT
tcacccctaaaatgtacttg

SEQ ID NO: 13747 - DNA, 20 bp, Artificial Sequence
  Description of Artificial Sequence: Synthetic oligonucleotide
  Target: ATXN1; (-) strand; PAM type: NNGRRT; PAM sequence: TCGAGT
aaatgctttcaaaattatac

SEQ ID NO: 13748 - DNA, 20 bp, Artificial Sequence
  Description of Artificial Sequence: Synthetic oligonucleotide
  Target: ATXN1; (-) strand; PAM type: NNGRRT; PAM sequence: GAGAAT
gggggtgatgaggtagttgt

SEQ ID NO: 13749 - DNA, 20 bp, Artificial Sequence
  Description of Artificial Sequence: Synthetic oligonucleotide
  Target: ATXN1; (-) strand; PAM type: NNGRRT; PAM sequence: GGGGGT
ttagtttcttgcccgtaaat

SEQ ID NO: 13750 - DNA, 20 bp, Artificial Sequence
  Description of Artificial Sequence: Synthetic oligonucleotide
  Target: ATXN1; (-) strand; PAM type: NNGRRT; PAM sequence: CTGGAT
gattttgatatcgtggagat

SEQ ID NO: 13751 - DNA, 20 bp, Artificial Sequence
  Description of Artificial Sequence: Synthetic oligonucleotide
  Target: ATXN1; (-) strand; PAM type: NNGRRT; PAM sequence: AAGGAT
acagttgcatagtggcgaag

SEQ ID NO: 13752 - DNA, 20 bp, Artificial Sequence
  Description of Artificial Sequence: Synthetic oligonucleotide
  Target: ATXN1; (-) strand; PAM type: NNGRRT; PAM sequence: ATGAAT
tagtttatgatgtcctggat

SEQ ID NO: 13753 - DNA, 20 bp, Artificial Sequence
  Description of Artificial Sequence: Synthetic oligonucleotide
  Target: ATXN1; (-) strand; PAM type: NNGRRT; PAM sequence: CTGGAT
tattgatagtttatgatgtc

SEQ ID NO: 13754 - DNA, 20 bp, Artificial Sequence
  Description of Artificial Sequence: Synthetic oligonucleotide
  Target: ATXN1; (-) strand; PAM type: NNGRRT; PAM sequence: TAGAAT
tgcttttgcccccatcctgt

SEQ ID NO: 13755 - DNA, 20 bp, Artificial Sequence
  Description of Artificial Sequence: Synthetic oligonucleotide
  Target: ATXN1; (-) strand; PAM type: NNGRRT; PAM sequence: AGGAAT
ctcatcagaaaagcaggcta

SEQ ID NO: 13756 - DNA, 20 bp, Artificial Sequence
  Description of Artificial Sequence: Synthetic oligonucleotide
  Target: ATXN1; (-) strand; PAM type: NNGRRT; PAM sequence: CTGGAT
tccaccatttccatcactct

SEQ ID NO: 13757 - DNA, 20 bp, Artificial Sequence
  Description of Artificial Sequence: Synthetic oligonucleotide
  Target: ATXN1; (-) strand; PAM type: NNGRRT; PAM sequence: ACGAGT
agccctgcagggtcaattta

SEQ ID NO: 13758 - DNA, 20 bp, Artificial Sequence
  Description of Artificial Sequence: Synthetic oligonucleotide
  Target: ATXN1; (-) strand; PAM type: NNGRRT; PAM sequence: CAGGGT
gtactggtggtagagccctg

SEQ ID NO: 13759 - DNA, 20 bp, Artificial Sequence
  Description of Artificial Sequence: Synthetic oligonucleotide
  Target: ATXN1; (-) strand; PAM type: NNGRRT; PAM sequence: TGGGAT
agccttgcctttttacctct

SEQ ID NO: 13760 - DNA, 20 bp, Artificial Sequence
  Description of Artificial Sequence: Synthetic oligonucleotide
  Target: ATXN1; (-) strand; PAM type: NNGRRT; PAM sequence: CTGGGT
gtaaaatgtgtactcagtgg

SEQ ID NO: 13761 - DNA, 20 bp, Artificial Sequence
  Description of Artificial Sequence: Synthetic oligonucleotide
  Target: ATXN1; (-) strand; PAM type: NNGRRT; PAM sequence: GTGAGT
gcttccatgcagatttcatt

SEQ ID NO: 13762 - DNA, 20 bp, Artificial Sequence
  Description of Artificial Sequence: Synthetic oligonucleotide
  Target: ATXN1; (-) strand; PAM type: NNGRRT; PAM sequence: TTGAAT
tacatagaaacttggaatgt

SEQ ID NO: 13763 - DNA, 20 bp, Artificial Sequence
  Description of Artificial Sequence: Synthetic oligonucleotide
  Target: ATXN1; (-) strand; PAM type: NNGRRT; PAM sequence: TGGAAT
gattgaaatacatagaaact

SEQ ID NO: 13764 - DNA, 20 bp, Artificial Sequence
  Description of Artificial Sequence: Synthetic oligonucleotide
  Target: ATXN1; (-) strand; PAM type: NNGRRT; PAM sequence: AAGAGT
gtagtgcctcagaaaatatc

SEQ ID NO: 13765 - DNA, 20 bp, Artificial Sequence
  Description of Artificial Sequence: Synthetic oligonucleotide
  Target: ATXN1; (-) strand; PAM type: NNGRRT; PAM sequence: GAGGAT
ttcactctgaactgagaggt

SEQ ID NO: 13766 - DNA, 20 bp, Artificial Sequence
  Description of Artificial Sequence: Synthetic oligonucleotide
  Target: ATXN1; (-) strand; PAM type: NNGRRT; PAM sequence: CAGAAT
ttctttgcacttctttcaag

SEQ ID NO: 13767 - DNA, 20 bp, Artificial Sequence
  Description of Artificial Sequence: Synthetic oligonucleotide
  Target: ATXN1; (-) strand; PAM type: NNGRRT; PAM sequence: GTGGAT
aaaagaagtattcagaaggt

SEQ ID NO: 13768 - DNA, 20 bp, Artificial Sequence
  Description of Artificial Sequence: Synthetic oligonucleotide
  Target: ATXN1; (-) strand; PAM type: NNGRRT; PAM sequence: AGGGGT
ctctgggctgcacgtgacaa

SEQ ID NO: 13769 - DNA, 20 bp, Artificial Sequence
  Description of Artificial Sequence: Synthetic oligonucleotide
  Target: ATXN1; (-) strand; PAM type: NNGRRT; PAM sequence: CTGAAT
gacagtaaggagctgtacag

SEQ ID NO: 13770 - DNA, 20 bp, Artificial Sequence
  Description of Artificial Sequence: Synthetic oligonucleotide
  Target: ATXN1; (-) strand; PAM type: NNGRRT; PAM sequence: ATGGAT
ttaaaggaatttaaaacaga

SEQ ID NO: 13771 - DNA, 20 bp, Artificial Sequence
  Description of Artificial Sequence: Synthetic oligonucleotide
  Target: ATXN1; (-) strand; PAM type: NNGRRT; PAM sequence: CAGAAT
acagttaaaggaatttaaaa

SEQ ID NO: 13772 - DNA, 20 bp, Artificial Sequence
  Description of Artificial Sequence: Synthetic oligonucleotide
  Target: ATXN1; (-) strand; PAM type: NNGRRT; PAM sequence: AGGAAT
atgctgcctgtcacagttaa

SEQ ID NO: 13773 - DNA, 20 bp, Artificial Sequence
  Description of Artificial Sequence: Synthetic oligonucleotide
  Target: ATXN1; (-) strand; PAM type: NNGRRT; PAM sequence: CTGAGT
tagtttggcatccatgtttg

SEQ ID NO: 13774 - DNA, 20 bp, Artificial Sequence
  Description of Artificial Sequence: Synthetic oligonucleotide
  Target: ATXN1; (-) strand; PAM type: NNGRRT; PAM sequence: TTGAAT
ttcagtctgatttgggcaca

SEQ ID NO: 13775 - DNA, 20 bp, Artificial Sequence
  Description of Artificial Sequence: Synthetic oligonucleotide
  Target: ATXN1; (-) strand; PAM type: NNGRRT; PAM sequence: TGGGGT
catatggtgtcaaattaatt

SEQ ID NO: 13776 - DNA, 20 bp, Artificial Sequence
  Description of Artificial Sequence: Synthetic oligonucleotide
  Target: ATXN1; (-) strand; PAM type: NNGRRT; PAM sequence: AAGGAT
acatgtttctgtacatggag

SEQ ID NO: 13777 - DNA, 20 bp, Artificial Sequence
  Description of Artificial Sequence: Synthetic oligonucleotide
  Target: ATXN1; (-) strand; PAM type: NNGRRT; PAM sequence: CTGGGT
actagataattaagacttaa

SEQ ID NO: 13778 - DNA, 20 bp, Artificial Sequence
  Description of Artificial Sequence: Synthetic oligonucleotide
  Target: ATXN1; (-) strand; PAM type: NNGRRT; PAM sequence: TTGGAT
agggagaaacagtaagaatc

SEQ ID NO: 13779 - DNA, 20 bp, Artificial Sequence
  Description of Artificial Sequence: Synthetic oligonucleotide
  Target: ATXN1; (-) strand; PAM type: NNGRRT; PAM sequence: AAGAAT
caggaaaagggagaaacagt

SEQ ID NO: 13780 - DNA, 20 bp, Artificial Sequence
  Description of Artificial Sequence: Synthetic oligonucleotide
  Target: ATXN1; (-) strand; PAM type: NNGRRT; PAM sequence: AGGAAT
tctcttttctttaatagtgg

SEQ ID NO: 13781 - DNA, 20 bp, Artificial Sequence
  Description of Artificial Sequence: Synthetic oligonucleotide
  Target: ATXN1; (-) strand; PAM type: NNGRRT; PAM sequence: AGGGGT
aaattacagtgaagaaggaa

SEQ ID NO: 13782 - DNA, 20 bp, Artificial Sequence
  Description of Artificial Sequence: Synthetic oligonucleotide
  Target: ATXN1; (-) strand; PAM type: NNGRRT; PAM sequence: ATGAAT
atcatttcccaataacacag

SEQ ID NO: 13783 - DNA, 20 bp, Artificial Sequence
  Description of Artificial Sequence: Synthetic oligonucleotide
  Target: ATXN1; (-) strand; PAM type: NNGRRT; PAM sequence: CTGAGT
actgttaccgataatacaca

SEQ ID NO: 13784 - DNA, 20 bp, Artificial Sequence
  Description of Artificial Sequence: Synthetic oligonucleotide
  Target: ATXN1; (-) strand; PAM type: NNGRRT; PAM sequence: ATGAAT
ctgtgtggtatggcaacatc

SEQ ID NO: 13785 - DNA, 20 bp, Artificial Sequence
  Description of Artificial Sequence: Synthetic oligonucleotide
  Target: ATXN1; (-) strand; PAM type: NNGRRT; PAM sequence: AAGAAT
actgagatcaagggagaatg

SEQ ID NO: 13786 - DNA, 20 bp, Artificial Sequence
  Description of Artificial Sequence: Synthetic oligonucleotide
  Target: ATXN1; (-) strand; PAM type: NNGRRT; PAM sequence: GAGAAT
atgacaaactgagatcaagg

SEQ ID NO: 13787 - DNA, 20 bp, Artificial Sequence
  Description of Artificial Sequence: Synthetic oligonucleotide
  Target: ATXN1; (-) strand; PAM type: NNGRRT; PAM sequence: TTGAGT
ctccatcagtatttgatttg

SEQ ID NO: 13788 - DNA, 20 bp, Artificial Sequence
  Description of Artificial Sequence: Synthetic oligonucleotide
  Target: ATXN1; (-) strand; PAM type: NNGRRT; PAM sequence: ATGAAT
ggtatttatgtgattatatc

SEQ ID NO: 13789 - DNA, 20 bp, Artificial Sequence
  Description of Artificial Sequence: Synthetic oligonucleotide
  Target: ATXN1; (-) strand; PAM type: NNGRRT; PAM sequence: TGGAGT
tctaggagccacagcttctc

SEQ ID NO: 13790 - DNA, 20 bp, Artificial Sequence
  Description of Artificial Sequence: Synthetic oligonucleotide
  Target: ATXN1; (-) strand; PAM type: NNGRRT; PAM sequence: TCGAAT
tgcaatctcctcagtgtctt

SEQ ID NO: 13791 - DNA, 20 bp, Artificial Sequence
  Description of Artificial Sequence: Synthetic oligonucleotide
  Target: ATXN1; (-) strand; PAM type: NNGRRT; PAM sequence: AAGAAT
ccaccaaacctcatctaccc

SEQ ID NO: 13792 - DNA, 20 bp, Artificial Sequence
  Description of Artificial Sequence: Synthetic oligonucleotide
  Target: ATXN1; (-) strand; PAM type: NNGRRT; PAM sequence: TGGGGT
tacctactctgcacctcctt

SEQ ID NO: 13793 - DNA, 20 bp, Artificial Sequence
  Description of Artificial Sequence: Synthetic oligonucleotide
  Target: ATXN1; (-) strand; PAM type: NNGRRT; PAM sequence: ATGGAT
tccaaactcacagtgccttg

SEQ ID NO: 13794 - DNA, 20 bp, Artificial Sequence
  Description of Artificial Sequence: Synthetic oligonucleotide
  Target: ATXN1; (-) strand; PAM type: NNGRRT; PAM sequence: TGGAGT
ctttctacgcctctaagtgt

SEQ ID NO: 13795 - DNA, 20 bp, Artificial Sequence
  Description of Artificial Sequence: Synthetic oligonucleotide
  Target: ATXN1; (-) strand; PAM type: NNGRRT; PAM sequence: TCGGGT
cttcctgaacaccactgtct

SEQ ID NO: 13796 - DNA, 20 bp, Artificial Sequence
  Description of Artificial Sequence: Synthetic oligonucleotide
  Target: ATXN1; (-) strand; PAM type: NNGRRT; PAM sequence: AGGAGT
accagttgtgtgtttttaat

SEQ ID NO: 13797 - DNA, 20 bp, Artificial Sequence
  Description of Artificial Sequence: Synthetic oligonucleotide
  Target: ATXN1; (-) strand; PAM type: NNGRRT; PAM sequence: CAGAGT
ctgcactccagcctgggtga

SEQ ID NO: 13798 - DNA, 20 bp, Artificial Sequence
  Description of Artificial Sequence: Synthetic oligonucleotide
  Target: ATXN1; (-) strand; PAM type: NNGRRT; PAM sequence: CTGGGT
ttgcaccactgcactccagc

SEQ ID NO: 13799 - DNA, 20 bp, Artificial Sequence
  Description of Artificial Sequence: Synthetic oligonucleotide
  Target: ATXN1; (-) strand; PAM type: NNGRRT; PAM sequence: GAGAAT
cactcaggaggctaaggcag

SEQ ID NO: 13800 - DNA, 20 bp, Artificial Sequence
  Description of Artificial Sequence: Synthetic oligonucleotide
  Target: ATXN1; (-) strand; PAM type: NNGRRT; PAM sequence: TTGAGT
gatcacctgaggtcaggagt

SEQ ID NO: 13801 - DNA, 20 bp, Artificial Sequence
  Description of Artificial Sequence: Synthetic oligonucleotide
  Target: ATXN1; (-) strand; PAM type: NNGRRT; PAM sequence: AGGAGT
caggcagatcacctgaggtc

SEQ ID NO: 13802 - DNA, 20 bp, Artificial Sequence
  Description of Artificial Sequence: Synthetic oligonucleotide
  Target: ATXN1; (-) strand; PAM type: NNGRRT; PAM sequence: ATGAGT
gcatttattcagcaactact

SEQ ID NO: 13803 - DNA, 20 bp, Artificial Sequence
  Description of Artificial Sequence: Synthetic oligonucleotide
  Target: ATXN1; (-) strand; PAM type: NNGRRT; PAM sequence: GAGGGT
atattgatttaatgggttat

SEQ ID NO: 13804 - DNA, 20 bp, Artificial Sequence
  Description of Artificial Sequence: Synthetic oligonucleotide
  Target: ATXN1; (-) strand; PAM type: NNGRRT; PAM sequence: ATGGGT
gctcaataaatattgattta

SEQ ID NO: 13805 - DNA, 20 bp, Artificial Sequence
  Description of Artificial Sequence: Synthetic oligonucleotide
  Target: ATXN1; (-) strand; PAM type: NNGRRT; PAM sequence: ATGGAT
tctagtacagtgcctggcag

SEQ ID NO: 13806 - DNA, 20 bp, Artificial Sequence
  Description of Artificial Sequence: Synthetic oligonucleotide
  Target: ATXN1; (-) strand; PAM type: NNGRRT; PAM sequence: GGGGGT
ataggtaattatttgttgtt

SEQ ID NO: 13807 - DNA, 20 bp, Artificial Sequence
  Description of Artificial Sequence: Synthetic oligonucleotide
  Target: ATXN1; (-) strand; PAM type: NNGRRT; PAM sequence: GAGGAT
tataaatcttttatttccat

SEQ ID NO: 13808 - DNA, 20 bp, Artificial Sequence
  Description of Artificial Sequence: Synthetic oligonucleotide
  Target: ATXN1; (-) strand; PAM type: NNGRRT; PAM sequence: CAGAGT
ccagtgcctctcagctcact

SEQ ID NO: 13809 - DNA, 20 bp, Artificial Sequence
  Description of Artificial Sequence: Synthetic oligonucleotide
  Target: ATXN1; (-) strand; PAM type: NNGRRT; PAM sequence: CAGAAT
gtagtctctctgcttcttct

SEQ ID NO: 13810 - DNA, 20 bp, Artificial Sequence
  Description of Artificial Sequence: Synthetic oligonucleotide
  Target: ATXN1; (-) strand; PAM type: NNGRRT; PAM sequence: CTGAGT
tggagttcatcagtaacctc

SEQ ID NO: 13811 - DNA, 20 bp, Artificial Sequence
  Description of Artificial Sequence: Synthetic oligonucleotide
  Target: ATXN1; (-) strand; PAM type: NNGRRT; PAM sequence: TGGAGT
cggtgccaccatctcttggc

SEQ ID NO: 13812 - DNA, 20 bp, Artificial Sequence
  Description of Artificial Sequence: Synthetic oligonucleotide
  Target: ATXN1; (-) strand; PAM type: NNGRRT; PAM sequence: TGGGAT
tgtctcttaactgccttcag

SEQ ID NO: 13813 - DNA, 20 bp, Artificial Sequence
  Description of Artificial Sequence: Synthetic oligonucleotide
  Target: ATXN1; (-) strand; PAM type: NNGRRT; PAM sequence: CAGAGT
ctaatcacaagtggaacaat

SEQ ID NO: 13814 - DNA, 20 bp, Artificial Sequence
  Description of Artificial Sequence: Synthetic oligonucleotide
  Target: ATXN1; (-) strand; PAM type: NNGRRT; PAM sequence: GGGGGT
cgcatcaagtagccttccac

SEQ ID NO: 13815 - DNA, 20 bp, Artificial Sequence
  Description of Artificial Sequence: Synthetic oligonucleotide
  Target: ATXN1; (-) strand; PAM type: NNGRRT; PAM sequence: GTGGAT
tgtagcttttgggtttgcca

SEQ ID NO: 13816 - DNA, 20 bp, Artificial Sequence
  Description of Artificial Sequence: Synthetic oligonucleotide
  Target: ATXN1; (-) strand; PAM type: NNGRRT; PAM sequence: TTGGGT
catgtagacatgtgtagctt

SEQ ID NO: 13817 - DNA, 20 bp, Artificial Sequence
  Description of Artificial Sequence: Synthetic oligonucleotide
  Target: ATXN1; (-) strand; PAM type: NNGRRT; PAM sequence: AGGAAT
gggagtcttatcagttctgt

SEQ ID NO: 13818 - DNA, 20 bp, Artificial Sequence
  Description of Artificial Sequence: Synthetic oligonucleotide
  Target: ATXN1; (-) strand; PAM type: NNGRRT; PAM sequence: GGGAGT
taatacaacaaaagtatcca

SEQ ID NO: 13819 - DNA, 20 bp, Artificial Sequence
  Description of Artificial Sequence: Synthetic oligonucleotide
  Target: ATXN1; (-) strand; PAM type: NNGRRT; PAM sequence: TTGGAT
caggaagagacacaaggagc

SEQ ID NO: 13820 - DNA, 20 bp, Artificial Sequence
  Description of Artificial Sequence: Synthetic oligonucleotide
  Target: ATXN1; (-) strand; PAM type: NNGRRT; PAM sequence: GGGAAT
tcaaatgggctggaacaaaa

SEQ ID NO: 13821 - DNA, 20 bp, Artificial Sequence
  Description of Artificial Sequence: Synthetic oligonucleotide
  Target: ATXN1; (-) strand; PAM type: NNGRRT; PAM sequence: CAGAAT
acacccatagtagccaaggc

SEQ ID NO: 13822 - DNA, 20 bp, Artificial Sequence
  Description of Artificial Sequence: Synthetic oligonucleotide
  Target: ATXN1; (-) strand; PAM type: NNGRRT; PAM sequence: GAGAAT
ctaggttgtaccttccttat

SEQ ID NO: 13823 - DNA, 20 bp, Artificial Sequence
  Description of Artificial Sequence: Synthetic oligonucleotide
  Target: ATXN1; (-) strand; PAM type: NNGRRT; PAM sequence: AGGGAT
tactgtgaactgcacatgtg

SEQ ID NO: 13824 - DNA, 20 bp, Artificial Sequence
  Description of Artificial Sequence: Synthetic oligonucleotide
  Target: ATXN1; (-) strand; PAM type: NNGRRT; PAM sequence: CTGGGT
ggtctgtggcctgttaggaa

SEQ ID NO: 13825 - DNA, 20 bp, Artificial Sequence
  Description of Artificial Sequence: Synthetic oligonucleotide
  Target: ATXN1; (-) strand; PAM type: NNGRRT; PAM sequence: ATGGGT
cccctgggccatggaccatt

SEQ ID NO: 13826 - DNA, 20 bp, Artificial Sequence
  Description of Artificial Sequence: Synthetic oligonucleotide
  Target: ATXN1; (-) strand; PAM type: NNGRRT; PAM sequence: AGGGGT
ggtgtcaggtcctataacac

SEQ ID NO: 13827 - DNA, 20 bp, Artificial Sequence
  Description of Artificial Sequence: Synthetic oligonucleotide
  Target: ATXN1; (-) strand; PAM type: NNGRRT; PAM sequence: TTGGGT
tgcttttcagatggcagaaa

SEQ ID NO: 13828 - DNA, 20 bp, Artificial Sequence
  Description of Artificial Sequence: Synthetic oligonucleotide
  Target: ATXN1; (-) strand; PAM type: NNGRRT; PAM sequence: CAGAGT
tatttctgctaaaaagtcaa

SEQ ID NO: 13829 - DNA, 20 bp, Artificial Sequence
  Description of Artificial Sequence: Synthetic oligonucleotide
  Target: ATXN1; (-) strand; PAM type: NNGRRT; PAM sequence: TTGGAT
ctattatgtgttgtaatatt

SEQ ID NO: 13830 - DNA, 20 bp, Artificial Sequence
  Description of Artificial Sequence: Synthetic oligonucleotide
  Target: ATXN1; (-) strand; PAM type: NNGRRT; PAM sequence: ATGGAT
atttactgtctacaagggag

SEQ ID NO: 13831 - DNA, 20 bp, Artificial Sequence
  Description of Artificial Sequence: Synthetic oligonucleotide
  Target: ATXN1; (-) strand; PAM type: NNGRRT; PAM sequence: CTGAGT
gttatctgattatacgtgct

SEQ ID NO: 13832 - DNA, 20 bp, Artificial Sequence
  Description of Artificial Sequence: Synthetic oligonucleotide
  Target: ATXN1; (-) strand; PAM type: NNGRRT; PAM sequence: TTGGAT
tttataggtataaatcattc

SEQ ID NO: 13833 - DNA, 20 bp, Artificial Sequence
  Description of Artificial Sequence: Synthetic oligonucleotide
  Target: ATXN1; (-) strand; PAM type: NNGRRT; PAM sequence: CTGGAT
ttattctgagatcctcctgg

SEQ ID NO: 13834 - DNA, 20 bp, Artificial Sequence
  Description of Artificial Sequence: Synthetic oligonucleotide
  Target: ATXN1; (-) strand; PAM type: NNGRRT; PAM sequence: AAGAGT
atttttcattctgttatttt

SEQ ID NO: 13835 - DNA, 20 bp, Artificial Sequence
  Description of Artificial Sequence: Synthetic oligonucleotide
  Target: ATXN1; (-) strand; PAM type: NNGRRT; PAM sequence: TCGAGT
actccttcatttggcattga

SEQ ID NO: 13836 - DNA, 20 bp, Artificial Sequence
  Description of Artificial Sequence: Synthetic oligonucleotide
  Target: ATXN1; (-) strand; PAM type: NNGRRT; PAM sequence: TTGAAT
agagattccagaatagcaac

SEQ ID NO: 13837 - DNA, 20 bp, Artificial Sequence
  Description of Artificial Sequence: Synthetic oligonucleotide
  Target: ATXN1; (-) strand; PAM type: NNGRRT; PAM sequence: CAGAAT
ccatcttacacaagagattc

SEQ ID NO: 13838 - DNA, 20 bp, Artificial Sequence
  Description of Artificial Sequence: Synthetic oligonucleotide
  Target: ATXN1; (-) strand; PAM type: NNGRRT; PAM sequence: TGGAGT
cagtaatgaaagggtaactt

SEQ ID NO: 13839 - DNA, 20 bp, Artificial Sequence
  Description of Artificial Sequence: Synthetic oligonucleotide
  Target: ATXN1; (-) strand; PAM type: NNGRRT; PAM sequence: AAGGGT
tctgagaaattcagtaatga

SEQ ID NO: 13840 - DNA, 20 bp, Artificial Sequence
  Description of Artificial Sequence: Synthetic oligonucleotide
  Target: ATXN1; (-) strand; PAM type: NNGRRT; PAM sequence: GAGAAT
agtttaaatttagatccact

SEQ ID NO: 13841 - DNA, 20 bp, Artificial Sequence
  Description of Artificial Sequence: Synthetic oligonucleotide
  Target: ATXN1; (-) strand; PAM type: NNGRRT; PAM sequence: CAGGAT
gcccttcataacatggaaca

SEQ ID NO: 13842 - DNA, 20 bp, Artificial Sequence
  Description of Artificial Sequence: Synthetic oligonucleotide
  Target: ATXN1; (-) strand; PAM type: NNGRRT; PAM sequence: CTGAGT
ctgaggctgaaaaaaaaccc

SEQ ID NO: 13843 - DNA, 20 bp, Artificial Sequence
  Description of Artificial Sequence: Synthetic oligonucleotide
  Target: ATXN1; (-) strand; PAM type: NNGRRT; PAM sequence: CTGAGT
cttggttaggacgctggacg

SEQ ID NO: 13844 - DNA, 20 bp, Artificial Sequence
  Description of Artificial Sequence: Synthetic oligonucleotide
  Target: ATXN1; (-) strand; PAM type: NNGRRT; PAM sequence: CTGGAT
ttctgctaaatactatgcct

SEQ ID NO: 13845 - DNA, 20 bp, Artificial Sequence
  Description of Artificial Sequence: Synthetic oligonucleotide
  Target: ATXN1; (-) strand; PAM type: NNGRRT; PAM sequence: TGGGAT
cttcagcctcccaaaagtgc

SEQ ID NO: 13846 - DNA, 20 bp, Artificial Sequence
  Description of Artificial Sequence: Synthetic oligonucleotide
  Target: ATXN1; (-) strand; PAM type: NNGRRT; PAM sequence: TGGGGT
ttttgtatttttggtaaaga

SEQ ID NO: 13847 - DNA, 20 bp, Artificial Sequence
  Description of Artificial Sequence: Synthetic oligonucleotide
  Target: ATXN1; (-) strand; PAM type: NNGRRT; PAM sequence: TGGGAT
gcctcagcctcccgagtagc

SEQ ID NO: 13848 - DNA, 20 bp, Artificial Sequence
  Description of Artificial Sequence: Synthetic oligonucleotide
  Target: ATXN1; (-) strand; PAM type: NNGRRT; PAM sequence: CCGAGT
gattctcctgcctcagcctc

SEQ ID NO: 13849 - DNA, 20 bp, Artificial Sequence
  Description of Artificial Sequence: Synthetic oligonucleotide
  Target: ATXN1; (-) strand; PAM type: NNGRRT; PAM sequence: CCGGGT
ctcactgcaacctccgcctc

SEQ ID NO: 13850 - DNA, 20 bp, Artificial Sequence
  Description of Artificial Sequence: Synthetic oligonucleotide
  Target: ATXN1; (-) strand; PAM type: NNGRRT; PAM sequence: TGGAGT
cttgctcttgtcccccaggc

SEQ ID NO: 13851 - DNA, 20 bp, Artificial Sequence
  Description of Artificial Sequence: Synthetic oligonucleotide
  Target: ATXN1; (-) strand; PAM type: NNGRRT; PAM sequence: TGGGAT
atttagacctcccaaagtgc

SEQ ID NO: 13852 - DNA, 20 bp, Artificial Sequence
  Description of Artificial Sequence: Synthetic oligonucleotide
  Target: ATXN1; (-) strand; PAM type: NNGRRT; PAM sequence: CTGGGT
gttgcccaggctggagactc

SEQ ID NO: 13853 - DNA, 20 bp, Artificial Sequence
  Description of Artificial Sequence: Synthetic oligonucleotide
  Target: ATXN1; (-) strand; PAM type: NNGRRT; PAM sequence: TGGGGT
ttttgtatttttggtagaga

SEQ ID NO: 13854 - DNA, 20 bp, Artificial Sequence
  Description of Artificial Sequence: Synthetic oligonucleotide
  Target: ATXN1; (-) strand; PAM type: NNGRRT; PAM sequence: AAGAAT
tgggggcatgtctctgtggt

SEQ ID NO: 13855 - DNA, 20 bp, Artificial Sequence
  Description of Artificial Sequence: Synthetic oligonucleotide
  Target: ATXN1; (-) strand; PAM type: NNGRRT; PAM sequence: TGGGAT
tcatttctgaatgtttttat

SEQ ID NO: 13856 - DNA, 20 bp, Artificial Sequence
  Description of Artificial Sequence: Synthetic oligonucleotide
  Target: ATXN1; (-) strand; PAM type: NNGRRT; PAM sequence: CTGAAT
tttctccaatcacttcattt

SEQ ID NO: 13857 - DNA, 20 bp, Artificial Sequence
  Description of Artificial Sequence: Synthetic oligonucleotide
  Target: ATXN1; (-) strand; PAM type: NNGRRT; PAM sequence: CTGGGT
ctcactgcaacctctggctc

SEQ ID NO: 13858 - DNA, 20 bp, Artificial Sequence
  Description of Artificial Sequence: Synthetic oligonucleotide
  Target: ATXN1; (-) strand; PAM type: NNGRRT; PAM sequence: TGGAGT
tctcactctgtttcccaggt

SEQ ID NO: 13859 - DNA, 20 bp, Artificial Sequence
  Description of Artificial Sequence: Synthetic oligonucleotide
  Target: ATXN1; (-) strand; PAM type: NNGRRT; PAM sequence: CAGGGT
tttcttttttttttttaaga

SEQ ID NO: 13860 - DNA, 20 bp, Artificial Sequence
  Description of Artificial Sequence: Synthetic oligonucleotide
  Target: ATXN1; (-) strand; PAM type: NNGRRT; PAM sequence: CTGAAT
cactggtgccatcatcttcc

SEQ ID NO: 13861 - DNA, 20 bp, Artificial Sequence
  Description of Artificial Sequence: Synthetic oligonucleotide
  Target: ATXN1; (-) strand; PAM type: NNGRRT; PAM sequence: AGGGAT
ctggcagggaggaggagggc

SEQ ID NO: 13862 - DNA, 20 bp, Artificial Sequence
  Description of Artificial Sequence: Synthetic oligonucleotide
  Target: ATXN1; (-) strand; PAM type: NNGRRT; PAM sequence: ATGGGT
attttgtcttgatgtggtcc

SEQ ID NO: 13863 - DNA, 20 bp, Artificial Sequence
  Description of Artificial Sequence: Synthetic oligonucleotide
  Target: ATXN1; (-) strand; PAM type: NNGRRT; PAM sequence: TTGGAT
ccttgccctcaccccatgaa

SEQ ID NO: 13864 - DNA, 20 bp, Artificial Sequence
  Description of Artificial Sequence: Synthetic oligonucleotide
  Target: ATXN1; (-) strand; PAM type: NNGRRT; PAM sequence: ATGAAT
gggttccttgccctcacccc

SEQ ID NO: 13865 - DNA, 20 bp, Artificial Sequence
  Description of Artificial Sequence: Synthetic oligonucleotide
  Target: ATXN1; (-) strand; PAM type: NNGRRT; PAM sequence: CAGGGT
ctaagcacctcagaccttcc

SEQ ID NO: 13866 - DNA, 20 bp, Artificial Sequence
  Description of Artificial Sequence: Synthetic oligonucleotide
  Target: ATXN1; (-) strand; PAM type: NNGRRT; PAM sequence: AAGAGT
agcttagatttgttggtctc

SEQ ID NO: 13867 - DNA, 20 bp, Artificial Sequence
  Description of Artificial Sequence: Synthetic oligonucleotide
  Target: ATXN1; (-) strand; PAM type: NNGRRT; PAM sequence: TTGGAT
tcttctctgcctcccttcac

SEQ ID NO: 13868 - DNA, 20 bp, Artificial Sequence
  Description of Artificial Sequence: Synthetic oligonucleotide
  Target: ATXN1; (-) strand; PAM type: NNGRRT; PAM sequence: TGGAAT
tccgtcttctgttgtttcca

SEQ ID NO: 13869 - DNA, 20 bp, Artificial Sequence
  Description of Artificial Sequence: Synthetic oligonucleotide
  Target: ATXN1; (-) strand; PAM type: NNGRRT; PAM sequence: AGGGAT
ttcttgtatttttagggata

SEQ ID NO: 13870 - DNA, 20 bp, Artificial Sequence
  Description of Artificial Sequence: Synthetic oligonucleotide
  Target: ATXN1; (-) strand; PAM type: NNGRRT; PAM sequence: AGGGAT
atgagttttcttgtattttt

SEQ ID NO: 13871 - DNA, 20 bp, Artificial Sequence
  Description of Artificial Sequence: Synthetic oligonucleotide
  Target: ATXN1; (-) strand; PAM type: NNGRRT; PAM sequence: ATGAGT
gttactcatttttaagtgga

SEQ ID NO: 13872 - DNA, 20 bp, Artificial Sequence
  Description of Artificial Sequence: Synthetic oligonucleotide
  Target: ATXN1; (-) strand; PAM type: NNGRRT; PAM sequence: TGGAAT
ttttgttactcatttttaag

SEQ ID NO: 13873 - DNA, 20 bp, Artificial Sequence
  Description of Artificial Sequence: Synthetic oligonucleotide
  Target: ATXN1; (-) strand; PAM type: NNGRRT; PAM sequence: AAGAAT
tgggggcatgtctctgtggt

SEQ ID NO: 13874 - DNA, 20 bp, Artificial Sequence
  Description of Artificial Sequence: Synthetic oligonucleotide
  Target: ATXN1; (-) strand; PAM type: NNGRRT; PAM sequence: TGGGAT
tcatttctgaatgtttttat

SEQ ID NO: 13875 - DNA, 20 bp, Artificial Sequence
  Description of Artificial Sequence: Synthetic oligonucleotide
  Target: ATXN1; (-) strand; PAM type: NNGRRT; PAM sequence: CTGAAT
tttctccaatcacttcattt

SEQ ID NO: 13876 - DNA, 20 bp, Artificial Sequence
  Description of Artificial Sequence: Synthetic oligonucleotide
  Target: ATXN1; (-) strand; PAM type: NNGRRT; PAM sequence: ATGGAT
atttggtcttcatctagaaa

SEQ ID NO: 13877 - DNA, 20 bp, Artificial Sequence
  Description of Artificial Sequence: Synthetic oligonucleotide
  Target: ATXN1; (-) strand; PAM type: NNGRRT; PAM sequence: TTGAAT
tccttttctgagtctttctc

SEQ ID NO: 13878 - DNA, 20 bp, Artificial Sequence
  Description of Artificial Sequence: Synthetic oligonucleotide
  Target: ATXN1; (-) strand; PAM type: NNGRRT; PAM sequence: CTGAGT
tctttgctcatgttcctttt

SEQ ID NO: 13879 - DNA, 20 bp, Artificial Sequence
  Description of Artificial Sequence: Synthetic oligonucleotide
  Target: ATXN1; (-) strand; PAM type: NNGRRT; PAM sequence: TTGGGT
gctcttattacagtgttatg

SEQ ID NO: 13880 - DNA, 20 bp, Artificial Sequence
  Description of Artificial Sequence: Synthetic oligonucleotide
  Target: ATXN1; (-) strand; PAM type: NNGRRT; PAM sequence: TAGAAT
ttcaaatctttttctacttc

SEQ ID NO: 13881 - DNA, 20 bp, Artificial Sequence
  Description of Artificial Sequence: Synthetic oligonucleotide
  Target: ATXN1; (-) strand; PAM type: NNGRRT; PAM sequence: TGGAGT
ggtcagtttttccaggtgca

SEQ ID NO: 13882 - DNA, 20 bp, Artificial Sequence
  Description of Artificial Sequence: Synthetic oligonucleotide
  Target: ATXN1; (-) strand; PAM type: NNGRRT; PAM sequence: AAGAAT
tcattttacctgagtgtcca

SEQ ID NO: 13883 - DNA, 20 bp, Artificial Sequence
  Description of Artificial Sequence: Synthetic oligonucleotide
  Target: ATXN1; (-) strand; PAM type: NNGRRT; PAM sequence: CTGAGT
aggtaactcagtcattttac

SEQ ID NO: 13884 - DNA, 20 bp, Artificial Sequence
  Description of Artificial Sequence: Synthetic oligonucleotide
  Target: ATXN1; (-) strand; PAM type: NNGRRT; PAM sequence: TCGGGT
gaagcctggctcttgaaaaa

SEQ ID NO: 13885 - DNA, 20 bp, Artificial Sequence
  Description of Artificial Sequence: Synthetic oligonucleotide
  Target: ATXN1; (-) strand; PAM type: NNGRRT; PAM sequence: CTGAGT
ccttggcttagttgtctttc

SEQ ID NO: 13886 - DNA, 20 bp, Artificial Sequence
  Description of Artificial Sequence: Synthetic oligonucleotide
  Target: ATXN1; (-) strand; PAM type: NNGRRT; PAM sequence: CTGGGT
tggctggaagatcattttgg

SEQ ID NO: 13887 - DNA, 20 bp, Artificial Sequence
  Description of Artificial Sequence: Synthetic oligonucleotide
  Target: ATXN1; (-) strand; PAM type: NNGRRT; PAM sequence: TTGGGT
gtttctgcgaacaatattcc

SEQ ID NO: 13888 - DNA, 20 bp, Artificial Sequence
  Description of Artificial Sequence: Synthetic oligonucleotide
  Target: ATXN1; (-) strand; PAM type: NNGRRT; PAM sequence: AAGGGT
cttctcccttgcagattact

SEQ ID NO: 13889 - DNA, 20 bp, Artificial Sequence
  Description of Artificial Sequence: Synthetic oligonucleotide
  Target: ATXN1; (-) strand; PAM type: NNGRRT; PAM sequence: CTGAGT
ttgtttattggtttccaact

SEQ ID NO: 13890 - DNA, 20 bp, Artificial Sequence
  Description of Artificial Sequence: Synthetic oligonucleotide
  Target: ATXN1; (-) strand; PAM type: NNGRRT; PAM sequence: TAGAAT
agccttccagtaaaaatgtt

SEQ ID NO: 13891 - DNA, 20 bp, Artificial Sequence
  Description of Artificial Sequence: Synthetic oligonucleotide
  Target: ATXN1; (-) strand; PAM type: NNGRRT; PAM sequence: TGGGAT
gccttggcctcccaaagtgt

SEQ ID NO: 13892 - DNA, 20 bp, Artificial Sequence
  Description of Artificial Sequence: Synthetic oligonucleotide
  Target: ATXN1; (-) strand; PAM type: NNGRRT; PAM sequence: CGGGGT
ttttggatttttggtagaga

SEQ ID NO: 13893 - DNA, 20 bp, Artificial Sequence
  Description of Artificial Sequence: Synthetic oligonucleotide
  Target: ATXN1; (-) strand; PAM type: NNGRRT; PAM sequence: TTGGAT
ccaccacgaccaggtaattt

SEQ ID NO: 13894 - DNA, 20 bp, Artificial Sequence
  Description of Artificial Sequence: Synthetic oligonucleotide
  Target: ATXN1; (-) strand; PAM type: NNGRRT; PAM sequence: TGGGAT
gcctcagcctcctgagtaga

SEQ ID NO: 13895 - DNA, 20 bp, Artificial Sequence
  Description of Artificial Sequence: Synthetic oligonucleotide
  Target: ATXN1; (-) strand; PAM type: NNGRRT; PAM sequence: CTGAGT
aattctcgtgcctcagcctc

SEQ ID NO: 13896 - DNA, 20 bp, Artificial Sequence
  Description of Artificial Sequence: Synthetic oligonucleotide
  Target: ATXN1; (-) strand; PAM type: NNGRRT; PAM sequence: CTGGGT
ctcactgcagcctcaccctc

SEQ ID NO: 13897 - DNA, 20 bp, Artificial Sequence
  Description of Artificial Sequence: Synthetic oligonucleotide
  Target: ATXN1; (-) strand; PAM type: NNGRRT; PAM sequence: TGGAGT
tctcactttgtcacccaggc

SEQ ID NO: 13898 - DNA, 20 bp, Artificial Sequence
  Description of Artificial Sequence: Synthetic oligonucleotide
  Target: ATXN1; (-) strand; PAM type: NNGRRT; PAM sequence: CAGGGT
tttatttatttatttagaga

SEQ ID NO: 13899 - DNA, 20 bp, Artificial Sequence
  Description of Artificial Sequence: Synthetic oligonucleotide
  Target: ATXN1; (-) strand; PAM type: NNGRRT; PAM sequence: TTGAGT
gccaataactggatatacat

SEQ ID NO: 13900 - DNA, 20 bp, Artificial Sequence
  Description of Artificial Sequence: Synthetic oligonucleotide
  Target: ATXN1; (-) strand; PAM type: NNGRRT; PAM sequence: CTGGAT
ctgtgtgtttatgccaataa

SEQ ID NO: 13901 - DNA, 20 bp, Artificial Sequence
  Description of Artificial Sequence: Synthetic oligonucleotide
  Target: ATXN1; (-) strand; PAM type: NNGRRT; PAM sequence: TGGAAT
tacaatatgttagggtcatt

SEQ ID NO: 13902 - DNA, 20 bp, Artificial Sequence
  Description of Artificial Sequence: Synthetic oligonucleotide
  Target: ATXN1; (-) strand; PAM type: NNGRRT; PAM sequence: TAGGGT
acaattacattacaatatgt

SEQ ID NO: 13903 - DNA, 20 bp, Artificial Sequence
  Description of Artificial Sequence: Synthetic oligonucleotide
  Target: ATXN1; (-) strand; PAM type: NNGRRT; PAM sequence: ATGAGT
tttttaaggtaaaatacctc

SEQ ID NO: 13904 - DNA, 20 bp, Artificial Sequence
  Description of Artificial Sequence: Synthetic oligonucleotide
  Target: ATXN1; (-) strand; PAM type: NNGRRT; PAM sequence: TGGGAT
tccttggcctcccaaagtgc

SEQ ID NO: 13905 - DNA, 20 bp, Artificial Sequence
  Description of Artificial Sequence: Synthetic oligonucleotide
  Target: ATXN1; (-) strand; PAM type: NNGRRT; PAM sequence: CAGGAT
cggggtttcactgtgttagc

SEQ ID NO: 13906 - DNA, 20 bp, Artificial Sequence
  Description of Artificial Sequence: Synthetic oligonucleotide
  Target: ATXN1; (-) strand; PAM type: NNGRRT; PAM sequence: CGGGGT
ttttctgtttttagtagaga

SEQ ID NO: 13907 - DNA, 20 bp, Artificial Sequence
  Description of Artificial Sequence: Synthetic oligonucleotide
  Target: ATXN1; (-) strand; PAM type: NNGRRT; PAM sequence: CCGAGT
cattctcctgcctcagcctc

SEQ ID NO: 13908 - DNA, 20 bp, Artificial Sequence
  Description of Artificial Sequence: Synthetic oligonucleotide
  Target: ATXN1; (-) strand; PAM type: NNGRRT; PAM sequence: TGGAAT
cctcgctctgtcgcccaggc

SEQ ID NO: 13909 - DNA, 20 bp, Artificial Sequence
  Description of Artificial Sequence: Synthetic oligonucleotide
  Target: ATXN1; (-) strand; PAM type: NNGRRT; PAM sequence: TTGAAT
ggggaactgttctcactggg

SEQ ID NO: 13910 - DNA, 20 bp, Artificial Sequence
  Description of Artificial Sequence: Synthetic oligonucleotide
  Target: ATXN1; (-) strand; PAM type: NNGRRT; PAM sequence: CTGGGT
ccccaggggaactgttctca

SEQ ID NO: 13911 - DNA, 20 bp, Artificial Sequence
  Description of Artificial Sequence: Synthetic oligonucleotide
  Target: ATXN1; (-) strand; PAM type: NNGRRT; PAM sequence: TGGGAT
tacatttcttgccttagctc

SEQ ID NO: 13912 - DNA, 20 bp, Artificial Sequence
  Description of Artificial Sequence: Synthetic oligonucleotide
  Target: ATXN1; (-) strand; PAM type: NNGRRT; PAM sequence: CTGAGT
gatcctattcagtttggcta

SEQ ID NO: 13913 - DNA, 20 bp, Artificial Sequence
  Description of Artificial Sequence: Synthetic oligonucleotide
  Target: ATXN1; (-) strand; PAM type: NNGRRT; PAM sequence: TGGGAT
atggtcccctgtctgagcat

SEQ ID NO: 13914 - DNA, 20 bp, Artificial Sequence
  Description of Artificial Sequence: Synthetic oligonucleotide
  Target: ATXN1; (-) strand; PAM type: NNGRRT; PAM sequence: CAGGAT
ttcaggttttgtaggaaaag

SEQ ID NO: 13915 - DNA, 20 bp, Artificial Sequence
  Description of Artificial Sequence: Synthetic oligonucleotide
  Target: ATXN1; (-) strand; PAM type: NNGRRT; PAM sequence: AGGAAT
ttatttgttcatttgttagc

SEQ ID NO: 13916 - DNA, 20 bp, Artificial Sequence
  Description of Artificial Sequence: Synthetic oligonucleotide
  Target: ATXN1; (-) strand; PAM type: NNGRRT; PAM sequence: AGGGAT
tctgaattcataaatttatc

SEQ ID NO: 13917 - DNA, 20 bp, Artificial Sequence
  Description of Artificial Sequence: Synthetic oligonucleotide
  Target: ATXN1; (-) strand; PAM type: NNGRRT; PAM sequence: CTGAAT
ttttgcagtgagactgtcat

SEQ ID NO: 13918 - DNA, 20 bp, Artificial Sequence
  Description of Artificial Sequence: Synthetic oligonucleotide
  Target: ATXN1; (-) strand; PAM type: NNGRRT; PAM sequence: GGGAAT
ctctgtctcctgaatttctt

SEQ ID NO: 13919 - DNA, 20 bp, Artificial Sequence
  Description of Artificial Sequence: Synthetic oligonucleotide
  Target: ATXN1; (-) strand; PAM type: NNGRRT; PAM sequence: CTGAAT
taagcatgtccctctgtctc

SEQ ID NO: 13920 - DNA, 20 bp, Artificial Sequence
  Description of Artificial Sequence: Synthetic oligonucleotide
  Target: ATXN1; (-) strand; PAM type: NNGRRT; PAM sequence: TTGGAT
aatttcccacccgtctgggt

SEQ ID NO: 13921 - DNA, 20 bp, Artificial Sequence
  Description of Artificial Sequence: Synthetic oligonucleotide
  Target: ATXN1; (-) strand; PAM type: NNGRRT; PAM sequence: CTGGGT
tggtagaatttcccacccgt

SEQ ID NO: 13922 - DNA, 20 bp, Artificial Sequence
  Description of Artificial Sequence: Synthetic oligonucleotide
  Target: ATXN1; (-) strand; PAM type: NNGRRT; PAM sequence: TAGAAT
aaaccagaccatttgtctgg

SEQ ID NO: 13923 - DNA, 20 bp, Artificial Sequence
  Description of Artificial Sequence: Synthetic oligonucleotide
  Target: ATXN1; (-) strand; PAM type: NNGRRT; PAM sequence: TAGGAT
ataagttttattttatgttg

SEQ ID NO: 13924 - DNA, 20 bp, Artificial Sequence
  Description of Artificial Sequence: Synthetic oligonucleotide
  Target: ATXN1; (-) strand; PAM type: NNGRRT; PAM sequence: TAGGAT
ttactatttctataaatgat

SEQ ID NO: 13925 - DNA, 20 bp, Artificial Sequence
  Description of Artificial Sequence: Synthetic oligonucleotide
  Target: ATXN1; (-) strand; PAM type: NNGRRT; PAM sequence: CTGGAT
tctctactccacctctgcac

SEQ ID NO: 13926 - DNA, 20 bp, Artificial Sequence
  Description of Artificial Sequence: Synthetic oligonucleotide
  Target: ATXN1; (-) strand; PAM type: NNGRRT; PAM sequence: ATGGGT
taatgctagatgacgaggta

SEQ ID NO: 13927 - DNA, 20 bp, Artificial Sequence
  Description of Artificial Sequence: Synthetic oligonucleotide
  Target: ATXN1; (-) strand; PAM type: NNGRRT; PAM sequence: AGGGAT
gtggggtggggggagggggg

SEQ ID NO: 13928 - DNA, 20 bp, Artificial Sequence
  Description of Artificial Sequence: Synthetic oligonucleotide
  Target: ATXN1; (-) strand; PAM type: NNGRRT; PAM sequence: TGGGGT
tcacactctggggactgttg

SEQ ID NO: 13929 - DNA, 20 bp, Artificial Sequence
  Description of Artificial Sequence: Synthetic oligonucleotide
  Target: ATXN1; (-) strand; PAM type: NNGRRT; PAM sequence: GGGAAT
gcatgttctcactcatagat

SEQ ID NO: 13930 - DNA, 20 bp, Artificial Sequence
  Description of Artificial Sequence: Synthetic oligonucleotide
  Target: ATXN1; (-) strand; PAM type: NNGRRT; PAM sequence: ATGGAT
ttcacgtcctttgtagggac

SEQ ID NO: 13931 - DNA, 20 bp, Artificial Sequence
  Description of Artificial Sequence: Synthetic oligonucleotide
  Target: ATXN1; (-) strand; PAM type: NNGRRT; PAM sequence: ATGAGT
ctatgcagccataaaaaatg

SEQ ID NO: 13932 - DNA, 20 bp, Artificial Sequence
  Description of Artificial Sequence: Synthetic oligonucleotide
  Target: ATXN1; (-) strand; PAM type: NNGRRT; PAM sequence: TGGAAT
aatgtggcacatatacacca

SEQ ID NO: 13933 - DNA, 20 bp, Artificial Sequence
  Description of Artificial Sequence: Synthetic oligonucleotide
  Target: ATXN1; (-) strand; PAM type: NNGRRT; PAM sequence: CTGGAT
aaatgtccaacaatgataga

SEQ ID NO: 13934 - DNA, 20 bp, Artificial Sequence
  Description of Artificial Sequence: Synthetic oligonucleotide
  Target: ATXN1; (-) strand; PAM type: NNGRRT; PAM sequence: CTGGGT
ttgacccagccatcccatta

SEQ ID NO: 13935 - DNA, 20 bp, Artificial Sequence
  Description of Artificial Sequence: Synthetic oligonucleotide
  Target: ATXN1; (-) strand; PAM type: NNGRRT; PAM sequence: AGGGAT
agtcagtgtggcgattcctc

SEQ ID NO: 13936 - DNA, 20 bp, Artificial Sequence
  Description of Artificial Sequence: Synthetic oligonucleotide
  Target: ATXN1; (-) strand; PAM type: NNGRRT; PAM sequence: GAGGAT
aggaaacaacaggtgctgga

SEQ ID NO: 13937 - DNA, 20 bp, Artificial Sequence
  Description of Artificial Sequence: Synthetic oligonucleotide
  Target: ATXN1; (-) strand; PAM type: NNGRRT; PAM sequence: TAGAAT
agataccatctcacaccagt

SEQ ID NO: 13938 - DNA, 20 bp, Artificial Sequence
  Description of Artificial Sequence: Synthetic oligonucleotide
  Target: ATXN1; (-) strand; PAM type: NNGRRT; PAM sequence: GTGAAT
agtaagctgatgtcaggaat

SEQ ID NO: 13939 - DNA, 20 bp, Artificial Sequence
  Description of Artificial Sequence: Synthetic oligonucleotide
  Target: ATXN1; (-) strand; PAM type: NNGRRT; PAM sequence: AGGAAT
gccccgagtaagctgatgtc

SEQ ID NO: 13940 - DNA, 20 bp, Artificial Sequence
  Description of Artificial Sequence: Synthetic oligonucleotide
  Target: ATXN1; (-) strand; PAM type: NNGRRT; PAM sequence: CCGAGT
tttcaattttgagaagtgcc

SEQ ID NO: 13941 - DNA, 20 bp, Artificial Sequence
  Description of Artificial Sequence: Synthetic oligonucleotide
  Target: ATXN1; (-) strand; PAM type: NNGRRT; PAM sequence: TGGGGT
ggaattctgattcacaaatc

SEQ ID NO: 13942 - DNA, 20 bp, Artificial Sequence
  Description of Artificial Sequence: Synthetic oligonucleotide
  Target: ATXN1; (-) strand; PAM type: NNGRRT; PAM sequence: AGGAAT
gttttctgggcttcactccc

SEQ ID NO: 13943 - DNA, 20 bp, Artificial Sequence
  Description of Artificial Sequence: Synthetic oligonucleotide
  Target: ATXN1; (-) strand; PAM type: NNGRRT; PAM sequence: TGGAGT
tgcaaatgactaaagcaaaa

SEQ ID NO: 13944 - DNA, 20 bp, Artificial Sequence
  Description of Artificial Sequence: Synthetic oligonucleotide
  Target: ATXN1; (-) strand; PAM type: NNGRRT; PAM sequence: AAGAAT
aaatgaaacaacaacatgtg

SEQ ID NO: 13945 - DNA, 20 bp, Artificial Sequence
  Description of Artificial Sequence: Synthetic oligonucleotide
  Target: ATXN1; (-) strand; PAM type: NNGRRT; PAM sequence: CAGGAT
ttgttgatagatgacaccaa

SEQ ID NO: 13946 - DNA, 20 bp, Artificial Sequence
  Description of Artificial Sequence: Synthetic oligonucleotide
  Target: ATXN1; (-) strand; PAM type: NNGRRT; PAM sequence: GAGAGT
cacacgctcagcaaactgta

SEQ ID NO: 13947 - DNA, 20 bp, Artificial Sequence
  Description of Artificial Sequence: Synthetic oligonucleotide
  Target: ATXN1; (-) strand; PAM type: NNGRRT; PAM sequence: CTGAGT
aatatatgctaatgctatag

SEQ ID NO: 13948 - DNA, 20 bp, Artificial Sequence
  Description of Artificial Sequence: Synthetic oligonucleotide
  Target: ATXN1; (-) strand; PAM type: NNGRRT; PAM sequence: GGGAAT
taggaatagttgtataatct

SEQ ID NO: 13949 - DNA, 20 bp, Artificial Sequence
  Description of Artificial Sequence: Synthetic oligonucleotide
  Target: ATXN1; (-) strand; PAM type: NNGRRT; PAM sequence: AGGAAT
aaaatagtgcttgtgagtct

SEQ ID NO: 13950 - DNA, 20 bp, Artificial Sequence
  Description of Artificial Sequence: Synthetic oligonucleotide
  Target: ATXN1; (-) strand; PAM type: NNGRRT; PAM sequence: GTGAGT
ctttttggaaaatagtgctt

SEQ ID NO: 13951 - DNA, 20 bp, Artificial Sequence
  Description of Artificial Sequence: Synthetic oligonucleotide
  Target: ATXN1; (-) strand; PAM type: NNGRRT; PAM sequence: AAGGAT
agaattatgttctgtgtgtt

SEQ ID NO: 13952 - DNA, 20 bp, Artificial Sequence
  Description of Artificial Sequence: Synthetic oligonucleotide
  Target: ATXN1; (-) strand; PAM type: NNGRRT; PAM sequence: AAGAAT
tgataagcactatcattaga

SEQ ID NO: 13953 - DNA, 20 bp, Artificial Sequence
  Description of Artificial Sequence: Synthetic oligonucleotide
  Target: ATXN1; (-) strand; PAM type: NNGRRT; PAM sequence: CTGAGT
atatttactttccagggaaa

SEQ ID NO: 13954 - DNA, 20 bp, Artificial Sequence
  Description of Artificial Sequence: Synthetic oligonucleotide
  Target: ATXN1; (-) strand; PAM type: NNGRRT; PAM sequence: GTGGGT
tcatgccactgcactctaac

SEQ ID NO: 13955 - DNA, 20 bp, Artificial Sequence
  Description of Artificial Sequence: Synthetic oligonucleotide
  Target: ATXN1; (-) strand; PAM type: NNGRRT; PAM sequence: GAGAAT
tactcaggaggctgaggcag

SEQ ID NO: 13956 - DNA, 20 bp, Artificial Sequence
  Description of Artificial Sequence: Synthetic oligonucleotide
  Target: ATXN1; (-) strand; PAM type: NNGRRT; PAM sequence: GTGGGT
aaaatacaaaaattagctgg

SEQ ID NO: 13957 - DNA, 20 bp, Artificial Sequence
  Description of Artificial Sequence: Synthetic oligonucleotide
  Target: ATXN1; (-) strand; PAM type: NNGRRT; PAM sequence: CTGGGT
actaaaaatacaaaaattag

SEQ ID NO: 13958 - DNA, 20 bp, Artificial Sequence
  Description of Artificial Sequence: Synthetic oligonucleotide
  Target: ATXN1; (-) strand; PAM type: NNGRRT; PAM sequence: AGGAGT
caggtggatcacttgaggcc

SEQ ID NO: 13959 - DNA, 20 bp, Artificial Sequence
  Description of Artificial Sequence: Synthetic oligonucleotide
  Target: ATXN1; (-) strand; PAM type: NNGRRT; PAM sequence: GTGGAT
actttgggaggctgaggcag

SEQ ID NO: 13960 - DNA, 20 bp, Artificial Sequence
  Description of Artificial Sequence: Synthetic oligonucleotide
  Target: ATXN1; (-) strand; PAM type: NNGRRT; PAM sequence: CAGGGT
tgataaaaaataaaaatagg

SEQ ID NO: 13961 - DNA, 20 bp, Artificial Sequence
  Description of Artificial Sequence: Synthetic oligonucleotide
  Target: ATXN1; (-) strand; PAM type: NNGRRT; PAM sequence: GAGGAT
actttgggaggccgaggtgg

SEQ ID NO: 13962 - DNA, 20 bp, Artificial Sequence
  Description of Artificial Sequence: Synthetic oligonucleotide
  Target: ATXN1; (-) strand; PAM type: NNGRRT; PAM sequence: AAGAGT
aaatcctatataaagcttct

SEQ ID NO: 13963 - DNA, 20 bp, Artificial Sequence
  Description of Artificial Sequence: Synthetic oligonucleotide
  Target: ATXN1; (-) strand; PAM type: NNGRRT; PAM sequence: TAGAAT
gatgctctgaagcccgttgg

SEQ ID NO: 13964 - DNA, 20 bp, Artificial Sequence
  Description of Artificial Sequence: Synthetic oligonucleotide
  Target: ATXN1; (-) strand; PAM type: NNGRRT; PAM sequence: CTGAAT
ggaactttagaccctagccc

SEQ ID NO: 13965 - DNA, 20 bp, Artificial Sequence
  Description of Artificial Sequence: Synthetic oligonucleotide
  Target: ATXN1; (-) strand; PAM type: NNGRRT; PAM sequence: TTGGGT
ttgaacccacacactctgca

SEQ ID NO: 13966 - DNA, 20 bp, Artificial Sequence
  Description of Artificial Sequence: Synthetic oligonucleotide
  Target: ATXN1; (-) strand; PAM type: NNGRRT; PAM sequence: AAGGAT
gatttgcaccttacaatttc

SEQ ID NO: 13967 - DNA, 20 bp, Artificial Sequence
  Description of Artificial Sequence: Synthetic oligonucleotide
  Target: ATXN1; (-) strand; PAM type: NNGRRT; PAM sequence: TAGGAT
aggtttgagtggaatggtat

SEQ ID NO: 13968 - DNA, 20 bp, Artificial Sequence
  Description of Artificial Sequence: Synthetic oligonucleotide
  Target: ATXN1; (-) strand; PAM type: NNGRRT; PAM sequence: TGGAAT
gaagcattgaaaggtttgag

SEQ ID NO: 13969 - DNA, 20 bp, Artificial Sequence
  Description of Artificial Sequence: Synthetic oligonucleotide
  Target: ATXN1; (-) strand; PAM type: NNGRRT; PAM sequence: TTGAGT
aataggaagcattgaaaggt

SEQ ID NO: 13970 - DNA, 20 bp, Artificial Sequence
  Description of Artificial Sequence: Synthetic oligonucleotide
  Target: ATXN1; (-) strand; PAM type: NNGRRT; PAM sequence: TGGGGT
ggaggagggtttcacatagt

SEQ ID NO: 13971 - DNA, 20 bp, Artificial Sequence
  Description of Artificial Sequence: Synthetic oligonucleotide
  Target: ATXN1; (-) strand; PAM type: NNGRRT; PAM sequence: GAGGGT
tgggcaggaaaaaagaggag

SEQ ID NO: 13972 - DNA, 20 bp, Artificial Sequence
  Description of Artificial Sequence: Synthetic oligonucleotide
  Target: ATXN1; (-) strand; PAM type: NNGRRT; PAM sequence: GGGAGT
gattgtgcctggatgtggaa

SEQ ID NO: 13973 - DNA, 20 bp, Artificial Sequence
  Description of Artificial Sequence: Synthetic oligonucleotide
  Target: ATXN1; (-) strand; PAM type: NNGRRT; PAM sequence: CTGGAT
aggtaggaccaggattgtgc

SEQ ID NO: 13974 - DNA, 20 bp, Artificial Sequence
  Description of Artificial Sequence: Synthetic oligonucleotide
  Target: ATXN1; (-) strand; PAM type: NNGRRT; PAM sequence: CAGGAT
aggagcattctaggtaggac

SEQ ID NO: 13975 - DNA, 20 bp, Artificial Sequence
  Description of Artificial Sequence: Synthetic oligonucleotide
  Target: ATXN1; (-) strand; PAM type: NNGRRT; PAM sequence: CTGAAT
ggacacatcacagcagagac

SEQ ID NO: 13976 - DNA, 20 bp, Artificial Sequence
  Description of Artificial Sequence: Synthetic oligonucleotide
  Target: ATXN1; (-) strand; PAM type: NNGRRT; PAM sequence: AAGAAT
cagctgtgatgaatgaagag

SEQ ID NO: 13977 - DNA, 20 bp, Artificial Sequence
  Description of Artificial Sequence: Synthetic oligonucleotide
  Target: ATXN1; (-) strand; PAM type: NNGRRT; PAM sequence: ATGAAT
gtggtgtaacatcagctgtg

SEQ ID NO: 13978 - DNA, 20 bp, Artificial Sequence
  Description of Artificial Sequence: Synthetic oligonucleotide
  Target: ATXN1; (-) strand; PAM type: NNGRRT; PAM sequence: ATGAAT
acacctgtgatatatcagta

SEQ ID NO: 13979 - DNA, 20 bp, Artificial Sequence
  Description of Artificial Sequence: Synthetic oligonucleotide
  Target: ATXN1; (-) strand; PAM type: NNGRRT; PAM sequence: TAGGAT
taaatagaaggagtaagttt

SEQ ID NO: 13980 - DNA, 20 bp, Artificial Sequence
  Description of Artificial Sequence: Synthetic oligonucleotide
  Target: ATXN1; (-) strand; PAM type: NNGRRT; PAM sequence: AGGAGT
caaaaatacagttaaataga

SEQ ID NO: 13981 - DNA, 20 bp, Artificial Sequence
  Description of Artificial Sequence: Synthetic oligonucleotide
  Target: ATXN1; (-) strand; PAM type: NNGRRT; PAM sequence: ATGGGT
ggatgaagagaagtcagtta

SEQ ID NO: 13982 - DNA, 20 bp, Artificial Sequence
  Description of Artificial Sequence: Synthetic oligonucleotide
  Target: ATXN1; (-) strand; PAM type: NNGRRT; PAM sequence: AAGGAT
ataggtgctgcagtttgagc

SEQ ID NO: 13983 - DNA, 20 bp, Artificial Sequence
  Description of Artificial Sequence: Synthetic oligonucleotide
  Target: ATXN1; (-) strand; PAM type: NNGRRT; PAM sequence: CAGAGT
atttattgagccaatactta

SEQ ID NO: 13984 - DNA, 20 bp, Artificial Sequence
  Description of Artificial Sequence: Synthetic oligonucleotide
  Target: ATXN1; (-) strand; PAM type: NNGRRT; PAM sequence: CAGGGT
tgtatgtgagcattgttgca

SEQ ID NO: 13985 - DNA, 20 bp, Artificial Sequence
  Description of Artificial Sequence: Synthetic oligonucleotide
  Target: ATXN1; (-) strand; PAM type: NNGRRT; PAM sequence: TGGAGT
gtagagccttactaacaaaa

SEQ ID NO: 13986 - DNA, 20 bp, Artificial Sequence
  Description of Artificial Sequence: Synthetic oligonucleotide
  Target: ATXN1; (-) strand; PAM type: NNGRRT; PAM sequence: AAGAAT
atttgattaacggggtaact

SEQ ID NO: 13987 - DNA, 20 bp, Artificial Sequence
  Description of Artificial Sequence: Synthetic oligonucleotide
  Target: ATXN1; (-) strand; PAM type: NNGRRT; PAM sequence: CGGGGT
tggaagttacatttgattaa

SEQ ID NO: 13988 - DNA, 20 bp, Artificial Sequence
  Description of Artificial Sequence: Synthetic oligonucleotide
  Target: ATXN1; (-) strand; PAM type: NNGRRT; PAM sequence: CAGGAT
attagtagttgtggcaatgc

SEQ ID NO: 13989 - DNA, 20 bp, Artificial Sequence
  Description of Artificial Sequence: Synthetic oligonucleotide
  Target: ATXN1; (-) strand; PAM type: NNGRRT; PAM sequence: CGGGAT
acaggatgtcactgagatga

SEQ ID NO: 13990 - DNA, 20 bp, Artificial Sequence
  Description of Artificial Sequence: Synthetic oligonucleotide
  Target: ATXN1; (-) strand; PAM type: NNGRRT; PAM sequence: CAGGAT
caacctttctacctgagaaa

SEQ ID NO: 13991 - DNA, 20 bp, Artificial Sequence
  Description of Artificial Sequence: Synthetic oligonucleotide
  Target: ATXN1; (-) strand; PAM type: NNGRRT; PAM sequence: TAGGGT
atgatacactcatgctgtac

SEQ ID NO: 13992 - DNA, 20 bp, Artificial Sequence
  Description of Artificial Sequence: Synthetic oligonucleotide
  Target: ATXN1; (-) strand; PAM type: NNGRRT; PAM sequence: CAGGGT
attcactgaggacaagaact

SEQ ID NO: 13993 - DNA, 20 bp, Artificial Sequence
  Description of Artificial Sequence: Synthetic oligonucleotide
  Target: ATXN1; (-) strand; PAM type: NNGRRT; PAM sequence: GTGGGT
aattgtctttgctttgcatg

SEQ ID NO: 13994 - DNA, 20 bp, Artificial Sequence
  Description of Artificial Sequence: Synthetic oligonucleotide
  Target: ATXN1; (-) strand; PAM type: NNGRRT; PAM sequence: CAGGAT
aaacagttaccttgcaagct

SEQ ID NO: 13995 - DNA, 20 bp, Artificial Sequence
  Description of Artificial Sequence: Synthetic oligonucleotide
  Target: ATXN1; (-) strand; PAM type: NNGRRT; PAM sequence: ATGAGT
ataaggagttgcaaataata

SEQ ID NO: 13996 - DNA, 20 bp, Artificial Sequence
  Description of Artificial Sequence: Synthetic oligonucleotide
  Target: ATXN1; (-) strand; PAM type: NNGRRT; PAM sequence: AGGAGT
aaccctgattccctaaaata

SEQ ID NO: 13997 - DNA, 20 bp, Artificial Sequence
  Description of Artificial Sequence: Synthetic oligonucleotide
  Target: ATXN1; (-) strand; PAM type: NNGRRT; PAM sequence: ACGAAT
ttgaaacctcaacatatgaa

SEQ ID NO: 13998 - DNA, 20 bp, Artificial Sequence
  Description of Artificial Sequence: Synthetic oligonucleotide
  Target: ATXN1; (-) strand; PAM type: NNGRRT; PAM sequence: CTGAGT
cattcatatattacttatat

SEQ ID NO: 13999 - DNA, 20 bp, Artificial Sequence
  Description of Artificial Sequence: Synthetic oligonucleotide
  Target: ATXN1; (-) strand; PAM type: NNGRRT; PAM sequence: AAGGGT
atcagagagcactagatggg

SEQ ID NO: 14000 - DNA, 20 bp, Artificial Sequence
  Description of Artificial Sequence: Synthetic oligonucleotide
  Target: ATXN1; (-) strand; PAM type: NNGRRT; PAM sequence: TTGAAT
tccaaagcacattccttccc

SEQ ID NO: 14001 - DNA, 20 bp, Artificial Sequence
  Description of Artificial Sequence: Synthetic oligonucleotide
  Target: ATXN1; (-) strand; PAM type: NNGRRT; PAM sequence: CTGAGT
ggctttgaacctacgtctct

SEQ ID NO: 14002 - DNA, 20 bp, Artificial Sequence
  Description of Artificial Sequence: Synthetic oligonucleotide
  Target: ATXN1; (-) strand; PAM type: NNGRRT; PAM sequence: CAGAGT
ggaatgggagtgagtcagtt

SEQ ID NO: 14003 - DNA, 20 bp, Artificial Sequence
  Description of Artificial Sequence: Synthetic oligonucleotide
  Target: ATXN1; (-) strand; PAM type: NNGRRT; PAM sequence: GTGAGT
agaggctcgatggaatggga

SEQ ID NO: 14004 - DNA, 20 bp, Artificial Sequence
  Description of Artificial Sequence: Synthetic oligonucleotide
  Target: ATXN1; (-) strand; PAM type: NNGRRT; PAM sequence: GGGAGT
taaaagaggctcgatggaat

SEQ ID NO: 14005 - DNA, 20 bp, Artificial Sequence
  Description of Artificial Sequence: Synthetic oligonucleotide
  Target: ATXN1; (-) strand; PAM type: NNGRRT; PAM sequence: TGGAAT
tgcagataaaagaggctcga

SEQ ID NO: 14006 - DNA, 20 bp, Artificial Sequence
  Description of Artificial Sequence: Synthetic oligonucleotide
  Target: ATXN1; (-) strand; PAM type: NNGRRT; PAM sequence: AGGAAT
gttatttttatgagatatta

SEQ ID NO: 14007 - DNA, 20 bp, Artificial Sequence
  Description of Artificial Sequence: Synthetic oligonucleotide
  Target: ATXN1; (-) strand; PAM type: NNGRRT; PAM sequence: TTGAAT
agaagggaggaagctattca

SEQ ID NO: 14008 - DNA, 20 bp, Artificial Sequence
  Description of Artificial Sequence: Synthetic oligonucleotide
  Target: ATXN1; (-) strand; PAM type: NNGRRT; PAM sequence: TGGGGT
ctctccatgatgtttaggaa

SEQ ID NO: 14009 - DNA, 20 bp, Artificial Sequence
  Description of Artificial Sequence: Synthetic oligonucleotide
  Target: ATXN1; (-) strand; PAM type: NNGRRT; PAM sequence: AGGAAT
aggacctctccatgatgttt

SEQ ID NO: 14010 - DNA, 20 bp, Artificial Sequence
  Description of Artificial Sequence: Synthetic oligonucleotide
  Target: ATXN1; (-) strand; PAM type: NNGRRT; PAM sequence: GGGGAT
aggctgaaagaggttaggat

SEQ ID NO: 14011 - DNA, 20 bp, Artificial Sequence
  Description of Artificial Sequence: Synthetic oligonucleotide
  Target: ATXN1; (-) strand; PAM type: NNGRRT; PAM sequence: TAGGAT
aaagtgaggctgaaagaggt

SEQ ID NO: 14012 - DNA, 20 bp, Artificial Sequence
  Description of Artificial Sequence: Synthetic oligonucleotide
  Target: ATXN1; (-) strand; PAM type: NNGRRT; PAM sequence: ATGGAT
ctgttgtccttttaatcctc

SEQ ID NO: 14013 - DNA, 20 bp, Artificial Sequence
  Description of Artificial Sequence: Synthetic oligonucleotide
  Target: ATXN1; (-) strand; PAM type: NNGRRT; PAM sequence: GGGGGT
ttcatagcgttggcccttgg

SEQ ID NO: 14014 - DNA, 20 bp, Artificial Sequence
  Description of Artificial Sequence: Synthetic oligonucleotide
  Target: ATXN1; (-) strand; PAM type: NNGRRT; PAM sequence: AGGAAT
ttcatgattagtaattctca

SEQ ID NO: 14015 - DNA, 20 bp, Artificial Sequence
  Description of Artificial Sequence: Synthetic oligonucleotide
  Target: ATXN1; (-) strand; PAM type: NNGRRT; PAM sequence: CCGAAT
caaaggagcatcctggagaa

SEQ ID NO: 14016 - DNA, 20 bp, Artificial Sequence
  Description of Artificial Sequence: Synthetic oligonucleotide
  Target: ATXN1; (-) strand; PAM type: NNGRRT; PAM sequence: TGGGAT
acctgggcatcccaaagttc

SEQ ID NO: 14017 - DNA, 20 bp, Artificial Sequence
  Description of Artificial Sequence: Synthetic oligonucleotide
  Target: ATXN1; (-) strand; PAM type: NNGRRT; PAM sequence: TCGAAT
ctgtgttggccaggcttgtc

SEQ ID NO: 14018 - DNA, 20 bp, Artificial Sequence
  Description of Artificial Sequence: Synthetic oligonucleotide
  Target: ATXN1; (-) strand; PAM type: NNGRRT; PAM sequence: CTGAGT
gattcttctgcctcagcctc

SEQ ID NO: 14019 - DNA, 20 bp, Artificial Sequence
  Description of Artificial Sequence: Synthetic oligonucleotide
  Target: ATXN1; (-) strand; PAM type: NNGRRT; PAM sequence: TCGGGT
ctcactgcaaactctggccc

SEQ ID NO: 14020 - DNA, 20 bp, Artificial Sequence
  Description of Artificial Sequence: Synthetic oligonucleotide
  Target: ATXN1; (-) strand; PAM type: NNGRRT; PAM sequence: TGGAGT
tctcgctctgtcgcccaggc

SEQ ID NO: 14021 - DNA, 20 bp, Artificial Sequence
  Description of Artificial Sequence: Synthetic oligonucleotide
  Target: ATXN1; (-) strand; PAM type: NNGRRT; PAM sequence: CGGAGT
cctggcctttttttttgaga

SEQ ID NO: 14022 - DNA, 20 bp, Artificial Sequence
  Description of Artificial Sequence: Synthetic oligonucleotide
  Target: ATXN1; (-) strand; PAM type: NNGRRT; PAM sequence: TGGGAT
gccttggcctcccaaagtgc

SEQ ID NO: 14023 - DNA, 20 bp, Artificial Sequence
  Description of Artificial Sequence: Synthetic oligonucleotide
  Target: ATXN1; (-) strand; PAM type: NNGRRT; PAM sequence: TGGGAT
gcctcagccttctgagtagc

SEQ ID NO: 14024 - DNA, 20 bp, Artificial Sequence
  Description of Artificial Sequence: Synthetic oligonucleotide
  Target: ATXN1; (-) strand; PAM type: NNGRRT; PAM sequence: CTGAGT
ggttctcctgcctcagcctt

SEQ ID NO: 14025 - DNA, 20 bp, Artificial Sequence
  Description of Artificial Sequence: Synthetic oligonucleotide
  Target: ATXN1; (-) strand; PAM type: NNGRRT; PAM sequence: CTGGGT
ctcactgcaacctccgcctc

SEQ ID NO: 14026 - DNA, 20 bp, Artificial Sequence
  Description of Artificial Sequence: Synthetic oligonucleotide
  Target: ATXN1; (-) strand; PAM type: NNGRRT; PAM sequence: CGGAGT
ttctttttttttttttgaga

SEQ ID NO: 14027 - DNA, 20 bp, Artificial Sequence
  Description of Artificial Sequence: Synthetic oligonucleotide
  Target: ATXN1; (-) strand; PAM type: NNGRRT; PAM sequence: GAGAAT
aatttgtttctgtttgcttt

SEQ ID NO: 14028 - DNA, 20 bp, Artificial Sequence
  Description of Artificial Sequence: Synthetic oligonucleotide
  Target: ATXN1; (-) strand; PAM type: NNGRRT; PAM sequence: GAGGAT
aagactgaagatagaaacag

SEQ ID NO: 14029 - DNA, 20 bp, Artificial Sequence
  Description of Artificial Sequence: Synthetic oligonucleotide
  Target: ATXN1; (-) strand; PAM type: NNGRRT; PAM sequence: CAGAAT
ggcacaagacagacaaatcc

SEQ ID NO: 14030 - DNA, 20 bp, Artificial Sequence
  Description of Artificial Sequence: Synthetic oligonucleotide
  Target: ATXN1; (-) strand; PAM type: NNGRRT; PAM sequence: CAGAAT
atgtcattgaatgtcgtttg

SEQ ID NO: 14031 - DNA, 20 bp, Artificial Sequence
  Description of Artificial Sequence: Synthetic oligonucleotide
  Target: ATXN1; (-) strand; PAM type: NNGRRT; PAM sequence: TTGAAT
tcttctctctgtggatgtca

SEQ ID NO: 14032 - DNA, 20 bp, Artificial Sequence
  Description of Artificial Sequence: Synthetic oligonucleotide
  Target: ATXN1; (-) strand; PAM type: NNGRRT; PAM sequence: GTGGAT
gagttgcaggtcttctctct

SEQ ID NO: 14033 - DNA, 20 bp, Artificial Sequence
  Description of Artificial Sequence: Synthetic oligonucleotide
  Target: ATXN1; (-) strand; PAM type: NNGRRT; PAM sequence: CCGAGT
aacatcgtgtttcttttcta

SEQ ID NO: 14034 - DNA, 20 bp, Artificial Sequence
  Description of Artificial Sequence: Synthetic oligonucleotide
  Target: ATXN1; (-) strand; PAM type: NNGRRT; PAM sequence: TTGAAT
attcattccctaaatattta

SEQ ID NO: 14035 - DNA, 20 bp, Artificial Sequence
  Description of Artificial Sequence: Synthetic oligonucleotide
  Target: ATXN1; (-) strand; PAM type: NNGRRT; PAM sequence: ATGAAT
catatcattcattactagtt

SEQ ID NO: 14036 - DNA, 20 bp, Artificial Sequence
  Description of Artificial Sequence: Synthetic oligonucleotide
  Target: ATXN1; (-) strand; PAM type: NNGRRT; PAM sequence: CTGAAT
taaatgttttccttttccag

SEQ ID NO: 14037 - DNA, 20 bp, Artificial Sequence
  Description of Artificial Sequence: Synthetic oligonucleotide
  Target: ATXN1; (-) strand; PAM type: NNGRRT; PAM sequence: ATGGAT
tgacacacaatcactcagag

SEQ ID NO: 14038 - DNA, 20 bp, Artificial Sequence
  Description of Artificial Sequence: Synthetic oligonucleotide
  Target: ATXN1; (-) strand; PAM type: NNGRRT; PAM sequence: ATGAGT
actctggttttgattcacaa

SEQ ID NO: 14039 - DNA, 20 bp, Artificial Sequence
  Description of Artificial Sequence: Synthetic oligonucleotide
  Target: ATXN1; (-) strand; PAM type: NNGRRT; PAM sequence: TGGAAT
tgctttttttaccctttcat

SEQ ID NO: 14040 - DNA, 20 bp, Artificial Sequence
  Description of Artificial Sequence: Synthetic oligonucleotide
  Target: ATXN1; (-) strand; PAM type: NNGRRT; PAM sequence: GAGAGT
ctttaaaatctcacaccagt

SEQ ID NO: 14041 - DNA, 20 bp, Artificial Sequence
  Description of Artificial Sequence: Synthetic oligonucleotide
  Target: ATXN1; (-) strand; PAM type: NNGRRT; PAM sequence: AGGAAT
acgccatccttttgacagga

SEQ ID NO: 14042 - DNA, 20 bp, Artificial Sequence
  Description of Artificial Sequence: Synthetic oligonucleotide
  Target: ATXN1; (-) strand; PAM type: NNGRRT; PAM sequence: AGGGAT
agatgtactataagaacaag

SEQ ID NO: 14043 - DNA, 20 bp, Artificial Sequence
  Description of Artificial Sequence: Synthetic oligonucleotide
  Target: ATXN1; (-) strand; PAM type: NNGRRT; PAM sequence: AAGAAT
ttgttgtggtggaatgagac

SEQ ID NO: 14044 - DNA, 20 bp, Artificial Sequence
  Description of Artificial Sequence: Synthetic oligonucleotide
  Target: ATXN1; (-) strand; PAM type: NNGRRT; PAM sequence: TGGAAT
tattataaaacttgttgtgg

SEQ ID NO: 14045 - DNA, 20 bp, Artificial Sequence
  Description of Artificial Sequence: Synthetic oligonucleotide
  Target: ATXN1; (-) strand; PAM type: NNGRRT; PAM sequence: GTGAAT
atcagtaatagagttttaat

SEQ ID NO: 14046 - DNA, 20 bp, Artificial Sequence
  Description of Artificial Sequence: Synthetic oligonucleotide
  Target: ATXN1; (-) strand; PAM type: NNGRRT; PAM sequence: TAGAGT
ttgaacttttaaatcagtaa

SEQ ID NO: 14047 - DNA, 20 bp, Artificial Sequence
  Description of Artificial Sequence: Synthetic oligonucleotide
  Target: ATXN1; (-) strand; PAM type: NNGRRT; PAM sequence: CAGAAT
ggtttacgctaaactttcat

SEQ ID NO: 14048 - DNA, 20 bp, Artificial Sequence
  Description of Artificial Sequence: Synthetic oligonucleotide
  Target: ATXN1; (-) strand; PAM type: NNGRRT; PAM sequence: CTGGAT
actttcgactagcatgttgt

SEQ ID NO: 14049 - DNA, 20 bp, Artificial Sequence
  Description of Artificial Sequence: Synthetic oligonucleotide
  Target: ATXN1; (-) strand; PAM type: NNGRRT; PAM sequence: AAGAAT
aaatctaataaaattttata

SEQ ID NO: 14050 - DNA, 20 bp, Artificial Sequence
  Description of Artificial Sequence: Synthetic oligonucleotide
  Target: ATXN1; (-) strand; PAM type: NNGRRT; PAM sequence: GAGAGT
cctcggcatcccaaagtgct

SEQ ID NO: 14051 - DNA, 20 bp, Artificial Sequence
  Description of Artificial Sequence: Synthetic oligonucleotide
  Target: ATXN1; (-) strand; PAM type: NNGRRT; PAM sequence: CAGGAT
cggggtttcaccgtgttagc

SEQ ID NO: 14052 - DNA, 20 bp, Artificial Sequence
  Description of Artificial Sequence: Synthetic oligonucleotide
  Target: ATXN1; (-) strand; PAM type: NNGRRT; PAM sequence: CGGGGT
ttttgtatttttagtagaga

SEQ ID NO: 14053 - DNA, 20 bp, Artificial Sequence
  Description of Artificial Sequence: Synthetic oligonucleotide
  Target: ATXN1; (-) strand; PAM type: NNGRRT; PAM sequence: CTGAGT
gattctcctgcctcagcctc

SEQ ID NO: 14054 - DNA, 20 bp, Artificial Sequence
  Description of Artificial Sequence: Synthetic oligonucleotide
  Target: ATXN1; (-) strand; PAM type: NNGRRT; PAM sequence: CCGGGT
ctcacttcaacctctgcctc

SEQ ID NO: 14055 - DNA, 20 bp, Artificial Sequence
  Description of Artificial Sequence: Synthetic oligonucleotide
  Target: ATXN1; (-) strand; PAM type: NNGRRT; PAM sequence: TGGAGT
tctcactctgtcgcccaggc

SEQ ID NO: 14056 - DNA, 20 bp, Artificial Sequence
  Description of Artificial Sequence: Synthetic oligonucleotide
  Target: ATXN1; (-) strand; PAM type: NNGRRT; PAM sequence: CGGAGT
attttattttatttttgaga

SEQ ID NO: 14057 - DNA, 20 bp, Artificial Sequence
  Description of Artificial Sequence: Synthetic oligonucleotide
  Target: ATXN1; (-) strand; PAM type: NNGRRT; PAM sequence: GTGGGT
ggtacagagtaggggatcca

SEQ ID NO: 14058 - DNA, 20 bp, Artificial Sequence
  Description of Artificial Sequence: Synthetic oligonucleotide
  Target: ATXN1; (-) strand; PAM type: NNGRRT; PAM sequence: GGGGAT
acaatgccaggtacagagta

SEQ ID NO: 14059 - DNA, 20 bp, Artificial Sequence
  Description of Artificial Sequence: Synthetic oligonucleotide
  Target: ATXN1; (-) strand; PAM type: NNGRRT; PAM sequence: CAGAGT
ctgtagcacaatgccaggta

SEQ ID NO: 14060 - DNA, 20 bp, Artificial Sequence
  Description of Artificial Sequence: Synthetic oligonucleotide
  Target: ATXN1; (-) strand; PAM type: NNGRRT; PAM sequence: CAGAAT
cctctctgcacctcattttc

SEQ ID NO: 14061 - DNA, 20 bp, Artificial Sequence
  Description of Artificial Sequence: Synthetic oligonucleotide
  Target: ATXN1; (-) strand; PAM type: NNGRRT; PAM sequence: TTGAAT
atttaattattgaagcatac

SEQ ID NO: 14062 - DNA, 20 bp, Artificial Sequence
  Description of Artificial Sequence: Synthetic oligonucleotide
  Target: ATXN1; (-) strand; PAM type: NNGRRT; PAM sequence: TGGGAT
gactcagcctcccaaagtgc

SEQ ID NO: 14063 - DNA, 20 bp, Artificial Sequence
  Description of Artificial Sequence: Synthetic oligonucleotide
  Target: ATXN1; (-) strand; PAM type: NNGRRT; PAM sequence: CGGGGT
ttttgtagttttagtagaga

SEQ ID NO: 14064 - DNA, 20 bp, Artificial Sequence
  Description of Artificial Sequence: Synthetic oligonucleotide
  Target: ATXN1; (-) strand; PAM type: NNGRRT; PAM sequence: TGGAAT
caagcgattgtctgagtagc

SEQ ID NO: 14065 - DNA, 20 bp, Artificial Sequence
  Description of Artificial Sequence: Synthetic oligonucleotide
  Target: ATXN1; (-) strand; PAM type: NNGRRT; PAM sequence: CTGAGT
tcctgggttcaagcgattgt

SEQ ID NO: 14066 - DNA, 20 bp, Artificial Sequence
  Description of Artificial Sequence: Synthetic oligonucleotide
  Target: ATXN1; (-) strand; PAM type: NNGRRT; PAM sequence: CTGGGT
ctcactgcaacctccacttc

SEQ ID NO: 14067 - DNA, 20 bp, Artificial Sequence
  Description of Artificial Sequence: Synthetic oligonucleotide
  Target: ATXN1; (-) strand; PAM type: NNGRRT; PAM sequence: TGGAGT
ctcgctcttattgcccaggc

SEQ ID NO: 14068 - DNA, 20 bp, Artificial Sequence
  Description of Artificial Sequence: Synthetic oligonucleotide
  Target: ATXN1; (-) strand; PAM type: NNGRRT; PAM sequence: CAGAGT
ttttttttttttttttgaga

SEQ ID NO: 14069 - DNA, 20 bp, Artificial Sequence
  Description of Artificial Sequence: Synthetic oligonucleotide
  Target: ATXN1; (-) strand; PAM type: NNGRRT; PAM sequence: AGGGAT
ctggtcagctctctgatggc

SEQ ID NO: 14070 - DNA, 20 bp, Artificial Sequence
  Description of Artificial Sequence: Synthetic oligonucleotide
  Target: ATXN1; (-) strand; PAM type: NNGRRT; PAM sequence: AAGAAT
aacaatgattttgaattcag

SEQ ID NO: 14071 - DNA, 20 bp, Artificial Sequence
  Description of Artificial Sequence: Synthetic oligonucleotide
  Target: ATXN1; (-) strand; PAM type: NNGRRT; PAM sequence: TTGAAT
gagtggggaaaacaatgatt

SEQ ID NO: 14072 - DNA, 20 bp, Artificial Sequence
  Description of Artificial Sequence: Synthetic oligonucleotide
  Target: ATXN1; (-) strand; PAM type: NNGRRT; PAM sequence: TGGAGT
ccccaagcactggcacaata

SEQ ID NO: 14073 - DNA, 20 bp, Artificial Sequence
  Description of Artificial Sequence: Synthetic oligonucleotide
  Target: ATXN1; (-) strand; PAM type: NNGRRT; PAM sequence: GGGGGT
gctacagagcccctagcagg

SEQ ID NO: 14074 - DNA, 20 bp, Artificial Sequence
  Description of Artificial Sequence: Synthetic oligonucleotide
  Target: ATXN1; (-) strand; PAM type: NNGRRT; PAM sequence: ATGGAT
ggctacaggtatatccaagt

SEQ ID NO: 14075 - DNA, 20 bp, Artificial Sequence
  Description of Artificial Sequence: Synthetic oligonucleotide
  Target: ATXN1; (-) strand; PAM type: NNGRRT; PAM sequence: CTGAAT
agtacaaattagggatattc

SEQ ID NO: 14076 - DNA, 20 bp, Artificial Sequence
  Description of Artificial Sequence: Synthetic oligonucleotide
  Target: ATXN1; (-) strand; PAM type: NNGRRT; PAM sequence: AGGGAT
ggaggaaatcagtacaaatt

SEQ ID NO: 14077 - DNA, 20 bp, Artificial Sequence
  Description of Artificial Sequence: Synthetic oligonucleotide
  Target: ATXN1; (-) strand; PAM type: NNGRRT; PAM sequence: GAGAGT
cactaagtctatggcagtaa

SEQ ID NO: 14078 - DNA, 20 bp, Artificial Sequence
  Description of Artificial Sequence: Synthetic oligonucleotide
  Target: ATXN1; (-) strand; PAM type: NNGRRT; PAM sequence: CTGAAT
cacagcttttagttcttttt

SEQ ID NO: 14079 - DNA, 20 bp, Artificial Sequence
  Description of Artificial Sequence: Synthetic oligonucleotide
  Target: ATXN1; (-) strand; PAM type: NNGRRT; PAM sequence: CTGAGT
cataacagtggtggtcactg

SEQ ID NO: 14080 - DNA, 20 bp, Artificial Sequence
  Description of Artificial Sequence: Synthetic oligonucleotide
  Target: ATXN1; (-) strand; PAM type: NNGRRT; PAM sequence: TTGGGT
agtcttactacctggttaga

SEQ ID NO: 14081 - DNA, 20 bp, Artificial Sequence
  Description of Artificial Sequence: Synthetic oligonucleotide
  Target: ATXN1; (-) strand; PAM type: NNGRRT; PAM sequence: ATGAGT
tacttcttttttacatcaag

SEQ ID NO: 14082 - DNA, 20 bp, Artificial Sequence
  Description of Artificial Sequence: Synthetic oligonucleotide
  Target: ATXN1; (-) strand; PAM type: NNGRRT; PAM sequence: CTGGGT
tcttttgtccattttaaaaa

SEQ ID NO: 14083 - DNA, 20 bp, Artificial Sequence
  Description of Artificial Sequence: Synthetic oligonucleotide
  Target: ATXN1; (-) strand; PAM type: NNGRRT; PAM sequence: TTGGAT
catctgctgttggcagtgtg

SEQ ID NO: 14084 - DNA, 20 bp, Artificial Sequence
  Description of Artificial Sequence: Synthetic oligonucleotide
  Target: ATXN1; (-) strand; PAM type: NNGRRT; PAM sequence: GAGAGT
attcccacccgcaatgactt

SEQ ID NO: 14085 - DNA, 20 bp, Artificial Sequence
  Description of Artificial Sequence: Synthetic oligonucleotide
  Target: ATXN1; (-) strand; PAM type: NNGRRT; PAM sequence: AAGAGT
tgcttgccacattgcatgtt

SEQ ID NO: 14086 - DNA, 20 bp, Artificial Sequence
  Description of Artificial Sequence: Synthetic oligonucleotide
  Target: ATXN1; (-) strand; PAM type: NNGRRT; PAM sequence: TTGAGT
aatgaagctgctataaacat

SEQ ID NO: 14087 - DNA, 20 bp, Artificial Sequence
  Description of Artificial Sequence: Synthetic oligonucleotide
  Target: ATXN1; (-) strand; PAM type: NNGRRT; PAM sequence: ATGAAT
tcatgtacccattcacgatt

SEQ ID NO: 14088 - DNA, 20 bp, Artificial Sequence
  Description of Artificial Sequence: Synthetic oligonucleotide
  Target: ATXN1; (-) strand; PAM type: NNGRRT; PAM sequence: ATGGAT
gctgaataatattctattgt

SEQ ID NO: 14089 - DNA, 20 bp, Artificial Sequence
  Description of Artificial Sequence: Synthetic oligonucleotide
  Target: ATXN1; (-) strand; PAM type: NNGRRT; PAM sequence: CTGAAT
aagcttatttgtttttagtg

SEQ ID NO: 14090 - DNA, 20 bp, Artificial Sequence
  Description of Artificial Sequence: Synthetic oligonucleotide
  Target: ATXN1; (-) strand; PAM type: NNGRRT; PAM sequence: CAGAGT
atattctgtttctgtcctat

SEQ ID NO: 14091 - DNA, 20 bp, Artificial Sequence
  Description of Artificial Sequence: Synthetic oligonucleotide
  Target: ATXN1; (-) strand; PAM type: NNGRRT; PAM sequence: TGGGGT
aatgggttgccactgctggc

SEQ ID NO: 14092 - DNA, 20 bp, Artificial Sequence
  Description of Artificial Sequence: Synthetic oligonucleotide
  Target: ATXN1; (-) strand; PAM type: NNGRRT; PAM sequence: ATGGGT
cagcgtggaaggggacccaa

SEQ ID NO: 14093 - DNA, 20 bp, Artificial Sequence
  Description of Artificial Sequence: Synthetic oligonucleotide
  Target: ATXN1; (-) strand; PAM type: NNGRRT; PAM sequence: AAGAGT
ttaaagatggcacagaccca

SEQ ID NO: 14094 - DNA, 20 bp, Artificial Sequence
  Description of Artificial Sequence: Synthetic oligonucleotide
  Target: ATXN1; (-) strand; PAM type: NNGRRT; PAM sequence: GTGAGT
tggaggcacggaccttcacg

SEQ ID NO: 14095 - DNA, 20 bp, Artificial Sequence
  Description of Artificial Sequence: Synthetic oligonucleotide
  Target: ATXN1; (-) strand; PAM type: NNGRRT; PAM sequence: AAGAAT
ttcatggtctcgctgacttc

SEQ ID NO: 14096 - DNA, 20 bp, Artificial Sequence
  Description of Artificial Sequence: Synthetic oligonucleotide
  Target: ATXN1; (-) strand; PAM type: NNGRRT; PAM sequence: GTGGAT
tccagagttggttccagccg

SEQ ID NO: 14097 - DNA, 20 bp, Artificial Sequence
  Description of Artificial Sequence: Synthetic oligonucleotide
  Target: ATXN1; (-) strand; PAM type: NNGRRT; PAM sequence: CAGAGT
aggatcccccaagatgtgtc

SEQ ID NO: 14098 - DNA, 20 bp, Artificial Sequence
  Description of Artificial Sequence: Synthetic oligonucleotide
  Target: ATXN1; (-) strand; PAM type: NNGRRT; PAM sequence: GAGGAT
caccacgttgcaatatctgg

SEQ ID NO: 14099 - DNA, 20 bp, Artificial Sequence
  Description of Artificial Sequence: Synthetic oligonucleotide
  Target: ATXN1; (-) strand; PAM type: NNGRRT; PAM sequence: AGGGGT
aggacagaatagcaagcaaa

SEQ ID NO: 14100 - DNA, 20 bp, Artificial Sequence
  Description of Artificial Sequence: Synthetic oligonucleotide
  Target: ATXN1; (-) strand; PAM type: NNGRRT; PAM sequence: CAGAAT
aattctaaggaaaaatagga

SEQ ID NO: 14101 - DNA, 20 bp, Artificial Sequence
  Description of Artificial Sequence: Synthetic oligonucleotide
  Target: ATXN1; (-) strand; PAM type: NNGRRT; PAM sequence: CTGAAT
caggtgcctagttttagccc

SEQ ID NO: 14102 - DNA, 20 bp, Artificial Sequence
  Description of Artificial Sequence: Synthetic oligonucleotide
  Target: ATXN1; (-) strand; PAM type: NNGRRT; PAM sequence: GGGGGT
gctcctgactccaaacagtc

SEQ ID NO: 14103 - DNA, 20 bp, Artificial Sequence
  Description of Artificial Sequence: Synthetic oligonucleotide
  Target: ATXN1; (-) strand; PAM type: NNGRRT; PAM sequence: CTGAAT
tttttgttgagaccccggag

SEQ ID NO: 14104 - DNA, 20 bp, Artificial Sequence
  Description of Artificial Sequence: Synthetic oligonucleotide
  Target: ATXN1; (-) strand; PAM type: NNGRRT; PAM sequence: GAGAGT
tgtttgggctatgtaacttt

SEQ ID NO: 14105 - DNA, 20 bp, Artificial Sequence
  Description of Artificial Sequence: Synthetic oligonucleotide
  Target: ATXN1; (-) strand; PAM type: NNGRRT; PAM sequence: GTGAGT
aggatagataggatagatgg

SEQ ID NO: 14106 - DNA, 20 bp, Artificial Sequence
  Description of Artificial Sequence: Synthetic oligonucleotide
  Target: ATXN1; (-) strand; PAM type: NNGRRT; PAM sequence: ATGGGT
ggtcaggatagataggatag

SEQ ID NO: 14107 - DNA, 20 bp, Artificial Sequence
  Description of Artificial Sequence: Synthetic oligonucleotide
  Target: ATXN1; (-) strand; PAM type: NNGRRT; PAM sequence: TAGGAT
gaggcaagggtcaggataga

SEQ ID NO: 14108 - DNA, 20 bp, Artificial Sequence
  Description of Artificial Sequence: Synthetic oligonucleotide
  Target: ATXN1; (-) strand; PAM type: NNGRRT; PAM sequence: CAGGAT
aggacccaggaggcaagggt

SEQ ID NO: 14109 - DNA, 20 bp, Artificial Sequence
  Description of Artificial Sequence: Synthetic oligonucleotide
  Target: ATXN1; (-) strand; PAM type: NNGRRT; PAM sequence: AAGGGT
ggtgttaggacccaggaggc

SEQ ID NO: 14110 - DNA, 20 bp, Artificial Sequence
  Description of Artificial Sequence: Synthetic oligonucleotide
  Target: ATXN1; (-) strand; PAM type: NNGRRT; PAM sequence: GGGAGT
ctggaagagcaccagggaca

SEQ ID NO: 14111 - DNA, 20 bp, Artificial Sequence
  Description of Artificial Sequence: Synthetic oligonucleotide
  Target: ATXN1; (-) strand; PAM type: NNGRRT; PAM sequence: CAGAGT
tgggtgcctaaagaagggag

SEQ ID NO: 14112 - DNA, 20 bp, Artificial Sequence
  Description of Artificial Sequence: Synthetic oligonucleotide
  Target: ATXN1; (-) strand; PAM type: NNGRRT; PAM sequence: CTGGGT
tgtctttctgattggtgagc

SEQ ID NO: 14113 - DNA, 20 bp, Artificial Sequence
  Description of Artificial Sequence: Synthetic oligonucleotide
  Target: ATXN1; (-) strand; PAM type: NNGRRT; PAM sequence: AGGGAT
ttaggtctgctagtctgagg

SEQ ID NO: 14114 - DNA, 20 bp, Artificial Sequence
  Description of Artificial Sequence: Synthetic oligonucleotide
  Target: ATXN1; (-) strand; PAM type: NNGRRT; PAM sequence: GGGAAT
tctcctcctatcctagcttt

SEQ ID NO: 14115 - DNA, 20 bp, Artificial Sequence
  Description of Artificial Sequence: Synthetic oligonucleotide
  Target: ATXN1; (-) strand; PAM type: NNGRRT; PAM sequence: CTGAGT
gaataggaaggatataattt

SEQ ID NO: 14116 - DNA, 20 bp, Artificial Sequence
  Description of Artificial Sequence: Synthetic oligonucleotide
  Target: ATXN1; (-) strand; PAM type: NNGRRT; PAM sequence: AAGGAT
tcacttatcatatgaatagg

SEQ ID NO: 14117 - DNA, 20 bp, Artificial Sequence
  Description of Artificial Sequence: Synthetic oligonucleotide
  Target: ATXN1; (-) strand; PAM type: NNGRRT; PAM sequence: ATGAAT
gttttgtcctcacttatcat

SEQ ID NO: 14118 - DNA, 20 bp, Artificial Sequence
  Description of Artificial Sequence: Synthetic oligonucleotide
  Target: ATXN1; (-) strand; PAM type: NNGRRT; PAM sequence: AAGAGT
gaagggatctccagggttgg

SEQ ID NO: 14119 - DNA, 20 bp, Artificial Sequence
  Description of Artificial Sequence: Synthetic oligonucleotide
  Target: ATXN1; (-) strand; PAM type: NNGRRT; PAM sequence: CAGGGT
tgagggaaggaagggatctc

SEQ ID NO: 14120 - DNA, 20 bp, Artificial Sequence
  Description of Artificial Sequence: Synthetic oligonucleotide
  Target: ATXN1; (-) strand; PAM type: NNGRRT; PAM sequence: AGGGAT
gccataccctgagggaagga

SEQ ID NO: 14121 - DNA, 20 bp, Artificial Sequence
  Description of Artificial Sequence: Synthetic oligonucleotide
  Target: ATXN1; (-) strand; PAM type: NNGRRT; PAM sequence: TGGAGT
aaagataatatgcctcaaaa

SEQ ID NO: 14122 - DNA, 20 bp, Artificial Sequence
  Description of Artificial Sequence: Synthetic oligonucleotide
  Target: ATXN1; (-) strand; PAM type: NNGRRT; PAM sequence: TAGAGT
atgcattcttgaaaacctgt

SEQ ID NO: 14123 - DNA, 20 bp, Artificial Sequence
  Description of Artificial Sequence: Synthetic oligonucleotide
  Target: ATXN1; (-) strand; PAM type: NNGRRT; PAM sequence: ATGGAT
agatttagtggcccttacca

SEQ ID NO: 14124 - DNA, 20 bp, Artificial Sequence
  Description of Artificial Sequence: Synthetic oligonucleotide
  Target: ATXN1; (-) strand; PAM type: NNGRRT; PAM sequence: CGGAAT
agtccctggatcctgctgtt

SEQ ID NO: 14125 - DNA, 20 bp, Artificial Sequence
  Description of Artificial Sequence: Synthetic oligonucleotide
  Target: ATXN1; (-) strand; PAM type: NNGRRT; PAM sequence: CTGGAT
ccaagaacccacaacagtcc

SEQ ID NO: 14126 - DNA, 20 bp, Artificial Sequence
  Description of Artificial Sequence: Synthetic oligonucleotide
  Target: ATXN1; (-) strand; PAM type: NNGRRT; PAM sequence: CTGGGT
aagggtgagcttgttgatgc

SEQ ID NO: 14127 - DNA, 20 bp, Artificial Sequence
  Description of Artificial Sequence: Synthetic oligonucleotide
  Target: ATXN1; (-) strand; PAM type: NNGRRT; PAM sequence: AAGGGT
aatggcttaggatgcgtttc

SEQ ID NO: 14128 - DNA, 20 bp, Artificial Sequence
  Description of Artificial Sequence: Synthetic oligonucleotide
  Target: ATXN1; (-) strand; PAM type: NNGRRT; PAM sequence: TAGGAT
acaaattggtcccaatggct

SEQ ID NO: 14129 - DNA, 20 bp, Artificial Sequence
  Description of Artificial Sequence: Synthetic oligonucleotide
  Target: ATXN1; (-) strand; PAM type: NNGRRT; PAM sequence: CAGGGT
aaaataagccgcttcttttt

SEQ ID NO: 14130 - DNA, 20 bp, Artificial Sequence
  Description of Artificial Sequence: Synthetic oligonucleotide
  Target: ATXN1; (-) strand; PAM type: NNGRRT; PAM sequence: CAGAAT
ttacagaaaaggtcaacctg

SEQ ID NO: 14131 - DNA, 20 bp, Artificial Sequence
  Description of Artificial Sequence: Synthetic oligonucleotide
  Target: ATXN1; (-) strand; PAM type: NNGRRT; PAM sequence: GTGGAT
atcgccagctttgcatagtt

SEQ ID NO: 14132 - DNA, 20 bp, Artificial Sequence
  Description of Artificial Sequence: Synthetic oligonucleotide
  Target: ATXN1; (-) strand; PAM type: NNGRRT; PAM sequence: TGGAAT
taatctgagaggtcctcctg

SEQ ID NO: 14133 - DNA, 20 bp, Artificial Sequence
  Description of Artificial Sequence: Synthetic oligonucleotide
  Target: ATXN1; (-) strand; PAM type: NNGRRT; PAM sequence: TAGGAT
aaggggagctgtagggaggc

SEQ ID NO: 14134 - DNA, 20 bp, Artificial Sequence
  Description of Artificial Sequence: Synthetic oligonucleotide
  Target: ATXN1; (-) strand; PAM type: NNGRRT; PAM sequence: CTGGAT
atttctttgcttgtttcctt

SEQ ID NO: 14135 - DNA, 20 bp, Artificial Sequence
  Description of Artificial Sequence: Synthetic oligonucleotide
  Target: ATXN1; (-) strand; PAM type: NNGRRT; PAM sequence: AGGGGT
gagacataactgatagcctg

SEQ ID NO: 14136 - DNA, 20 bp, Artificial Sequence
  Description of Artificial Sequence: Synthetic oligonucleotide
  Target: ATXN1; (-) strand; PAM type: NNGRRT; PAM sequence: CAGGAT
taggacatctatatacctac

SEQ ID NO: 14137 - DNA, 20 bp, Artificial Sequence
  Description of Artificial Sequence: Synthetic oligonucleotide
  Target: ATXN1; (-) strand; PAM type: NNGRRT; PAM sequence: CAGGGT
gcattcttttcattaaaggc

SEQ ID NO: 14138 - DNA, 20 bp, Artificial Sequence
  Description of Artificial Sequence: Synthetic oligonucleotide
  Target: ATXN1; (-) strand; PAM type: NNGRRT; PAM sequence: GGGAAT
ggatggcttgctgcccatta

SEQ ID NO: 14139 - DNA, 20 bp, Artificial Sequence
  Description of Artificial Sequence: Synthetic oligonucleotide
  Target: ATXN1; (-) strand; PAM type: NNGRRT; PAM sequence: GGGGAT
tcccagtggggatccataat

SEQ ID NO: 14140 - DNA, 20 bp, Artificial Sequence
  Description of Artificial Sequence: Synthetic oligonucleotide
  Target: ATXN1; (-) strand; PAM type: NNGRRT; PAM sequence: GGGGAT
atctgagtctaggtcccagt

SEQ ID NO: 14141 - DNA, 20 bp, Artificial Sequence
  Description of Artificial Sequence: Synthetic oligonucleotide
  Target: ATXN1; (-) strand; PAM type: NNGRRT; PAM sequence: CTGAGT
gcgactccagttcccatgat

SEQ ID NO: 14142 - DNA, 20 bp, Artificial Sequence
  Description of Artificial Sequence: Synthetic oligonucleotide
  Target: ATXN1; (-) strand; PAM type: NNGRRT; PAM sequence: TGGAAT
ctaattctccttagtccttc

SEQ ID NO: 14143 - DNA, 20 bp, Artificial Sequence
  Description of Artificial Sequence: Synthetic oligonucleotide
  Target: ATXN1; (-) strand; PAM type: NNGRRT; PAM sequence: TTGAAT
ctgagttatggtggacatca

SEQ ID NO: 14144 - DNA, 20 bp, Artificial Sequence
  Description of Artificial Sequence: Synthetic oligonucleotide
  Target: ATXN1; (-) strand; PAM type: NNGRRT; PAM sequence: CTGAGT
gtaggattttcttcctttcc

SEQ ID NO: 14145 - DNA, 20 bp, Artificial Sequence
  Description of Artificial Sequence: Synthetic oligonucleotide
  Target: ATXN1; (-) strand; PAM type: NNGRRT; PAM sequence: TAGGAT
tagctgcttgaggaaggcag

SEQ ID NO: 14146 - DNA, 20 bp, Artificial Sequence
  Description of Artificial Sequence: Synthetic oligonucleotide
  Target: ATXN1; (-) strand; PAM type: NNGRRT; PAM sequence: GGGAGT
tcgagggagttgggtgacag

SEQ ID NO: 14147 - DNA, 20 bp, Artificial Sequence
  Description of Artificial Sequence: Synthetic oligonucleotide
  Target: ATXN1; (-) strand; PAM type: NNGRRT; PAM sequence: TTGGGT
tcaattgaccctcgagggag

SEQ ID NO: 14148 - DNA, 20 bp, Artificial Sequence
  Description of Artificial Sequence: Synthetic oligonucleotide
  Target: ATXN1; (-) strand; PAM type: NNGRRT; PAM sequence: GGGAGT
taggatcaattgaccctcga

SEQ ID NO: 14149 - DNA, 20 bp, Artificial Sequence
  Description of Artificial Sequence: Synthetic oligonucleotide
  Target: ATXN1; (-) strand; PAM type: NNGRRT; PAM sequence: TAGGAT
attgggtaataaacatcttt

SEQ ID NO: 14150 - DNA, 20 bp, Artificial Sequence
  Description of Artificial Sequence: Synthetic oligonucleotide
  Target: ATXN1; (-) strand; PAM type: NNGRRT; PAM sequence: TTGGGT
tctcctgatatctcagctga

SEQ ID NO: 14151 - DNA, 20 bp, Artificial Sequence
  Description of Artificial Sequence: Synthetic oligonucleotide
  Target: ATXN1; (-) strand; PAM type: NNGRRT; PAM sequence: CTGGGT
cacactgataacaagcccta

SEQ ID NO: 14152 - DNA, 20 bp, Artificial Sequence
  Description of Artificial Sequence: Synthetic oligonucleotide
  Target: ATXN1; (-) strand; PAM type: NNGRRT; PAM sequence: GGGAGT
ggcatagtggacatgggtga

SEQ ID NO: 14153 - DNA, 20 bp, Artificial Sequence
  Description of Artificial Sequence: Synthetic oligonucleotide
  Target: ATXN1; (-) strand; PAM type: NNGRRT; PAM sequence: ATGGGT
attgccttggcatagtggac

SEQ ID NO: 14154 - DNA, 20 bp, Artificial Sequence
  Description of Artificial Sequence: Synthetic oligonucleotide
  Target: ATXN1; (-) strand; PAM type: NNGRRT; PAM sequence: TTGGAT
aggcaccctcagtcctgttg

SEQ ID NO: 14155 - DNA, 20 bp, Artificial Sequence
  Description of Artificial Sequence: Synthetic oligonucleotide
  Target: ATXN1; (-) strand; PAM type: NNGRRT; PAM sequence: GAGGGT
aaacttgcccagggctcagt

SEQ ID NO: 14156 - DNA, 20 bp, Artificial Sequence
  Description of Artificial Sequence: Synthetic oligonucleotide
  Target: ATXN1; (-) strand; PAM type: NNGRRT; PAM sequence: ATGGAT
ccaggattccttggatggta

SEQ ID NO: 14157 - DNA, 20 bp, Artificial Sequence
  Description of Artificial Sequence: Synthetic oligonucleotide
  Target: ATXN1; (-) strand; PAM type: NNGRRT; PAM sequence: TTGGAT
acaggctgtcccaggattcc

SEQ ID NO: 14158 - DNA, 20 bp, Artificial Sequence
  Description of Artificial Sequence: Synthetic oligonucleotide
  Target: ATXN1; (-) strand; PAM type: NNGRRT; PAM sequence: CAGGAT
tacctggttacaggctgtcc

SEQ ID NO: 14159 - DNA, 20 bp, Artificial Sequence
  Description of Artificial Sequence: Synthetic oligonucleotide
  Target: ATXN1; (-) strand; PAM type: NNGRRT; PAM sequence: AAGGGT
ctaatatgtccctccctaat

SEQ ID NO: 14160 - DNA, 20 bp, Artificial Sequence
  Description of Artificial Sequence: Synthetic oligonucleotide
  Target: ATXN1; (-) strand; PAM type: NNGRRT; PAM sequence: ATGGGT
cctcaagtaggggacaacaa

SEQ ID NO: 14161 - DNA, 20 bp, Artificial Sequence
  Description of Artificial Sequence: Synthetic oligonucleotide
  Target: ATXN1; (-) strand; PAM type: NNGRRT; PAM sequence: CAGGGT
tccttccaatgcccagactt

SEQ ID NO: 14162 - DNA, 20 bp, Artificial Sequence
  Description of Artificial Sequence: Synthetic oligonucleotide
  Target: ATXN1; (-) strand; PAM type: NNGRRT; PAM sequence: CCGAAT
ggtgggcattttttgccttt

SEQ ID NO: 14163 - DNA, 20 bp, Artificial Sequence
  Description of Artificial Sequence: Synthetic oligonucleotide
  Target: ATXN1; (-) strand; PAM type: NNGRRT; PAM sequence: CTGGGT
gtcttatagcctgatttgga

SEQ ID NO: 14164 - DNA, 20 bp, Artificial Sequence
  Description of Artificial Sequence: Synthetic oligonucleotide
  Target: ATXN1; (-) strand; PAM type: NNGRRT; PAM sequence: TGGGGT
cctttgataaggaaaagtgg

SEQ ID NO: 14165 - DNA, 20 bp, Artificial Sequence
  Description of Artificial Sequence: Synthetic oligonucleotide
  Target: ATXN1; (-) strand; PAM type: NNGRRT; PAM sequence: TGGGGT
agtttttgtactcctagaat

SEQ ID NO: 14166 - DNA, 20 bp, Artificial Sequence
  Description of Artificial Sequence: Synthetic oligonucleotide
  Target: ATXN1; (-) strand; PAM type: NNGRRT; PAM sequence: TAGAAT
cgattcagtttttgtactcc

SEQ ID NO: 14167 - DNA, 20 bp, Artificial Sequence
  Description of Artificial Sequence: Synthetic oligonucleotide
  Target: ATXN1; (-) strand; PAM type: NNGRRT; PAM sequence: TAGGAT
tacttcctcactgatgagtc

SEQ ID NO: 14168 - DNA, 20 bp, Artificial Sequence
  Description of Artificial Sequence: Synthetic oligonucleotide
  Target: ATXN1; (-) strand; PAM type: NNGRRT; PAM sequence: ATGAGT
gaggaattacttcctcactg

SEQ ID NO: 14169 - DNA, 20 bp, Artificial Sequence
  Description of Artificial Sequence: Synthetic oligonucleotide
  Target: ATXN1; (-) strand; PAM type: NNGRRT; PAM sequence: AGGAAT
ttgggtacaaccggatatag

SEQ ID NO: 14170 - DNA, 20 bp, Artificial Sequence
  Description of Artificial Sequence: Synthetic oligonucleotide
  Target: ATXN1; (-) strand; PAM type: NNGRRT; PAM sequence: CCGGAT
ggtataggggttgggtacaa

SEQ ID NO: 14171 - DNA, 20 bp, Artificial Sequence
  Description of Artificial Sequence: Synthetic oligonucleotide
  Target: ATXN1; (-) strand; PAM type: NNGRRT; PAM sequence: TTGGGT
gagagagcagggtatagggg

SEQ ID NO: 14172 - DNA, 20 bp, Artificial Sequence
  Description of Artificial Sequence: Synthetic oligonucleotide
  Target: ATXN1; (-) strand; PAM type: NNGRRT; PAM sequence: AGGGGT
tatttgagagagcagggtat

SEQ ID NO: 14173 - DNA, 20 bp, Artificial Sequence
  Description of Artificial Sequence: Synthetic oligonucleotide
  Target: ATXN1; (-) strand; PAM type: NNGRRT; PAM sequence: CAGGGT
tcctttggtatttgagagag

SEQ ID NO: 14174 - DNA, 20 bp, Artificial Sequence
  Description of Artificial Sequence: Synthetic oligonucleotide
  Target: ATXN1; (-) strand; PAM type: NNGRRT; PAM sequence: GGGAGT
ctcaaaggcaaagagaaact

SEQ ID NO: 14175 - DNA, 20 bp, Artificial Sequence
  Description of Artificial Sequence: Synthetic oligonucleotide
  Target: ATXN1; (-) strand; PAM type: NNGRRT; PAM sequence: TGGGAT
aagttgggttttgtggtctg

SEQ ID NO: 14176 - DNA, 20 bp, Artificial Sequence
  Description of Artificial Sequence: Synthetic oligonucleotide
  Target: ATXN1; (-) strand; PAM type: NNGRRT; PAM sequence: TTGGGT
ggcaagaccgtccatgtaag

SEQ ID NO: 14177 - DNA, 20 bp, Artificial Sequence
  Description of Artificial Sequence: Synthetic oligonucleotide
  Target: ATXN1; (-) strand; PAM type: NNGRRT; PAM sequence: TAGAGT
gctagaaagttcaagagatc

SEQ ID NO: 14178 - DNA, 20 bp, Artificial Sequence
  Description of Artificial Sequence: Synthetic oligonucleotide
  Target: ATXN1; (-) strand; PAM type: NNGRRT; PAM sequence: TAGGAT
agggccctggttcctctggc

SEQ ID NO: 14179 - DNA, 20 bp, Artificial Sequence
  Description of Artificial Sequence: Synthetic oligonucleotide
  Target: ATXN1; (-) strand; PAM type: NNGRRT; PAM sequence: GGGGAT
ctggccatctcgctgtatcc

SEQ ID NO: 14180 - DNA, 20 bp, Artificial Sequence
  Description of Artificial Sequence: Synthetic oligonucleotide
  Target: ATXN1; (-) strand; PAM type: NNGRRT; PAM sequence: TAGAGT
cggtctccttgattagagta

SEQ ID NO: 14181 - DNA, 20 bp, Artificial Sequence
  Description of Artificial Sequence: Synthetic oligonucleotide
  Target: ATXN1; (-) strand; PAM type: NNGRRT; PAM sequence: TAGAGT
gccctctcggtctccttgat

SEQ ID NO: 14182 - DNA, 20 bp, Artificial Sequence
  Description of Artificial Sequence: Synthetic oligonucleotide
  Target: ATXN1; (-) strand; PAM type: NNGRRT; PAM sequence: ATGAAT
tctggttcccattctactag

SEQ ID NO: 14183 - DNA, 20 bp, Artificial Sequence
  Description of Artificial Sequence: Synthetic oligonucleotide
  Target: ATXN1; (-) strand; PAM type: NNGRRT; PAM sequence: TTGAGT
tcctggggaaggcttaagtc

SEQ ID NO: 14184 - DNA, 20 bp, Artificial Sequence
  Description of Artificial Sequence: Synthetic oligonucleotide
  Target: ATXN1; (-) strand; PAM type: NNGRRT; PAM sequence: CTGAGT
tgtggggttgtcctacaagt

SEQ ID NO: 14185 - DNA, 20 bp, Artificial Sequence
  Description of Artificial Sequence: Synthetic oligonucleotide
  Target: ATXN1; (-) strand; PAM type: NNGRRT; PAM sequence: TGGGGT
ggttccttccttactggttg

SEQ ID NO: 14186 - DNA, 20 bp, Artificial Sequence
  Description of Artificial Sequence: Synthetic oligonucleotide
  Target: ATXN1; (-) strand; PAM type: NNGRRT; PAM sequence: TGGGGT
caatttccttacttaggttg

SEQ ID NO: 14187 - DNA, 20 bp, Artificial Sequence
  Description of Artificial Sequence: Synthetic oligonucleotide
  Target: ATXN1; (-) strand; PAM type: NNGRRT; PAM sequence: ATGAGT
cctggtatgccatttacatc

SEQ ID NO: 14188 - DNA, 20 bp, Artificial Sequence
  Description of Artificial Sequence: Synthetic oligonucleotide
  Target: ATXN1; (-) strand; PAM type: NNGRRT; PAM sequence: CTGAGT
gaatgagtagcgcctggtac

SEQ ID NO: 14189 - DNA, 20 bp, Artificial Sequence
  Description of Artificial Sequence: Synthetic oligonucleotide
  Target: ATXN1; (-) strand; PAM type: NNGRRT; PAM sequence: ATGAGT
tttcaagcaccagtccctga

SEQ ID NO: 14190 - DNA, 20 bp, Artificial Sequence
  Description of Artificial Sequence: Synthetic oligonucleotide
  Target: ATXN1; (-) strand; PAM type: NNGRRT; PAM sequence: CTGAAT
tgtatttcaagcaccagtcc

SEQ ID NO: 14191 - DNA, 20 bp, Artificial Sequence
  Description of Artificial Sequence: Synthetic oligonucleotide
  Target: ATXN1; (-) strand; PAM type: NNGRRT; PAM sequence: CAGGGT
atcctctgggagaaaagtag

SEQ ID NO: 14192 - DNA, 20 bp, Artificial Sequence
  Description of Artificial Sequence: Synthetic oligonucleotide
  Target: ATXN1; (-) strand; PAM type: NNGRRT; PAM sequence: AAGGGT
ggttaaggtcaggattagct

SEQ ID NO: 14193 - DNA, 20 bp, Artificial Sequence
  Description of Artificial Sequence: Synthetic oligonucleotide
  Target: ATXN1; (-) strand; PAM type: NNGRRT; PAM sequence: CAGGAT
atcggtatataggttaaggt

SEQ ID NO: 14194 - DNA, 20 bp, Artificial Sequence
  Description of Artificial Sequence: Synthetic oligonucleotide
  Target: ATXN1; (-) strand; PAM type: NNGRRT; PAM sequence: TTGGGT
tcctttcccggttctaaggc

SEQ ID NO: 14195 - DNA, 20 bp, Artificial Sequence
  Description of Artificial Sequence: Synthetic oligonucleotide
  Target: ATXN1; (-) strand; PAM type: NNGRRT; PAM sequence: TAGGAT
catattgcagcatgggcatg

SEQ ID NO: 14196 - DNA, 20 bp, Artificial Sequence
  Description of Artificial Sequence: Synthetic oligonucleotide
  Target: ATXN1; (-) strand; PAM type: NNGRRT; PAM sequence: GGGGGT
atttccttgtggtatttaat

SEQ ID NO: 14197 - DNA, 20 bp, Artificial Sequence
  Description of Artificial Sequence: Synthetic oligonucleotide
  Target: ATXN1; (-) strand; PAM type: NNGRRT; PAM sequence: TTGGGT
agtgtaacactgccacctcc

SEQ ID NO: 14198 - DNA, 20 bp, Artificial Sequence
  Description of Artificial Sequence: Synthetic oligonucleotide
  Target: ATXN1; (-) strand; PAM type: NNGRRT; PAM sequence: ATGGGT
ggagggggttgttccatacc

SEQ ID NO: 14199 - DNA, 20 bp, Artificial Sequence
  Description of Artificial Sequence: Synthetic oligonucleotide
  Target: ATXN1; (-) strand; PAM type: NNGRRT; PAM sequence: GGGGGT
ctggggcttaatctcttgga

SEQ ID NO: 14200 - DNA, 20 bp, Artificial Sequence
  Description of Artificial Sequence: Synthetic oligonucleotide
  Target: ATXN1; (-) strand; PAM type: NNGRRT; PAM sequence: GGGAGT
tccccattctgtttcgatca

SEQ ID NO: 14201 - DNA, 20 bp, Artificial Sequence
  Description of Artificial Sequence: Synthetic oligonucleotide
  Target: ATXN1; (-) strand; PAM type: NNGRRT; PAM sequence: ATGAGT
tccactggctggcttcggat

SEQ ID NO: 14202 - DNA, 20 bp, Artificial Sequence
  Description of Artificial Sequence: Synthetic oligonucleotide
  Target: ATXN1; (-) strand; PAM type: NNGRRT; PAM sequence: TCGGAT
gtattttccactggctggct

SEQ ID NO: 14203 - DNA, 20 bp, Artificial Sequence
  Description of Artificial Sequence: Synthetic oligonucleotide
  Target: ATXN1; (-) strand; PAM type: NNGRRT; PAM sequence: GGGGGT
cccatgtgaaaagtttggca

SEQ ID NO: 14204 - DNA, 20 bp, Artificial Sequence
  Description of Artificial Sequence: Synthetic oligonucleotide
  Target: ATXN1; (-) strand; PAM type: NNGRRT; PAM sequence: ATGAGT
aatagggatttggccatttg

SEQ ID NO: 14205 - DNA, 20 bp, Artificial Sequence
  Description of Artificial Sequence: Synthetic oligonucleotide
  Target: ATXN1; (-) strand; PAM type: NNGRRT; PAM sequence: AGGGAT
ggagatatggccccataaat

SEQ ID NO: 14206 - DNA, 20 bp, Artificial Sequence
  Description of Artificial Sequence: Synthetic oligonucleotide
  Target: ATXN1; (-) strand; PAM type: NNGRRT; PAM sequence: TTGGAT
tcacaggctttgactacttg

SEQ ID NO: 14207 - DNA, 20 bp, Artificial Sequence
  Description of Artificial Sequence: Synthetic oligonucleotide
  Target: ATXN1; (-) strand; PAM type: NNGRRT; PAM sequence: CAGGAT
gtctaactgccagtcctctc

SEQ ID NO: 14208 - DNA, 20 bp, Artificial Sequence
  Description of Artificial Sequence: Synthetic oligonucleotide
  Target: ATXN1; (-) strand; PAM type: NNGRRT; PAM sequence: ATGGGT
aatccccttgacttaggcat

SEQ ID NO: 14209 - DNA, 20 bp, Artificial Sequence
  Description of Artificial Sequence: Synthetic oligonucleotide
  Target: ATXN1; (-) strand; PAM type: NNGRRT; PAM sequence: ATGAGT
ccaaatctgggaattatttc

SEQ ID NO: 14210 - DNA, 20 bp, Artificial Sequence
  Description of Artificial Sequence: Synthetic oligonucleotide
  Target: ATXN1; (-) strand; PAM type: NNGRRT; PAM sequence: GGGAAT
ctttggggaagcccaaatct

SEQ ID NO: 14211 - DNA, 20 bp, Artificial Sequence
  Description of Artificial Sequence: Synthetic oligonucleotide
  Target: ATXN1; (-) strand; PAM type: NNGRRT; PAM sequence: CTGAGT
cctagtgccctggaaattcc

SEQ ID NO: 14212 - DNA, 20 bp, Artificial Sequence
  Description of Artificial Sequence: Synthetic oligonucleotide
  Target: ATXN1; (-) strand; PAM type: NNGRRT; PAM sequence: GAGGAT
ttgccttctcagccttccct

SEQ ID NO: 14213 - DNA, 20 bp, Artificial Sequence
  Description of Artificial Sequence: Synthetic oligonucleotide
  Target: ATXN1; (-) strand; PAM type: NNGRRT; PAM sequence: TTGAGT
ttcgtttccttaagtgcctc

SEQ ID NO: 14214 - DNA, 20 bp, Artificial Sequence
  Description of Artificial Sequence: Synthetic oligonucleotide
  Target: ATXN1; (-) strand; PAM type: NNGRRT; PAM sequence: ATGAGT
aagagagtaggccatgggag

SEQ ID NO: 14215 - DNA, 20 bp, Artificial Sequence
  Description of Artificial Sequence: Synthetic oligonucleotide
  Target: ATXN1; (-) strand; PAM type: NNGRRT; PAM sequence: GAGAGT
ctcaacaaggccatgggcaa

SEQ ID NO: 14216 - DNA, 20 bp, Artificial Sequence
  Description of Artificial Sequence: Synthetic oligonucleotide
  Target: ATXN1; (-) strand; PAM type: NNGRRT; PAM sequence: TTGGAT
cccattttgtgaggagaatt

SEQ ID NO: 14217 - DNA, 20 bp, Artificial Sequence
  Description of Artificial Sequence: Synthetic oligonucleotide
  Target: ATXN1; (-) strand; PAM type: NNGRRT; PAM sequence: GAGAAT
actgagccccattttgtgag

SEQ ID NO: 14218 - DNA, 20 bp, Artificial Sequence
  Description of Artificial Sequence: Synthetic oligonucleotide
  Target: ATXN1; (-) strand; PAM type: NNGRRT; PAM sequence: TTGGGT
ccttgtctctgtgacatcct

SEQ ID NO: 14219 - DNA, 20 bp, Artificial Sequence
  Description of Artificial Sequence: Synthetic oligonucleotide
  Target: ATXN1; (-) strand; PAM type: NNGRRT; PAM sequence: AGGAAT
tgagtatggtccttcccaca

SEQ ID NO: 14220 - DNA, 20 bp, Artificial Sequence
  Description of Artificial Sequence: Synthetic oligonucleotide
  Target: ATXN1; (-) strand; PAM type: NNGRRT; PAM sequence: CTGAGT
agtgggggtagagaggatta

SEQ ID NO: 14221 - DNA, 20 bp, Artificial Sequence
  Description of Artificial Sequence: Synthetic oligonucleotide
  Target: ATXN1; (-) strand; PAM type: NNGRRT; PAM sequence: GAGGAT
ttaactgcagtgggggtaga

SEQ ID NO: 14222 - DNA, 20 bp, Artificial Sequence
  Description of Artificial Sequence: Synthetic oligonucleotide
  Target: ATXN1; (-) strand; PAM type: NNGRRT; PAM sequence: GGGGGT
cctgccaccttaactgcagt

SEQ ID NO: 14223 - DNA, 20 bp, Artificial Sequence
  Description of Artificial Sequence: Synthetic oligonucleotide
  Target: ATXN1; (-) strand; PAM type: NNGRRT; PAM sequence: GTGAAT
caaagtttaactcgcatgta

SEQ ID NO: 14224 - DNA, 20 bp, Artificial Sequence
  Description of Artificial Sequence: Synthetic oligonucleotide
  Target: ATXN1; (-) strand; PAM type: NNGRRT; PAM sequence: GGGGGT
atggtcctacaggttcttca

SEQ ID NO: 14225 - DNA, 20 bp, Artificial Sequence
  Description of Artificial Sequence: Synthetic oligonucleotide
  Target: ATXN1; (-) strand; PAM type: NNGRRT; PAM sequence: TGGGAT
ctataggggcctttttagtc

SEQ ID NO: 14226 - DNA, 20 bp, Artificial Sequence
  Description of Artificial Sequence: Synthetic oligonucleotide
  Target: ATXN1; (-) strand; PAM type: NNGRRT; PAM sequence: TAGGAT
aataggaaagagtttttcct

SEQ ID NO: 14227 - DNA, 20 bp, Artificial Sequence
  Description of Artificial Sequence: Synthetic oligonucleotide
  Target: ATXN1; (-) strand; PAM type: NNGRRT; PAM sequence: AAGAGT
cttatcctttttaaatagga

SEQ ID NO: 14228 - DNA, 20 bp, Artificial Sequence
  Description of Artificial Sequence: Synthetic oligonucleotide
  Target: ATXN1; (-) strand; PAM type: NNGRRT; PAM sequence: AGGAGT
aggattccattaaaggggca

SEQ ID NO: 14229 - DNA, 20 bp, Artificial Sequence
  Description of Artificial Sequence: Synthetic oligonucleotide
  Target: ATXN1; (-) strand; PAM type: NNGRRT; PAM sequence: AAGGAT
ataatgtgatgaaactgtaa

SEQ ID NO: 14230 - DNA, 20 bp, Artificial Sequence
  Description of Artificial Sequence: Synthetic oligonucleotide
  Target: ATXN1; (-) strand; PAM type: NNGRRT; PAM sequence: GAGAAT
gtatatagtcctgctgcaaa

SEQ ID NO: 14231 - DNA, 20 bp, Artificial Sequence
  Description of Artificial Sequence: Synthetic oligonucleotide
  Target: ATXN1; (-) strand; PAM type: NNGRRT; PAM sequence: TAGGAT
gtaaaaaaggttgatgtgat

SEQ ID NO: 14232 - DNA, 20 bp, Artificial Sequence
  Description of Artificial Sequence: Synthetic oligonucleotide
  Target: ATXN1; (-) strand; PAM type: NNGRRT; PAM sequence: CTGGAT
gaaatgtaagagcgtaaaag

SEQ ID NO: 14233 - DNA, 20 bp, Artificial Sequence
  Description of Artificial Sequence: Synthetic oligonucleotide
  Target: ATXN1; (-) strand; PAM type: NNGRRT; PAM sequence: TTGGAT
aggcctgataacaggttgcg

SEQ ID NO: 14234 - DNA, 20 bp, Artificial Sequence
  Description of Artificial Sequence: Synthetic oligonucleotide
  Target: ATXN1; (-) strand; PAM type: NNGRRT; PAM sequence: TGGGAT
ggagagtgtaattacactga

SEQ ID NO: 14235 - DNA, 20 bp, Artificial Sequence
  Description of Artificial Sequence: Synthetic oligonucleotide
  Target: ATXN1; (-) strand; PAM type: NNGRRT; PAM sequence: GAGAGT
tcatttggggcttgaagttg

SEQ ID NO: 14236 - DNA, 20 bp, Artificial Sequence
  Description of Artificial Sequence: Synthetic oligonucleotide
  Target: ATXN1; (-) strand; PAM type: NNGRRT; PAM sequence: TTGGGT
agccatctgaatagagcggt

SEQ ID NO: 14237 - DNA, 20 bp, Artificial Sequence
  Description of Artificial Sequence: Synthetic oligonucleotide
  Target: ATXN1; (-) strand; PAM type: NNGRRT; PAM sequence: CTGAAT
ctgagaagcggacaagccat

SEQ ID NO: 14238 - DNA, 20 bp, Artificial Sequence
  Description of Artificial Sequence: Synthetic oligonucleotide
  Target: ATXN1; (-) strand; PAM type: NNGRRT; PAM sequence: GGGAGT
caggggtgaatagtcataca

SEQ ID NO: 14239 - DNA, 20 bp, Artificial Sequence
  Description of Artificial Sequence: Synthetic oligonucleotide
  Target: ATXN1; (-) strand; PAM type: NNGRRT; PAM sequence: GTGAAT
ctgctgcagggggtccaggg

SEQ ID NO: 14240 - DNA, 20 bp, Artificial Sequence
  Description of Artificial Sequence: Synthetic oligonucleotide
  Target: ATXN1; (-) strand; PAM type: NNGRRT; PAM sequence: AGGGGT
ggtgctgctgcagggggtcc

SEQ ID NO: 14241 - DNA, 20 bp, Artificial Sequence
  Description of Artificial Sequence: Synthetic oligonucleotide
  Target: ATXN1; (-) strand; PAM type: NNGRRT; PAM sequence: GGGGGT
gtggtgggggtgctgctgca

SEQ ID NO: 14242 - DNA, 20 bp, Artificial Sequence
  Description of Artificial Sequence: Synthetic oligonucleotide
  Target: ATXN1; (-) strand; PAM type: NNGRRT; PAM sequence: GGGGGT
agaaggtattccttagtggt

SEQ ID NO: 14243 - DNA, 20 bp, Artificial Sequence
  Description of Artificial Sequence: Synthetic oligonucleotide
  Target: ATXN1; (-) strand; PAM type: NNGRRT; PAM sequence: GAGGAT
tcaagagagtgattgaaaga

SEQ ID NO: 14244 - DNA, 20 bp, Artificial Sequence
  Description of Artificial Sequence: Synthetic oligonucleotide
  Target: ATXN1; (-) strand; PAM type: NNGRRT; PAM sequence: GAGAGT
atctactaggaaccattcaa

SEQ ID NO: 14245 - DNA, 20 bp, Artificial Sequence
  Description of Artificial Sequence: Synthetic oligonucleotide
  Target: ATXN1; (-) strand; PAM type: NNGRRT; PAM sequence: CTGAGT
aaaggggtgttgggagcaaa

SEQ ID NO: 14246 - DNA, 20 bp, Artificial Sequence
  Description of Artificial Sequence: Synthetic oligonucleotide
  Target: ATXN1; (-) strand; PAM type: NNGRRT; PAM sequence: AGGGGT
agtctggtgagtggctggaa

SEQ ID NO: 14247 - DNA, 20 bp, Artificial Sequence
  Description of Artificial Sequence: Synthetic oligonucleotide
  Target: ATXN1; (-) strand; PAM type: NNGRRT; PAM sequence: GTGAGT
gtacttgccaaggtagtctg

SEQ ID NO: 14248 - DNA, 20 bp, Artificial Sequence
  Description of Artificial Sequence: Synthetic oligonucleotide
  Target: ATXN1; (-) strand; PAM type: NNGRRT; PAM sequence: TAGAGT
ttttcattttcccatactcc

SEQ ID NO: 14249 - DNA, 20 bp, Artificial Sequence
  Description of Artificial Sequence: Synthetic oligonucleotide
  Target: ATXN1; (-) strand; PAM type: NNGRRT; PAM sequence: GTGAGT
tgtgtatgttaaaaaggtgt

SEQ ID NO: 14250 - DNA, 20 bp, Artificial Sequence
  Description of Artificial Sequence: Synthetic oligonucleotide
  Target: ATXN1; (-) strand; PAM type: NNGRRT; PAM sequence: CTGGGT
cacataagaatatgccttgg

SEQ ID NO: 14251 - DNA, 20 bp, Artificial Sequence
  Description of Artificial Sequence: Synthetic oligonucleotide
  Target: ATXN1; (-) strand; PAM type: NNGRRT; PAM sequence: AAGAAT
tgtaagttgaagttccacat

SEQ ID NO: 14252 - DNA, 20 bp, Artificial Sequence
  Description of Artificial Sequence: Synthetic oligonucleotide
  Target: ATXN1; (-) strand; PAM type: NNGRRT; PAM sequence: TAGGGT
tgagctttgaggggcactga

SEQ ID NO: 14253 - DNA, 20 bp, Artificial Sequence
  Description of Artificial Sequence: Synthetic oligonucleotide
  Target: ATXN1; (-) strand; PAM type: NNGRRT; PAM sequence: AGGGGT
ctattcttaaccgtataagt

SEQ ID NO: 14254 - DNA, 20 bp, Artificial Sequence
  Description of Artificial Sequence: Synthetic oligonucleotide
  Target: ATXN1; (-) strand; PAM type: NNGRRT; PAM sequence: TAGGAT
cctttgagagtgtgtggtag

SEQ ID NO: 14255 - DNA, 20 bp, Artificial Sequence
  Description of Artificial Sequence: Synthetic oligonucleotide
  Target: ATXN1; (-) strand; PAM type: NNGRRT; PAM sequence: GAGAGT
actgtcttgagaaatccttt

SEQ ID NO: 14256 - DNA, 20 bp, Artificial Sequence
  Description of Artificial Sequence: Synthetic oligonucleotide
  Target: ATXN1; (-) strand; PAM type: NNGRRT; PAM sequence: AAGGAT
tctatttgggattgcagagt

SEQ ID NO: 14257 - DNA, 20 bp, Artificial Sequence
  Description of Artificial Sequence: Synthetic oligonucleotide
  Target: ATXN1; (-) strand; PAM type: NNGRRT; PAM sequence: CAGAGT
aaagagtctatttgggattg

SEQ ID NO: 14258 - DNA, 20 bp, Artificial Sequence
  Description of Artificial Sequence: Synthetic oligonucleotide
  Target: ATXN1; (-) strand; PAM type: NNGRRT; PAM sequence: TGGGAT
ctactgccaaagagtctatt

SEQ ID NO: 14259 - DNA, 20 bp, Artificial Sequence
  Description of Artificial Sequence: Synthetic oligonucleotide
  Target: ATXN1; (-) strand; PAM type: NNGRRT; PAM sequence: AAGAGT
ttggatattcactactgcca

SEQ ID NO: 14260 - DNA, 20 bp, Artificial Sequence
  Description of Artificial Sequence: Synthetic oligonucleotide
  Target: ATXN1; (-) strand; PAM type: NNGRRT; PAM sequence: TTGGAT
aggtctaggccttggcggtt

SEQ ID NO: 14261 - DNA, 20 bp, Artificial Sequence
  Description of Artificial Sequence: Synthetic oligonucleotide
  Target: ATXN1; (-) strand; PAM type: NNGRRT; PAM sequence: CAGAGT
agtcttctcctaagaaggtg

SEQ ID NO: 14262 - DNA, 20 bp, Artificial Sequence
  Description of Artificial Sequence: Synthetic oligonucleotide
  Target: ATXN1; (-) strand; PAM type: NNGRRT; PAM sequence: CTGAGT
ggcagcatcttgtactatcc

SEQ ID NO: 14263 - DNA, 20 bp, Artificial Sequence
  Description of Artificial Sequence: Synthetic oligonucleotide
  Target: ATXN1; (-) strand; PAM type: NNGRRT; PAM sequence: AAGAGT
ccaactctagaggttggtat

SEQ ID NO: 14264 - DNA, 20 bp, Artificial Sequence
  Description of Artificial Sequence: Synthetic oligonucleotide
  Target: ATXN1; (-) strand; PAM type: NNGRRT; PAM sequence: GTGAGT
taaaaacacagggcccgaag

SEQ ID NO: 14265 - DNA, 20 bp, Artificial Sequence
  Description of Artificial Sequence: Synthetic oligonucleotide
  Target: ATXN1; (-) strand; PAM type: NNGRRT; PAM sequence: TGGGGT
agttgtgagttgagctcatt

SEQ ID NO: 14266 - DNA, 20 bp, Artificial Sequence
  Description of Artificial Sequence: Synthetic oligonucleotide
  Target: ATXN1; (-) strand; PAM type: NNGRRT; PAM sequence: GTGAGT
aggggtccttggtagaagtt

SEQ ID NO: 14267 - DNA, 20 bp, Artificial Sequence
  Description of Artificial Sequence: Synthetic oligonucleotide
  Target: ATXN1; (-) strand; PAM type: NNGRRT; PAM sequence: AGGGGT
aagggctggtgggtcagtcc

SEQ ID NO: 14268 - DNA, 20 bp, Artificial Sequence
  Description of Artificial Sequence: Synthetic oligonucleotide
  Target: ATXN1; (-) strand; PAM type: NNGRRT; PAM sequence: GTGGGT
cactctaggccaaagggctg

SEQ ID NO: 14269 - DNA, 20 bp, Artificial Sequence
  Description of Artificial Sequence: Synthetic oligonucleotide
  Target: ATXN1; (-) strand; PAM type: NNGRRT; PAM sequence: AGGGGT
ctagctacttcctgctggat

SEQ ID NO: 14270 - DNA, 20 bp, Artificial Sequence
  Description of Artificial Sequence: Synthetic oligonucleotide
  Target: ATXN1; (-) strand; PAM type: NNGRRT; PAM sequence: CTGGAT
actgctctagctacttcctg

SEQ ID NO: 14271 - DNA, 20 bp, Artificial Sequence
  Description of Artificial Sequence: Synthetic oligonucleotide
  Target: ATXN1; (-) strand; PAM type: NNGRRT; PAM sequence: CTGGGT
accccagctgctgttgggaa

SEQ ID NO: 14272 - DNA, 20 bp, Artificial Sequence
  Description of Artificial Sequence: Synthetic oligonucleotide
  Target: ATXN1; (-) strand; PAM type: NNGRRT; PAM sequence: TAGAAT
tccctgcgattggctacctt

SEQ ID NO: 14273 - DNA, 20 bp, Artificial Sequence
  Description of Artificial Sequence: Synthetic oligonucleotide
  Target: ATXN1; (-) strand; PAM type: NNGRRT; PAM sequence: CAGAGT
atgttccatttctgttctgt

SEQ ID NO: 14274 - DNA, 20 bp, Artificial Sequence
  Description of Artificial Sequence: Synthetic oligonucleotide
  Target: ATXN1; (-) strand; PAM type: NNGRRT; PAM sequence: GTGGGT
cagcgtggaaggggacccaa

SEQ ID NO: 14275 - DNA, 20 bp, Artificial Sequence
  Description of Artificial Sequence: Synthetic oligonucleotide
  Target: ATXN1; (-) strand; PAM type: NNGRRT; PAM sequence: AAGAGT
ttaaagatggcatggaccca

SEQ ID NO: 14276 - DNA, 20 bp, Artificial Sequence
  Description of Artificial Sequence: Synthetic oligonucleotide
  Target: ATXN1; (-) strand; PAM type: NNGRRT; PAM sequence: GTGAGT
tggagctgcggaccttcatg

SEQ ID NO: 14277 - DNA, 20 bp, Artificial Sequence
  Description of Artificial Sequence: Synthetic oligonucleotide
  Target: ATXN1; (-) strand; PAM type: NNGRRT; PAM sequence: AAGAAT
tttatggtctcgctgacttc

SEQ ID NO: 14278 - DNA, 20 bp, Artificial Sequence
  Description of Artificial Sequence: Synthetic oligonucleotide
  Target: ATXN1; (-) strand; PAM type: NNGRRT; PAM sequence: GTGGGT
tctggagttggttcctaccg

SEQ ID NO: 14279 - DNA, 20 bp, Artificial Sequence
  Description of Artificial Sequence: Synthetic oligonucleotide
  Target: ATXN1; (-) strand; PAM type: NNGRRT; PAM sequence: TGGAGT
cctctatgtctttttgtgtc

SEQ ID NO: 14280 - DNA, 20 bp, Artificial Sequence
  Description of Artificial Sequence: Synthetic oligonucleotide
  Target: ATXN1; (-) strand; PAM type: NNGRRT; PAM sequence: TGGAAT
tttccaaaatgtcataaagt

SEQ ID NO: 14281 - DNA, 20 bp, Artificial Sequence
  Description of Artificial Sequence: Synthetic oligonucleotide
  Target: ATXN1; (-) strand; PAM type: NNGRRT; PAM sequence: TAGAGT
ctaaagtctatagttcatgt

SEQ ID NO: 14282 - DNA, 20 bp, Artificial Sequence
  Description of Artificial Sequence: Synthetic oligonucleotide
  Target: ATXN1; (-) strand; PAM type: NNGRRT; PAM sequence: ATGGAT
tttgttgaaattgaactaat

SEQ ID NO: 14283 - DNA, 20 bp, Artificial Sequence
  Description of Artificial Sequence: Synthetic oligonucleotide
  Target: ATXN1; (-) strand; PAM type: NNGRRT; PAM sequence: AAGAGT
aaaattgatttgaaagtaca

SEQ ID NO: 14284 - DNA, 20 bp, Artificial Sequence
  Description of Artificial Sequence: Synthetic oligonucleotide
  Target: ATXN1; (-) strand; PAM type: NNGRRT; PAM sequence: TGGGAT
gccttggcctcccaaagtgc

SEQ ID NO: 14285 - DNA, 20 bp, Artificial Sequence
  Description of Artificial Sequence: Synthetic oligonucleotide
  Target: ATXN1; (-) strand; PAM type: NNGRRT; PAM sequence: CGGGGT
ttttctatttttagtagaga

SEQ ID NO: 14286 - DNA, 20 bp, Artificial Sequence
  Description of Artificial Sequence: Synthetic oligonucleotide
  Target: ATXN1; (-) strand; PAM type: NNGRRT; PAM sequence: CTGGGT
ctcacggcaacctccgtctc

SEQ ID NO: 14287 - DNA, 20 bp, Artificial Sequence
  Description of Artificial Sequence: Synthetic oligonucleotide
  Target: ATXN1; (-) strand; PAM type: NNGRRT; PAM sequence: TGGAGT
ttcactcttgtcacccaggc

SEQ ID NO: 14288 - DNA, 20 bp, Artificial Sequence
  Description of Artificial Sequence: Synthetic oligonucleotide
  Target: ATXN1; (-) strand; PAM type: NNGRRT; PAM sequence: TGGAAT
ttttgttttgtttttggaaa

SEQ ID NO: 14289 - DNA, 20 bp, Artificial Sequence
  Description of Artificial Sequence: Synthetic oligonucleotide
  Target: ATXN1; (-) strand; PAM type: NNGRRT; PAM sequence: GGGAGT
tagcccttcaaaccttgcct

SEQ ID NO: 14290 - DNA, 20 bp, Artificial Sequence
  Description of Artificial Sequence: Synthetic oligonucleotide
  Target: ATXN1; (-) strand; PAM type: NNGRRT; PAM sequence: CTGAAT
gcccttgccctcatccccat

SEQ ID NO: 14291 - DNA, 20 bp, Artificial Sequence
  Description of Artificial Sequence: Synthetic oligonucleotide
  Target: ATXN1; (-) strand; PAM type: NNGRRT; PAM sequence: TGGAGT
tcatgagctttcccagagtc

SEQ ID NO: 14292 - DNA, 20 bp, Artificial Sequence
  Description of Artificial Sequence: Synthetic oligonucleotide
  Target: ATXN1; (-) strand; PAM type: NNGRRT; PAM sequence: CAGAGT
gattgcatcatgagctttcc

SEQ ID NO: 14293 - DNA, 20 bp, Artificial Sequence
  Description of Artificial Sequence: Synthetic oligonucleotide
  Target: ATXN1; (-) strand; PAM type: NNGRRT; PAM sequence: TAGAAT
ttggaaattatgcattccct

SEQ ID NO: 14294 - DNA, 20 bp, Artificial Sequence
  Description of Artificial Sequence: Synthetic oligonucleotide
  Target: ATXN1; (-) strand; PAM type: NNGRRT; PAM sequence: TGGGAT
gccttggcctcccaaagtgc

SEQ ID NO: 14295 - DNA, 20 bp, Artificial Sequence
  Description of Artificial Sequence: Synthetic oligonucleotide
  Target: ATXN1; (-) strand; PAM type: NNGRRT; PAM sequence: CAGGAT
tggggtttcactgtgttagc

SEQ ID NO: 14296 - DNA, 20 bp, Artificial Sequence
  Description of Artificial Sequence: Synthetic oligonucleotide
  Target: ATXN1; (-) strand; PAM type: NNGRRT; PAM sequence: TGGGGT
ttttgtatttttagtagaga

SEQ ID NO: 14297 - DNA, 20 bp, Artificial Sequence
  Description of Artificial Sequence: Synthetic oligonucleotide
  Target: ATXN1; (-) strand; PAM type: NNGRRT; PAM sequence: TGGGAT
gcctcagcctccctagtagc

SEQ ID NO: 14298 - DNA, 20 bp, Artificial Sequence
  Description of Artificial Sequence: Synthetic oligonucleotide
  Target: ATXN1; (-) strand; PAM type: NNGRRT; PAM sequence: CTGGGT
actgcaatctctgcccccgc

SEQ ID NO: 14299 - DNA, 20 bp, Artificial Sequence
  Description of Artificial Sequence: Synthetic oligonucleotide
  Target: ATXN1; (-) strand; PAM type: NNGRRT; PAM sequence: TGGAGT
tctgactctgtcacccagac

SEQ ID NO: 14300 - DNA, 20 bp, Artificial Sequence
  Description of Artificial Sequence: Synthetic oligonucleotide
  Target: ATXN1; (-) strand; PAM type: NNGRRT; PAM sequence: TGGGGT
ttttttttttttttttgaga

SEQ ID NO: 14301 - DNA, 20 bp, Artificial Sequence
  Description of Artificial Sequence: Synthetic oligonucleotide
  Target: ATXN1; (-) strand; PAM type: NNGRRT; PAM sequence: TTGGGT
cttgatagagagttatcctc

SEQ ID NO: 14302 - DNA, 20 bp, Artificial Sequence
  Description of Artificial Sequence: Synthetic oligonucleotide
  Target: ATXN1; (-) strand; PAM type: NNGRRT; PAM sequence: GAGAGT
tctaggaaccctacttgata

SEQ ID NO: 14303 - DNA, 20 bp, Artificial Sequence
  Description of Artificial Sequence: Synthetic oligonucleotide
  Target: ATXN1; (-) strand; PAM type: NNGRRT; PAM sequence: GAGAAT
tatcctaaatatgatcagat

SEQ ID NO: 14304 - DNA, 20 bp, Artificial Sequence
  Description of Artificial Sequence: Synthetic oligonucleotide
  Target: ATXN1; (-) strand; PAM type: NNGRRT; PAM sequence: TTGGAT
aagttcttcgatttcaccag

SEQ ID NO: 14305 - DNA, 20 bp, Artificial Sequence
  Description of Artificial Sequence: Synthetic oligonucleotide
  Target: ATXN1; (-) strand; PAM type: NNGRRT; PAM sequence: AAGAGT
cttttccagtatatgaatgt

SEQ ID NO: 14306 - DNA, 20 bp, Artificial Sequence
  Description of Artificial Sequence: Synthetic oligonucleotide
  Target: ATXN1; (-) strand; PAM type: NNGRRT; PAM sequence: ATGAAT
gctactgacttttccagtat

SEQ ID NO: 14307 - DNA, 20 bp, Artificial Sequence
  Description of Artificial Sequence: Synthetic oligonucleotide
  Target: ATXN1; (-) strand; PAM type: NNGRRT; PAM sequence: CTGAAT
agttgtgaatgtctttccat

SEQ ID NO: 14308 - DNA, 20 bp, Artificial Sequence
  Description of Artificial Sequence: Synthetic oligonucleotide
  Target: ATXN1; (-) strand; PAM type: NNGRRT; PAM sequence: GTGAAT
tctctcacattgcaaaagtt

SEQ ID NO: 14309 - DNA, 20 bp, Artificial Sequence
  Description of Artificial Sequence: Synthetic oligonucleotide
  Target: ATXN1; (-) strand; PAM type: NNGRRT; PAM sequence: TAGAAT
tacatgtagctttacagaaa

SEQ ID NO: 14310 - DNA, 20 bp, Artificial Sequence
  Description of Artificial Sequence: Synthetic oligonucleotide
  Target: ATXN1; (-) strand; PAM type: NNGRRT; PAM sequence: ATGGAT
tttcttccagaagattttct

SEQ ID NO: 14311 - DNA, 20 bp, Artificial Sequence
  Description of Artificial Sequence: Synthetic oligonucleotide
  Target: ATXN1; (-) strand; PAM type: NNGRRT; PAM sequence: TTGAGT
atgttcaccaccgttagcat

SEQ ID NO: 14312 - DNA, 20 bp, Artificial Sequence
  Description of Artificial Sequence: Synthetic oligonucleotide
  Target: ATXN1; (-) strand; PAM type: NNGRRT; PAM sequence: ATGGAT
tgaaaacattagtcttttac

SEQ ID NO: 14313 - DNA, 20 bp, Artificial Sequence
  Description of Artificial Sequence: Synthetic oligonucleotide
  Target: ATXN1; (-) strand; PAM type: NNGRRT; PAM sequence: TTGAGT
aggaagacgttattggaaac

SEQ ID NO: 14314 - DNA, 20 bp, Artificial Sequence
  Description of Artificial Sequence: Synthetic oligonucleotide
  Target: ATXN1; (-) strand; PAM type: NNGRRT; PAM sequence: CAGGAT
ctttgttttcccttgtgcat

SEQ ID NO: 14315 - DNA, 20 bp, Artificial Sequence
  Description of Artificial Sequence: Synthetic oligonucleotide
  Target: ATXN1; (-) strand; PAM type: NNGRRT; PAM sequence: GGGGGT
agtgctggggatgtgtgggt

SEQ ID NO: 14316 - DNA, 20 bp, Artificial Sequence
  Description of Artificial Sequence: Synthetic oligonucleotide
  Target: ATXN1; (-) strand; PAM type: NNGRRT; PAM sequence: GTGGGT
aaaacaagtgctggggatgt

SEQ ID NO: 14317 - DNA, 20 bp, Artificial Sequence
  Description of Artificial Sequence: Synthetic oligonucleotide
  Target: ATXN1; (-) strand; PAM type: NNGRRT; PAM sequence: GGGGAT
gagtcaagaaaacaagtgct

SEQ ID NO: 14318 - DNA, 20 bp, Artificial Sequence
  Description of Artificial Sequence: Synthetic oligonucleotide
  Target: ATXN1; (-) strand; PAM type: NNGRRT; PAM sequence: CAGAGT
actaatcaagaaagcgcctc

SEQ ID NO: 14319 - DNA, 20 bp, Artificial Sequence
  Description of Artificial Sequence: Synthetic oligonucleotide
  Target: ATXN1; (-) strand; PAM type: NNGRRT; PAM sequence: TGGGGT
ttcatacataatttgcatca

SEQ ID NO: 14320 - DNA, 20 bp, Artificial Sequence
  Description of Artificial Sequence: Synthetic oligonucleotide
  Target: ATXN1; (-) strand; PAM type: NNGRRT; PAM sequence: TAGAAT
tgaggagcatatctccgtga

SEQ ID NO: 14321 - DNA, 20 bp, Artificial Sequence
  Description of Artificial Sequence: Synthetic oligonucleotide
  Target: ATXN1; (-) strand; PAM type: NNGRRT; PAM sequence: GTGGAT
accgtgcgtccctctggttt

SEQ ID NO: 14322 - DNA, 20 bp, Artificial Sequence
  Description of Artificial Sequence: Synthetic oligonucleotide
  Target: ATXN1; (-) strand; PAM type: NNGRRT; PAM sequence: TGGGAT
gtctttaaaaatactgtcac

SEQ ID NO: 14323 - DNA, 20 bp, Artificial Sequence
  Description of Artificial Sequence: Synthetic oligonucleotide
  Target: ATXN1; (-) strand; PAM type: NNGRRT; PAM sequence: TAGAGT
agttcagaaaagatggtaga

SEQ ID NO: 14324 - DNA, 20 bp, Artificial Sequence
  Description of Artificial Sequence: Synthetic oligonucleotide
  Target: ATXN1; (-) strand; PAM type: NNGRRT; PAM sequence: AAGAAT
gtgaatgtatgcccatagaa

SEQ ID NO: 14325 - DNA, 20 bp, Artificial Sequence
  Description of Artificial Sequence: Synthetic oligonucleotide
  Target: ATXN1; (-) strand; PAM type: NNGRRT; PAM sequence: GTGAAT
aactacagtaaatagctata

SEQ ID NO: 14326 - DNA, 20 bp, Artificial Sequence
  Description of Artificial Sequence: Synthetic oligonucleotide
  Target: ATXN1; (-) strand; PAM type: NNGRRT; PAM sequence: TAGGAT
atactcctacattaatgcaa

SEQ ID NO: 14327 - DNA, 20 bp, Artificial Sequence
  Description of Artificial Sequence: Synthetic oligonucleotide
  Target: ATXN1; (-) strand; PAM type: NNGRRT; PAM sequence: CAGGGT
ttacctactaaaattttgga

SEQ ID NO: 14328 - DNA, 20 bp, Artificial Sequence
  Description of Artificial Sequence: Synthetic oligonucleotide
  Target: ATXN1; (-) strand; PAM type: NNGRRT; PAM sequence: TGGAAT
aacaggaaacaagtactaaa

SEQ ID NO: 14329 - DNA, 20 bp, Artificial Sequence
  Description of Artificial Sequence: Synthetic oligonucleotide
  Target: ATXN1; (-) strand; PAM type: NNGRRT; PAM sequence: GAGAAT
aaatggaatgtctttaccaa

SEQ ID NO: 14330 - DNA, 20 bp, Artificial Sequence
  Description of Artificial Sequence: Synthetic oligonucleotide
  Target: ATXN1; (-) strand; PAM type: NNGRRT; PAM sequence: TGGAAT
tcactagatagaaatagaaa

SEQ ID NO: 14331 - DNA, 20 bp, Artificial Sequence
  Description of Artificial Sequence: Synthetic oligonucleotide
  Target: ATXN1; (-) strand; PAM type: NNGRRT; PAM sequence: CAGAGT
cttactttagtctctagcct

SEQ ID NO: 14332 - DNA, 20 bp, Artificial Sequence
  Description of Artificial Sequence: Synthetic oligonucleotide
  Target: ATXN1; (-) strand; PAM type: NNGRRT; PAM sequence: CAGAGT
ctgcactccagcctgggcga

SEQ ID NO: 14333 - DNA, 20 bp, Artificial Sequence
  Description of Artificial Sequence: Synthetic oligonucleotide
  Target: ATXN1; (-) strand; PAM type: NNGRRT; PAM sequence: GAGAAT
tactcaggaggctgaggcgg

SEQ ID NO: 14334 - DNA, 20 bp, Artificial Sequence
  Description of Artificial Sequence: Synthetic oligonucleotide
  Target: ATXN1; (-) strand; PAM type: NNGRRT; PAM sequence: AGGGAT
ataccagcaactcctagccc

SEQ ID NO: 14335 - DNA, 20 bp, Artificial Sequence
  Description of Artificial Sequence: Synthetic oligonucleotide
  Target: ATXN1; (-) strand; PAM type: NNGRRT; PAM sequence: GGGAGT
ttaacaatctgcttagaaag

SEQ ID NO: 14336 - DNA, 20 bp, Artificial Sequence
  Description of Artificial Sequence: Synthetic oligonucleotide
  Target: ATXN1; (-) strand; PAM type: NNGRRT; PAM sequence: GTGGAT
cagggacttggtccagatga

SEQ ID NO: 14337 - DNA, 20 bp, Artificial Sequence
  Description of Artificial Sequence: Synthetic oligonucleotide
  Target: ATXN1; (-) strand; PAM type: NNGRRT; PAM sequence: ATGAGT
ggtgcagggacttggtccag

SEQ ID NO: 14338 - DNA, 20 bp, Artificial Sequence
  Description of Artificial Sequence: Synthetic oligonucleotide
  Target: ATXN1; (-) strand; PAM type: NNGRRT; PAM sequence: TTGGGT
atttattcatcaagcattta

SEQ ID NO: 14339 - DNA, 20 bp, Artificial Sequence
  Description of Artificial Sequence: Synthetic oligonucleotide
  Target: ATXN1; (-) strand; PAM type: NNGRRT; PAM sequence: TAGAAT
gttggtttttcaggccctaa

SEQ ID NO: 14340 - DNA, 20 bp, Artificial Sequence
  Description of Artificial Sequence: Synthetic oligonucleotide
  Target: ATXN1; (-) strand; PAM type: NNGRRT; PAM sequence: TAGAAT
tatatttttgcttctcctga

SEQ ID NO: 14341 - DNA, 20 bp, Artificial Sequence
  Description of Artificial Sequence: Synthetic oligonucleotide
  Target: ATXN1; (-) strand; PAM type: NNGRRT; PAM sequence: GTGAAT
taagatattagcaccttggt

SEQ ID NO: 14342 - DNA, 20 bp, Artificial Sequence
  Description of Artificial Sequence: Synthetic oligonucleotide
  Target: ATXN1; (-) strand; PAM type: NNGRRT; PAM sequence: TGGGAT
gcctcggcctcccaaagcac

SEQ ID NO: 14343 - DNA, 20 bp, Artificial Sequence
  Description of Artificial Sequence: Synthetic oligonucleotide
  Target: ATXN1; (-) strand; PAM type: NNGRRT; PAM sequence: CAGGGT
ttttgtatttttagtagggt

SEQ ID NO: 14344 - DNA, 20 bp, Artificial Sequence
  Description of Artificial Sequence: Synthetic oligonucleotide
  Target: ATXN1; (-) strand; PAM type: NNGRRT; PAM sequence: TAGGGT
ggctaattttgtatttttag

SEQ ID NO: 14345 - DNA, 20 bp, Artificial Sequence
  Description of Artificial Sequence: Synthetic oligonucleotide
  Target: ATXN1; (-) strand; PAM type: NNGRRT; PAM sequence: TGGGAT
gcctcagcctcccaagtagc

SEQ ID NO: 14346 - DNA, 20 bp, Artificial Sequence
  Description of Artificial Sequence: Synthetic oligonucleotide
  Target: ATXN1; (-) strand; PAM type: NNGRRT; PAM sequence: TGGAGT
tttgctcttgttgcccaggc

SEQ ID NO: 14347 - DNA, 20 bp, Artificial Sequence
  Description of Artificial Sequence: Synthetic oligonucleotide
  Target: ATXN1; (-) strand; PAM type: NNGRRT; PAM sequence: CAGAGT
tcttttttttttttttgaga

SEQ ID NO: 14348 - DNA, 20 bp, Artificial Sequence
  Description of Artificial Sequence: Synthetic oligonucleotide
  Target: ATXN1; (-) strand; PAM type: NNGRRT; PAM sequence: ATGAGT
ttaataatgctgctatggat

SEQ ID NO: 14349 - DNA, 20 bp, Artificial Sequence
  Description of Artificial Sequence: Synthetic oligonucleotide
  Target: ATXN1; (-) strand; PAM type: NNGRRT; PAM sequence: ATGGAT
ttattgttaataatgctgct

SEQ ID NO: 14350 - DNA, 20 bp, Artificial Sequence
  Description of Artificial Sequence: Synthetic oligonucleotide
  Target: ATXN1; (-) strand; PAM type: NNGRRT; PAM sequence: TTGGGT
cttcatctatcagtgggcac

SEQ ID NO: 14351 - DNA, 20 bp, Artificial Sequence
  Description of Artificial Sequence: Synthetic oligonucleotide
  Target: ATXN1; (-) strand; PAM type: NNGRRT; PAM sequence: CTGAAT
gaatttccttcctttttaga

SEQ ID NO: 14352 - DNA, 20 bp, Artificial Sequence
  Description of Artificial Sequence: Synthetic oligonucleotide
  Target: ATXN1; (-) strand; PAM type: NNGRRT; PAM sequence: CAGAAT
ctgtctgtgctatagcatgt

SEQ ID NO: 14353 - DNA, 20 bp, Artificial Sequence
  Description of Artificial Sequence: Synthetic oligonucleotide
  Target: ATXN1; (-) strand; PAM type: NNGRRT; PAM sequence: TGGAAT
ctgtaagtggctcatataag

SEQ ID NO: 14354 - DNA, 20 bp, Artificial Sequence
  Description of Artificial Sequence: Synthetic oligonucleotide
  Target: ATXN1; (-) strand; PAM type: NNGRRT; PAM sequence: CTGAAT
cctctttttttctggcaaaa

SEQ ID NO: 14355 - DNA, 20 bp, Artificial Sequence
  Description of Artificial Sequence: Synthetic oligonucleotide
  Target: ATXN1; (-) strand; PAM type: NNGRRT; PAM sequence: TTGGGT
ctgatcccaggggagatctt

SEQ ID NO: 14356 - DNA, 20 bp, Artificial Sequence
  Description of Artificial Sequence: Synthetic oligonucleotide
  Target: ATXN1; (-) strand; PAM type: NNGRRT; PAM sequence: CTGAAT
gctgaaattacaagcatggc

SEQ ID NO: 14357 - DNA, 20 bp, Artificial Sequence
  Description of Artificial Sequence: Synthetic oligonucleotide
  Target: ATXN1; (-) strand; PAM type: NNGRRT; PAM sequence: AAGGAT
tttcaaaggctaagggttgg

SEQ ID NO: 14358 - DNA, 20 bp, Artificial Sequence
  Description of Artificial Sequence: Synthetic oligonucleotide
  Target: ATXN1; (-) strand; PAM type: NNGRRT; PAM sequence: AAGGGT
aattgcatttttcaaaggct

SEQ ID NO: 14359 - DNA, 20 bp, Artificial Sequence
  Description of Artificial Sequence: Synthetic oligonucleotide
  Target: ATXN1; (-) strand; PAM type: NNGRRT; PAM sequence: TAGGAT
aagctgatagagaccttggc

SEQ ID NO: 14360 - DNA, 20 bp, Artificial Sequence
  Description of Artificial Sequence: Synthetic oligonucleotide
  Target: ATXN1; (-) strand; PAM type: NNGRRT; PAM sequence: ACGAAT
actctctgttccctttccag

SEQ ID NO: 14361 - DNA, 20 bp, Artificial Sequence
  Description of Artificial Sequence: Synthetic oligonucleotide
  Target: ATXN1; (-) strand; PAM type: NNGRRT; PAM sequence: TGGAAT
tcagatagcagggagattat

SEQ ID NO: 14362 - DNA, 20 bp, Artificial Sequence
  Description of Artificial Sequence: Synthetic oligonucleotide
  Target: ATXN1; (-) strand; PAM type: NNGRRT; PAM sequence: TTGAAT
gatgaagcccttttcaagtt

SEQ ID NO: 14363 - DNA, 20 bp, Artificial Sequence
  Description of Artificial Sequence: Synthetic oligonucleotide
  Target: ATXN1; (-) strand; PAM type: NNGRRT; PAM sequence: GGGAAT
taacttacattgtgatggtt

SEQ ID NO: 14364 - DNA, 20 bp, Artificial Sequence
  Description of Artificial Sequence: Synthetic oligonucleotide
  Target: ATXN1; (-) strand; PAM type: NNGRRT; PAM sequence: CAGGAT
tactaaccatagttcagttt

SEQ ID NO: 14365 - DNA, 20 bp, Artificial Sequence
  Description of Artificial Sequence: Synthetic oligonucleotide
  Target: ATXN1; (-) strand; PAM type: NNGRRT; PAM sequence: AGGAAT
ctactcattgcagcaaactc

SEQ ID NO: 14366 - DNA, 20 bp, Artificial Sequence
  Description of Artificial Sequence: Synthetic oligonucleotide
  Target: ATXN1; (-) strand; PAM type: NNGRRT; PAM sequence: GCGAAT
ctgcccagctacagagaggt

SEQ ID NO: 14367 - DNA, 20 bp, Artificial Sequence
  Description of Artificial Sequence: Synthetic oligonucleotide
  Target: ATXN1; (-) strand; PAM type: NNGRRT; PAM sequence: CCGAGT
gttaaggcctgttaggtatt

SEQ ID NO: 14368 - DNA, 20 bp, Artificial Sequence
  Description of Artificial Sequence: Synthetic oligonucleotide
  Target: ATXN1; (-) strand; PAM type: NNGRRT; PAM sequence: GGGGGT
cctcttcttgattaatgcat

SEQ ID NO: 14369 - DNA, 20 bp, Artificial Sequence
  Description of Artificial Sequence: Synthetic oligonucleotide
  Target: ATXN1; (-) strand; PAM type: NNGRRT; PAM sequence: ATGGGT
cattctaagctgccagggac

SEQ ID NO: 14370 - DNA, 20 bp, Artificial Sequence
  Description of Artificial Sequence: Synthetic oligonucleotide
  Target: ATXN1; (-) strand; PAM type: NNGRRT; PAM sequence: CTGAGT
gccacctgcgtgttatttca

SEQ ID NO: 14371 - DNA, 20 bp, Artificial Sequence
  Description of Artificial Sequence: Synthetic oligonucleotide
  Target: ATXN1; (-) strand; PAM type: NNGRRT; PAM sequence: TGGGGT
aatcttcttatttttggaag

SEQ ID NO: 14372 - DNA, 20 bp, Artificial Sequence
  Description of Artificial Sequence: Synthetic oligonucleotide
  Target: ATXN1; (-) strand; PAM type: NNGRRT; PAM sequence: TAGAAT
gagtagacagtaaaaaaaaa

SEQ ID NO: 14373 - DNA, 20 bp, Artificial Sequence
  Description of Artificial Sequence: Synthetic oligonucleotide
  Target: ATXN1; (-) strand; PAM type: NNGRRT; PAM sequence: TGGAGT
gtaatctgttctagagtgta

SEQ ID NO: 14374 - DNA, 20 bp, Artificial Sequence
  Description of Artificial Sequence: Synthetic oligonucleotide
  Target: ATXN1; (-) strand; PAM type: NNGRRT; PAM sequence: TAGAGT
aatatgtatgtaatctgttc

SEQ ID NO: 14375 - DNA, 20 bp, Artificial Sequence
  Description of Artificial Sequence: Synthetic oligonucleotide
  Target: ATXN1; (-) strand; PAM type: NNGRRT; PAM sequence: AGGGAT
atagaacaagtgccagaaga

SEQ ID NO: 14376 - DNA, 20 bp, Artificial Sequence
  Description of Artificial Sequence: Synthetic oligonucleotide
  Target: ATXN1; (-) strand; PAM type: NNGRRT; PAM sequence: TGGAAT
aatgaaaacatggcatgttt

SEQ ID NO: 14377 - DNA, 20 bp, Artificial Sequence
  Description of Artificial Sequence: Synthetic oligonucleotide
  Target: ATXN1; (-) strand; PAM type: NNGRRT; PAM sequence: CAGAGT
agcatttttgacatttttat

SEQ ID NO: 14378 - DNA, 20 bp, Artificial Sequence
  Description of Artificial Sequence: Synthetic oligonucleotide
  Target: ATXN1; (-) strand; PAM type: NNGRRT; PAM sequence: GAGGGT
atgcattttcaaagacagga

SEQ ID NO: 14379 - DNA, 20 bp, Artificial Sequence
  Description of Artificial Sequence: Synthetic oligonucleotide
  Target: ATXN1; (-) strand; PAM type: NNGRRT; PAM sequence: TGGGAT
caccagcactgctaactgaa

SEQ ID NO: 14380 - DNA, 20 bp, Artificial Sequence
  Description of Artificial Sequence: Synthetic oligonucleotide
  Target: ATXN1; (-) strand; PAM type: NNGRRT; PAM sequence: CTGAAT
cttatcaccagcactgctaa

SEQ ID NO: 14381 - DNA, 20 bp, Artificial Sequence
  Description of Artificial Sequence: Synthetic oligonucleotide
  Target: ATXN1; (-) strand; PAM type: NNGRRT; PAM sequence: AGGGGT
ggttctgctctggcaccttt

SEQ ID NO: 14382 - DNA, 20 bp, Artificial Sequence
  Description of Artificial Sequence: Synthetic oligonucleotide
  Target: ATXN1; (-) strand; PAM type: NNGRRT; PAM sequence: CAGGGT
tgtcagcattaaactcaatg

SEQ ID NO: 14383 - DNA, 20 bp, Artificial Sequence
  Description of Artificial Sequence: Synthetic oligonucleotide
  Target: ATXN1; (-) strand; PAM type: NNGRRT; PAM sequence: TGGAGT
gttcgaacagactgactgat

SEQ ID NO: 14384 - DNA, 20 bp, Artificial Sequence
  Description of Artificial Sequence: Synthetic oligonucleotide
  Target: ATXN1; (-) strand; PAM type: NNGRRT; PAM sequence: AAGAGT
tctgaccttttctccaatca

SEQ ID NO: 14385 - DNA, 20 bp, Artificial Sequence
  Description of Artificial Sequence: Synthetic oligonucleotide
  Target: ATXN1; (-) strand; PAM type: NNGRRT; PAM sequence: GGGAAT
ccaaataattgaaaataaat

SEQ ID NO: 14386 - DNA, 20 bp, Artificial Sequence
  Description of Artificial Sequence: Synthetic oligonucleotide
  Target: ATXN1; (-) strand; PAM type: NNGRRT; PAM sequence: AAGAGT
cattaaaaaagaacatacag

SEQ ID NO: 14387 - DNA, 20 bp, Artificial Sequence
  Description of Artificial Sequence: Synthetic oligonucleotide
  Target: ATXN1; (-) strand; PAM type: NNGRRT; PAM sequence: TGGGGT
gctgggtatttttcagtcct

SEQ ID NO: 14388 - DNA, 20 bp, Artificial Sequence
  Description of Artificial Sequence: Synthetic oligonucleotide
  Target: ATXN1; (-) strand; PAM type: NNGRRT; PAM sequence: CTGGGT
ctgatatcgggtcggagtgg

SEQ ID NO: 14389 - DNA, 20 bp, Artificial Sequence
  Description of Artificial Sequence: Synthetic oligonucleotide
  Target: ATXN1; (-) strand; PAM type: NNGRRT; PAM sequence: CGGAGT
gaaactgcctgatatcgggt

SEQ ID NO: 14390 - DNA, 20 bp, Artificial Sequence
  Description of Artificial Sequence: Synthetic oligonucleotide
  Target: ATXN1; (-) strand; PAM type: NNGRRT; PAM sequence: TCGGGT
gtcactgaaactgcctgata

SEQ ID NO: 14391 - DNA, 20 bp, Artificial Sequence
  Description of Artificial Sequence: Synthetic oligonucleotide
  Target: ATXN1; (-) strand; PAM type: NNGRRT; PAM sequence: AAGAGT
ttcaccaaattcaagtcgcc

SEQ ID NO: 14392 - DNA, 20 bp, Artificial Sequence
  Description of Artificial Sequence: Synthetic oligonucleotide
  Target: ATXN1; (-) strand; PAM type: NNGRRT; PAM sequence: TCGGAT
ctcaaaatgcttctctgacc

SEQ ID NO: 14393 - DNA, 20 bp, Artificial Sequence
  Description of Artificial Sequence: Synthetic oligonucleotide
  Target: ATXN1; (-) strand; PAM type: NNGRRT; PAM sequence: CTGAGT
aataaacacctaccaagggg

SEQ ID NO: 14394 - DNA, 20 bp, Artificial Sequence
  Description of Artificial Sequence: Synthetic oligonucleotide
  Target: ATXN1; (-) strand; PAM type: NNGRRT; PAM sequence: TTGGGT
cctgccagactccaatgtcc

SEQ ID NO: 14395 - DNA, 20 bp, Artificial Sequence
  Description of Artificial Sequence: Synthetic oligonucleotide
  Target: ATXN1; (-) strand; PAM type: NNGRRT; PAM sequence: TGGGAT
ttcctcacctcgctcctttg

SEQ ID NO: 14396 - DNA, 20 bp, Artificial Sequence
  Description of Artificial Sequence: Synthetic oligonucleotide
  Target: ATXN1; (-) strand; PAM type: NNGRRT; PAM sequence: ATGAAT
aggtcatcagcaatatccgt

SEQ ID NO: 14397 - DNA, 20 bp, Artificial Sequence
  Description of Artificial Sequence: Synthetic oligonucleotide
  Target: ATXN1; (-) strand; PAM type: NNGRRT; PAM sequence: AGGGAT
agtttccaaagagatgaccc

SEQ ID NO: 14398 - DNA, 20 bp, Artificial Sequence
  Description of Artificial Sequence: Synthetic oligonucleotide
  Target: ATXN1; (-) strand; PAM type: NNGRRT; PAM sequence: CAGGAT
ggtcattgaaagagtttaag

SEQ ID NO: 14399 - DNA, 20 bp, Artificial Sequence
  Description of Artificial Sequence: Synthetic oligonucleotide
  Target: ATXN1; (-) strand; PAM type: NNGRRT; PAM sequence: AAGAGT
gacaggggagtggtcattga

SEQ ID NO: 14400 - DNA, 20 bp, Artificial Sequence
  Description of Artificial Sequence: Synthetic oligonucleotide
  Target: ATXN1; (-) strand; PAM type: NNGRRT; PAM sequence: GGGAGT
agagtttatcttgaagacag

SEQ ID NO: 14401 - DNA, 20 bp, Artificial Sequence
  Description of Artificial Sequence: Synthetic oligonucleotide
  Target: ATXN1; (-) strand; PAM type: NNGRRT; PAM sequence: TAGAGT
gtaagttctgctgaggagtt

SEQ ID NO: 14402 - DNA, 20 bp, Artificial Sequence
  Description of Artificial Sequence: Synthetic oligonucleotide
  Target: ATXN1; (-) strand; PAM type: NNGRRT; PAM sequence: AGGAGT
cttttcagtaagttctgctg

SEQ ID NO: 14403 - DNA, 20 bp, Artificial Sequence
  Description of Artificial Sequence: Synthetic oligonucleotide
  Target: ATXN1; (-) strand; PAM type: NNGRRT; PAM sequence: TGGAGT
agcaagtagtttggagtggc

SEQ ID NO: 14404 - DNA, 20 bp, Artificial Sequence
  Description of Artificial Sequence: Synthetic oligonucleotide
  Target: ATXN1; (-) strand; PAM type: NNGRRT; PAM sequence: TGGAGT
ttggaagacagcaagtagtt

SEQ ID NO: 14405 - DNA, 20 bp, Artificial Sequence
  Description of Artificial Sequence: Synthetic oligonucleotide
  Target: ATXN1; (-) strand; PAM type: NNGRRT; PAM sequence: AAGGAT
tacttaatttgttcagttca

SEQ ID NO: 14406 - DNA, 20 bp, Artificial Sequence
  Description of Artificial Sequence: Synthetic oligonucleotide
  Target: ATXN1; (-) strand; PAM type: NNGRRT; PAM sequence: ATGAGT
gaaagggcaagccccagtgc

SEQ ID NO: 14407 - DNA, 20 bp, Artificial Sequence
  Description of Artificial Sequence: Synthetic oligonucleotide
  Target: ATXN1; (-) strand; PAM type: NNGRRT; PAM sequence: AAGGGT
gcttcttcactttgcaggct

SEQ ID NO: 14408 - DNA, 20 bp, Artificial Sequence
  Description of Artificial Sequence: Synthetic oligonucleotide
  Target: ATXN1; (-) strand; PAM type: NNGRRT; PAM sequence: ATGGGT
aaggctggtttgcctgagag

SEQ ID NO: 14409 - DNA, 20 bp, Artificial Sequence
  Description of Artificial Sequence: Synthetic oligonucleotide
  Target: ATXN1; (-) strand; PAM type: NNGRRT; PAM sequence: GTGGGT
aagaccacaatcttatgatt

SEQ ID NO: 14410 - DNA, 20 bp, Artificial Sequence
  Description of Artificial Sequence: Synthetic oligonucleotide
  Target: ATXN1; (-) strand; PAM type: NNGRRT; PAM sequence: GTGGAT
gatgttaaccagaaaacaaa

SEQ ID NO: 14411 - DNA, 20 bp, Artificial Sequence
  Description of Artificial Sequence: Synthetic oligonucleotide
  Target: ATXN1; (-) strand; PAM type: NNGRRT; PAM sequence: AGGAGT
ttcatcctcagacttgaatg

SEQ ID NO: 14412 - DNA, 20 bp, Artificial Sequence
  Description of Artificial Sequence: Synthetic oligonucleotide
  Target: ATXN1; (-) strand; PAM type: NNGRRT; PAM sequence: TTGAAT
ggaagctttcatcctcagac

SEQ ID NO: 14413 - DNA, 20 bp, Artificial Sequence
  Description of Artificial Sequence: Synthetic oligonucleotide
  Target: ATXN1; (-) strand; PAM type: NNGRRT; PAM sequence: TGGGAT
cagaccagcatggcatcttc

SEQ ID NO: 14414 - DNA, 20 bp, Artificial Sequence
  Description of Artificial Sequence: Synthetic oligonucleotide
  Target: ATXN1; (-) strand; PAM type: NNGRRT; PAM sequence: ATGGAT
aatggtacccacaggttgcc

SEQ ID NO: 14415 - DNA, 20 bp, Artificial Sequence
  Description of Artificial Sequence: Synthetic oligonucleotide
  Target: ATXN1; (-) strand; PAM type: NNGRRT; PAM sequence: GAGAGT
aatatttacagaaagagaga

SEQ ID NO: 14416 - DNA, 20 bp, Artificial Sequence
  Description of Artificial Sequence: Synthetic oligonucleotide
  Target: ATXN1; (-) strand; PAM type: NNGRRT; PAM sequence: ATGGAT
ggatagaagaaagcctgaag

SEQ ID NO: 14417 - DNA, 20 bp, Artificial Sequence
  Description of Artificial Sequence: Synthetic oligonucleotide
  Target: ATXN1; (-) strand; PAM type: NNGRRT; PAM sequence: TAGGAT
tagtctaattctttgaaatt

SEQ ID NO: 14418 - DNA, 20 bp, Artificial Sequence
  Description of Artificial Sequence: Synthetic oligonucleotide
  Target: ATXN1; (-) strand; PAM type: NNGRRT; PAM sequence: ATGAGT
gattcccaaaggctgttgat

SEQ ID NO: 14419 - DNA, 20 bp, Artificial Sequence
  Description of Artificial Sequence: Synthetic oligonucleotide
  Target: ATXN1; (-) strand; PAM type: NNGRRT; PAM sequence: AGGAGT
ataatagtctcatctataaa

SEQ ID NO: 14420 - DNA, 20 bp, Artificial Sequence
  Description of Artificial Sequence: Synthetic oligonucleotide
  Target: ATXN1; (-) strand; PAM type: NNGRRT; PAM sequence: GTGAGT
tagtcaaactgaaaggcaca

SEQ ID NO: 14421 - DNA, 20 bp, Artificial Sequence
  Description of Artificial Sequence: Synthetic oligonucleotide
  Target: ATXN1; (-) strand; PAM type: NNGRRT; PAM sequence: GTGAAT
gagggcccttggaattttag

SEQ ID NO: 14422 - DNA, 20 bp, Artificial Sequence
  Description of Artificial Sequence: Synthetic oligonucleotide
  Target: ATXN1; (-) strand; PAM type: NNGRRT; PAM sequence: TGGAAT
gtgcatatgctgagggccct

SEQ ID NO: 14423 - DNA, 20 bp, Artificial Sequence
  Description of Artificial Sequence: Synthetic oligonucleotide
  Target: ATXN1; (-) strand; PAM type: NNGRRT; PAM sequence: CAGAAT
agtgaaggtgacacatttgt

SEQ ID NO: 14424 - DNA, 20 bp, Artificial Sequence
  Description of Artificial Sequence: Synthetic oligonucleotide
  Target: ATXN1; (-) strand; PAM type: NNGRRT; PAM sequence: TAGAAT
cttccttgacatgtatatag

SEQ ID NO: 14425 - DNA, 20 bp, Artificial Sequence
  Description of Artificial Sequence: Synthetic oligonucleotide
  Target: ATXN1; (-) strand; PAM type: NNGRRT; PAM sequence: GTGAAT
tcattgtcattacactgaca

SEQ ID NO: 14426 - DNA, 20 bp, Artificial Sequence
  Description of Artificial Sequence: Synthetic oligonucleotide
  Target: ATXN1; (-) strand; PAM type: NNGRRT; PAM sequence: AGGAGT
agagacatttctgctataat

SEQ ID NO: 14427 - DNA, 20 bp, Artificial Sequence
  Description of Artificial Sequence: Synthetic oligonucleotide
  Target: ATXN1; (-) strand; PAM type: NNGRRT; PAM sequence: GAGAGT
ctaccctgatgacctgttaa

SEQ ID NO: 14428 - DNA, 20 bp, Artificial Sequence
  Description of Artificial Sequence: Synthetic oligonucleotide
  Target: ATXN1; (-) strand; PAM type: NNGRRT; PAM sequence: TTGGGT
agagactctttgaatcacat

SEQ ID NO: 14429 - DNA, 20 bp, Artificial Sequence
  Description of Artificial Sequence: Synthetic oligonucleotide
  Target: ATXN1; (-) strand; PAM type: NNGRRT; PAM sequence: TTGAAT
tagttcatataagagactct

SEQ ID NO: 14430 - DNA, 20 bp, Artificial Sequence
  Description of Artificial Sequence: Synthetic oligonucleotide
  Target: ATXN1; (-) strand; PAM type: NNGRRT; PAM sequence: CTGGGT
agtggcaagctactctctat

SEQ ID NO: 14431 - DNA, 20 bp, Artificial Sequence
  Description of Artificial Sequence: Synthetic oligonucleotide
  Target: ATXN1; (-) strand; PAM type: NNGRRT; PAM sequence: CTGGGT
ctcaggctaagaagggacac

SEQ ID NO: 14432 - DNA, 20 bp, Artificial Sequence
  Description of Artificial Sequence: Synthetic oligonucleotide
  Target: ATXN1; (-) strand; PAM type: NNGRRT; PAM sequence: CAGAGT
ctgcactccagtctgggtaa

SEQ ID NO: 14433 - DNA, 20 bp, Artificial Sequence
  Description of Artificial Sequence: Synthetic oligonucleotide
  Target: ATXN1; (-) strand; PAM type: NNGRRT; PAM sequence: CTGGGT
tcatgccactgcactccagt

SEQ ID NO: 14434 - DNA, 20 bp, Artificial Sequence
  Description of Artificial Sequence: Synthetic oligonucleotide
  Target: ATXN1; (-) strand; PAM type: NNGRRT; PAM sequence: GAGAAT
tactcgggaggctgaggcag

SEQ ID NO: 14435 - DNA, 20 bp, Artificial Sequence
  Description of Artificial Sequence: Synthetic oligonucleotide
  Target: ATXN1; (-) strand; PAM type: NNGRRT; PAM sequence: AGGAGT
cgggtggatcacctgaggtc

SEQ ID NO: 14436 - DNA, 20 bp, Artificial Sequence
  Description of Artificial Sequence: Synthetic oligonucleotide
  Target: ATXN1; (-) strand; PAM type: NNGRRT; PAM sequence: GTGGAT
actttgggaagccaaggcgg

SEQ ID NO: 14437 - DNA, 20 bp, Artificial Sequence
  Description of Artificial Sequence: Synthetic oligonucleotide
  Target: ATXN1; (-) strand; PAM type: NNGRRT; PAM sequence: GCGGGT
cagcactttgggaagccaag

SEQ ID NO: 14438 - DNA, 20 bp, Artificial Sequence
  Description of Artificial Sequence: Synthetic oligonucleotide
  Target: ATXN1; (-) strand; PAM type: NNGRRT; PAM sequence: AGGGGT
aataagttgtcgttgatcac

SEQ ID NO: 14439 - DNA, 20 bp, Artificial Sequence
  Description of Artificial Sequence: Synthetic oligonucleotide
  Target: ATXN1; (-) strand; PAM type: NNGRRT; PAM sequence: CTGAAT
agtagaaagaacccttcttc

SEQ ID NO: 14440 - DNA, 20 bp, Artificial Sequence
  Description of Artificial Sequence: Synthetic oligonucleotide
  Target: ATXN1; (-) strand; PAM type: NNGRRT; PAM sequence: TAGAGT
gtaaataactggaagcatac

SEQ ID NO: 14441 - DNA, 20 bp, Artificial Sequence
  Description of Artificial Sequence: Synthetic oligonucleotide
  Target: ATXN1; (-) strand; PAM type: NNGRRT; PAM sequence: CTGGGT
tagaagcttcaaattcttct

SEQ ID NO: 14442 - DNA, 20 bp, Artificial Sequence
  Description of Artificial Sequence: Synthetic oligonucleotide
  Target: ATXN1; (-) strand; PAM type: NNGRRT; PAM sequence: GTGAAT
gaataagaaatacaactaat

SEQ ID NO: 14443 - DNA, 20 bp, Artificial Sequence
  Description of Artificial Sequence: Synthetic oligonucleotide
  Target: ATXN1; (-) strand; PAM type: NNGRRT; PAM sequence: ATGAAT
cataaagatagttctctcat

SEQ ID NO: 14444 - DNA, 20 bp, Artificial Sequence
  Description of Artificial Sequence: Synthetic oligonucleotide
  Target: ATXN1; (-) strand; PAM type: NNGRRT; PAM sequence: TTGGAT
tttgttttttgttttttttt

SEQ ID NO: 14445 - DNA, 20 bp, Artificial Sequence
  Description of Artificial Sequence: Synthetic oligonucleotide
  Target: ATXN1; (-) strand; PAM type: NNGRRT; PAM sequence: CAGGGT
agtaaatcagttttgtttga

SEQ ID NO: 14446 - DNA, 20 bp, Artificial Sequence
  Description of Artificial Sequence: Synthetic oligonucleotide
  Target: ATXN1; (-) strand; PAM type: NNGRRT; PAM sequence: CAGGAT
ttcagagcatcccatatttt

SEQ ID NO: 14447 - DNA, 20 bp, Artificial Sequence
  Description of Artificial Sequence: Synthetic oligonucleotide
  Target: ATXN1; (-) strand; PAM type: NNGRRT; PAM sequence: AAGGGT
tttggaaaaagaaaaactcc

SEQ ID NO: 14448 - DNA, 20 bp, Artificial Sequence
  Description of Artificial Sequence: Synthetic oligonucleotide
  Target: ATXN1; (-) strand; PAM type: NNGRRT; PAM sequence: TGGAAT
tggtagtgaagatctgggac

SEQ ID NO: 14449 - DNA, 20 bp, Artificial Sequence
  Description of Artificial Sequence: Synthetic oligonucleotide
  Target: ATXN1; (-) strand; PAM type: NNGRRT; PAM sequence: TAGGGT
cttatgatgggaaagacatt

SEQ ID NO: 14450 - DNA, 20 bp, Artificial Sequence
  Description of Artificial Sequence: Synthetic oligonucleotide
  Target: ATXN1; (-) strand; PAM type: NNGRRT; PAM sequence: CTGAAT
gaccgttgtcatttgttcca

SEQ ID NO: 14451 - DNA, 20 bp, Artificial Sequence
  Description of Artificial Sequence: Synthetic oligonucleotide
  Target: ATXN1; (-) strand; PAM type: NNGRRT; PAM sequence: AAGAGT
gcctttcccttcacgactaa

SEQ ID NO: 14452 - DNA, 20 bp, Artificial Sequence
  Description of Artificial Sequence: Synthetic oligonucleotide
  Target: ATXN1; (-) strand; PAM type: NNGRRT; PAM sequence: AAGGGT
ggaacaagggagactgatga

SEQ ID NO: 14453 - DNA, 20 bp, Artificial Sequence
  Description of Artificial Sequence: Synthetic oligonucleotide
  Target: ATXN1; (-) strand; PAM type: NNGRRT; PAM sequence: GTGGGT
cacgaagaaagagactcaag

SEQ ID NO: 14454 - DNA, 20 bp, Artificial Sequence
  Description of Artificial Sequence: Synthetic oligonucleotide
  Target: ATXN1; (-) strand; PAM type: NNGRRT; PAM sequence: GAGAGT
tttgggtgacattttctcct

SEQ ID NO: 14455 - DNA, 20 bp, Artificial Sequence
  Description of Artificial Sequence: Synthetic oligonucleotide
  Target: ATXN1; (-) strand; PAM type: NNGRRT; PAM sequence: TTGGGT
gaagcccctaggcaatgggt

SEQ ID NO: 14456 - DNA, 20 bp, Artificial Sequence
  Description of Artificial Sequence: Synthetic oligonucleotide
  Target: ATXN1; (-) strand; PAM type: NNGRRT; PAM sequence: ATGGGT
tctgtggaagcccctaggca

SEQ ID NO: 14457 - DNA, 20 bp, Artificial Sequence
  Description of Artificial Sequence: Synthetic oligonucleotide
  Target: ATXN1; (-) strand; PAM type: NNGRRT; PAM sequence: GTGGAT
ccaaagaacatagaaatact

SEQ ID NO: 14458 - DNA, 20 bp, Artificial Sequence
  Description of Artificial Sequence: Synthetic oligonucleotide
  Target: ATXN1; (-) strand; PAM type: NNGRRT; PAM sequence: TTGGAT
tttttctgccattttccgat

SEQ ID NO: 14459 - DNA, 20 bp, Artificial Sequence
  Description of Artificial Sequence: Synthetic oligonucleotide
  Target: ATXN1; (-) strand; PAM type: NNGRRT; PAM sequence: TTGAAT
tctcctctcattatgccaca

SEQ ID NO: 14460 - DNA, 20 bp, Artificial Sequence
  Description of Artificial Sequence: Synthetic oligonucleotide
  Target: ATXN1; (-) strand; PAM type: NNGRRT; PAM sequence: AGGAAT
ccatgcacccagccttgaag

SEQ ID NO: 14461 - DNA, 20 bp, Artificial Sequence
  Description of Artificial Sequence: Synthetic oligonucleotide
  Target: ATXN1; (-) strand; PAM type: NNGRRT; PAM sequence: AGGAAT
gacatgagtagatgtttggg

SEQ ID NO: 14462 - DNA, 20 bp, Artificial Sequence
  Description of Artificial Sequence: Synthetic oligonucleotide
  Target: ATXN1; (-) strand; PAM type: NNGRRT; PAM sequence: ATGAGT
tggcatgcagagttggagac

SEQ ID NO: 14463 - DNA, 20 bp, Artificial Sequence
  Description of Artificial Sequence: Synthetic oligonucleotide
  Target: ATXN1; (-) strand; PAM type: NNGRRT; PAM sequence: CAGAGT
tgtttatcagcactggcatg

SEQ ID NO: 14464 - DNA, 20 bp, Artificial Sequence
  Description of Artificial Sequence: Synthetic oligonucleotide
  Target: ATXN1; (-) strand; PAM type: NNGRRT; PAM sequence: GTGAAT
tgatggtatcagtttttctt

SEQ ID NO: 14465 - DNA, 20 bp, Artificial Sequence
  Description of Artificial Sequence: Synthetic oligonucleotide
  Target: ATXN1; (-) strand; PAM type: NNGRRT; PAM sequence: CAGAAT
gaattaatgggtagtccagg

SEQ ID NO: 14466 - DNA, 20 bp, Artificial Sequence
  Description of Artificial Sequence: Synthetic oligonucleotide
  Target: ATXN1; (-) strand; PAM type: NNGRRT; PAM sequence: ATGGGT
ggagaataacaaatgaatta

SEQ ID NO: 14467 - DNA, 20 bp, Artificial Sequence
  Description of Artificial Sequence: Synthetic oligonucleotide
  Target: ATXN1; (-) strand; PAM type: NNGRRT; PAM sequence: ATGAAT
aatcccacggagaataacaa

SEQ ID NO: 14468 - DNA, 20 bp, Artificial Sequence
  Description of Artificial Sequence: Synthetic oligonucleotide
  Target: ATXN1; (-) strand; PAM type: NNGRRT; PAM sequence: GAGAAT
ggtacagatagaatcccacg

SEQ ID NO: 14469 - DNA, 20 bp, Artificial Sequence
  Description of Artificial Sequence: Synthetic oligonucleotide
  Target: ATXN1; (-) strand; PAM type: NNGRRT; PAM sequence: TAGAAT
catggtctttctggtacaga

SEQ ID NO: 14470 - DNA, 20 bp, Artificial Sequence
  Description of Artificial Sequence: Synthetic oligonucleotide
  Target: ATXN1; (-) strand; PAM type: NNGRRT; PAM sequence: AAGGAT
tcatgggagtgtcacttact

SEQ ID NO: 14471 - DNA, 20 bp, Artificial Sequence
  Description of Artificial Sequence: Synthetic oligonucleotide
  Target: ATXN1; (-) strand; PAM type: NNGRRT; PAM sequence: GGGAGT
tcacttactaagtgtatcat

SEQ ID NO: 14472 - DNA, 20 bp, Artificial Sequence
  Description of Artificial Sequence: Synthetic oligonucleotide
  Target: ATXN1; (-) strand; PAM type: NNGRRT; PAM sequence: GAGGAT
tggcagtcaccttgctcaaa

SEQ ID NO: 14473 - DNA, 20 bp, Artificial Sequence
  Description of Artificial Sequence: Synthetic oligonucleotide
  Target: ATXN1; (-) strand; PAM type: NNGRRT; PAM sequence: GGGAGT
tggcctcgagagggtcagaa

SEQ ID NO: 14474 - DNA, 20 bp, Artificial Sequence
  Description of Artificial Sequence: Synthetic oligonucleotide
  Target: ATXN1; (-) strand; PAM type: NNGRRT; PAM sequence: GAGGGT
gtggaagagggtggcctcga

SEQ ID NO: 14475 - DNA, 20 bp, Artificial Sequence
  Description of Artificial Sequence: Synthetic oligonucleotide
  Target: ATXN1; (-) strand; PAM type: NNGRRT; PAM sequence: GAGGGT
gtaagggagtggtggtggaa

SEQ ID NO: 14476 - DNA, 20 bp, Artificial Sequence
  Description of Artificial Sequence: Synthetic oligonucleotide
  Target: ATXN1; (-) strand; PAM type: NNGRRT; PAM sequence: GGGAGT
acttcgttaaaggcaagtaa

SEQ ID NO: 14477 - DNA, 20 bp, Artificial Sequence
  Description of Artificial Sequence: Synthetic oligonucleotide
  Target: ATXN1; (-) strand; PAM type: NNGRRT; PAM sequence: CTGGGT
gtcaaggtgagagctgccca

SEQ ID NO: 14478 - DNA, 20 bp, Artificial Sequence
  Description of Artificial Sequence: Synthetic oligonucleotide
  Target: ATXN1; (-) strand; PAM type: NNGRRT; PAM sequence: AAGGGT
tcaagcacaaatgtagatga

SEQ ID NO: 14479 - DNA, 20 bp, Artificial Sequence
  Description of Artificial Sequence: Synthetic oligonucleotide
  Target: ATXN1; (-) strand; PAM type: NNGRRT; PAM sequence: CAGAGT
ctggctcacataattcaaaa

SEQ ID NO: 14480 - DNA, 20 bp, Artificial Sequence
  Description of Artificial Sequence: Synthetic oligonucleotide
  Target: ATXN1; (-) strand; PAM type: NNGRRT; PAM sequence: AAGAGT
tgatctctaaaagaaggtag

SEQ ID NO: 14481 - DNA, 20 bp, Artificial Sequence
  Description of Artificial Sequence: Synthetic oligonucleotide
  Target: ATXN1; (-) strand; PAM type: NNGRRT; PAM sequence: ACGAGT
tcttaatgcatggggctcct

SEQ ID NO: 14482 - DNA, 20 bp, Artificial Sequence
  Description of Artificial Sequence: Synthetic oligonucleotide
  Target: ATXN1; (-) strand; PAM type: NNGRRT; PAM sequence: TAGAAT
ccaagcctttgtggcttgca

SEQ ID NO: 14483 - DNA, 20 bp, Artificial Sequence
  Description of Artificial Sequence: Synthetic oligonucleotide
  Target: ATXN1; (-) strand; PAM type: NNGRRT; PAM sequence: CAGAAT
tgacctgcccacattgctgt

SEQ ID NO: 14484 - DNA, 20 bp, Artificial Sequence
  Description of Artificial Sequence: Synthetic oligonucleotide
  Target: ATXN1; (-) strand; PAM type: NNGRRT; PAM sequence: TTGAGT
cttgtgatcatttcccagtc

SEQ ID NO: 14485 - DNA, 20 bp, Artificial Sequence
  Description of Artificial Sequence: Synthetic oligonucleotide
  Target: ATXN1; (-) strand; PAM type: NNGRRT; PAM sequence: GAGAGT
cctgaaacaacttgcttaag

SEQ ID NO: 14486 - DNA, 20 bp, Artificial Sequence
  Description of Artificial Sequence: Synthetic oligonucleotide
  Target: ATXN1; (-) strand; PAM type: NNGRRT; PAM sequence: AAGAAT
taagtagaattgtagactga

SEQ ID NO: 14487 - DNA, 20 bp, Artificial Sequence
  Description of Artificial Sequence: Synthetic oligonucleotide
  Target: ATXN1; (-) strand; PAM type: NNGRRT; PAM sequence: TAGAAT
tgtaataaattattgctaag

SEQ ID NO: 14488 - DNA, 20 bp, Artificial Sequence
  Description of Artificial Sequence: Synthetic oligonucleotide
  Target: ATXN1; (-) strand; PAM type: NNGRRT; PAM sequence: AAGAAT
taaatttttcacttttgtaa

SEQ ID NO: 14489 - DNA, 20 bp, Artificial Sequence
  Description of Artificial Sequence: Synthetic oligonucleotide
  Target: ATXN1; (-) strand; PAM type: NNGRRT; PAM sequence: CTGAAT
ataaagaagggcagggatga

SEQ ID NO: 14490 - DNA, 20 bp, Artificial Sequence
  Description of Artificial Sequence: Synthetic oligonucleotide
  Target: ATXN1; (-) strand; PAM type: NNGRRT; PAM sequence: AGGGAT
aatccacaataaagaagggc

SEQ ID NO: 14491 - DNA, 20 bp, Artificial Sequence
  Description of Artificial Sequence: Synthetic oligonucleotide
  Target: ATXN1; (-) strand; PAM type: NNGRRT; PAM sequence: AAGAAT
attcgaagtgctcaatgttc

SEQ ID NO: 14492 - DNA, 20 bp, Artificial Sequence
  Description of Artificial Sequence: Synthetic oligonucleotide
  Target: ATXN1; (-) strand; PAM type: NNGRRT; PAM sequence: AAGAAT
gcaagaacttgggatgccta

SEQ ID NO: 14493 - DNA, 20 bp, Artificial Sequence
  Description of Artificial Sequence: Synthetic oligonucleotide
  Target: ATXN1; (-) strand; PAM type: NNGRRT; PAM sequence: TGGGAT
taaaagttgaagcaagaact

SEQ ID NO: 14494 - DNA, 20 bp, Artificial Sequence
  Description of Artificial Sequence: Synthetic oligonucleotide
  Target: ATXN1; (-) strand; PAM type: NNGRRT; PAM sequence: TTGGAT
gccactacgcctggcacatt

SEQ ID NO: 14495 - DNA, 20 bp, Artificial Sequence
  Description of Artificial Sequence: Synthetic oligonucleotide
  Target: ATXN1; (-) strand; PAM type: NNGRRT; PAM sequence: TGGGAT
acctcggcttcccaaaatgc

SEQ ID NO: 14496 - DNA, 20 bp, Artificial Sequence
  Description of Artificial Sequence: Synthetic oligonucleotide
  Target: ATXN1; (-) strand; PAM type: NNGRRT; PAM sequence: TGGGAT
gcctcagcctcccaagtagc

SEQ ID NO: 14497 - DNA, 20 bp, Artificial Sequence
  Description of Artificial Sequence: Synthetic oligonucleotide
  Target: ATXN1; (-) strand; PAM type: NNGRRT; PAM sequence: CTGGGT
ctcactgcaacctccacctt

SEQ ID NO: 14498 - DNA, 20 bp, Artificial Sequence
  Description of Artificial Sequence: Synthetic oligonucleotide
  Target: ATXN1; (-) strand; PAM type: NNGRRT; PAM sequence: CAGGAT
caccaggccaccattttctt

SEQ ID NO: 14499 - DNA, 20 bp, Artificial Sequence
  Description of Artificial Sequence: Synthetic oligonucleotide
  Target: ATXN1; (-) strand; PAM type: NNGRRT; PAM sequence: GAGGAT
cactgacaaaaacatagcat

SEQ ID NO: 14500 - DNA, 20 bp, Artificial Sequence
  Description of Artificial Sequence: Synthetic oligonucleotide
  Target: ATXN1; (-) strand; PAM type: NNGRRT; PAM sequence: AGGAAT
ggatgctttgagaagagact

SEQ ID NO: 14501 - DNA, 20 bp, Artificial Sequence
  Description of Artificial Sequence: Synthetic oligonucleotide
  Target: ATXN1; (-) strand; PAM type: NNGRRT; PAM sequence: AAGGAT
atgtgtatttagagaagaca

SEQ ID NO: 14502 - DNA, 20 bp, Artificial Sequence
  Description of Artificial Sequence: Synthetic oligonucleotide
  Target: ATXN1; (-) strand; PAM type: NNGRRT; PAM sequence: TGGAAT
attgagccttcaagcagagg

SEQ ID NO: 14503 - DNA, 20 bp, Artificial Sequence
  Description of Artificial Sequence: Synthetic oligonucleotide
  Target: ATXN1; (-) strand; PAM type: NNGRRT; PAM sequence: TGGAAT
tgggtaagagttgtcagcgc

SEQ ID NO: 14504 - DNA, 20 bp, Artificial Sequence
  Description of Artificial Sequence: Synthetic oligonucleotide
  Target: ATXN1; (-) strand; PAM type: NNGRRT; PAM sequence: AAGAGT
taccgaaagggacgatgggt

SEQ ID NO: 14505 - DNA, 20 bp, Artificial Sequence
  Description of Artificial Sequence: Synthetic oligonucleotide
  Target: ATXN1; (-) strand; PAM type: NNGRRT; PAM sequence: ATGGGT
caggtgtaccgaaagggacg

SEQ ID NO: 14506 - DNA, 20 bp, Artificial Sequence
  Description of Artificial Sequence: Synthetic oligonucleotide
  Target: ATXN1; (-) strand; PAM type: NNGRRT; PAM sequence: CGGAGT
gggaaggatgtacttggtgg

SEQ ID NO: 14507 - DNA, 20 bp, Artificial Sequence
  Description of Artificial Sequence: Synthetic oligonucleotide
  Target: ATXN1; (-) strand; PAM type: NNGRRT; PAM sequence: AAGGAT
ctctaggaaggtgctatggg

SEQ ID NO: 14508 - DNA, 20 bp, Artificial Sequence
  Description of Artificial Sequence: Synthetic oligonucleotide
  Target: ATXN1; (-) strand; PAM type: NNGRRT; PAM sequence: CTGAGT
agtctatcagggatccaggg

SEQ ID NO: 14509 - DNA, 20 bp, Artificial Sequence
  Description of Artificial Sequence: Synthetic oligonucleotide
  Target: ATXN1; (-) strand; PAM type: NNGRRT; PAM sequence: AGGGAT
aggatgttcttgagtctatc

SEQ ID NO: 14510 - DNA, 20 bp, Artificial Sequence
  Description of Artificial Sequence: Synthetic oligonucleotide
  Target: ATXN1; (-) strand; PAM type: NNGRRT; PAM sequence: TTGAGT
tgttgtgtgccaggatgttc

SEQ ID NO: 14511 - DNA, 20 bp, Artificial Sequence
  Description of Artificial Sequence: Synthetic oligonucleotide
  Target: ATXN1; (-) strand; PAM type: NNGRRT; PAM sequence: CAGGAT
attaaaagagtgttgtgtgc

SEQ ID NO: 14512 - DNA, 20 bp, Artificial Sequence
  Description of Artificial Sequence: Synthetic oligonucleotide
  Target: ATXN1; (-) strand; PAM type: NNGRRT; PAM sequence: AAGAGT
aattacatgatatttattaa

SEQ ID NO: 14513 - DNA, 20 bp, Artificial Sequence
  Description of Artificial Sequence: Synthetic oligonucleotide
  Target: ATXN1; (-) strand; PAM type: NNGRRT; PAM sequence: TAGAGT
ttttgtgtcctctttaagtt

SEQ ID NO: 14514 - DNA, 20 bp, Artificial Sequence
  Description of Artificial Sequence: Synthetic oligonucleotide
  Target: ATXN1; (-) strand; PAM type: NNGRRT; PAM sequence: CTGAAT
ctggtcaggctgctttgtaa

SEQ ID NO: 14515 - DNA, 20 bp, Artificial Sequence
  Description of Artificial Sequence: Synthetic oligonucleotide
  Target: ATXN1; (-) strand; PAM type: NNGRRT; PAM sequence: TGGGGT
tttacaacatttgtgttcta

SEQ ID NO: 14516 - DNA, 20 bp, Artificial Sequence
  Description of Artificial Sequence: Synthetic oligonucleotide
  Target: ATXN1; (-) strand; PAM type: NNGRRT; PAM sequence: ATGGAT
ttgtggaaggaaaaaagttc

SEQ ID NO: 14517 - DNA, 20 bp, Artificial Sequence
  Description of Artificial Sequence: Synthetic oligonucleotide
  Target: ATXN1; (-) strand; PAM type: NNGRRT; PAM sequence: AGGAGT
acctttggcagggtctttgc

SEQ ID NO: 14518 - DNA, 20 bp, Artificial Sequence
  Description of Artificial Sequence: Synthetic oligonucleotide
  Target: ATXN1; (-) strand; PAM type: NNGRRT; PAM sequence: CAGGGT
tttgggatgggcacctttgg

SEQ ID NO: 14519 - DNA, 20 bp, Artificial Sequence
  Description of Artificial Sequence: Synthetic oligonucleotide
  Target: ATXN1; (-) strand; PAM type: NNGRRT; PAM sequence: TGGGAT
attgcccctggtgtgttatt

SEQ ID NO: 14520 - DNA, 20 bp, Artificial Sequence
  Description of Artificial Sequence: Synthetic oligonucleotide
  Target: ATXN1; (-) strand; PAM type: NNGRRT; PAM sequence: TTGAAT
tctctcttcctcagacttcc

SEQ ID NO: 14521 - DNA, 20 bp, Artificial Sequence
  Description of Artificial Sequence: Synthetic oligonucleotide
  Target: ATXN1; (-) strand; PAM type: NNGRRT; PAM sequence: TAGAGT
ggggatagcttcaagtcttc

SEQ ID NO: 14522 - DNA, 20 bp, Artificial Sequence
  Description of Artificial Sequence: Synthetic oligonucleotide
  Target: ATXN1; (-) strand; PAM type: NNGRRT; PAM sequence: GGGGAT
tcattccatccaagtgcact

SEQ ID NO: 14523 - DNA, 20 bp, Artificial Sequence
  Description of Artificial Sequence: Synthetic oligonucleotide
  Target: ATXN1; (-) strand; PAM type: NNGRRT; PAM sequence: GAGGGT
aaaaaatctgaagtagataa

SEQ ID NO: 14524 - DNA, 20 bp, Artificial Sequence
  Description of Artificial Sequence: Synthetic oligonucleotide
  Target: ATXN1; (-) strand; PAM type: NNGRRT; PAM sequence: GGGAAT
cactctaataagagcaatct

SEQ ID NO: 14525 - DNA, 20 bp, Artificial Sequence
  Description of Artificial Sequence: Synthetic oligonucleotide
  Target: ATXN1; (-) strand; PAM type: NNGRRT; PAM sequence: GAGAAT
actctgaatctccagactaa

SEQ ID NO: 14526 - DNA, 20 bp, Artificial Sequence
  Description of Artificial Sequence: Synthetic oligonucleotide
  Target: ATXN1; (-) strand; PAM type: NNGRRT; PAM sequence: CTGAAT
ggagctgaatttctcttact

SEQ ID NO: 14527 - DNA, 20 bp, Artificial Sequence
  Description of Artificial Sequence: Synthetic oligonucleotide
  Target: ATXN1; (-) strand; PAM type: NNGRRT; PAM sequence: CTGAAT
taagtcttaaaaaatgggag

SEQ ID NO: 14528 - DNA, 20 bp, Artificial Sequence
  Description of Artificial Sequence: Synthetic oligonucleotide
  Target: ATXN1; (-) strand; PAM type: NNGRRT; PAM sequence: CTGAGT
cccttttcagaataactgct

SEQ ID NO: 14529 - DNA, 20 bp, Artificial Sequence
  Description of Artificial Sequence: Synthetic oligonucleotide
  Target: ATXN1; (-) strand; PAM type: NNGRRT; PAM sequence: CAGAAT
gtgtctatggactccctttt

SEQ ID NO: 14530 - DNA, 20 bp, Artificial Sequence
  Description of Artificial Sequence: Synthetic oligonucleotide
  Target: ATXN1; (-) strand; PAM type: NNGRRT; PAM sequence: TGGAAT
acagcaataataaaggtttc

SEQ ID NO: 14531 - DNA, 20 bp, Artificial Sequence
  Description of Artificial Sequence: Synthetic oligonucleotide
  Target: ATXN1; (-) strand; PAM type: NNGRRT; PAM sequence: TAGAAT
cttcattctagtgcacacct

SEQ ID NO: 14532 - DNA, 20 bp, Artificial Sequence
  Description of Artificial Sequence: Synthetic oligonucleotide
  Target: ATXN1; (-) strand; PAM type: NNGRRT; PAM sequence: CTGAAT
tctccctagaaaggggctga

SEQ ID NO: 14533 - DNA, 20 bp, Artificial Sequence
  Description of Artificial Sequence: Synthetic oligonucleotide
  Target: ATXN1; (-) strand; PAM type: NNGRRT; PAM sequence: AGGGAT
ttcatatttcttttcaaagt

SEQ ID NO: 14534 - DNA, 20 bp, Artificial Sequence
  Description of Artificial Sequence: Synthetic oligonucleotide
  Target: ATXN1; (-) strand; PAM type: NNGRRT; PAM sequence: TTGAGT
tatttcctctccttttccat

SEQ ID NO: 14535 - DNA, 20 bp, Artificial Sequence
  Description of Artificial Sequence: Synthetic oligonucleotide
  Target: ATXN1; (-) strand; PAM type: NNGRRT; PAM sequence: GGGGAT
tagacctatcagtagagttt

SEQ ID NO: 14536 - DNA, 20 bp, Artificial Sequence
  Description of Artificial Sequence: Synthetic oligonucleotide
  Target: ATXN1; (-) strand; PAM type: NNGRRT; PAM sequence: TAGAGT
aaaaattctagacctatcag

SEQ ID NO: 14537 - DNA, 20 bp, Artificial Sequence
  Description of Artificial Sequence: Synthetic oligonucleotide
  Target: ATXN1; (-) strand; PAM type: NNGRRT; PAM sequence: GTGGAT
ctagactattttccttagaa

SEQ ID NO: 14538 - DNA, 20 bp, Artificial Sequence
  Description of Artificial Sequence: Synthetic oligonucleotide
  Target: ATXN1; (-) strand; PAM type: NNGRRT; PAM sequence: GAGAGT
aagggtgtggggaagggatg

SEQ ID NO: 14539 - DNA, 20 bp, Artificial Sequence
  Description of Artificial Sequence: Synthetic oligonucleotide
  Target: ATXN1; (-) strand; PAM type: NNGRRT; PAM sequence: AGGGAT
gcagtttaagggtgtgggga

SEQ ID NO: 14540 - DNA, 20 bp, Artificial Sequence
  Description of Artificial Sequence: Synthetic oligonucleotide
  Target: ATXN1; (-) strand; PAM type: NNGRRT; PAM sequence: AAGGGT
cttgaatctgatagcagttt

SEQ ID NO: 14541 - DNA, 20 bp, Artificial Sequence
  Description of Artificial Sequence: Synthetic oligonucleotide
  Target: ATXN1; (-) strand; PAM type: NNGRRT; PAM sequence: TTGAAT
tgctgttctgatgagaatgc

SEQ ID NO: 14542 - DNA, 20 bp, Artificial Sequence
  Description of Artificial Sequence: Synthetic oligonucleotide
  Target: ATXN1; (-) strand; PAM type: NNGRRT; PAM sequence: GAGAAT
aacatacatgctgttctgat

SEQ ID NO: 14543 - DNA, 20 bp, Artificial Sequence
  Description of Artificial Sequence: Synthetic oligonucleotide
  Target: ATXN1; (-) strand; PAM type: NNGRRT; PAM sequence: GTGAAT
gcctaaatgacattcactaa

SEQ ID NO: 14544 - DNA, 20 bp, Artificial Sequence
  Description of Artificial Sequence: Synthetic oligonucleotide
  Target: ATXN1; (-) strand; PAM type: NNGRRT; PAM sequence: GTGAAT
agtcagtaaatattcattga

SEQ ID NO: 14545 - DNA, 20 bp, Artificial Sequence
  Description of Artificial Sequence: Synthetic oligonucleotide
  Target: ATXN1; (-) strand; PAM type: NNGRRT; PAM sequence: TTGAGT
gggcagtcagtaaatattca

SEQ ID NO: 14546 - DNA, 20 bp, Artificial Sequence
  Description of Artificial Sequence: Synthetic oligonucleotide
  Target: ATXN1; (-) strand; PAM type: NNGRRT; PAM sequence: ATGAAT
ttcttattcttccctggtga

SEQ ID NO: 14547 - DNA, 20 bp, Artificial Sequence
  Description of Artificial Sequence: Synthetic oligonucleotide
  Target: ATXN1; (-) strand; PAM type: NNGRRT; PAM sequence: GTGAAT
ctcattcttattcttccctg

SEQ ID NO: 14548 - DNA, 20 bp, Artificial Sequence
  Description of Artificial Sequence: Synthetic oligonucleotide
  Target: ATXN1; (-) strand; PAM type: NNGRRT; PAM sequence: AGGGAT
tctgcaagctctgcaaaagg

SEQ ID NO: 14549 - DNA, 20 bp, Artificial Sequence
  Description of Artificial Sequence: Synthetic oligonucleotide
  Target: ATXN1; (-) strand; PAM type: NNGRRT; PAM sequence: TTGAGT
gcttccttaagtaggaattc

SEQ ID NO: 14550 - DNA, 20 bp, Artificial Sequence
  Description of Artificial Sequence: Synthetic oligonucleotide
  Target: ATXN1; (-) strand; PAM type: NNGRRT; PAM sequence: AGGAAT
gcttctctgcttccttaagt

SEQ ID NO: 14551 - DNA, 20 bp, Artificial Sequence
  Description of Artificial Sequence: Synthetic oligonucleotide
  Target: ATXN1; (-) strand; PAM type: NNGRRT; PAM sequence: TAGAGT
ctctgtgctcaaatattggt

SEQ ID NO: 14552 - DNA, 20 bp, Artificial Sequence
  Description of Artificial Sequence: Synthetic oligonucleotide
  Target: ATXN1; (-) strand; PAM type: NNGRRT; PAM sequence: TTGAGT
aacaggaacgatttttgaac

SEQ ID NO: 14553 - DNA, 20 bp, Artificial Sequence
  Description of Artificial Sequence: Synthetic oligonucleotide
  Target: ATXN1; (-) strand; PAM type: NNGRRT; PAM sequence: TAGGGT
tagctttagctgtttaaatt

SEQ ID NO: 14554 - DNA, 20 bp, Artificial Sequence
  Description of Artificial Sequence: Synthetic oligonucleotide
  Target: ATXN1; (-) strand; PAM type: NNGRRT; PAM sequence: AAGAGT
tcttagggttaaaagaaaaa

SEQ ID NO: 14555 - DNA, 20 bp, Artificial Sequence
  Description of Artificial Sequence: Synthetic oligonucleotide
  Target: ATXN1; (-) strand; PAM type: NNGRRT; PAM sequence: TAGGGT
taaaacattgagcacagtct

SEQ ID NO: 14556 - DNA, 20 bp, Artificial Sequence
  Description of Artificial Sequence: Synthetic oligonucleotide
  Target: ATXN1; (-) strand; PAM type: NNGRRT; PAM sequence: TTGGGT
tgaacgtttattttaccttc

SEQ ID NO: 14557 - DNA, 20 bp, Artificial Sequence
  Description of Artificial Sequence: Synthetic oligonucleotide
  Target: ATXN1; (-) strand; PAM type: NNGRRT; PAM sequence: TTGAGT
tgatggacaacttgagaaaa

SEQ ID NO: 14558 - DNA, 20 bp, Artificial Sequence
  Description of Artificial Sequence: Synthetic oligonucleotide
  Target: ATXN1; (-) strand; PAM type: NNGRRT; PAM sequence: TTGGGT
ctgttgttagccatataacc

SEQ ID NO: 14559 - DNA, 20 bp, Artificial Sequence
  Description of Artificial Sequence: Synthetic oligonucleotide
  Target: ATXN1; (-) strand; PAM type: NNGRRT; PAM sequence: CTGGAT
tgaactcagagttagcagac

SEQ ID NO: 14560 - DNA, 20 bp, Artificial Sequence
  Description of Artificial Sequence: Synthetic oligonucleotide
  Target: ATXN1; (-) strand; PAM type: NNGRRT; PAM sequence: CAGAGT
aatgatgctgacactgaact

SEQ ID NO: 14561 - DNA, 20 bp, Artificial Sequence
  Description of Artificial Sequence: Synthetic oligonucleotide
  Target: ATXN1; (-) strand; PAM type: NNGRRT; PAM sequence: GAGAAT
ggggggatcttgtacaagaa

SEQ ID NO: 14562 - DNA, 20 bp, Artificial Sequence
  Description of Artificial Sequence: Synthetic oligonucleotide
  Target: ATXN1; (-) strand; PAM type: NNGRRT; PAM sequence: GGGGAT
ctgtaagggctggggggagg

SEQ ID NO: 14563 - DNA, 20 bp, Artificial Sequence
  Description of Artificial Sequence: Synthetic oligonucleotide
  Target: ATXN1; (-) strand; PAM type: NNGRRT; PAM sequence: GTGAGT
aggagtgggtgtataaatgt

SEQ ID NO: 14564 - DNA, 20 bp, Artificial Sequence
  Description of Artificial Sequence: Synthetic oligonucleotide
  Target: ATXN1; (-) strand; PAM type: NNGRRT; PAM sequence: GTGGGT
cacataaacagggtctagga

SEQ ID NO: 14565 - DNA, 20 bp, Artificial Sequence
  Description of Artificial Sequence: Synthetic oligonucleotide
  Target: ATXN1; (-) strand; PAM type: NNGRRT; PAM sequence: AGGAGT
tttgcacataaacagggtct

SEQ ID NO: 14566 - DNA, 20 bp, Artificial Sequence
  Description of Artificial Sequence: Synthetic oligonucleotide
  Target: ATXN1; (-) strand; PAM type: NNGRRT; PAM sequence: CAGGGT
aatgcatgtttgcacataaa

SEQ ID NO: 14567 - DNA, 20 bp, Artificial Sequence
  Description of Artificial Sequence: Synthetic oligonucleotide
  Target: ATXN1; (-) strand; PAM type: NNGRRT; PAM sequence: AAGAAT
gagaaggcaggcaattttca

SEQ ID NO: 14568 - DNA, 20 bp, Artificial Sequence
  Description of Artificial Sequence: Synthetic oligonucleotide
  Target: ATXN1; (-) strand; PAM type: NNGRRT; PAM sequence: CTGGGT
aacactggttttctgtcttc

SEQ ID NO: 14569 - DNA, 20 bp, Artificial Sequence
  Description of Artificial Sequence: Synthetic oligonucleotide
  Target: ATXN1; (-) strand; PAM type: NNGRRT; PAM sequence: GGGGGT
tttgcttggtaggggcagtg

SEQ ID NO: 14570 - DNA, 20 bp, Artificial Sequence
  Description of Artificial Sequence: Synthetic oligonucleotide
  Target: ATXN1; (-) strand; PAM type: NNGRRT; PAM sequence: TGGAGT
ttttaaaatccttctgtaaa

SEQ ID NO: 14571 - DNA, 20 bp, Artificial Sequence
  Description of Artificial Sequence: Synthetic oligonucleotide
  Target: ATXN1; (-) strand; PAM type: NNGRRT; PAM sequence: TTGAGT
accctgtcagacctcaaaga

SEQ ID NO: 14572 - DNA, 20 bp, Artificial Sequence
  Description of Artificial Sequence: Synthetic oligonucleotide
  Target: ATXN1; (-) strand; PAM type: NNGRRT; PAM sequence: GGGGGT
gcttttgtttcaaatctagt

SEQ ID NO: 14573 - DNA, 20 bp, Artificial Sequence
  Description of Artificial Sequence: Synthetic oligonucleotide
  Target: ATXN1; (-) strand; PAM type: NNGRRT; PAM sequence: TAGAAT
tttcccaatcaggtaactgt

SEQ ID NO: 14574 - DNA, 20 bp, Artificial Sequence
  Description of Artificial Sequence: Synthetic oligonucleotide
  Target: ATXN1; (-) strand; PAM type: NNGRRT; PAM sequence: TTGGGT
aattgtgggccatgttagat

SEQ ID NO: 14575 - DNA, 20 bp, Artificial Sequence
  Description of Artificial Sequence: Synthetic oligonucleotide
  Target: ATXN1; (-) strand; PAM type: NNGRRT; PAM sequence: AGGAAT
aaaagtttctgtcactatca

SEQ ID NO: 14576 - DNA, 20 bp, Artificial Sequence
  Description of Artificial Sequence: Synthetic oligonucleotide
  Target: ATXN1; (-) strand; PAM type: NNGRRT; PAM sequence: TAGGGT
aagcaatcagcatcttggtt

SEQ ID NO: 14577 - DNA, 20 bp, Artificial Sequence
  Description of Artificial Sequence: Synthetic oligonucleotide
  Target: ATXN1; (-) strand; PAM type: NNGRRT; PAM sequence: CAGAGT
ttttgtatttttggtagaga

SEQ ID NO: 14578 - DNA, 20 bp, Artificial Sequence
  Description of Artificial Sequence: Synthetic oligonucleotide
  Target: ATXN1; (-) strand; PAM type: NNGRRT; PAM sequence: CAGAGT
gaccctcccacctcagcctt

SEQ ID NO: 14579 - DNA, 20 bp, Artificial Sequence
  Description of Artificial Sequence: Synthetic oligonucleotide
  Target: ATXN1; (-) strand; PAM type: NNGRRT; PAM sequence: TGGAGT
ccttactctgtcacccaggc

SEQ ID NO: 14580 - DNA, 20 bp, Artificial Sequence
  Description of Artificial Sequence: Synthetic oligonucleotide
  Target: ATXN1; (-) strand; PAM type: NNGRRT; PAM sequence: CTGAAT
tcagcctggaatcagctgac

SEQ ID NO: 14581 - DNA, 20 bp, Artificial Sequence
  Description of Artificial Sequence: Synthetic oligonucleotide
  Target: ATXN1; (-) strand; PAM type: NNGRRT; PAM sequence: TGGAAT
ctagtggaaatcagtcagcc

SEQ ID NO: 14582 - DNA, 20 bp, Artificial Sequence
  Description of Artificial Sequence: Synthetic oligonucleotide
  Target: ATXN1; (-) strand; PAM type: NNGRRT; PAM sequence: TTGGGT
gtgtttccattctgtacacg

SEQ ID NO: 14583 - DNA, 20 bp, Artificial Sequence
  Description of Artificial Sequence: Synthetic oligonucleotide
  Target: ATXN1; (-) strand; PAM type: NNGRRT; PAM sequence: CAGGGT
atgtatccatatcatctcct

SEQ ID NO: 14584 - DNA, 20 bp, Artificial Sequence
  Description of Artificial Sequence: Synthetic oligonucleotide
  Target: ATXN1; (-) strand; PAM type: NNGRRT; PAM sequence: ATGAAT
catgaaacccaggatggcct

SEQ ID NO: 14585 - DNA, 20 bp, Artificial Sequence
  Description of Artificial Sequence: Synthetic oligonucleotide
  Target: ATXN1; (-) strand; PAM type: NNGRRT; PAM sequence: CAGGAT
gaaaatagctacatgaaacc

SEQ ID NO: 14586 - DNA, 20 bp, Artificial Sequence
  Description of Artificial Sequence: Synthetic oligonucleotide
  Target: ATXN1; (-) strand; PAM type: NNGRRT; PAM sequence: GAGAAT
ctcagccctcctactttcta

SEQ ID NO: 14587 - DNA, 20 bp, Artificial Sequence
  Description of Artificial Sequence: Synthetic oligonucleotide
  Target: ATXN1; (-) strand; PAM type: NNGRRT; PAM sequence: TGGGAT
gttttgatcagttactggct

SEQ ID NO: 14588 - DNA, 20 bp, Artificial Sequence
  Description of Artificial Sequence: Synthetic oligonucleotide
  Target: ATXN1; (-) strand; PAM type: NNGRRT; PAM sequence: CAGAGT
ccaggctaaggattagcaat

SEQ ID NO: 14589 - DNA, 20 bp, Artificial Sequence
  Description of Artificial Sequence: Synthetic oligonucleotide
  Target: ATXN1; (-) strand; PAM type: NNGRRT; PAM sequence: AAGGAT
ggggtaaaattctccaggct

SEQ ID NO: 14590 - DNA, 20 bp, Artificial Sequence
  Description of Artificial Sequence: Synthetic oligonucleotide
  Target: ATXN1; (-) strand; PAM type: NNGRRT; PAM sequence: GGGGGT
ttcttttaggttggtgagta

SEQ ID NO: 14591 - DNA, 20 bp, Artificial Sequence
  Description of Artificial Sequence: Synthetic oligonucleotide
  Target: ATXN1; (-) strand; PAM type: NNGRRT; PAM sequence: GTGAGT
gttgcagttcttttaggttg

SEQ ID NO: 14592 - DNA, 20 bp, Artificial Sequence
  Description of Artificial Sequence: Synthetic oligonucleotide
  Target: ATXN1; (-) strand; PAM type: NNGRRT; PAM sequence: TGGAAT
ctacttcaggaataaaagga

SEQ ID NO: 14593 - DNA, 20 bp, Artificial Sequence
  Description of Artificial Sequence: Synthetic oligonucleotide
  Target: ATXN1; (-) strand; PAM type: NNGRRT; PAM sequence: AAGGAT
actatctacttcaggaataa

SEQ ID NO: 14594 - DNA, 20 bp, Artificial Sequence
  Description of Artificial Sequence: Synthetic oligonucleotide
  Target: ATXN1; (-) strand; PAM type: NNGRRT; PAM sequence: AGGAAT
tgctgcaaactatctacttc

SEQ ID NO: 14595 - DNA, 20 bp, Artificial Sequence
  Description of Artificial Sequence: Synthetic oligonucleotide
  Target: ATXN1; (-) strand; PAM type: NNGRRT; PAM sequence: GGGAAT
atttctttttttaattggaa

SEQ ID NO: 14596 - DNA, 20 bp, Artificial Sequence
  Description of Artificial Sequence: Synthetic oligonucleotide
  Target: ATXN1; (-) strand; PAM type: NNGRRT; PAM sequence: AGGGGT
gtaaccgagccaggtgttga

SEQ ID NO: 14597 - DNA, 20 bp, Artificial Sequence
  Description of Artificial Sequence: Synthetic oligonucleotide
  Target: ATXN1; (-) strand; PAM type: NNGRRT; PAM sequence: ATGAAT
tggcttgccttgtaggattc

SEQ ID NO: 14598 - DNA, 20 bp, Artificial Sequence
  Description of Artificial Sequence: Synthetic oligonucleotide
  Target: ATXN1; (-) strand; PAM type: NNGRRT; PAM sequence: TAGGAT
atgtgtagtggcttgccttg

SEQ ID NO: 14599 - DNA, 20 bp, Artificial Sequence
  Description of Artificial Sequence: Synthetic oligonucleotide
  Target: ATXN1; (-) strand; PAM type: NNGRRT; PAM sequence: GTGAAT
ctacctgtgaacagtacgca

SEQ ID NO: 14600 - DNA, 20 bp, Artificial Sequence
  Description of Artificial Sequence: Synthetic oligonucleotide
  Target: ATXN1; (-) strand; PAM type: NNGRRT; PAM sequence: TGGGGT
cccagaaatggcttcaactt

SEQ ID NO: 14601 - DNA, 20 bp, Artificial Sequence
  Description of Artificial Sequence: Synthetic oligonucleotide
  Target: ATXN1; (-) strand; PAM type: NNGRRT; PAM sequence: AAGAGT
gtccttgcctccttttgcag

SEQ ID NO: 14602 - DNA, 20 bp, Artificial Sequence
  Description of Artificial Sequence: Synthetic oligonucleotide
  Target: ATXN1; (-) strand; PAM type: NNGRRT; PAM sequence: AAGAAT
gggaactgtgtgtgctttgc

SEQ ID NO: 14603 - DNA, 20 bp, Artificial Sequence
  Description of Artificial Sequence: Synthetic oligonucleotide
  Target: ATXN1; (-) strand; PAM type: NNGRRT; PAM sequence: GTGGAT
caacgctttgcattaacata

SEQ ID NO: 14604 - DNA, 20 bp, Artificial Sequence
  Description of Artificial Sequence: Synthetic oligonucleotide
  Target: ATXN1; (-) strand; PAM type: NNGRRT; PAM sequence: CGGGAT
tgcagacgtttggatgctcc

SEQ ID NO: 14605 - DNA, 20 bp, Artificial Sequence
  Description of Artificial Sequence: Synthetic oligonucleotide
  Target: ATXN1; (-) strand; PAM type: NNGRRT; PAM sequence: TTGGAT
acagtagggcatgcagacgt

SEQ ID NO: 14606 - DNA, 20 bp, Artificial Sequence
  Description of Artificial Sequence: Synthetic oligonucleotide
  Target: ATXN1; (-) strand; PAM type: NNGRRT; PAM sequence: GTGGGT
ggcctcgctgtgccactctg

SEQ ID NO: 14607 - DNA, 20 bp, Artificial Sequence
  Description of Artificial Sequence: Synthetic oligonucleotide
  Target: ATXN1; (-) strand; PAM type: NNGRRT; PAM sequence: ATGAAT
aaaatattaatgatcaggat

SEQ ID NO: 14608 - DNA, 20 bp, Artificial Sequence
  Description of Artificial Sequence: Synthetic oligonucleotide
  Target: ATXN1; (-) strand; PAM type: NNGRRT; PAM sequence: CAGGAT
gtgtggaaaatattaatgat

SEQ ID NO: 14609 - DNA, 20 bp, Artificial Sequence
  Description of Artificial Sequence: Synthetic oligonucleotide
  Target: ATXN1; (-) strand; PAM type: NNGRRT; PAM sequence: CTGGGT
cgttccaggagaagctgttc

SEQ ID NO: 14610 - DNA, 20 bp, Artificial Sequence
  Description of Artificial Sequence: Synthetic oligonucleotide
  Target: ATXN1; (-) strand; PAM type: NNGRRT; PAM sequence: GTGAGT
tgaaagtgatggttaattat

SEQ ID NO: 14611 - DNA, 20 bp, Artificial Sequence
  Description of Artificial Sequence: Synthetic oligonucleotide
  Target: ATXN1; (-) strand; PAM type: NNGRRT; PAM sequence: GCGAAT
accaagtaaaattgtatcaa

SEQ ID NO: 14612 - DNA, 20 bp, Artificial Sequence
  Description of Artificial Sequence: Synthetic oligonucleotide
  Target: ATXN1; (-) strand; PAM type: NNGRRT; PAM sequence: GTGGAT
ccagttgaacacagagcctg

SEQ ID NO: 14613 - DNA, 20 bp, Artificial Sequence
  Description of Artificial Sequence: Synthetic oligonucleotide
  Target: ATXN1; (-) strand; PAM type: NNGRRT; PAM sequence: CAGGGT
ggcagtgagctccttgggtg

SEQ ID NO: 14614 - DNA, 20 bp, Artificial Sequence
  Description of Artificial Sequence: Synthetic oligonucleotide
  Target: ATXN1; (-) strand; PAM type: NNGRRT; PAM sequence: TTGGGT
ctcttgaggcagtgagctcc

SEQ ID NO: 14615 - DNA, 20 bp, Artificial Sequence
  Description of Artificial Sequence: Synthetic oligonucleotide
  Target: ATXN1; (-) strand; PAM type: NNGRRT; PAM sequence: TCGAAT
ctcatttttgactttcctgt

SEQ ID NO: 14616 - DNA, 20 bp, Artificial Sequence
  Description of Artificial Sequence: Synthetic oligonucleotide
  Target: ATXN1; (-) strand; PAM type: NNGRRT; PAM sequence: ATGAAT
atggcctagcagtcagaaag

SEQ ID NO: 14617 - DNA, 20 bp, Artificial Sequence
  Description of Artificial Sequence: Synthetic oligonucleotide
  Target: ATXN1; (-) strand; PAM type: NNGRRT; PAM sequence: AGGGGT
tcaagaataatacctgcatc

SEQ ID NO: 14618 - DNA, 20 bp, Artificial Sequence
  Description of Artificial Sequence: Synthetic oligonucleotide
  Target: ATXN1; (-) strand; PAM type: NNGRRT; PAM sequence: AAGAAT
tcattatttgctgtcacatc

SEQ ID NO: 14619 - DNA, 20 bp, Artificial Sequence
  Description of Artificial Sequence: Synthetic oligonucleotide
  Target: ATXN1; (-) strand; PAM type: NNGRRT; PAM sequence: CAGGGT
acttggggtgcattagagag

SEQ ID NO: 14620 - DNA, 20 bp, Artificial Sequence
  Description of Artificial Sequence: Synthetic oligonucleotide
  Target: ATXN1; (-) strand; PAM type: NNGRRT; PAM sequence: TGGGGT
actgtgataacggagtgact

SEQ ID NO: 14621 - DNA, 20 bp, Artificial Sequence
  Description of Artificial Sequence: Synthetic oligonucleotide
  Target: ATXN1; (-) strand; PAM type: NNGRRT; PAM sequence: CGGAGT
cttttacttcactgtgataa

SEQ ID NO: 14622 - DNA, 20 bp, Artificial Sequence
  Description of Artificial Sequence: Synthetic oligonucleotide
  Target: ATXN1; (-) strand; PAM type: NNGRRT; PAM sequence: GAGGGT
gttttcagtcctttttgggg

SEQ ID NO: 14623 - DNA, 20 bp, Artificial Sequence
  Description of Artificial Sequence: Synthetic oligonucleotide
  Target: ATXN1; (-) strand; PAM type: NNGRRT; PAM sequence: GTGGGT
gcaccttgcttgcggctcat

SEQ ID NO: 14624 - DNA, 20 bp, Artificial Sequence
  Description of Artificial Sequence: Synthetic oligonucleotide
  Target: ATXN1; (-) strand; PAM type: NNGRRT; PAM sequence: TGGGAT
gaattaagttgagccagatg

SEQ ID NO: 14625 - DNA, 20 bp, Artificial Sequence
  Description of Artificial Sequence: Synthetic oligonucleotide
  Target: ATXN1; (-) strand; PAM type: NNGRRT; PAM sequence: AAGAAT
ctactgattttccttagtgg

SEQ ID NO: 14626 - DNA, 20 bp, Artificial Sequence
  Description of Artificial Sequence: Synthetic oligonucleotide
  Target: ATXN1; (-) strand; PAM type: NNGRRT; PAM sequence: TAGGAT
tggatgatgctttaatgttg

SEQ ID NO: 14627 - DNA, 20 bp, Artificial Sequence
  Description of Artificial Sequence: Synthetic oligonucleotide
  Target: ATXN1; (-) strand; PAM type: NNGRRT; PAM sequence: TTGGAT
ggagaacatgaatgagcctg

SEQ ID NO: 14628 - DNA, 20 bp, Artificial Sequence
  Description of Artificial Sequence: Synthetic oligonucleotide
  Target: ATXN1; (-) strand; PAM type: NNGRRT; PAM sequence: ATGAAT
actccattcatggggagaac

SEQ ID NO: 14629 - DNA, 20 bp, Artificial Sequence
  Description of Artificial Sequence: Synthetic oligonucleotide
  Target: ATXN1; (-) strand; PAM type: NNGRRT; PAM sequence: TAGGAT
ttgtttgtataagaagcttg

SEQ ID NO: 14630 - DNA, 20 bp, Artificial Sequence
  Description of Artificial Sequence: Synthetic oligonucleotide
  Target: ATXN1; (-) strand; PAM type: NNGRRT; PAM sequence: TGGAAT
atactctgagactttgaatg

SEQ ID NO: 14631 - DNA, 20 bp, Artificial Sequence
  Description of Artificial Sequence: Synthetic oligonucleotide
  Target: ATXN1; (-) strand; PAM type: NNGRRT; PAM sequence: TTGAAT
aaggtttatactctgagact

SEQ ID NO: 14632 - DNA, 20 bp, Artificial Sequence
  Description of Artificial Sequence: Synthetic oligonucleotide
  Target: ATXN1; (-) strand; PAM type: NNGRRT; PAM sequence: CTGAGT
tcttgttctctctctccttt

SEQ ID NO: 14633 - DNA, 20 bp, Artificial Sequence
  Description of Artificial Sequence: Synthetic oligonucleotide
  Target: ATXN1; (-) strand; PAM type: NNGRRT; PAM sequence: GAGGAT
gtcattttctcctctaggca

SEQ ID NO: 14634 - DNA, 20 bp, Artificial Sequence
  Description of Artificial Sequence: Synthetic oligonucleotide
  Target: ATXN1; (-) strand; PAM type: NNGRRT; PAM sequence: CAGAAT
aactgaaaaggaccttgggt

SEQ ID NO: 14635 - DNA, 20 bp, Artificial Sequence
  Description of Artificial Sequence: Synthetic oligonucleotide
  Target: ATXN1; (-) strand; PAM type: NNGRRT; PAM sequence: TTGGGT
gtgctgaactgaaaaggacc

SEQ ID NO: 14636 - DNA, 20 bp, Artificial Sequence
  Description of Artificial Sequence: Synthetic oligonucleotide
  Target: ATXN1; (-) strand; PAM type: NNGRRT; PAM sequence: TGGAGT
caagacttaaataaatccag

SEQ ID NO: 14637 - DNA, 20 bp, Artificial Sequence
  Description of Artificial Sequence: Synthetic oligonucleotide
  Target: ATXN1; (-) strand; PAM type: NNGRRT; PAM sequence: ATGGAT
tcctagaacaggttttggat

SEQ ID NO: 14638 - DNA, 20 bp, Artificial Sequence
  Description of Artificial Sequence: Synthetic oligonucleotide
  Target: ATXN1; (-) strand; PAM type: NNGRRT; PAM sequence: TTGGAT
gttaagtcctagaacaggtt

SEQ ID NO: 14639 - DNA, 20 bp, Artificial Sequence
  Description of Artificial Sequence: Synthetic oligonucleotide
  Target: ATXN1; (-) strand; PAM type: NNGRRT; PAM sequence: AAGGGT
actggtgattcttttggagt

SEQ ID NO: 14640 - DNA, 20 bp, Artificial Sequence
  Description of Artificial Sequence: Synthetic oligonucleotide
  Target: ATXN1; (-) strand; PAM type: NNGRRT; PAM sequence: TGGAGT
ctgtagactggtgattcttt

SEQ ID NO: 14641 - DNA, 20 bp, Artificial Sequence
  Description of Artificial Sequence: Synthetic oligonucleotide
  Target: ATXN1; (-) strand; PAM type: NNGRRT; PAM sequence: TTGAGT
aagttgtaatttaatttttt

SEQ ID NO: 14642 - DNA, 20 bp, Artificial Sequence
  Description of Artificial Sequence: Synthetic oligonucleotide
  Target: ATXN1; (-) strand; PAM type: NNGRRT; PAM sequence: CAGAAT
gatgtaatggattggaagaa

SEQ ID NO: 14643 - DNA, 20 bp, Artificial Sequence
  Description of Artificial Sequence: Synthetic oligonucleotide
  Target: ATXN1; (-) strand; PAM type: NNGRRT; PAM sequence: ATGGAT
cactaatgacttaagatgta

SEQ ID NO: 14644 - DNA, 20 bp, Artificial Sequence
  Description of Artificial Sequence: Synthetic oligonucleotide
  Target: ATXN1; (-) strand; PAM type: NNGRRT; PAM sequence: GGGAGT
tgctggtgatgaggaaatgg

SEQ ID NO: 14645 - DNA, 20 bp, Artificial Sequence
  Description of Artificial Sequence: Synthetic oligonucleotide
  Target: ATXN1; (-) strand; PAM type: NNGRRT; PAM sequence: TTGAAT
tttctgatgctgcttcaagt

SEQ ID NO: 14646 - DNA, 20 bp, Artificial Sequence
  Description of Artificial Sequence: Synthetic oligonucleotide
  Target: ATXN1; (-) strand; PAM type: NNGRRT; PAM sequence: TGGGAT
gcctcagcctcccaaagtgc

SEQ ID NO: 14647 - DNA, 20 bp, Artificial Sequence
  Description of Artificial Sequence: Synthetic oligonucleotide
  Target: ATXN1; (-) strand; PAM type: NNGRRT; PAM sequence: TGGGGT
tcttgttctttcgcccaggc

SEQ ID NO: 14648 - DNA, 20 bp, Artificial Sequence
  Description of Artificial Sequence: Synthetic oligonucleotide
  Target: ATXN1; (-) strand; PAM type: NNGRRT; PAM sequence: CGGAGT
tttctttcctttttttgagt

SEQ ID NO: 14649 - DNA, 20 bp, Artificial Sequence
  Description of Artificial Sequence: Synthetic oligonucleotide
  Target: ATXN1; (-) strand; PAM type: NNGRRT; PAM sequence: TTGAGT
tattcgtttctttccttttt

SEQ ID NO: 14650 - DNA, 20 bp, Artificial Sequence
  Description of Artificial Sequence: Synthetic oligonucleotide
  Target: ATXN1; (-) strand; PAM type: NNGRRT; PAM sequence: ATGGGT
ctgaatcagaaattctacag

SEQ ID NO: 14651 - DNA, 20 bp, Artificial Sequence
  Description of Artificial Sequence: Synthetic oligonucleotide
  Target: ATXN1; (-) strand; PAM type: NNGRRT; PAM sequence: CTGAAT
ctgaccccaccccaagccta

SEQ ID NO: 14652 - DNA, 20 bp, Artificial Sequence
  Description of Artificial Sequence: Synthetic oligonucleotide
  Target: ATXN1; (-) strand; PAM type: NNGRRT; PAM sequence: CTGGGT
gccacacacagtgtaataac

SEQ ID NO: 14653 - DNA, 20 bp, Artificial Sequence
  Description of Artificial Sequence: Synthetic oligonucleotide
  Target: ATXN1; (-) strand; PAM type: NNGRRT; PAM sequence: ATGGAT
ctggaaccagtaggaggaga

SEQ ID NO: 14654 - DNA, 20 bp, Artificial Sequence
  Description of Artificial Sequence: Synthetic oligonucleotide
  Target: ATXN1; (-) strand; PAM type: NNGRRT; PAM sequence: GAGAAT
ggatctggaaccagtaggag

SEQ ID NO: 14655 - DNA, 20 bp, Artificial Sequence
  Description of Artificial Sequence: Synthetic oligonucleotide
  Target: ATXN1; (-) strand; PAM type: NNGRRT; PAM sequence: CAGGAT
gggagcagagttgaccccag

SEQ ID NO: 14656 - DNA, 20 bp, Artificial Sequence
  Description of Artificial Sequence: Synthetic oligonucleotide
  Target: ATXN1; (-) strand; PAM type: NNGRRT; PAM sequence: CAGAGT
gactgaagggaagttgggag

SEQ ID NO: 14657 - DNA, 20 bp, Artificial Sequence
  Description of Artificial Sequence: Synthetic oligonucleotide
  Target: ATXN1; (-) strand; PAM type: NNGRRT; PAM sequence: TGGAGT
tagcagtgactgagtatgct

SEQ ID NO: 14658 - DNA, 20 bp, Artificial Sequence
  Description of Artificial Sequence: Synthetic oligonucleotide
  Target: ATXN1; (-) strand; PAM type: NNGRRT; PAM sequence: CTGAGT
tcttttaggaatagcagtga

SEQ ID NO: 14659 - DNA, 20 bp, Artificial Sequence
  Description of Artificial Sequence: Synthetic oligonucleotide
  Target: ATXN1; (-) strand; PAM type: NNGRRT; PAM sequence: AGGAAT
gggtatggataaattctttt

SEQ ID NO: 14660 - DNA, 20 bp, Artificial Sequence
  Description of Artificial Sequence: Synthetic oligonucleotide
  Target: ATXN1; (-) strand; PAM type: NNGRRT; PAM sequence: ATGGAT
atttgggactgtattagggt

SEQ ID NO: 14661 - DNA, 20 bp, Artificial Sequence
  Description of Artificial Sequence: Synthetic oligonucleotide
  Target: ATXN1; (-) strand; PAM type: NNGRRT; PAM sequence: TAGGGT
acagccatttgggactgtat

SEQ ID NO: 14662 - DNA, 20 bp, Artificial Sequence
  Description of Artificial Sequence: Synthetic oligonucleotide
  Target: ATXN1; (-) strand; PAM type: NNGRRT; PAM sequence: TTGAAT
taggcggtgaaatactggca

SEQ ID NO: 14663 - DNA, 20 bp, Artificial Sequence
  Description of Artificial Sequence: Synthetic oligonucleotide
  Target: ATXN1; (-) strand; PAM type: NNGRRT; PAM sequence: CAGAGT
aagtggtggaaatcaagctc

SEQ ID NO: 14664 - DNA, 20 bp, Artificial Sequence
  Description of Artificial Sequence: Synthetic oligonucleotide
  Target: ATXN1; (-) strand; PAM type: NNGRRT; PAM sequence: CTGGGT
tgtattacgattgcccagac

SEQ ID NO: 14665 - DNA, 20 bp, Artificial Sequence
  Description of Artificial Sequence: Synthetic oligonucleotide
  Target: ATXN1; (-) strand; PAM type: NNGRRT; PAM sequence: GAGGGT
taggccagtcactgtggctg

SEQ ID NO: 14666 - DNA, 20 bp, Artificial Sequence
  Description of Artificial Sequence: Synthetic oligonucleotide
  Target: ATXN1; (-) strand; PAM type: NNGRRT; PAM sequence: TTGGGT
aggcctttgattggcttgcc

SEQ ID NO: 14667 - DNA, 20 bp, Artificial Sequence
  Description of Artificial Sequence: Synthetic oligonucleotide
  Target: ATXN1; (-) strand; PAM type: NNGRRT; PAM sequence: AAGAGT
ctcccgtggtctcactagga

SEQ ID NO: 14668 - DNA, 20 bp, Artificial Sequence
  Description of Artificial Sequence: Synthetic oligonucleotide
  Target: ATXN1; (-) strand; PAM type: NNGRRT; PAM sequence: AGGGAT
aaaaaaaaaaaaaaaaatcc

SEQ ID NO: 14669 - DNA, 20 bp, Artificial Sequence
  Description of Artificial Sequence: Synthetic oligonucleotide
  Target: ATXN1; (-) strand; PAM type: NNGRRT; PAM sequence: CTGGGT
agaccgtgccactgctctgt

SEQ ID NO: 14670 - DNA, 20 bp, Artificial Sequence
  Description of Artificial Sequence: Synthetic oligonucleotide
  Target: ATXN1; (-) strand; PAM type: NNGRRT; PAM sequence: GTGAGT
actcggagtcagaggttgca

SEQ ID NO: 14671 - DNA, 20 bp, Artificial Sequence
  Description of Artificial Sequence: Synthetic oligonucleotide
  Target: ATXN1; (-) strand; PAM type: NNGRRT; PAM sequence: CGGAGT
tcaggagtattgcttgaact

SEQ ID NO: 14672 - DNA, 20 bp, Artificial Sequence
  Description of Artificial Sequence: Synthetic oligonucleotide
  Target: ATXN1; (-) strand; PAM type: NNGRRT; PAM sequence: AGGAGT
gctactcgggaggctgagtc

SEQ ID NO: 14673 - DNA, 20 bp, Artificial Sequence
  Description of Artificial Sequence: Synthetic oligonucleotide
  Target: ATXN1; (-) strand; PAM type: NNGRRT; PAM sequence: CTGAGT
aatcccagctactcgggagg

SEQ ID NO: 14674 - DNA, 20 bp, Artificial Sequence
  Description of Artificial Sequence: Synthetic oligonucleotide
  Target: ATXN1; (-) strand; PAM type: NNGRRT; PAM sequence: GAGAAT
tactcaggaggctgagacag

SEQ ID NO: 14675 - DNA, 20 bp, Artificial Sequence
  Description of Artificial Sequence: Synthetic oligonucleotide
  Target: ATXN1; (-) strand; PAM type: NNGRRT; PAM sequence: AGGAGT
caggtggatcacttgaggcc

SEQ ID NO: 14676 - DNA, 20 bp, Artificial Sequence
  Description of Artificial Sequence: Synthetic oligonucleotide
  Target: ATXN1; (-) strand; PAM type: NNGRRT; PAM sequence: GTGGAT
actttgggaggctgaggcag

SEQ ID NO: 14677 - DNA, 20 bp, Artificial Sequence
  Description of Artificial Sequence: Synthetic oligonucleotide
  Target: ATXN1; (-) strand; PAM type: NNGRRT; PAM sequence: AGGGAT
ataatataactaaaaattcc

SEQ ID NO: 14678 - DNA, 20 bp, Artificial Sequence
  Description of Artificial Sequence: Synthetic oligonucleotide
  Target: ATXN1; (-) strand; PAM type: NNGRRT; PAM sequence: TAGAAT
ggcaatcttgtgggctacgt

SEQ ID NO: 14679 - DNA, 20 bp, Artificial Sequence
  Description of Artificial Sequence: Synthetic oligonucleotide
  Target: ATXN1; (-) strand; PAM type: NNGRRT; PAM sequence: TAGGGT
tggtaaagccccatcccttt

SEQ ID NO: 14680 - DNA, 20 bp, Artificial Sequence
  Description of Artificial Sequence: Synthetic oligonucleotide
  Target: ATXN1; (-) strand; PAM type: NNGRRT; PAM sequence: TTGAAT
tcaacatgtcctctctcact

SEQ ID NO: 14681 - DNA, 20 bp, Artificial Sequence
  Description of Artificial Sequence: Synthetic oligonucleotide
  Target: ATXN1; (-) strand; PAM type: NNGRRT; PAM sequence: CAGGGT
gcttagctgaattatctgtt

SEQ ID NO: 14682 - DNA, 20 bp, Artificial Sequence
  Description of Artificial Sequence: Synthetic oligonucleotide
  Target: ATXN1; (-) strand; PAM type: NNGRRT; PAM sequence: CTGAAT
gaagtccaggcatggcttag

SEQ ID NO: 14683 - DNA, 20 bp, Artificial Sequence
  Description of Artificial Sequence: Synthetic oligonucleotide
  Target: ATXN1; (-) strand; PAM type: NNGRRT; PAM sequence: TTGAAT
gaagtccaggcatggcttag

SEQ ID NO: 14684 - DNA, 20 bp, Artificial Sequence
  Description of Artificial Sequence: Synthetic oligonucleotide
  Target: ATXN1; (-) strand; PAM type: NNGRRT; PAM sequence: CAGAGT
ccccaccccactacagtccc

SEQ ID NO: 14685 - DNA, 20 bp, Artificial Sequence
  Description of Artificial Sequence: Synthetic oligonucleotide
  Target: ATXN1; (-) strand; PAM type: NNGRRT; PAM sequence: TAGGGT
tattattatactttaggttt

SEQ ID NO: 14686 - DNA, 20 bp, Artificial Sequence
  Description of Artificial Sequence: Synthetic oligonucleotide
  Target: ATXN1; (-) strand; PAM type: NNGRRT; PAM sequence: GTGGAT
agaaatgtattgtattatat

SEQ ID NO: 14687 - DNA, 20 bp, Artificial Sequence
  Description of Artificial Sequence: Synthetic oligonucleotide
  Target: ATXN1; (-) strand; PAM type: NNGRRT; PAM sequence: AAGAAT
agtaccatctcagagaaatt

SEQ ID NO: 14688 - DNA, 20 bp, Artificial Sequence
  Description of Artificial Sequence: Synthetic oligonucleotide
  Target: ATXN1; (-) strand; PAM type: NNGRRT; PAM sequence: AGGAGT
aaaactgcagaggggccata

SEQ ID NO: 14689 - DNA, 20 bp, Artificial Sequence
  Description of Artificial Sequence: Synthetic oligonucleotide
  Target: ATXN1; (-) strand; PAM type: NNGRRT; PAM sequence: TAGAGT
gccttaggaaatctgtcccc

SEQ ID NO: 14690 - DNA, 20 bp, Artificial Sequence
  Description of Artificial Sequence: Synthetic oligonucleotide
  Target: ATXN1; (-) strand; PAM type: NNGRRT; PAM sequence: GTGAAT
gaaggaaatcattatagaaa

SEQ ID NO: 14691 - DNA, 20 bp, Artificial Sequence
  Description of Artificial Sequence: Synthetic oligonucleotide
  Target: ATXN1; (-) strand; PAM type: NNGRRT; PAM sequence: CAGGAT
tagggggagataccagggac

SEQ ID NO: 14692 - DNA, 20 bp, Artificial Sequence
  Description of Artificial Sequence: Synthetic oligonucleotide
  Target: ATXN1; (-) strand; PAM type: NNGRRT; PAM sequence: AGGAGT
tgtttccactgcatatatcc

SEQ ID NO: 14693 - DNA, 20 bp, Artificial Sequence
  Description of Artificial Sequence: Synthetic oligonucleotide
  Target: ATXN1; (-) strand; PAM type: NNGRRT; PAM sequence: CTGGGT
cagaaattaaagaggaggag

SEQ ID NO: 14694 - DNA, 20 bp, Artificial Sequence
  Description of Artificial Sequence: Synthetic oligonucleotide
  Target: ATXN1; (-) strand; PAM type: NNGRRT; PAM sequence: AAGAGT
aaccgatggaatgtgggaga

SEQ ID NO: 14695 - DNA, 20 bp, Artificial Sequence
  Description of Artificial Sequence: Synthetic oligonucleotide
  Target: ATXN1; (-) strand; PAM type: NNGRRT; PAM sequence: TGGAAT
tggtaggacttggaaaccga

SEQ ID NO: 14696 - DNA, 20 bp, Artificial Sequence
  Description of Artificial Sequence: Synthetic oligonucleotide
  Target: ATXN1; (-) strand; PAM type: NNGRRT; PAM sequence: CAGAAT
cggtgaagatagaaagggtg

SEQ ID NO: 14697 - DNA, 20 bp, Artificial Sequence
  Description of Artificial Sequence: Synthetic oligonucleotide
  Target: ATXN1; (-) strand; PAM type: NNGRRT; PAM sequence: AAGGGT
catggggcggtgaagataga

SEQ ID NO: 14698 - DNA, 20 bp, Artificial Sequence
  Description of Artificial Sequence: Synthetic oligonucleotide
  Target: ATXN1; (-) strand; PAM type: NNGRRT; PAM sequence: AGGAAT
aatgagcaggctgctgtgag

SEQ ID NO: 14699 - DNA, 20 bp, Artificial Sequence
  Description of Artificial Sequence: Synthetic oligonucleotide
  Target: ATXN1; (-) strand; PAM type: NNGRRT; PAM sequence: AGGGAT
tttaggaagttcgatccaac

SEQ ID NO: 14700 - DNA, 20 bp, Artificial Sequence
  Description of Artificial Sequence: Synthetic oligonucleotide
  Target: ATXN1; (-) strand; PAM type: NNGRRT; PAM sequence: ATGGAT
ctgtaggaaccaatgaaggt

SEQ ID NO: 14701 - DNA, 20 bp, Artificial Sequence
  Description of Artificial Sequence: Synthetic oligonucleotide
  Target: ATXN1; (-) strand; PAM type: NNGRRT; PAM sequence: AAGAAT
aagatcttcagcatcaaata

SEQ ID NO: 14702 - DNA, 20 bp, Artificial Sequence
  Description of Artificial Sequence: Synthetic oligonucleotide
  Target: ATXN1; (-) strand; PAM type: NNGRRT; PAM sequence: TGGAGT
ctggcttacattttgacacg

SEQ ID NO: 14703 - DNA, 20 bp, Artificial Sequence
  Description of Artificial Sequence: Synthetic oligonucleotide
  Target: ATXN1; (-) strand; PAM type: NNGRRT; PAM sequence: TGGGAT
taaaagagttgtagaaaaag

SEQ ID NO: 14704 - DNA, 20 bp, Artificial Sequence
  Description of Artificial Sequence: Synthetic oligonucleotide
  Target: ATXN1; (-) strand; PAM type: NNGRRT; PAM sequence: AAGAGT
gttgtagaataagaggataa

SEQ ID NO: 14705 - DNA, 20 bp, Artificial Sequence
  Description of Artificial Sequence: Synthetic oligonucleotide
  Target: ATXN1; (-) strand; PAM type: NNGRRT; PAM sequence: GAGGAT
ttgagaaagttgtagaataa

SEQ ID NO: 14706 - DNA, 20 bp, Artificial Sequence
  Description of Artificial Sequence: Synthetic oligonucleotide
  Target: ATXN1; (-) strand; PAM type: NNGRRT; PAM sequence: TAGAAT
acttctgattgagaaagttg

SEQ ID NO: 14707 - DNA, 20 bp, Artificial Sequence
  Description of Artificial Sequence: Synthetic oligonucleotide
  Target: ATXN1; (-) strand; PAM type: NNGRRT; PAM sequence: ATGAAT
tggttagtaacataaggaaa

SEQ ID NO: 14708 - DNA, 20 bp, Artificial Sequence
  Description of Artificial Sequence: Synthetic oligonucleotide
  Target: ATXN1; (-) strand; PAM type: NNGRRT; PAM sequence: AGGAAT
atgacacctattgtaggata

SEQ ID NO: 14709 - DNA, 20 bp, Artificial Sequence
  Description of Artificial Sequence: Synthetic oligonucleotide
  Target: ATXN1; (-) strand; PAM type: NNGRRT; PAM sequence: TAGGAT
tggggagatgacacctattg

SEQ ID NO: 14710 - DNA, 20 bp, Artificial Sequence
  Description of Artificial Sequence: Synthetic oligonucleotide
  Target: ATXN1; (-) strand; PAM type: NNGRRT; PAM sequence: AAGAGT
taatcaacaaatattgatca

SEQ ID NO: 14711 - DNA, 20 bp, Artificial Sequence
  Description of Artificial Sequence: Synthetic oligonucleotide
  Target: ATXN1; (-) strand; PAM type: NNGRRT; PAM sequence: AAGGGT
tttttctccaagtcacccaa

SEQ ID NO: 14712 - DNA, 20 bp, Artificial Sequence
  Description of Artificial Sequence: Synthetic oligonucleotide
  Target: ATXN1; (-) strand; PAM type: NNGRRT; PAM sequence: CTGAGT
acaaagagttacctttagtt

SEQ ID NO: 14713 - DNA, 20 bp, Artificial Sequence
  Description of Artificial Sequence: Synthetic oligonucleotide
  Target: ATXN1; (-) strand; PAM type: NNGRRT; PAM sequence: AAGAGT
ttcctcagaaaggaaataca

SEQ ID NO: 14714 - DNA, 20 bp, Artificial Sequence
  Description of Artificial Sequence: Synthetic oligonucleotide
  Target: ATXN1; (-) strand; PAM type: NNGRRT; PAM sequence: CTGAGT
gggctctgcaccctgctggg

SEQ ID NO: 14715 - DNA, 20 bp, Artificial Sequence
  Description of Artificial Sequence: Synthetic oligonucleotide
  Target: ATXN1; (-) strand; PAM type: NNGRRT; PAM sequence: CAGGGT
cacttaagctccttggtggg

SEQ ID NO: 14716 - DNA, 20 bp, Artificial Sequence
  Description of Artificial Sequence: Synthetic oligonucleotide
  Target: ATXN1; (-) strand; PAM type: NNGRRT; PAM sequence: AGGGGT
gagatgcctctccatgggaa

SEQ ID NO: 14717 - DNA, 20 bp, Artificial Sequence
  Description of Artificial Sequence: Synthetic oligonucleotide
  Target: ATXN1; (-) strand; PAM type: NNGRRT; PAM sequence: TTGAGT
atcatattcttcagaatacc

SEQ ID NO: 14718 - DNA, 20 bp, Artificial Sequence
  Description of Artificial Sequence: Synthetic oligonucleotide
  Target: ATXN1; (-) strand; PAM type: NNGRRT; PAM sequence: CAGAAT
tgtgaataaatcatattctt

SEQ ID NO: 14719 - DNA, 20 bp, Artificial Sequence
  Description of Artificial Sequence: Synthetic oligonucleotide
  Target: ATXN1; (-) strand; PAM type: NNGRRT; PAM sequence: GTGAAT
aacagggaacgcatgatatt

SEQ ID NO: 14720 - DNA, 20 bp, Artificial Sequence
  Description of Artificial Sequence: Synthetic oligonucleotide
  Target: ATXN1; (-) strand; PAM type: NNGRRT; PAM sequence: ATGGAT
agtttgtaagaaattttaca

SEQ ID NO: 14721 - DNA, 20 bp, Artificial Sequence
  Description of Artificial Sequence: Synthetic oligonucleotide
  Target: ATXN1; (-) strand; PAM type: NNGRRT; PAM sequence: CTGAGT
taatatacacagagaatatt

SEQ ID NO: 14722 - DNA, 20 bp, Artificial Sequence
  Description of Artificial Sequence: Synthetic oligonucleotide
  Target: ATXN1; (-) strand; PAM type: NNGRRT; PAM sequence: GAGAAT
caaaccagttaatatacaca

SEQ ID NO: 14723 - DNA, 20 bp, Artificial Sequence
  Description of Artificial Sequence: Synthetic oligonucleotide
  Target: ATXN1; (-) strand; PAM type: NNGRRT; PAM sequence: TTGGAT
tctttaggccggtactaatt

SEQ ID NO: 14724 - DNA, 20 bp, Artificial Sequence
  Description of Artificial Sequence: Synthetic oligonucleotide
  Target: ATXN1; (-) strand; PAM type: NNGRRT; PAM sequence: GAGGAT
aatttttttaaaaaaccttt

SEQ ID NO: 14725 - DNA, 20 bp, Artificial Sequence
  Description of Artificial Sequence: Synthetic oligonucleotide
  Target: ATXN1; (-) strand; PAM type: NNGRRT; PAM sequence: ATGGAT
taatgataagaagcagtgac

SEQ ID NO: 14726 - DNA, 20 bp, Artificial Sequence
  Description of Artificial Sequence: Synthetic oligonucleotide
  Target: ATXN1; (-) strand; PAM type: NNGRRT; PAM sequence: ATGAAT
cacacagcagcagtctctgt

SEQ ID NO: 14727 - DNA, 20 bp, Artificial Sequence
  Description of Artificial Sequence: Synthetic oligonucleotide
  Target: ATXN1; (-) strand; PAM type: NNGRRT; PAM sequence: TTGGGT
ctacagctgctcagcacaga

SEQ ID NO: 14728 - DNA, 20 bp, Artificial Sequence
  Description of Artificial Sequence: Synthetic oligonucleotide
  Target: ATXN1; (-) strand; PAM type: NNGRRT; PAM sequence: AGGAAT
cgtgttgaacaaataaggcc

SEQ ID NO: 14729 - DNA, 20 bp, Artificial Sequence
  Description of Artificial Sequence: Synthetic oligonucleotide
  Target: ATXN1; (-) strand; PAM type: NNGRRT; PAM sequence: TGGAGT
gggatgtgtaactcgggatg

SEQ ID NO: 14730 - DNA, 20 bp, Artificial Sequence
  Description of Artificial Sequence: Synthetic oligonucleotide
  Target: ATXN1; (-) strand; PAM type: NNGRRT; PAM sequence: CGGGAT
cagaaaggggatgtgtaact

SEQ ID NO: 14731 - DNA, 20 bp, Artificial Sequence
  Description of Artificial Sequence: Synthetic oligonucleotide
  Target: ATXN1; (-) strand; PAM type: NNGRRT; PAM sequence: GGGGAT
tgactcatggcaaccagaaa

SEQ ID NO: 14732 - DNA, 20 bp, Artificial Sequence
  Description of Artificial Sequence: Synthetic oligonucleotide
  Target: ATXN1; (-) strand; PAM type: NNGRRT; PAM sequence: ATGAAT
actgaccttttcaagcaggc

SEQ ID NO: 14733 - DNA, 20 bp, Artificial Sequence
  Description of Artificial Sequence: Synthetic oligonucleotide
  Target: ATXN1; (-) strand; PAM type: NNGRRT; PAM sequence: TAGGAT
atatttagctatttcttttt

SEQ ID NO: 14734 - DNA, 20 bp, Artificial Sequence
  Description of Artificial Sequence: Synthetic oligonucleotide
  Target: ATXN1; (-) strand; PAM type: NNGRRT; PAM sequence: GAGAAT
tctcaatattatggcaaaaa

SEQ ID NO: 14735 - DNA, 20 bp, Artificial Sequence
  Description of Artificial Sequence: Synthetic oligonucleotide
  Target: ATXN1; (-) strand; PAM type: NNGRRT; PAM sequence: GTGGAT
agaggttgggagatgcatat

SEQ ID NO: 14736 - DNA, 20 bp, Artificial Sequence
  Description of Artificial Sequence: Synthetic oligonucleotide
  Target: ATXN1; (-) strand; PAM type: NNGRRT; PAM sequence: TAGGAT
aaaggaagttgtggctttga

SEQ ID NO: 14737 - DNA, 20 bp, Artificial Sequence
  Description of Artificial Sequence: Synthetic oligonucleotide
  Target: ATXN1; (-) strand; PAM type: NNGRRT; PAM sequence: AGGGAT
gccttggcctcccaaagtac

SEQ ID NO: 14738 - DNA, 20 bp, Artificial Sequence
  Description of Artificial Sequence: Synthetic oligonucleotide
  Target: ATXN1; (-) strand; PAM type: NNGRRT; PAM sequence: CAGGGT
ttttgtatttttagtagaga

SEQ ID NO: 14739 - DNA, 20 bp, Artificial Sequence
  Description of Artificial Sequence: Synthetic oligonucleotide
  Target: ATXN1; (-) strand; PAM type: NNGRRT; PAM sequence: GTGAGT
gattctcctgcctcagcctc

SEQ ID NO: 14740 - DNA, 20 bp, Artificial Sequence
  Description of Artificial Sequence: Synthetic oligonucleotide
  Target: ATXN1; (-) strand; PAM type: NNGRRT; PAM sequence: CTGGGT
ctcactgcaacctccgcttc

SEQ ID NO: 14741 - DNA, 20 bp, Artificial Sequence
  Description of Artificial Sequence: Synthetic oligonucleotide
  Target: ATXN1; (-) strand; PAM type: NNGRRT; PAM sequence: TAGAGT
tctcactctgtcacccaggc

SEQ ID NO: 14742 - DNA, 20 bp, Artificial Sequence
  Description of Artificial Sequence: Synthetic oligonucleotide
  Target: ATXN1; (-) strand; PAM type: NNGRRT; PAM sequence: GAGAGT
ttttttttgagagagagaga

SEQ ID NO: 14743 - DNA, 20 bp, Artificial Sequence
  Description of Artificial Sequence: Synthetic oligonucleotide
  Target: ATXN1; (-) strand; PAM type: NNGRRT; PAM sequence: TTGAAT
aattctgttgtttttgagct

SEQ ID NO: 14744 - DNA, 20 bp, Artificial Sequence
  Description of Artificial Sequence: Synthetic oligonucleotide
  Target: ATXN1; (-) strand; PAM type: NNGRRT; PAM sequence: TTGAAT
agttaaatctggcactgatt

SEQ ID NO: 14745 - DNA, 20 bp, Artificial Sequence
  Description of Artificial Sequence: Synthetic oligonucleotide
  Target: ATXN1; (-) strand; PAM type: NNGRRT; PAM sequence: ATGAGT
acaagtagaccaaaaagaaa

SEQ ID NO: 14746 - DNA, 20 bp, Artificial Sequence
  Description of Artificial Sequence: Synthetic oligonucleotide
  Target: ATXN1; (-) strand; PAM type: NNGRRT; PAM sequence: TGGAGT
taaaaaaggagtttaaagta

SEQ ID NO: 14747 - DNA, 20 bp, Artificial Sequence
  Description of Artificial Sequence: Synthetic oligonucleotide
  Target: ATXN1; (-) strand; PAM type: NNGRRT; PAM sequence: AGGAGT
actcggaatagtattaaaaa

SEQ ID NO: 14748 - DNA, 20 bp, Artificial Sequence
  Description of Artificial Sequence: Synthetic oligonucleotide
  Target: ATXN1; (-) strand; PAM type: NNGRRT; PAM sequence: CGGAAT
taaacaaggaggcagttact

SEQ ID NO: 14749 - DNA, 20 bp, Artificial Sequence
  Description of Artificial Sequence: Synthetic oligonucleotide
  Target: ATXN1; (-) strand; PAM type: NNGRRT; PAM sequence: TTGAGT
cttgcaatactttgttctga

SEQ ID NO: 14750 - DNA, 20 bp, Artificial Sequence
  Description of Artificial Sequence: Synthetic oligonucleotide
  Target: ATXN1; (-) strand; PAM type: NNGRRT; PAM sequence: TAGAAT
ttgaaatcccagttttaagc

SEQ ID NO: 14751 - DNA, 20 bp, Artificial Sequence
  Description of Artificial Sequence: Synthetic oligonucleotide
  Target: ATXN1; (-) strand; PAM type: NNGRRT; PAM sequence: AAGAAT
gcgccacattcatagaaaga

SEQ ID NO: 14752 - DNA, 20 bp, Artificial Sequence
  Description of Artificial Sequence: Synthetic oligonucleotide
  Target: ATXN1; (-) strand; PAM type: NNGRRT; PAM sequence: ATGGAT
tttccccatccctccacacg

SEQ ID NO: 14753 - DNA, 20 bp, Artificial Sequence
  Description of Artificial Sequence: Synthetic oligonucleotide
  Target: ATXN1; (-) strand; PAM type: NNGRRT; PAM sequence: CAGGGT
aaattgcagcaagtggagta

SEQ ID NO: 14754 - DNA, 20 bp, Artificial Sequence
  Description of Artificial Sequence: Synthetic oligonucleotide
  Target: ATXN1; (-) strand; PAM type: NNGRRT; PAM sequence: TGGAGT
tgcattgaaattgcagcaag

SEQ ID NO: 14755 - DNA, 20 bp, Artificial Sequence
  Description of Artificial Sequence: Synthetic oligonucleotide
  Target: ATXN1; (-) strand; PAM type: NNGRRT; PAM sequence: CTGAGT
gcgatcatcaggtattttaa

SEQ ID NO: 14756 - DNA, 20 bp, Artificial Sequence
  Description of Artificial Sequence: Synthetic oligonucleotide
  Target: ATXN1; (-) strand; PAM type: NNGRRT; PAM sequence: TGGGGT
catggtgtaaagaaattcct

SEQ ID NO: 14757 - DNA, 20 bp, Artificial Sequence
  Description of Artificial Sequence: Synthetic oligonucleotide
  Target: ATXN1; (-) strand; PAM type: NNGRRT; PAM sequence: TAGAAT
aaagagaggtaggaaacttg

SEQ ID NO: 14758 - DNA, 20 bp, Artificial Sequence
  Description of Artificial Sequence: Synthetic oligonucleotide
  Target: ATXN1; (-) strand; PAM type: NNGRRT; PAM sequence: AAGAGT
catagatgatgctaattcta

SEQ ID NO: 14759 - DNA, 20 bp, Artificial Sequence
  Description of Artificial Sequence: Synthetic oligonucleotide
  Target: ATXN1; (-) strand; PAM type: NNGRRT; PAM sequence: GAGAAT
atggggatatgctcttcccc

SEQ ID NO: 14760 - DNA, 20 bp, Artificial Sequence
  Description of Artificial Sequence: Synthetic oligonucleotide
  Target: ATXN1; (-) strand; PAM type: NNGRRT; PAM sequence: GGGGAT
ttctttctcctaatagaaat

SEQ ID NO: 14761 - DNA, 20 bp, Artificial Sequence
  Description of Artificial Sequence: Synthetic oligonucleotide
  Target: ATXN1; (-) strand; PAM type: NNGRRT; PAM sequence: TAGGAT
aatcccctgagccatgatac

SEQ ID NO: 14762 - DNA, 20 bp, Artificial Sequence
  Description of Artificial Sequence: Synthetic oligonucleotide
  Target: ATXN1; (-) strand; PAM type: NNGRRT; PAM sequence: GAGAAT
atattaggagttgtaagtgt

SEQ ID NO: 14763 - DNA, 20 bp, Artificial Sequence
  Description of Artificial Sequence: Synthetic oligonucleotide
  Target: ATXN1; (-) strand; PAM type: NNGRRT; PAM sequence: AGGAGT
ttctccttttttgatatatt

SEQ ID NO: 14764 - DNA, 20 bp, Artificial Sequence
  Description of Artificial Sequence: Synthetic oligonucleotide
  Target: ATXN1; (-) strand; PAM type: NNGRRT; PAM sequence: TAGAAT
gaattccattgttttagcaa

SEQ ID NO: 14765 - DNA, 20 bp, Artificial Sequence
  Description of Artificial Sequence: Synthetic oligonucleotide
  Target: ATXN1; (-) strand; PAM type: NNGRRT; PAM sequence: GAGAAT
cataacgaagtcattcccgg

SEQ ID NO: 14766 - DNA, 20 bp, Artificial Sequence
  Description of Artificial Sequence: Synthetic oligonucleotide
  Target: ATXN1; (-) strand; PAM type: NNGRRT; PAM sequence: CTGAAT
acacacaacacttgagtgct

SEQ ID NO: 14767 - DNA, 20 bp, Artificial Sequence
  Description of Artificial Sequence: Synthetic oligonucleotide
  Target: ATXN1; (-) strand; PAM type: NNGRRT; PAM sequence: TTGAGT
tgtcctcccacacacaacac

SEQ ID NO: 14768 - DNA, 20 bp, Artificial Sequence
  Description of Artificial Sequence: Synthetic oligonucleotide
  Target: ATXN1; (-) strand; PAM type: NNGRRT; PAM sequence: CTGAAT
gatgggaggaatgctgcaat

SEQ ID NO: 14769 - DNA, 20 bp, Artificial Sequence
  Description of Artificial Sequence: Synthetic oligonucleotide
  Target: ATXN1; (-) strand; PAM type: NNGRRT; PAM sequence: AGGAAT
tactgaaagacctggatggg

SEQ ID NO: 14770 - DNA, 20 bp, Artificial Sequence
  Description of Artificial Sequence: Synthetic oligonucleotide
  Target: ATXN1; (-) strand; PAM type: NNGRRT; PAM sequence: CTGGAT
ttatgattatactgaaagac

SEQ ID NO: 14771 - DNA, 20 bp, Artificial Sequence
  Description of Artificial Sequence: Synthetic oligonucleotide
  Target: ATXN1; (-) strand; PAM type: NNGRRT; PAM sequence: GGGAAT
ctgctggggtcagcaggaat

SEQ ID NO: 14772 - DNA, 20 bp, Artificial Sequence
  Description of Artificial Sequence: Synthetic oligonucleotide
  Target: ATXN1; (-) strand; PAM type: NNGRRT; PAM sequence: AGGAAT
ctttttctgctggggtcagc

SEQ ID NO: 14773 - DNA, 20 bp, Artificial Sequence
  Description of Artificial Sequence: Synthetic oligonucleotide
  Target: ATXN1; (-) strand; PAM type: NNGRRT; PAM sequence: TGGGGT
ttctttctctctttttctgc

SEQ ID NO: 14774 - DNA, 20 bp, Artificial Sequence
  Description of Artificial Sequence: Synthetic oligonucleotide
  Target: ATXN1; (-) strand; PAM type: NNGRRT; PAM sequence: GTGGAT
ctgctctgattgcctcgaag

SEQ ID NO: 14775 - DNA, 20 bp, Artificial Sequence
  Description of Artificial Sequence: Synthetic oligonucleotide
  Target: ATXN1; (-) strand; PAM type: NNGRRT; PAM sequence: ATGGAT
agtgcttttaactttggata

SEQ ID NO: 14776 - DNA, 20 bp, Artificial Sequence
  Description of Artificial Sequence: Synthetic oligonucleotide
  Target: ATXN1; (-) strand; PAM type: NNGRRT; PAM sequence: TTGGAT
gagttaaagtgcttttaact

SEQ ID NO: 14777 - DNA, 20 bp, Artificial Sequence
  Description of Artificial Sequence: Synthetic oligonucleotide
  Target: ATXN1; (-) strand; PAM type: NNGRRT; PAM sequence: CAGAGT
agacgtgatgctgttactag

SEQ ID NO: 14778 - DNA, 20 bp, Artificial Sequence
  Description of Artificial Sequence: Synthetic oligonucleotide
  Target: ATXN1; (-) strand; PAM type: NNGRRT; PAM sequence: AAGAAT
agagtgaaagtcacacgaac

SEQ ID NO: 14779 - DNA, 20 bp, Artificial Sequence
  Description of Artificial Sequence: Synthetic oligonucleotide
  Target: ATXN1; (-) strand; PAM type: NNGRRT; PAM sequence: GAGAGT
ggcgattcctgcaaacttag

SEQ ID NO: 14780 - DNA, 20 bp, Artificial Sequence
  Description of Artificial Sequence: Synthetic oligonucleotide
  Target: ATXN1; (-) strand; PAM type: NNGRRT; PAM sequence: AGGAAT
cgtccattgcactgtcacca

SEQ ID NO: 14781 - DNA, 20 bp, Artificial Sequence
  Description of Artificial Sequence: Synthetic oligonucleotide
  Target: ATXN1; (-) strand; PAM type: NNGRRT; PAM sequence: GTGAAT
aatgctgaattttgttttat

SEQ ID NO: 14782 - DNA, 20 bp, Artificial Sequence
  Description of Artificial Sequence: Synthetic oligonucleotide
  Target: ATXN1; (-) strand; PAM type: NNGRRT; PAM sequence: CTGAAT
ctttaaaaacagttaaaatg

SEQ ID NO: 14783 - DNA, 20 bp, Artificial Sequence
  Description of Artificial Sequence: Synthetic oligonucleotide
  Target: ATXN1; (-) strand; PAM type: NNGRRT; PAM sequence: TGGAGT
atggttgttcaacatgtgga

SEQ ID NO: 14784 - DNA, 20 bp, Artificial Sequence
  Description of Artificial Sequence: Synthetic oligonucleotide
  Target: ATXN1; (-) strand; PAM type: NNGRRT; PAM sequence: GTGGAT
tgatgatggttgttcaacat

SEQ ID NO: 14785 - DNA, 20 bp, Artificial Sequence
  Description of Artificial Sequence: Synthetic oligonucleotide
  Target: ATXN1; (-) strand; PAM type: NNGRRT; PAM sequence: TGGAAT
gggggatgatgacaatcttc

SEQ ID NO: 14786 - DNA, 20 bp, Artificial Sequence
  Description of Artificial Sequence: Synthetic oligonucleotide
  Target: ATXN1; (-) strand; PAM type: NNGRRT; PAM sequence: GGGGAT
gtgactgtttcatggataag

SEQ ID NO: 14787 - DNA, 20 bp, Artificial Sequence
  Description of Artificial Sequence: Synthetic oligonucleotide
  Target: ATXN1; (-) strand; PAM type: NNGRRT; PAM sequence: ATGGAT
ggacagggagtgactgtttc

SEQ ID NO: 14788 - DNA, 20 bp, Artificial Sequence
  Description of Artificial Sequence: Synthetic oligonucleotide
  Target: ATXN1; (-) strand; PAM type: NNGRRT; PAM sequence: GGGAGT
gctgagaggagtgggggaca

SEQ ID NO: 14789 - DNA, 20 bp, Artificial Sequence
  Description of Artificial Sequence: Synthetic oligonucleotide
  Target: ATXN1; (-) strand; PAM type: NNGRRT; PAM sequence: AGGAGT
agtctttgccaggggctgag

SEQ ID NO: 14790 - DNA, 20 bp, Artificial Sequence
  Description of Artificial Sequence: Synthetic oligonucleotide
  Target: ATXN1; (-) strand; PAM type: NNGRRT; PAM sequence: TAGAGT
atccagaatagacaactcct

SEQ ID NO: 14791 - DNA, 20 bp, Artificial Sequence
  Description of Artificial Sequence: Synthetic oligonucleotide
  Target: ATXN1; (-) strand; PAM type: NNGRRT; PAM sequence: CAGAAT
ttcagtttatacacaacatc

SEQ ID NO: 14792 - DNA, 20 bp, Artificial Sequence
  Description of Artificial Sequence: Synthetic oligonucleotide
  Target: ATXN1; (-) strand; PAM type: NNGRRT; PAM sequence: ATGAAT
gtactggtacatgttacaat

SEQ ID NO: 14793 - DNA, 20 bp, Artificial Sequence
  Description of Artificial Sequence: Synthetic oligonucleotide
  Target: ATXN1; (-) strand; PAM type: NNGRRT; PAM sequence: AAGAAT
gagtattattgaaccaaaac

SEQ ID NO: 14794 - DNA, 20 bp, Artificial Sequence
  Description of Artificial Sequence: Synthetic oligonucleotide
  Target: ATXN1; (-) strand; PAM type: NNGRRT; PAM sequence: TAGAGT
aaatgtggtatagcctacaa

SEQ ID NO: 14795 - DNA, 20 bp, Artificial Sequence
  Description of Artificial Sequence: Synthetic oligonucleotide
  Target: ATXN1; (-) strand; PAM type: NNGRRT; PAM sequence: ACGAAT
tcccaaatgtccatcaactg

SEQ ID NO: 14796 - DNA, 20 bp, Artificial Sequence
  Description of Artificial Sequence: Synthetic oligonucleotide
  Target: ATXN1; (-) strand; PAM type: NNGRRT; PAM sequence: TGGAAT
gattcatagtagcccaaata

SEQ ID NO: 14797 - DNA, 20 bp, Artificial Sequence
  Description of Artificial Sequence: Synthetic oligonucleotide
  Target: ATXN1; (-) strand; PAM type: NNGRRT; PAM sequence: ATGAAT
attcaaacaaaaacatgtac

SEQ ID NO: 14798 - DNA, 20 bp, Artificial Sequence
  Description of Artificial Sequence: Synthetic oligonucleotide
  Target: ATXN1; (-) strand; PAM type: NNGRRT; PAM sequence: CAGAAT
agtcctcaaatagctaaata

SEQ ID NO: 14799 - DNA, 20 bp, Artificial Sequence
  Description of Artificial Sequence: Synthetic oligonucleotide
  Target: ATXN1; (-) strand; PAM type: NNGRRT; PAM sequence: GGGAAT
aatcttcctacctggctggt

SEQ ID NO: 14800 - DNA, 20 bp, Artificial Sequence
  Description of Artificial Sequence: Synthetic oligonucleotide
  Target: ATXN1; (-) strand; PAM type: NNGRRT; PAM sequence: GGGAAT
ccaacatcattagtgtttag

SEQ ID NO: 14801 - DNA, 20 bp, Artificial Sequence
  Description of Artificial Sequence: Synthetic oligonucleotide
  Target: ATXN1; (-) strand; PAM type: NNGRRT; PAM sequence: TTGGAT
tttaaagatggacaaaggca

SEQ ID NO: 14802 - DNA, 20 bp, Artificial Sequence
  Description of Artificial Sequence: Synthetic oligonucleotide
  Target: ATXN1; (-) strand; PAM type: NNGRRT; PAM sequence: TGGAAT
tctcataagggtctagtttc

SEQ ID NO: 14803 - DNA, 20 bp, Artificial Sequence
  Description of Artificial Sequence: Synthetic oligonucleotide
  Target: ATXN1; (-) strand; PAM type: NNGRRT; PAM sequence: AAGGGT
tttgcaagtcagtatctcat

SEQ ID NO: 14804 - DNA, 20 bp, Artificial Sequence
  Description of Artificial Sequence: Synthetic oligonucleotide
  Target: ATXN1; (-) strand; PAM type: NNGRRT; PAM sequence: CAGAAT
gaaagtcaaaagacagccca

SEQ ID NO: 14805 - DNA, 20 bp, Artificial Sequence
  Description of Artificial Sequence: Synthetic oligonucleotide
  Target: ATXN1; (-) strand; PAM type: NNGRRT; PAM sequence: ATGGAT
aggagtaaatcttcatgacc

SEQ ID NO: 14806 - DNA, 20 bp, Artificial Sequence
  Description of Artificial Sequence: Synthetic oligonucleotide
  Target: ATXN1; (-) strand; PAM type: NNGRRT; PAM sequence: AGGAGT
taaaacttttaaatgaaaac

SEQ ID NO: 14807 - DNA, 20 bp, Artificial Sequence
  Description of Artificial Sequence: Synthetic oligonucleotide
  Target: ATXN1; (-) strand; PAM type: NNGRRT; PAM sequence: ATGGAT
tatacaaaaatgaactaaaa

SEQ ID NO: 14808 - DNA, 20 bp, Artificial Sequence
  Description of Artificial Sequence: Synthetic oligonucleotide
  Target: ATXN1; (-) strand; PAM type: NNGRRT; PAM sequence: CTGAAT
gaaaaacatttaaatagtgg

SEQ ID NO: 14809 - DNA, 20 bp, Artificial Sequence
  Description of Artificial Sequence: Synthetic oligonucleotide
  Target: ATXN1; (-) strand; PAM type: NNGRRT; PAM sequence: TGGGAT
cttgctgcatctttaaaatg

SEQ ID NO: 14810 - DNA, 20 bp, Artificial Sequence
  Description of Artificial Sequence: Synthetic oligonucleotide
  Target: ATXN1; (-) strand; PAM type: NNGRRT; PAM sequence: GTGGGT
agctcagcatcatggctctg

SEQ ID NO: 14811 - DNA, 20 bp, Artificial Sequence
  Description of Artificial Sequence: Synthetic oligonucleotide
  Target: ATXN1; (-) strand; PAM type: NNGRRT; PAM sequence: GTGGAT
tggaaagagaacagaggtct

SEQ ID NO: 14812 - DNA, 20 bp, Artificial Sequence
  Description of Artificial Sequence: Synthetic oligonucleotide
  Target: ATXN1; (-) strand; PAM type: NNGRRT; PAM sequence: GTGGGT
caaagagccaatcttaatgg

SEQ ID NO: 14813 - DNA, 20 bp, Artificial Sequence
  Description of Artificial Sequence: Synthetic oligonucleotide
  Target: ATXN1; (-) strand; PAM type: NNGRRT; PAM sequence: ATGGGT
tctccaaagagccaatctta

SEQ ID NO: 14814 - DNA, 20 bp, Artificial Sequence
  Description of Artificial Sequence: Synthetic oligonucleotide
  Target: ATXN1; (-) strand; PAM type: NNGRRT; PAM sequence: ATGAAT
ttggttatacacgatttggc

SEQ ID NO: 14815 - DNA, 20 bp, Artificial Sequence
  Description of Artificial Sequence: Synthetic oligonucleotide
  Target: ATXN1; (-) strand; PAM type: NNGRRT; PAM sequence: CAGAGT
ttctttttgcttaagataaa

SEQ ID NO: 14816 - DNA, 20 bp, Artificial Sequence
  Description of Artificial Sequence: Synthetic oligonucleotide
  Target: ATXN1; (-) strand; PAM type: NNGRRT; PAM sequence: CAGAAT
ttggctgaattgatgatagc

SEQ ID NO: 14817 - DNA, 20 bp, Artificial Sequence
  Description of Artificial Sequence: Synthetic oligonucleotide
  Target: ATXN1; (-) strand; PAM type: NNGRRT; PAM sequence: CTGAAT
gtcttcactccttgcattgg

SEQ ID NO: 14818 - DNA, 20 bp, Artificial Sequence
  Description of Artificial Sequence: Synthetic oligonucleotide
  Target: ATXN1; (-) strand; PAM type: NNGRRT; PAM sequence: GGGGAT
ttggagaactgatgctttag

SEQ ID NO: 14819 - DNA, 20 bp, Artificial Sequence
  Description of Artificial Sequence: Synthetic oligonucleotide
  Target: ATXN1; (-) strand; PAM type: NNGRRT; PAM sequence: CTGGGT
ttagtactttctaaatctct

SEQ ID NO: 14820 - DNA, 20 bp, Artificial Sequence
  Description of Artificial Sequence: Synthetic oligonucleotide
  Target: ATXN1; (-) strand; PAM type: NNGRRT; PAM sequence: GTGGGT
ccagttaagtaaggatctct

SEQ ID NO: 14821 - DNA, 20 bp, Artificial Sequence
  Description of Artificial Sequence: Synthetic oligonucleotide
  Target: ATXN1; (-) strand; PAM type: NNGRRT; PAM sequence: AAGGAT
ataccccagaccagttaagt

SEQ ID NO: 14822 - DNA, 20 bp, Artificial Sequence
  Description of Artificial Sequence: Synthetic oligonucleotide
  Target: ATXN1; (-) strand; PAM type: NNGRRT; PAM sequence: TAGAAT
tctccaccttggctgcatag

SEQ ID NO: 14823 - DNA, 20 bp, Artificial Sequence
  Description of Artificial Sequence: Synthetic oligonucleotide
  Target: ATXN1; (-) strand; PAM type: NNGRRT; PAM sequence: AGGAGT
agaggagccacctttgtggg

SEQ ID NO: 14824 - DNA, 20 bp, Artificial Sequence
  Description of Artificial Sequence: Synthetic oligonucleotide
  Target: ATXN1; (-) strand; PAM type: NNGRRT; PAM sequence: GTGAAT
tcacacggttgttgagaaga

SEQ ID NO: 14825 - DNA, 20 bp, Artificial Sequence
  Description of Artificial Sequence: Synthetic oligonucleotide
  Target: ATXN1; (-) strand; PAM type: NNGRRT; PAM sequence: AAGAGT
actttcacacggttgttgag

SEQ ID NO: 14826 - DNA, 20 bp, Artificial Sequence
  Description of Artificial Sequence: Synthetic oligonucleotide
  Target: ATXN1; (-) strand; PAM type: NNGRRT; PAM sequence: CAGAGT
ctgtcgcttaattaatctct

SEQ ID NO: 14827 - DNA, 20 bp, Artificial Sequence
  Description of Artificial Sequence: Synthetic oligonucleotide
  Target: ATXN1; (-) strand; PAM type: NNGRRT; PAM sequence: TGGGGT
gattataatgatacagactg

SEQ ID NO: 14828 - DNA, 20 bp, Artificial Sequence
  Description of Artificial Sequence: Synthetic oligonucleotide
  Target: ATXN1; (-) strand; PAM type: NNGRRT; PAM sequence: ATGGGT
ccctcgtcccattccacaag

SEQ ID NO: 14829 - DNA, 20 bp, Artificial Sequence
  Description of Artificial Sequence: Synthetic oligonucleotide
  Target: ATXN1; (-) strand; PAM type: NNGRRT; PAM sequence: GCGAGT
agtgcctgctattctcttca

SEQ ID NO: 14830 - DNA, 20 bp, Artificial Sequence
  Description of Artificial Sequence: Synthetic oligonucleotide
  Target: ATXN1; (-) strand; PAM type: NNGRRT; PAM sequence: AAGAAT
cagtcttatcacatcttgga

SEQ ID NO: 14831 - DNA, 20 bp, Artificial Sequence
  Description of Artificial Sequence: Synthetic oligonucleotide
  Target: ATXN1; (-) strand; PAM type: NNGRRT; PAM sequence: ATGAAT
ttagatgaatccataaatga

SEQ ID NO: 14832 - DNA, 20 bp, Artificial Sequence
  Description of Artificial Sequence: Synthetic oligonucleotide
  Target: ATXN1; (-) strand; PAM type: NNGRRT; PAM sequence: ATGAAT
ggcattagatgaatccataa

SEQ ID NO: 14833 - DNA, 20 bp, Artificial Sequence
  Description of Artificial Sequence: Synthetic oligonucleotide
  Target: ATXN1; (-) strand; PAM type: NNGRRT; PAM sequence: ATGAAT
aatctatatatgggcattag

SEQ ID NO: 14834 - DNA, 20 bp, Artificial Sequence
  Description of Artificial Sequence: Synthetic oligonucleotide
  Target: ATXN1; (-) strand; PAM type: NNGRRT; PAM sequence: CTGAAT
gtcttgtctattataagaac

SEQ ID NO: 14835 - DNA, 20 bp, Artificial Sequence
  Description of Artificial Sequence: Synthetic oligonucleotide
  Target: ATXN1; (-) strand; PAM type: NNGRRT; PAM sequence: TTGAGT
acatgcacaaacctacacat

SEQ ID NO: 14836 - DNA, 20 bp, Artificial Sequence
  Description of Artificial Sequence: Synthetic oligonucleotide
  Target: ATXN1; (-) strand; PAM type: NNGRRT; PAM sequence: TGGAGT
gaacaatggcagaactgaaa

SEQ ID NO: 14837 - DNA, 20 bp, Artificial Sequence
  Description of Artificial Sequence: Synthetic oligonucleotide
  Target: ATXN1; (-) strand; PAM type: NNGRRT; PAM sequence: CAGAAT
ttatggcataataatggaaa

SEQ ID NO: 14838 - DNA, 20 bp, Artificial Sequence
  Description of Artificial Sequence: Synthetic oligonucleotide
  Target: ATXN1; (-) strand; PAM type: NNGRRT; PAM sequence: AAGAAT
ttaaaaatattttaaaaata

SEQ ID NO: 14839 - DNA, 20 bp, Artificial Sequence
  Description of Artificial Sequence: Synthetic oligonucleotide
  Target: ATXN1; (-) strand; PAM type: NNGRRT; PAM sequence: ATGGGT
aggggcttaaaacctagatg

SEQ ID NO: 14840 - DNA, 20 bp, Artificial Sequence
  Description of Artificial Sequence: Synthetic oligonucleotide
  Target: ATXN1; (-) strand; PAM type: NNGRRT; PAM sequence: GAGAAT
gtggggggcaaggggaggga

SEQ ID NO: 14841 - DNA, 20 bp, Artificial Sequence
  Description of Artificial Sequence: Synthetic oligonucleotide
  Target: ATXN1; (-) strand; PAM type: NNGRRT; PAM sequence: GTGAGT
tcacacaccagggcctatcg

SEQ ID NO: 14842 - DNA, 20 bp, Artificial Sequence
  Description of Artificial Sequence: Synthetic oligonucleotide
  Target: ATXN1; (-) strand; PAM type: NNGRRT; PAM sequence: TTGAAT
gttctcactcatagtaggag

SEQ ID NO: 14843 - DNA, 20 bp, Artificial Sequence
  Description of Artificial Sequence: Synthetic oligonucleotide
  Target: ATXN1; (-) strand; PAM type: NNGRRT; PAM sequence: AGGAGT
cgcatgttctcactcatagt

SEQ ID NO: 14844 - DNA, 20 bp, Artificial Sequence
  Description of Artificial Sequence: Synthetic oligonucleotide
  Target: ATXN1; (-) strand; PAM type: NNGRRT; PAM sequence: ATGGAT
ctcatgtcctttacagggac

SEQ ID NO: 14845 - DNA, 20 bp, Artificial Sequence
  Description of Artificial Sequence: Synthetic oligonucleotide
  Target: ATXN1; (-) strand; PAM type: NNGRRT; PAM sequence: AAGAAT
aatactatgcagccataaaa

SEQ ID NO: 14846 - DNA, 20 bp, Artificial Sequence
  Description of Artificial Sequence: Synthetic oligonucleotide
  Target: ATXN1; (-) strand; PAM type: NNGRRT; PAM sequence: TGGAAT
aatgtggtaaatatacacca

SEQ ID NO: 14847 - DNA, 20 bp, Artificial Sequence
  Description of Artificial Sequence: Synthetic oligonucleotide
  Target: ATXN1; (-) strand; PAM type: NNGRRT; PAM sequence: CTGGAT
aaatgcccatcaatgataga

SEQ ID NO: 14848 - DNA, 20 bp, Artificial Sequence
  Description of Artificial Sequence: Synthetic oligonucleotide
  Target: ATXN1; (-) strand; PAM type: NNGRRT; PAM sequence: AAGGAT
cgttactggttatataccca

SEQ ID NO: 14849 - DNA, 20 bp, Artificial Sequence
  Description of Artificial Sequence: Synthetic oligonucleotide
  Target: ATXN1; (-) strand; PAM type: NNGRRT; PAM sequence: AAGGAT
agacagtgtggcgattcctc

SEQ ID NO: 14850 - DNA, 20 bp, Artificial Sequence
  Description of Artificial Sequence: Synthetic oligonucleotide
  Target: ATXN1; (-) strand; PAM type: NNGRRT; PAM sequence: AGGAAT
tggcgaggctgtggagaaat

SEQ ID NO: 14851 - DNA, 20 bp, Artificial Sequence
  Description of Artificial Sequence: Synthetic oligonucleotide
  Target: ATXN1; (-) strand; PAM type: NNGRRT; PAM sequence: TAGAAT
cagctcctaaatctattgta

SEQ ID NO: 14852 - DNA, 20 bp, Artificial Sequence
  Description of Artificial Sequence: Synthetic oligonucleotide
  Target: ATXN1; (-) strand; PAM type: NNGRRT; PAM sequence: AAGAGT
gcatactgagaatgattttg

SEQ ID NO: 14853 - DNA, 20 bp, Artificial Sequence
  Description of Artificial Sequence: Synthetic oligonucleotide
  Target: ATXN1; (-) strand; PAM type: NNGRRT; PAM sequence: GAGAAT
atagcaattcagagcatact

SEQ ID NO: 14854 - DNA, 20 bp, Artificial Sequence
  Description of Artificial Sequence: Synthetic oligonucleotide
  Target: ATXN1; (-) strand; PAM type: NNGRRT; PAM sequence: AAGGAT
tacatgttcagttgaagata

SEQ ID NO: 14855 - DNA, 20 bp, Artificial Sequence
  Description of Artificial Sequence: Synthetic oligonucleotide
  Target: ATXN1; (-) strand; PAM type: NNGRRT; PAM sequence: CAGAAT
gtttctttacggtctatagc

SEQ ID NO: 14856 - DNA, 20 bp, Artificial Sequence
  Description of Artificial Sequence: Synthetic oligonucleotide
  Target: ATXN1; (-) strand; PAM type: NNGRRT; PAM sequence: TAGGAT
gacaattccgattctgtatg

SEQ ID NO: 14857 - DNA, 20 bp, Artificial Sequence
  Description of Artificial Sequence: Synthetic oligonucleotide
  Target: ATXN1; (-) strand; PAM type: NNGRRT; PAM sequence: CTGAGT
gactgtaataattatttttt

SEQ ID NO: 14858 - DNA, 20 bp, Artificial Sequence
  Description of Artificial Sequence: Synthetic oligonucleotide
  Target: ATXN1; (-) strand; PAM type: NNGRRT; PAM sequence: AGGAAT
atgttgcccagtaactcaaa

SEQ ID NO: 14859 - DNA, 20 bp, Artificial Sequence
  Description of Artificial Sequence: Synthetic oligonucleotide
  Target: ATXN1; (-) strand; PAM type: NNGRRT; PAM sequence: TAGAAT
gtcataagggtccacttaaa

SEQ ID NO: 14860 - DNA, 20 bp, Artificial Sequence
  Description of Artificial Sequence: Synthetic oligonucleotide
  Target: ATXN1; (-) strand; PAM type: NNGRRT; PAM sequence: AAGGGT
tttcattatactactgtcat

SEQ ID NO: 14861 - DNA, 20 bp, Artificial Sequence
  Description of Artificial Sequence: Synthetic oligonucleotide
  Target: ATXN1; (-) strand; PAM type: NNGRRT; PAM sequence: AGGGAT
ttgttttagggctatgactt

SEQ ID NO: 14862 - DNA, 20 bp, Artificial Sequence
  Description of Artificial Sequence: Synthetic oligonucleotide
  Target: ATXN1; (-) strand; PAM type: NNGRRT; PAM sequence: GGGAAT
cattcaatgaaatgttcagt

SEQ ID NO: 14863 - DNA, 20 bp, Artificial Sequence
  Description of Artificial Sequence: Synthetic oligonucleotide
  Target: ATXN1; (-) strand; PAM type: NNGRRT; PAM sequence: AGGAAT
aatcattgctgttggcaatg

SEQ ID NO: 14864 - DNA, 20 bp, Artificial Sequence
  Description of Artificial Sequence: Synthetic oligonucleotide
  Target: ATXN1; (-) strand; PAM type: NNGRRT; PAM sequence: CAGAGT
tataagattttgtttgaagg

SEQ ID NO: 14865 - DNA, 20 bp, Artificial Sequence
  Description of Artificial Sequence: Synthetic oligonucleotide
  Target: ATXN1; (-) strand; PAM type: NNGRRT; PAM sequence: AGGAGT
gtacttggtggtgatggatg

SEQ ID NO: 14866 - DNA, 20 bp, Artificial Sequence
  Description of Artificial Sequence: Synthetic oligonucleotide
  Target: ATXN1; (-) strand; PAM type: NNGRRT; PAM sequence: ATGGAT
ttcagaagtacttggtggtg

SEQ ID NO: 14867 - DNA, 20 bp, Artificial Sequence
  Description of Artificial Sequence: Synthetic oligonucleotide
  Target: ATXN1; (-) strand; PAM type: NNGRRT; PAM sequence: GAGGAT
accacattctccagtagcct

SEQ ID NO: 14868 - DNA, 20 bp, Artificial Sequence
  Description of Artificial Sequence: Synthetic oligonucleotide
  Target: ATXN1; (-) strand; PAM type: NNGRRT; PAM sequence: AGGAGT
gggtctcataggccatgtta

SEQ ID NO: 14869 - DNA, 20 bp, Artificial Sequence
  Description of Artificial Sequence: Synthetic oligonucleotide
  Target: ATXN1; (-) strand; PAM type: NNGRRT; PAM sequence: GAGGGT
gaggccaggagcaaaccata

SEQ ID NO: 14870 - DNA, 20 bp, Artificial Sequence
  Description of Artificial Sequence: Synthetic oligonucleotide
  Target: ATXN1; (-) strand; PAM type: NNGRRT; PAM sequence: TGGGGT
tgtccagctgtgcagagttg

SEQ ID NO: 14871 - DNA, 20 bp, Artificial Sequence
  Description of Artificial Sequence: Synthetic oligonucleotide
  Target: ATXN1; (-) strand; PAM type: NNGRRT; PAM sequence: CAGAGT
taagactgtgtccagctgtg

SEQ ID NO: 14872 - DNA, 20 bp, Artificial Sequence
  Description of Artificial Sequence: Synthetic oligonucleotide
  Target: ATXN1; (-) strand; PAM type: NNGRRT; PAM sequence: TGGAGT
gccaaaaatgaatgtgtatg

SEQ ID NO: 14873 - DNA, 20 bp, Artificial Sequence
  Description of Artificial Sequence: Synthetic oligonucleotide
  Target: ATXN1; (-) strand; PAM type: NNGRRT; PAM sequence: ATGAAT
gccagcgtggtgagccaaaa

SEQ ID NO: 14874 - DNA, 20 bp, Artificial Sequence
  Description of Artificial Sequence: Synthetic oligonucleotide
  Target: ATXN1; (-) strand; PAM type: NNGRRT; PAM sequence: ATGAAT
ttccaagctggaatataact

SEQ ID NO: 14875 - DNA, 20 bp, Artificial Sequence
  Description of Artificial Sequence: Synthetic oligonucleotide
  Target: ATXN1; (-) strand; PAM type: NNGRRT; PAM sequence: TGGAAT
tcaacatctgtgttccaagc

SEQ ID NO: 14876 - DNA, 20 bp, Artificial Sequence
  Description of Artificial Sequence: Synthetic oligonucleotide
  Target: ATXN1; (-) strand; PAM type: NNGRRT; PAM sequence: GTGGAT
caaaatgaagagtttggggg

SEQ ID NO: 14877 - DNA, 20 bp, Artificial Sequence
  Description of Artificial Sequence: Synthetic oligonucleotide
  Target: ATXN1; (-) strand; PAM type: NNGRRT; PAM sequence: GGGGGT
tttgcaaaatgaagagtttg

SEQ ID NO: 14878 - DNA, 20 bp, Artificial Sequence
  Description of Artificial Sequence: Synthetic oligonucleotide
  Target: ATXN1; (-) strand; PAM type: NNGRRT; PAM sequence: AAGAGT
agtttcagttttgcaaaatg

SEQ ID NO: 14879 - DNA, 20 bp, Artificial Sequence
  Description of Artificial Sequence: Synthetic oligonucleotide
  Target: ATXN1; (-) strand; PAM type: NNGRRT; PAM sequence: AAGAAT
gatcattcaattacattttt

SEQ ID NO: 14880 - DNA, 20 bp, Artificial Sequence
  Description of Artificial Sequence: Synthetic oligonucleotide
  Target: ATXN1; (-) strand; PAM type: NNGRRT; PAM sequence: CTGGGT
gcaagggggaagtgaagaac

SEQ ID NO: 14881 - DNA, 20 bp, Artificial Sequence
  Description of Artificial Sequence: Synthetic oligonucleotide
  Target: ATXN1; (-) strand; PAM type: NNGRRT; PAM sequence: AGGAGT
tagtagctaagctagtaggc

SEQ ID NO: 14882 - DNA, 20 bp, Artificial Sequence
  Description of Artificial Sequence: Synthetic oligonucleotide
  Target: ATXN1; (-) strand; PAM type: NNGRRT; PAM sequence: AGGAGT
tcctagcaatacatgcgagt

SEQ ID NO: 14883 - DNA, 20 bp, Artificial Sequence
  Description of Artificial Sequence: Synthetic oligonucleotide
  Target: ATXN1; (-) strand; PAM type: NNGRRT; PAM sequence: GCGAGT
gctggctcctagcaatacat

SEQ ID NO: 14884 - DNA, 20 bp, Artificial Sequence
  Description of Artificial Sequence: Synthetic oligonucleotide
  Target: ATXN1; (-) strand; PAM type: NNGRRT; PAM sequence: AGGAGT
tggaagcccaaaccagtccc

SEQ ID NO: 14885 - DNA, 20 bp, Artificial Sequence
  Description of Artificial Sequence: Synthetic oligonucleotide
  Target: ATXN1; (-) strand; PAM type: NNGRRT; PAM sequence: CTGAGT
aatcatatataaaataagtc

SEQ ID NO: 14886 - DNA, 20 bp, Artificial Sequence
  Description of Artificial Sequence: Synthetic oligonucleotide
  Target: ATXN1; (-) strand; PAM type: NNGRRT; PAM sequence: GGGGGT
aatgattagtttctgggggt

SEQ ID NO: 14887 - DNA, 20 bp, Artificial Sequence
  Description of Artificial Sequence: Synthetic oligonucleotide
  Target: ATXN1; (-) strand; PAM type: NNGRRT; PAM sequence: GGGGGT
agattaaatgattagtttct

SEQ ID NO: 14888 - DNA, 20 bp, Artificial Sequence
  Description of Artificial Sequence: Synthetic oligonucleotide
  Target: ATXN1; (-) strand; PAM type: NNGRRT; PAM sequence: CTGAGT
cctggcctcatcccattcac

SEQ ID NO: 14889 - DNA, 20 bp, Artificial Sequence
  Description of Artificial Sequence: Synthetic oligonucleotide
  Target: ATXN1; (-) strand; PAM type: NNGRRT; PAM sequence: GGGAGT
tgtgttattttacacatgag

SEQ ID NO: 14890 - DNA, 20 bp, Artificial Sequence
  Description of Artificial Sequence: Synthetic oligonucleotide
  Target: ATXN1; (-) strand; PAM type: NNGRRT; PAM sequence: TTGAAT
taagaaggtcagagagctgg

SEQ ID NO: 14891 - DNA, 20 bp, Artificial Sequence
  Description of Artificial Sequence: Synthetic oligonucleotide
  Target: ATXN1; (-) strand; PAM type: NNGRRT; PAM sequence: TAGAAT
cctgaaccaaccatgcaaag

SEQ ID NO: 14892 - DNA, 20 bp, Artificial Sequence
  Description of Artificial Sequence: Synthetic oligonucleotide
  Target: ATXN1; (-) strand; PAM type: NNGRRT; PAM sequence: CTGAGT
agggtgtgtgtaattagctg

SEQ ID NO: 14893 - DNA, 20 bp, Artificial Sequence
  Description of Artificial Sequence: Synthetic oligonucleotide
  Target: ATXN1; (-) strand; PAM type: NNGRRT; PAM sequence: GAGGGT
tcagtggcctacgttcctcg

SEQ ID NO: 14894 - DNA, 20 bp, Artificial Sequence
  Description of Artificial Sequence: Synthetic oligonucleotide
  Target: ATXN1; (-) strand; PAM type: NNGRRT; PAM sequence: CTGAGT
taagcagggattgtgtccag

SEQ ID NO: 14895 - DNA, 20 bp, Artificial Sequence
  Description of Artificial Sequence: Synthetic oligonucleotide
  Target: ATXN1; (-) strand; PAM type: NNGRRT; PAM sequence: AGGGAT
cacagctgagagggataagc

SEQ ID NO: 14896 - DNA, 20 bp, Artificial Sequence
  Description of Artificial Sequence: Synthetic oligonucleotide
  Target: ATXN1; (-) strand; PAM type: NNGRRT; PAM sequence: AGGGAT
tccagctgaccacagctgag

SEQ ID NO: 14897 - DNA, 20 bp, Artificial Sequence
  Description of Artificial Sequence: Synthetic oligonucleotide
  Target: ATXN1; (-) strand; PAM type: NNGRRT; PAM sequence: CTGAGT
tttcttctttcaggcaagga

SEQ ID NO: 14898 - DNA, 20 bp, Artificial Sequence
  Description of Artificial Sequence: Synthetic oligonucleotide
  Target: ATXN1; (-) strand; PAM type: NNGRRT; PAM sequence: CTGAGT
ttcatactgtttacttattt

SEQ ID NO: 14899 - DNA, 20 bp, Artificial Sequence
  Description of Artificial Sequence: Synthetic oligonucleotide
  Target: ATXN1; (-) strand; PAM type: NNGRRT; PAM sequence: TAGAAT
atgtcagcctgacctaatga

SEQ ID NO: 14900 - DNA, 20 bp, Artificial Sequence
  Description of Artificial Sequence: Synthetic oligonucleotide
  Target: ATXN1; (-) strand; PAM type: NNGRRT; PAM sequence: TGGGAT
cttattaactttttaaggtt

SEQ ID NO: 14901 - DNA, 20 bp, Artificial Sequence
  Description of Artificial Sequence: Synthetic oligonucleotide
  Target: ATXN1; (-) strand; PAM type: NNGRRT; PAM sequence: ACGGGT
ggagcctcataaccgtgtac

SEQ ID NO: 14902 - DNA, 20 bp, Artificial Sequence
  Description of Artificial Sequence: Synthetic oligonucleotide
  Target: ATXN1; (-) strand; PAM type: NNGRRT; PAM sequence: GAGAGT
ttaaactgtcggttctccct

SEQ ID NO: 14903 - DNA, 20 bp, Artificial Sequence
  Description of Artificial Sequence: Synthetic oligonucleotide
  Target: ATXN1; (-) strand; PAM type: NNGRRT; PAM sequence: TTGGGT
gtaacatcattcgccattcg

SEQ ID NO: 14904 - DNA, 20 bp, Artificial Sequence
  Description of Artificial Sequence: Synthetic oligonucleotide
  Target: ATXN1; (-) strand; PAM type: NNGRRT; PAM sequence: GAGGAT
gaaaaggagaatcacaaaaa

SEQ ID NO: 14905 - DNA, 20 bp, Artificial Sequence
  Description of Artificial Sequence: Synthetic oligonucleotide
  Target: ATXN1; (-) strand; PAM type: NNGRRT; PAM sequence: GAGAAT
cctccagatgaagtgaaaag

SEQ ID NO: 14906 - DNA, 20 bp, Artificial Sequence
  Description of Artificial Sequence: Synthetic oligonucleotide
  Target: ATXN1; (-) strand; PAM type: NNGRRT; PAM sequence: CTGAGT
agccctgatgccaagatttt

SEQ ID NO: 14907 - DNA, 20 bp, Artificial Sequence
  Description of Artificial Sequence: Synthetic oligonucleotide
  Target: ATXN1; (-) strand; PAM type: NNGRRT; PAM sequence: ATGAGT
tgctccatgtcacccaaatg

SEQ ID NO: 14908 - DNA, 20 bp, Artificial Sequence
  Description of Artificial Sequence: Synthetic oligonucleotide
  Target: ATXN1; (-) strand; PAM type: NNGRRT; PAM sequence: CAGAAT
tcttgtggcctgatctccat

SEQ ID NO: 14909 - DNA, 20 bp, Artificial Sequence
  Description of Artificial Sequence: Synthetic oligonucleotide
  Target: ATXN1; (-) strand; PAM type: NNGRRT; PAM sequence: GGGAGT
tcctggccaccaattacata

SEQ ID NO: 14910 - DNA, 20 bp, Artificial Sequence
  Description of Artificial Sequence: Synthetic oligonucleotide
  Target: ATXN1; (-) strand; PAM type: NNGRRT; PAM sequence: GAGAAT
aatggattctgtgttttcca

SEQ ID NO: 14911 - DNA, 20 bp, Artificial Sequence
  Description of Artificial Sequence: Synthetic oligonucleotide
  Target: ATXN1; (-) strand; PAM type: NNGRRT; PAM sequence: ATGGAT
tcattgaattcatcatgtaa

SEQ ID NO: 14912 - DNA, 20 bp, Artificial Sequence
  Description of Artificial Sequence: Synthetic oligonucleotide
  Target: ATXN1; (-) strand; PAM type: NNGRRT; PAM sequence: TTGAAT
caagacattataatatatca

SEQ ID NO: 14913 - DNA, 20 bp, Artificial Sequence
  Description of Artificial Sequence: Synthetic oligonucleotide
  Target: ATXN1; (-) strand; PAM type: NNGRRT; PAM sequence: CAGAGT
catctttgacctgggaattg

SEQ ID NO: 14914 - DNA, 20 bp, Artificial Sequence
  Description of Artificial Sequence: Synthetic oligonucleotide
  Target: ATXN1; (-) strand; PAM type: NNGRRT; PAM sequence: GGGAAT
tcatttcacatctttgacct

SEQ ID NO: 14915 - DNA, 20 bp, Artificial Sequence
  Description of Artificial Sequence: Synthetic oligonucleotide
  Target: ATXN1; (-) strand; PAM type: NNGRRT; PAM sequence: GAGAAT
tttactcccttagggtagaa

SEQ ID NO: 14916 - DNA, 20 bp, Artificial Sequence
  Description of Artificial Sequence: Synthetic oligonucleotide
  Target: ATXN1; (-) strand; PAM type: NNGRRT; PAM sequence: TAGGGT
tggcatgccctttactccct

SEQ ID NO: 14917 - DNA, 20 bp, Artificial Sequence
  Description of Artificial Sequence: Synthetic oligonucleotide
  Target: ATXN1; (-) strand; PAM type: NNGRRT; PAM sequence: TTGAAT
tgtcaactcattacatggcg

SEQ ID NO: 14918 - DNA, 20 bp, Artificial Sequence
  Description of Artificial Sequence: Synthetic oligonucleotide
  Target: ATXN1; (-) strand; PAM type: NNGRRT; PAM sequence: AGGAGT
agccttaatatataacacgg

SEQ ID NO: 14919 - DNA, 20 bp, Artificial Sequence
  Description of Artificial Sequence: Synthetic oligonucleotide
  Target: ATXN1; (-) strand; PAM type: NNGRRT; PAM sequence: TTGGGT
tctgcttctacagtgataat

SEQ ID NO: 14920 - DNA, 20 bp, Artificial Sequence
  Description of Artificial Sequence: Synthetic oligonucleotide
  Target: ATXN1; (-) strand; PAM type: NNGRRT; PAM sequence: AGGAAT
tgagtttggctgacaagggt

SEQ ID NO: 14921 - DNA, 20 bp, Artificial Sequence
  Description of Artificial Sequence: Synthetic oligonucleotide
  Target: ATXN1; (-) strand; PAM type: NNGRRT; PAM sequence: AAGGGT
attttatgagtttggctgac

SEQ ID NO: 14922 - DNA, 20 bp, Artificial Sequence
  Description of Artificial Sequence: Synthetic oligonucleotide
  Target: ATXN1; (-) strand; PAM type: NNGRRT; PAM sequence: ATGAGT
tattagaaaatctttatttt

SEQ ID NO: 14923 - DNA, 20 bp, Artificial Sequence
  Description of Artificial Sequence: Synthetic oligonucleotide
  Target: ATXN1; (-) strand; PAM type: NNGRRT; PAM sequence: GAGAAT
caaacaccttctatagtgca

SEQ ID NO: 14924 - DNA, 20 bp, Artificial Sequence
  Description of Artificial Sequence: Synthetic oligonucleotide
  Target: ATXN1; (-) strand; PAM type: NNGRRT; PAM sequence: CTGGAT
cggacattgcagtgctgtgg

SEQ ID NO: 14925 - DNA, 20 bp, Artificial Sequence
  Description of Artificial Sequence: Synthetic oligonucleotide
  Target: ATXN1; (-) strand; PAM type: NNGRRT; PAM sequence: CAGAGT
tagaggcatgaggaacgttt

SEQ ID NO: 14926 - DNA, 20 bp, Artificial Sequence
  Description of Artificial Sequence: Synthetic oligonucleotide
  Target: ATXN1; (-) strand; PAM type: NNGRRT; PAM sequence: AAGGGT
tttgtaagaactcaaaaatt

SEQ ID NO: 14927 - DNA, 20 bp, Artificial Sequence
  Description of Artificial Sequence: Synthetic oligonucleotide
  Target: ATXN1; (-) strand; PAM type: NNGRRT; PAM sequence: AAGAAT
actaggaaagtcatacttcc

SEQ ID NO: 14928 - DNA, 20 bp, Artificial Sequence
  Description of Artificial Sequence: Synthetic oligonucleotide
  Target: ATXN1; (-) strand; PAM type: NNGRRT; PAM sequence: GTGAGT
tgtttttcttcattcttcct

SEQ ID NO: 14929 - DNA, 20 bp, Artificial Sequence
  Description of Artificial Sequence: Synthetic oligonucleotide
  Target: ATXN1; (-) strand; PAM type: NNGRRT; PAM sequence: AAGGAT
cagtttgtctataagcattt

SEQ ID NO: 14930 - DNA, 20 bp, Artificial Sequence
  Description of Artificial Sequence: Synthetic oligonucleotide
  Target: ATXN1; (-) strand; PAM type: NNGRRT; PAM sequence: ATGAAT
tgccatcctttatcctttca

SEQ ID NO: 14931 - DNA, 20 bp, Artificial Sequence
  Description of Artificial Sequence: Synthetic oligonucleotide
  Target: ATXN1; (-) strand; PAM type: NNGRRT; PAM sequence: TTGAGT
gggatatttcagatagacag

SEQ ID NO: 14932 - DNA, 20 bp, Artificial Sequence
  Description of Artificial Sequence: Synthetic oligonucleotide
  Target: ATXN1; (-) strand; PAM type: NNGRRT; PAM sequence: GGGGAT
aggtttgagaccttttttta

SEQ ID NO: 14933 - DNA, 20 bp, Artificial Sequence
  Description of Artificial Sequence: Synthetic oligonucleotide
  Target: ATXN1; (-) strand; PAM type: NNGRRT; PAM sequence: AAGGGT
catttctaccaacagtgcac

SEQ ID NO: 14934 - DNA, 20 bp, Artificial Sequence
  Description of Artificial Sequence: Synthetic oligonucleotide
  Target: ATXN1; (-) strand; PAM type: NNGRRT; PAM sequence: CTGGAT
tatacctggaaatggaattg

SEQ ID NO: 14935 - DNA, 20 bp, Artificial Sequence
  Description of Artificial Sequence: Synthetic oligonucleotide
  Target: ATXN1; (-) strand; PAM type: NNGRRT; PAM sequence: TGGAAT
tttgggtatatacctggaaa

SEQ ID NO: 14936 - DNA, 20 bp, Artificial Sequence
  Description of Artificial Sequence: Synthetic oligonucleotide
  Target: ATXN1; (-) strand; PAM type: NNGRRT; PAM sequence: TTGGGT
aggttctcctttcagttctt

SEQ ID NO: 14937 - DNA, 20 bp, Artificial Sequence
  Description of Artificial Sequence: Synthetic oligonucleotide
  Target: ATXN1; (-) strand; PAM type: NNGRRT; PAM sequence: GTGGGT
tgaataatgctgctatgaat

SEQ ID NO: 14938 - DNA, 20 bp, Artificial Sequence
  Description of Artificial Sequence: Synthetic oligonucleotide
  Target: ATXN1; (-) strand; PAM type: NNGRRT; PAM sequence: ATGAAT
ttactgtgaataatgctgct

SEQ ID NO: 14939 - DNA, 20 bp, Artificial Sequence
  Description of Artificial Sequence: Synthetic oligonucleotide
  Target: ATXN1; (-) strand; PAM type: NNGRRT; PAM sequence: GTGAAT
gtttccaccttttggttact

SEQ ID NO: 14940 - DNA, 20 bp, Artificial Sequence
  Description of Artificial Sequence: Synthetic oligonucleotide
  Target: ATXN1; (-) strand; PAM type: NNGRRT; PAM sequence: TTGGGT
attcatctgtccataaacac

SEQ ID NO: 14941 - DNA, 20 bp, Artificial Sequence
  Description of Artificial Sequence: Synthetic oligonucleotide
  Target: ATXN1; (-) strand; PAM type: NNGRRT; PAM sequence: ATGAAT
aatttctttttttaaggctg

SEQ ID NO: 14942 - DNA, 20 bp, Artificial Sequence
  Description of Artificial Sequence: Synthetic oligonucleotide
  Target: ATXN1; (-) strand; PAM type: NNGRRT; PAM sequence: CAGAAT
atccatgttgtaacatgtgt

SEQ ID NO: 14943 - DNA, 20 bp, Artificial Sequence
  Description of Artificial Sequence: Synthetic oligonucleotide
  Target: ATXN1; (-) strand; PAM type: NNGRRT; PAM sequence: CAGGGT
ctcctatgagtagaatcaca

SEQ ID NO: 14944 - DNA, 20 bp, Artificial Sequence
  Description of Artificial Sequence: Synthetic oligonucleotide
  Target: ATXN1; (-) strand; PAM type: NNGRRT; PAM sequence: TAGAAT
ctctagggacctcctatgag

SEQ ID NO: 14945 - DNA, 20 bp, Artificial Sequence
  Description of Artificial Sequence: Synthetic oligonucleotide
  Target: ATXN1; (-) strand; PAM type: NNGRRT; PAM sequence: ATGAGT
gactgctctagggacctcct

SEQ ID NO: 14946 - DNA, 20 bp, Artificial Sequence
  Description of Artificial Sequence: Synthetic oligonucleotide
  Target: ATXN1; (-) strand; PAM type: NNGRRT; PAM sequence: ATGAAT
ccattctactttctgcctct

SEQ ID NO: 14947 - DNA, 20 bp, Artificial Sequence
  Description of Artificial Sequence: Synthetic oligonucleotide
  Target: ATXN1; (-) strand; PAM type: NNGRRT; PAM sequence: CTGGGT
gtggcatcagagagaggtag

SEQ ID NO: 14948 - DNA, 20 bp, Artificial Sequence
  Description of Artificial Sequence: Synthetic oligonucleotide
  Target: ATXN1; (-) strand; PAM type: NNGRRT; PAM sequence: TTGAAT
aaaatgacagtggcttgggc

SEQ ID NO: 14949 - DNA, 20 bp, Artificial Sequence
  Description of Artificial Sequence: Synthetic oligonucleotide
  Target: ATXN1; (-) strand; PAM type: NNGRRT; PAM sequence: CAGGAT
ggtaagaaacctgtagttga

SEQ ID NO: 14950 - DNA, 20 bp, Artificial Sequence
  Description of Artificial Sequence: Synthetic oligonucleotide
  Target: ATXN1; (-) strand; PAM type: NNGRRT; PAM sequence: AAGGAT
actttttactgtgacattaa

SEQ ID NO: 14951 - DNA, 20 bp, Artificial Sequence
  Description of Artificial Sequence: Synthetic oligonucleotide
  Target: ATXN1; (-) strand; PAM type: NNGRRT; PAM sequence: ATGAGT
tgaatggaaaaatgacctga

SEQ ID NO: 14952 - DNA, 20 bp, Artificial Sequence
  Description of Artificial Sequence: Synthetic oligonucleotide
  Target: ATXN1; (-) strand; PAM type: NNGRRT; PAM sequence: CTGAAT
cttttgaatggaaaaatgac

SEQ ID NO: 14953 - DNA, 20 bp, Artificial Sequence
  Description of Artificial Sequence: Synthetic oligonucleotide
  Target: ATXN1; (-) strand; PAM type: NNGRRT; PAM sequence: TTGAAT
gaatgagctatcgaatgctt

SEQ ID NO: 14954 - DNA, 20 bp, Artificial Sequence
  Description of Artificial Sequence: Synthetic oligonucleotide
  Target: ATXN1; (-) strand; PAM type: NNGRRT; PAM sequence: TCGAAT
aggacagtcagaatgagcta

SEQ ID NO: 14955 - DNA, 20 bp, Artificial Sequence
  Description of Artificial Sequence: Synthetic oligonucleotide
  Target: ATXN1; (-) strand; PAM type: NNGRRT; PAM sequence: CAGAAT
attaccataaataggacagt

SEQ ID NO: 14956 - DNA, 20 bp, Artificial Sequence
  Description of Artificial Sequence: Synthetic oligonucleotide
  Target: ATXN1; (-) strand; PAM type: NNGRRT; PAM sequence: CAGAAT
gtttcagtcctgaatggcta

SEQ ID NO: 14957 - DNA, 20 bp, Artificial Sequence
  Description of Artificial Sequence: Synthetic oligonucleotide
  Target: ATXN1; (-) strand; PAM type: NNGRRT; PAM sequence: CTGAAT
gggctgtcagagtttcagtc

SEQ ID NO: 14958 - DNA, 20 bp, Artificial Sequence
  Description of Artificial Sequence: Synthetic oligonucleotide
  Target: ATXN1; (-) strand; PAM type: NNGRRT; PAM sequence: CAGAGT
agaaggtgtccaggggctgt

SEQ ID NO: 14959 - DNA, 20 bp, Artificial Sequence
  Description of Artificial Sequence: Synthetic oligonucleotide
  Target: ATXN1; (-) strand; PAM type: NNGRRT; PAM sequence: AAGGAT
tagatgcgatacagagagag

SEQ ID NO: 14960 - DNA, 20 bp, Artificial Sequence
  Description of Artificial Sequence: Synthetic oligonucleotide
  Target: ATXN1; (-) strand; PAM type: NNGRRT; PAM sequence: AGGAGT
tgacagcccattccaagaga

SEQ ID NO: 14961 - DNA, 20 bp, Artificial Sequence
  Description of Artificial Sequence: Synthetic oligonucleotide
  Target: ATXN1; (-) strand; PAM type: NNGRRT; PAM sequence: GGGAGT
atgtaggatagacgggagtg

SEQ ID NO: 14962 - DNA, 20 bp, Artificial Sequence
  Description of Artificial Sequence: Synthetic oligonucleotide
  Target: ATXN1; (-) strand; PAM type: NNGRRT; PAM sequence: GGGAGT
catgtatatgtaggatagac

SEQ ID NO: 14963 - DNA, 20 bp, Artificial Sequence
  Description of Artificial Sequence: Synthetic oligonucleotide
  Target: ATXN1; (-) strand; PAM type: NNGRRT; PAM sequence: TAGGAT
attcatctggcatgtatatg

SEQ ID NO: 14964 - DNA, 20 bp, Artificial Sequence
  Description of Artificial Sequence: Synthetic oligonucleotide
  Target: ATXN1; (-) strand; PAM type: NNGRRT; PAM sequence: TGGGAT
ttgtagactgtcagacagtc

SEQ ID NO: 14965 - DNA, 20 bp, Artificial Sequence
  Description of Artificial Sequence: Synthetic oligonucleotide
  Target: ATXN1; (-) strand; PAM type: NNGRRT; PAM sequence: AAGAGT
gacgcagattctggaaagtg

SEQ ID NO: 14966 - DNA, 20 bp, Artificial Sequence
  Description of Artificial Sequence: Synthetic oligonucleotide
  Target: ATXN1; (-) strand; PAM type: NNGRRT; PAM sequence: AGGGAT
atgggattttagtttgcaac

SEQ ID NO: 14967 - DNA, 20 bp, Artificial Sequence
  Description of Artificial Sequence: Synthetic oligonucleotide
  Target: ATXN1; (-) strand; PAM type: NNGRRT; PAM sequence: TGGGAT
cagagaaggtgatttgggaa

SEQ ID NO: 14968 - DNA, 20 bp, Artificial Sequence
  Description of Artificial Sequence: Synthetic oligonucleotide
  Target: ATXN1; (-) strand; PAM type: NNGRRT; PAM sequence: GGGAAT
ttccacagagaaggtgattt

SEQ ID NO: 14969 - DNA, 20 bp, Artificial Sequence
  Description of Artificial Sequence: Synthetic oligonucleotide
  Target: ATXN1; (-) strand; PAM type: NNGRRT; PAM sequence: GAGGGT
aaaagtaaaaacacgcttca

SEQ ID NO: 14970 - DNA, 20 bp, Artificial Sequence
  Description of Artificial Sequence: Synthetic oligonucleotide
  Target: ATXN1; (-) strand; PAM type: NNGRRT; PAM sequence: GGGAAT
caagtgggtcggaatcccct

SEQ ID NO: 14971 - DNA, 20 bp, Artificial Sequence
  Description of Artificial Sequence: Synthetic oligonucleotide
  Target: ATXN1; (-) strand; PAM type: NNGRRT; PAM sequence: CGGAAT
gtgagcttgatcaagtgggt

SEQ ID NO: 14972 - DNA, 20 bp, Artificial Sequence
  Description of Artificial Sequence: Synthetic oligonucleotide
  Target: ATXN1; (-) strand; PAM type: NNGRRT; PAM sequence: GTGGGT
gctgctgtgagcttgatcaa

SEQ ID NO: 14973 - DNA, 20 bp, Artificial Sequence
  Description of Artificial Sequence: Synthetic oligonucleotide
  Target: ATXN1; (-) strand; PAM type: NNGRRT; PAM sequence: ATGAGT
ttcaaccagtcaagtatgag

SEQ ID NO: 14974 - DNA, 20 bp, Artificial Sequence
  Description of Artificial Sequence: Synthetic oligonucleotide
  Target: ATXN1; (-) strand; PAM type: NNGRRT; PAM sequence: ATGAGT
tcactcacaatgatctttga

SEQ ID NO: 14975 - DNA, 20 bp, Artificial Sequence
  Description of Artificial Sequence: Synthetic oligonucleotide
  Target: ATXN1; (-) strand; PAM type: NNGRRT; PAM sequence: TTGAAT
ttagtcactcacaatgatct

SEQ ID NO: 14976 - DNA, 20 bp, Artificial Sequence
  Description of Artificial Sequence: Synthetic oligonucleotide
  Target: ATXN1; (-) strand; PAM type: NNGRRT; PAM sequence: TGGGGT
ttttgtatttttggtagaga

SEQ ID NO: 14977 - DNA, 20 bp, Artificial Sequence
  Description of Artificial Sequence: Synthetic oligonucleotide
  Target: ATXN1; (-) strand; PAM type: NNGRRT; PAM sequence: TGGGGT
tcattgcagcctcaacctcc

SEQ ID NO: 14978 - DNA, 20 bp, Artificial Sequence
  Description of Artificial Sequence: Synthetic oligonucleotide
  Target: ATXN1; (-) strand; PAM type: NNGRRT; PAM sequence: TGGAGT
cctcactctgtcacccaggc

SEQ ID NO: 14979 - DNA, 20 bp, Artificial Sequence
  Description of Artificial Sequence: Synthetic oligonucleotide
  Target: ATXN1; (-) strand; PAM type: NNGRRT; PAM sequence: CTGGAT
caatctgtattataagtcta

SEQ ID NO: 14980 - DNA, 20 bp, Artificial Sequence
  Description of Artificial Sequence: Synthetic oligonucleotide
  Target: ATXN1; (-) strand; PAM type: NNGRRT; PAM sequence: GAGGAT
gtgctgttgctacatcaagt

SEQ ID NO: 14981 - DNA, 20 bp, Artificial Sequence
  Description of Artificial Sequence: Synthetic oligonucleotide
  Target: ATXN1; (-) strand; PAM type: NNGRRT; PAM sequence: TTGAGT
aagcacccactttacagtag

SEQ ID NO: 14982 - DNA, 20 bp, Artificial Sequence
  Description of Artificial Sequence: Synthetic oligonucleotide
  Target: ATXN1; (-) strand; PAM type: NNGRRT; PAM sequence: CAGGAT
gctgtttgaatcctggaaat

SEQ ID NO: 14983 - DNA, 20 bp, Artificial Sequence
  Description of Artificial Sequence: Synthetic oligonucleotide
  Target: ATXN1; (-) strand; PAM type: NNGRRT; PAM sequence: TTGAAT
ccatgcatggtgtctgctgt

SEQ ID NO: 14984 - DNA, 20 bp, Artificial Sequence
  Description of Artificial Sequence: Synthetic oligonucleotide
  Target: ATXN1; (-) strand; PAM type: NNGRRT; PAM sequence: AAGAGT
gacatttataaagggaaagg

SEQ ID NO: 14985 - DNA, 20 bp, Artificial Sequence
  Description of Artificial Sequence: Synthetic oligonucleotide
  Target: ATXN1; (-) strand; PAM type: NNGRRT; PAM sequence: AAGAGT
ctattgtgttaaaacataaa

SEQ ID NO: 14986 - DNA, 20 bp, Artificial Sequence
  Description of Artificial Sequence: Synthetic oligonucleotide
  Target: ATXN1; (-) strand; PAM type: NNGRRT; PAM sequence: AAGAAT
cagaaggttgtggacttctg

SEQ ID NO: 14987 - DNA, 20 bp, Artificial Sequence
  Description of Artificial Sequence: Synthetic oligonucleotide
  Target: ATXN1; (-) strand; PAM type: NNGRRT; PAM sequence: TAGGAT
actttggcttcccaaagtgc

SEQ ID NO: 14988 - DNA, 20 bp, Artificial Sequence
  Description of Artificial Sequence: Synthetic oligonucleotide
  Target: ATXN1; (-) strand; PAM type: NNGRRT; PAM sequence: TTGAAT
ttttggagacatggctggtc

SEQ ID NO: 14989 - DNA, 20 bp, Artificial Sequence
  Description of Artificial Sequence: Synthetic oligonucleotide
  Target: ATXN1; (-) strand; PAM type: NNGRRT; PAM sequence: TTGAAT
gcaatgggtggactatcaac

SEQ ID NO: 14990 - DNA, 20 bp, Artificial Sequence
  Description of Artificial Sequence: Synthetic oligonucleotide
  Target: ATXN1; (-) strand; PAM type: NNGRRT; PAM sequence: ATGGGT
gaaggaaatatccttttgca

SEQ ID NO: 14991 - DNA, 20 bp, Artificial Sequence
  Description of Artificial Sequence: Synthetic oligonucleotide
  Target: ATXN1; (-) strand; PAM type: NNGRRT; PAM sequence: ATGAGT
cctgcctggtaattgaaccc

SEQ ID NO: 14992 - DNA, 20 bp, Artificial Sequence
  Description of Artificial Sequence: Synthetic oligonucleotide
  Target: ATXN1; (-) strand; PAM type: NNGRRT; PAM sequence: CTGAAT
atatctttatcaccctgacg

SEQ ID NO: 14993 - DNA, 20 bp, Artificial Sequence
  Description of Artificial Sequence: Synthetic oligonucleotide
  Target: ATXN1; (-) strand; PAM type: NNGRRT; PAM sequence: GAGGGT
acttctgaggagctggcttt

SEQ ID NO: 14994 - DNA, 20 bp, Artificial Sequence
  Description of Artificial Sequence: Synthetic oligonucleotide
  Target: ATXN1; (-) strand; PAM type: NNGRRT; PAM sequence: ACGGAT
gtcttctgtaggagttattt

SEQ ID NO: 14995 - DNA, 20 bp, Artificial Sequence
  Description of Artificial Sequence: Synthetic oligonucleotide
  Target: ATXN1; (-) strand; PAM type: NNGRRT; PAM sequence: AGGAGT
gagcaaattgtgtcttctgt

SEQ ID NO: 14996 - DNA, 20 bp, Artificial Sequence
  Description of Artificial Sequence: Synthetic oligonucleotide
  Target: ATXN1; (-) strand; PAM type: NNGRRT; PAM sequence: AGGGGT
cgttactcttcttagagctg

SEQ ID NO: 14997 - DNA, 20 bp, Artificial Sequence
  Description of Artificial Sequence: Synthetic oligonucleotide
  Target: ATXN1; (-) strand; PAM type: NNGRRT; PAM sequence: GGGAGT
aagtatgctgacactgtcct

SEQ ID NO: 14998 - DNA, 20 bp, Artificial Sequence
  Description of Artificial Sequence: Synthetic oligonucleotide
  Target: ATXN1; (-) strand; PAM type: NNGRRT; PAM sequence: GAGAAT
acttgtctttatctttaaaa

SEQ ID NO: 14999 - DNA, 20 bp, Artificial Sequence
  Description of Artificial Sequence: Synthetic oligonucleotide
  Target: ATXN1; (-) strand; PAM type: NNGRRT; PAM sequence: GGGAAT
accctcacttgcaggaggga

SEQ ID NO: 15000 - DNA, 20 bp, Artificial Sequence
  Description of Artificial Sequence: Synthetic oligonucleotide
  Target: ATXN1; (-) strand; PAM type: NNGRRT; PAM sequence: GAGGGT
ggtgatggtgatggcaggta

SEQ ID NO: 15001 - DNA, 20 bp, Artificial Sequence
  Description of Artificial Sequence: Synthetic oligonucleotide
  Target: ATXN1; (-) strand; PAM type: NNGRRT; PAM sequence: GTGAGT
tatttggtcaaaagagaaac

SEQ ID NO: 15002 - DNA, 20 bp, Artificial Sequence
  Description of Artificial Sequence: Synthetic oligonucleotide
  Target: ATXN1; (-) strand; PAM type: NNGRRT; PAM sequence: AGGGAT
attagttctgttggcgtaga

SEQ ID NO: 15003 - DNA, 20 bp, Artificial Sequence
  Description of Artificial Sequence: Synthetic oligonucleotide
  Target: ATXN1; (-) strand; PAM type: NNGRRT; PAM sequence: CTGGGT
taatgaagataaacatgttg

SEQ ID NO: 15004 - DNA, 20 bp, Artificial Sequence
  Description of Artificial Sequence: Synthetic oligonucleotide
  Target: ATXN1; (-) strand; PAM type: NNGRRT; PAM sequence: AAGAAT
gcttcagagtcagctaacca

SEQ ID NO: 15005 - DNA, 20 bp, Artificial Sequence
  Description of Artificial Sequence: Synthetic oligonucleotide
  Target: ATXN1; (-) strand; PAM type: NNGRRT; PAM sequence: CAGAGT
actcaagcacgagcaggctt

SEQ ID NO: 15006 - DNA, 20 bp, Artificial Sequence
  Description of Artificial Sequence: Synthetic oligonucleotide
  Target: ATXN1; (-) strand; PAM type: NNGRRT; PAM sequence: TAGAAT
tcctagagactttaaacatt

SEQ ID NO: 15007 - DNA, 20 bp, Artificial Sequence
  Description of Artificial Sequence: Synthetic oligonucleotide
  Target: ATXN1; (-) strand; PAM type: NNGRRT; PAM sequence: GTGAGT
gtggcctgttagattgattt

SEQ ID NO: 15008 - DNA, 20 bp, Artificial Sequence
  Description of Artificial Sequence: Synthetic oligonucleotide
  Target: ATXN1; (-) strand; PAM type: NNGRRT; PAM sequence: CTGAGT
ttactctggtggacagacac

SEQ ID NO: 15009 - DNA, 20 bp, Artificial Sequence
  Description of Artificial Sequence: Synthetic oligonucleotide
  Target: ATXN1; (-) strand; PAM type: NNGRRT; PAM sequence: TTGGGT
ctttcttgtctgctttctgc

SEQ ID NO: 15010 - DNA, 20 bp, Artificial Sequence
  Description of Artificial Sequence: Synthetic oligonucleotide
  Target: ATXN1; (-) strand; PAM type: NNGRRT; PAM sequence: GAGAAT
aagatgctactgggagagaa

SEQ ID NO: 15011 - DNA, 20 bp, Artificial Sequence
  Description of Artificial Sequence: Synthetic oligonucleotide
  Target: ATXN1; (-) strand; PAM type: NNGRRT; PAM sequence: TGGGAT
gagtgagctcctgagctccc

SEQ ID NO: 15012 - DNA, 20 bp, Artificial Sequence
  Description of Artificial Sequence: Synthetic oligonucleotide
  Target: ATXN1; (-) strand; PAM type: NNGRRT; PAM sequence: CAGAGT
actcttcagctccaaggaat

SEQ ID NO: 15013 - DNA, 20 bp, Artificial Sequence
  Description of Artificial Sequence: Synthetic oligonucleotide
  Target: ATXN1; (-) strand; PAM type: NNGRRT; PAM sequence: AGGAAT
acagcaactcttcagctcca

SEQ ID NO: 15014 - DNA, 20 bp, Artificial Sequence
  Description of Artificial Sequence: Synthetic oligonucleotide
  Target: ATXN1; (-) strand; PAM type: NNGRRT; PAM sequence: GAGAGT
gcctggctctagtggtagaa

SEQ ID NO: 15015 - DNA, 20 bp, Artificial Sequence
  Description of Artificial Sequence: Synthetic oligonucleotide
  Target: ATXN1; (-) strand; PAM type: NNGRRT; PAM sequence: GGGAGT
ctctttgtgatccaacaaga

SEQ ID NO: 15016 - DNA, 20 bp, Artificial Sequence
  Description of Artificial Sequence: Synthetic oligonucleotide
  Target: ATXN1; (-) strand; PAM type: NNGRRT; PAM sequence: AGGGGT
ccctatggctctgggacatg

SEQ ID NO: 15017 - DNA, 20 bp, Artificial Sequence
  Description of Artificial Sequence: Synthetic oligonucleotide
  Target: ATXN1; (-) strand; PAM type: NNGRRT; PAM sequence: GAGGGT
gagtctagctgttgataaga

SEQ ID NO: 15018 - DNA, 20 bp, Artificial Sequence
  Description of Artificial Sequence: Synthetic oligonucleotide
  Target: ATXN1; (-) strand; PAM type: NNGRRT; PAM sequence: CTGAGT
taaaacggaatgtgtggttg

SEQ ID NO: 15019 - DNA, 20 bp, Artificial Sequence
  Description of Artificial Sequence: Synthetic oligonucleotide
  Target: ATXN1; (-) strand; PAM type: NNGRRT; PAM sequence: CGGAAT
atgtgggcgagaaagtaaaa

SEQ ID NO: 15020 - DNA, 20 bp, Artificial Sequence
  Description of Artificial Sequence: Synthetic oligonucleotide
  Target: ATXN1; (-) strand; PAM type: NNGRRT; PAM sequence: TTGAAT
tctagtggagataaaatggt

SEQ ID NO: 15021 - DNA, 20 bp, Artificial Sequence
  Description of Artificial Sequence: Synthetic oligonucleotide
  Target: ATXN1; (-) strand; PAM type: NNGRRT; PAM sequence: TAGGAT
agccctccctccccaaggtt

SEQ ID NO: 15022 - DNA, 20 bp, Artificial Sequence
  Description of Artificial Sequence: Synthetic oligonucleotide
  Target: ATXN1; (-) strand; PAM type: NNGRRT; PAM sequence: CTGAGT
agatatgcccacgtgagtat

SEQ ID NO: 15023 - DNA, 20 bp, Artificial Sequence
  Description of Artificial Sequence: Synthetic oligonucleotide
  Target: ATXN1; (-) strand; PAM type: NNGRRT; PAM sequence: GTGAGT
tgggacccagatatgcccac

SEQ ID NO: 15024 - DNA, 20 bp, Artificial Sequence
  Description of Artificial Sequence: Synthetic oligonucleotide
  Target: ATXN1; (-) strand; PAM type: NNGRRT; PAM sequence: AGGGAT
gagagcctgtggcagaaccc

SEQ ID NO: 15025 - DNA, 20 bp, Artificial Sequence
  Description of Artificial Sequence: Synthetic oligonucleotide
  Target: ATXN1; (-) strand; PAM type: NNGRRT; PAM sequence: GTGGAT
ccttggcctcccaaagtgcc

SEQ ID NO: 15026 - DNA, 20 bp, Artificial Sequence
  Description of Artificial Sequence: Synthetic oligonucleotide
  Target: ATXN1; (-) strand; PAM type: NNGRRT; PAM sequence: TGGGGT
ttttgtatttttagtagaga

SEQ ID NO: 15027 - DNA, 20 bp, Artificial Sequence
  Description of Artificial Sequence: Synthetic oligonucleotide
  Target: ATXN1; (-) strand; PAM type: NNGRRT; PAM sequence: TGGGAT
gcctcagcctcccaagtagc

SEQ ID NO: 15028 - DNA, 20 bp, Artificial Sequence
  Description of Artificial Sequence: Synthetic oligonucleotide
  Target: ATXN1; (-) strand; PAM type: NNGRRT; PAM sequence: CCGGGT
ctcactgcaacctctgcctc

SEQ ID NO: 15029 - DNA, 20 bp, Artificial Sequence
  Description of Artificial Sequence: Synthetic oligonucleotide
  Target: ATXN1; (-) strand; PAM type: NNGRRT; PAM sequence: TGGAGT
gcctcgctctgtcgccaggc

SEQ ID NO: 15030 - DNA, 20 bp, Artificial Sequence
  Description of Artificial Sequence: Synthetic oligonucleotide
  Target: ATXN1; (-) strand; PAM type: NNGRRT; PAM sequence: ATGGAT
ggtgtcctgtgttgtacttt

SEQ ID NO: 15031 - DNA, 20 bp, Artificial Sequence
  Description of Artificial Sequence: Synthetic oligonucleotide
  Target: ATXN1; (-) strand; PAM type: NNGRRT; PAM sequence: TGGAGT
attagaaacaatgaaaggaa

SEQ ID NO: 15032 - DNA, 20 bp, Artificial Sequence
  Description of Artificial Sequence: Synthetic oligonucleotide
  Target: ATXN1; (-) strand; PAM type: NNGRRT; PAM sequence: AGGAAT
tgggtattagaaacaatgaa

SEQ ID NO: 15033 - DNA, 20 bp, Artificial Sequence
  Description of Artificial Sequence: Synthetic oligonucleotide
  Target: ATXN1; (-) strand; PAM type: NNGRRT; PAM sequence: CTGGGT
gagttgaacaaactgagcaa

SEQ ID NO: 15034 - DNA, 20 bp, Artificial Sequence
  Description of Artificial Sequence: Synthetic oligonucleotide
  Target: ATXN1; (-) strand; PAM type: NNGRRT; PAM sequence: AAGAGT
tgtggaggacactacaaaga

SEQ ID NO: 15035 - DNA, 20 bp, Artificial Sequence
  Description of Artificial Sequence: Synthetic oligonucleotide
  Target: ATXN1; (-) strand; PAM type: NNGRRT; PAM sequence: TGGGGT
atggtggagaaaaaagagac

SEQ ID NO: 15036 - DNA, 20 bp, Artificial Sequence
  Description of Artificial Sequence: Synthetic oligonucleotide
  Target: ATXN1; (-) strand; PAM type: NNGRRT; PAM sequence: GGGGAT
tggagatttttcaacaagtt

SEQ ID NO: 15037 - DNA, 20 bp, Artificial Sequence
  Description of Artificial Sequence: Synthetic oligonucleotide
  Target: ATXN1; (-) strand; PAM type: NNGRRT; PAM sequence: GGGGGT
gtggggaggggtcctgaact

SEQ ID NO: 15038 - DNA, 20 bp, Artificial Sequence
  Description of Artificial Sequence: Synthetic oligonucleotide
  Target: ATXN1; (-) strand; PAM type: NNGRRT; PAM sequence: AGGGGT
aaatgggcagtgctgtgggg

SEQ ID NO: 15039 - DNA, 20 bp, Artificial Sequence
  Description of Artificial Sequence: Synthetic oligonucleotide
  Target: ATXN1; (-) strand; PAM type: NNGRRT; PAM sequence: AGGAGT
ggtggtagtggtagggaggg

SEQ ID NO: 15040 - DNA, 20 bp, Artificial Sequence
  Description of Artificial Sequence: Synthetic oligonucleotide
  Target: ATXN1; (-) strand; PAM type: NNGRRT; PAM sequence: GGGGGT
ttcttgttggtttgtggttt

SEQ ID NO: 15041 - DNA, 20 bp, Artificial Sequence
  Description of Artificial Sequence: Synthetic oligonucleotide
  Target: ATXN1; (-) strand; PAM type: NNGRRT; PAM sequence: CTGAGT
aaacctgcctgcgaggagga

SEQ ID NO: 15042 - DNA, 20 bp, Artificial Sequence
  Description of Artificial Sequence: Synthetic oligonucleotide
  Target: ATXN1; (-) strand; PAM type: NNGRRT; PAM sequence: AAGAAT
acaccacatgtgtcagacca

SEQ ID NO: 15043 - DNA, 20 bp, Artificial Sequence
  Description of Artificial Sequence: Synthetic oligonucleotide
  Target: ATXN1; (-) strand; PAM type: NNGRRT; PAM sequence: AGGGGT
actgccttggacagggagat

SEQ ID NO: 15044 - DNA, 20 bp, Artificial Sequence
  Description of Artificial Sequence: Synthetic oligonucleotide
  Target: ATXN1; (-) strand; PAM type: NNGRRT; PAM sequence: GAGAAT
tccgtgtaggactcaacacg

SEQ ID NO: 15045 - DNA, 20 bp, Artificial Sequence
  Description of Artificial Sequence: Synthetic oligonucleotide
  Target: ATXN1; (-) strand; PAM type: NNGRRT; PAM sequence: TGGGGT
tcatgctttcatctttcatc

SEQ ID NO: 15046 - DNA, 20 bp, Artificial Sequence
  Description of Artificial Sequence: Synthetic oligonucleotide
  Target: ATXN1; (-) strand; PAM type: NNGRRT; PAM sequence: TGGGAT
taaggcaaagttaacctgtc

SEQ ID NO: 15047 - DNA, 20 bp, Artificial Sequence
  Description of Artificial Sequence: Synthetic oligonucleotide
  Target: ATXN1; (-) strand; PAM type: NNGRRT; PAM sequence: CTGAAT
tctttctgaccttgttcctc

SEQ ID NO: 15048 - DNA, 20 bp, Artificial Sequence
  Description of Artificial Sequence: Synthetic oligonucleotide
  Target: ATXN1; (-) strand; PAM type: NNGRRT; PAM sequence: AAGAAT
gtaaaagaatgaatgaactt

SEQ ID NO: 15049 - DNA, 20 bp, Artificial Sequence
  Description of Artificial Sequence: Synthetic oligonucleotide
  Target: ATXN1; (-) strand; PAM type: NNGRRT; PAM sequence: ATGAAT
ataacgtgtagggtaaaaga

SEQ ID NO: 15050 - DNA, 20 bp, Artificial Sequence
  Description of Artificial Sequence: Synthetic oligonucleotide
  Target: ATXN1; (-) strand; PAM type: NNGRRT; PAM sequence: AAGAAT
ctcgataacgtgtagggtaa

SEQ ID NO: 15051 - DNA, 20 bp, Artificial Sequence
  Description of Artificial Sequence: Synthetic oligonucleotide
  Target: ATXN1; (-) strand; PAM type: NNGRRT; PAM sequence: TAGGGT
agtaggtgctcgataacgtg

SEQ ID NO: 15052 - DNA, 20 bp, Artificial Sequence
  Description of Artificial Sequence: Synthetic oligonucleotide
  Target: ATXN1; (-) strand; PAM type: NNGRRT; PAM sequence: GTGGAT
tcattcatacagtgaccgct

SEQ ID NO: 15053 - DNA, 20 bp, Artificial Sequence
  Description of Artificial Sequence: Synthetic oligonucleotide
  Target: ATXN1; (-) strand; PAM type: NNGRRT; PAM sequence: TAGGAT
agctattgtattagtcagga

SEQ ID NO: 15054 - DNA, 20 bp, Artificial Sequence
  Description of Artificial Sequence: Synthetic oligonucleotide
  Target: ATXN1; (-) strand; PAM type: NNGRRT; PAM sequence: CAGGAT
ataaaagctattgtattagt

SEQ ID NO: 15055 - DNA, 20 bp, Artificial Sequence
  Description of Artificial Sequence: Synthetic oligonucleotide
  Target: ATXN1; (-) strand; PAM type: NNGRRT; PAM sequence: GTGAGT
gtctcattaagtggcaagga

SEQ ID NO: 15056 - DNA, 20 bp, Artificial Sequence
  Description of Artificial Sequence: Synthetic oligonucleotide
  Target: ATXN1; (-) strand; PAM type: NNGRRT; PAM sequence: AGGAGT
tcttgtctcattaagtggca

SEQ ID NO: 15057 - DNA, 20 bp, Artificial Sequence
  Description of Artificial Sequence: Synthetic oligonucleotide
  Target: ATXN1; (-) strand; PAM type: NNGRRT; PAM sequence: GAGGGT
aggaaggaaaatgtgagttg

SEQ ID NO: 15058 - DNA, 20 bp, Artificial Sequence
  Description of Artificial Sequence: Synthetic oligonucleotide
  Target: ATXN1; (-) strand; PAM type: NNGRRT; PAM sequence: GTGAGT
atgatgagaggaaggaaaat

SEQ ID NO: 15059 - DNA, 20 bp, Artificial Sequence
  Description of Artificial Sequence: Synthetic oligonucleotide
  Target: ATXN1; (-) strand; PAM type: NNGRRT; PAM sequence: ATGAGT
aaaatatcaagtcatcagtt

SEQ ID NO: 15060 - DNA, 20 bp, Artificial Sequence
  Description of Artificial Sequence: Synthetic oligonucleotide
  Target: ATXN1; (-) strand; PAM type: NNGRRT; PAM sequence: GGGAAT
aataattgttattacgtatt

SEQ ID NO: 15061 - DNA, 20 bp, Artificial Sequence
  Description of Artificial Sequence: Synthetic oligonucleotide
  Target: ATXN1; (-) strand; PAM type: NNGRRT; PAM sequence: ATGAAT
ggtggtattggttaatgcaa

SEQ ID NO: 15062 - DNA, 20 bp, Artificial Sequence
  Description of Artificial Sequence: Synthetic oligonucleotide
  Target: ATXN1; (-) strand; PAM type: NNGRRT; PAM sequence: ATGAAT
tggctaagataaattcacag

SEQ ID NO: 15063 - DNA, 20 bp, Artificial Sequence
  Description of Artificial Sequence: Synthetic oligonucleotide
  Target: ATXN1; (-) strand; PAM type: NNGRRT; PAM sequence: CAGAAT
atgatgagccatggttgaca

SEQ ID NO: 15064 - DNA, 20 bp, Artificial Sequence
  Description of Artificial Sequence: Synthetic oligonucleotide
  Target: ATXN1; (-) strand; PAM type: NNGRRT; PAM sequence: TAGGGT
ttaaatagacctaaagacat

SEQ ID NO: 15065 - DNA, 20 bp, Artificial Sequence
  Description of Artificial Sequence: Synthetic oligonucleotide
  Target: ATXN1; (-) strand; PAM type: NNGRRT; PAM sequence: GAGAAT
gaatgaacaaatgactgaat

SEQ ID NO: 15066 - DNA, 20 bp, Artificial Sequence
  Description of Artificial Sequence: Synthetic oligonucleotide
  Target: ATXN1; (-) strand; PAM type: NNGRRT; PAM sequence: CTGAAT
ttgtgtgaatgaacaaatga

SEQ ID NO: 15067 - DNA, 20 bp, Artificial Sequence
  Description of Artificial Sequence: Synthetic oligonucleotide
  Target: ATXN1; (-) strand; PAM type: NNGRRT; PAM sequence: GTGAAT
aaactgactactgtatttgt

SEQ ID NO: 15068 - DNA, 20 bp, Artificial Sequence
  Description of Artificial Sequence: Synthetic oligonucleotide
  Target: ATXN1; (-) strand; PAM type: NNGRRT; PAM sequence: GTGAGT
atgtgtgtgctctcatgtag

SEQ ID NO: 15069 - DNA, 20 bp, Artificial Sequence
  Description of Artificial Sequence: Synthetic oligonucleotide
  Target: ATXN1; (-) strand; PAM type: NNGRRT; PAM sequence: ATGAAT
atttgatcaatatttgttga

SEQ ID NO: 15070 - DNA, 20 bp, Artificial Sequence
  Description of Artificial Sequence: Synthetic oligonucleotide
  Target: ATXN1; (-) strand; PAM type: NNGRRT; PAM sequence: TTGAAT
aggcatttgatcaatatttg

SEQ ID NO: 15071 - DNA, 20 bp, Artificial Sequence
  Description of Artificial Sequence: Synthetic oligonucleotide
  Target: ATXN1; (-) strand; PAM type: NNGRRT; PAM sequence: TAGAAT
ttattgttagtctcctctat

SEQ ID NO: 15072 - DNA, 20 bp, Artificial Sequence
  Description of Artificial Sequence: Synthetic oligonucleotide
  Target: ATXN1; (-) strand; PAM type: NNGRRT; PAM sequence: TGGGGT
aatcctcccccatagaaagc

SEQ ID NO: 15073 - DNA, 20 bp, Artificial Sequence
  Description of Artificial Sequence: Synthetic oligonucleotide
  Target: ATXN1; (-) strand; PAM type: NNGRRT; PAM sequence: CCGGGT
cacgttggctttagccccag

SEQ ID NO: 15074 - DNA, 20 bp, Artificial Sequence
  Description of Artificial Sequence: Synthetic oligonucleotide
  Target: ATXN1; (-) strand; PAM type: NNGRRT; PAM sequence: TTGAGT
aggccacctgcaggaaagtt

SEQ ID NO: 15075 - DNA, 20 bp, Artificial Sequence
  Description of Artificial Sequence: Synthetic oligonucleotide
  Target: ATXN1; (-) strand; PAM type: NNGRRT; PAM sequence: CAGAAT
gtattgaggcagacgggggc

SEQ ID NO: 15076 - DNA, 20 bp, Artificial Sequence
  Description of Artificial Sequence: Synthetic oligonucleotide
  Target: ATXN1; (-) strand; PAM type: NNGRRT; PAM sequence: AAGAGT
agcccactgagaaataagac

SEQ ID NO: 15077 - DNA, 20 bp, Artificial Sequence
  Description of Artificial Sequence: Synthetic oligonucleotide
  Target: ATXN1; (-) strand; PAM type: NNGRRT; PAM sequence: AAGAGT
tatggaaacttttatcttac

SEQ ID NO: 15078 - DNA, 20 bp, Artificial Sequence
  Description of Artificial Sequence: Synthetic oligonucleotide
  Target: ATXN1; (-) strand; PAM type: NNGRRT; PAM sequence: TAGGAT
atagattaggtttgatagat

SEQ ID NO: 15079 - DNA, 20 bp, Artificial Sequence
  Description of Artificial Sequence: Synthetic oligonucleotide
  Target: ATXN1; (-) strand; PAM type: NNGRRT; PAM sequence: AGGGAT
actattaagtaagagatttg

SEQ ID NO: 15080 - DNA, 20 bp, Artificial Sequence
  Description of Artificial Sequence: Synthetic oligonucleotide
  Target: ATXN1; (-) strand; PAM type: NNGRRT; PAM sequence: TGGGAT
cactgtattgaatttgtctt

SEQ ID NO: 15081 - DNA, 20 bp, Artificial Sequence
  Description of Artificial Sequence: Synthetic oligonucleotide
  Target: ATXN1; (-) strand; PAM type: NNGRRT; PAM sequence: TTGAAT
cactcccaatattcactgta

SEQ ID NO: 15082 - DNA, 20 bp, Artificial Sequence
  Description of Artificial Sequence: Synthetic oligonucleotide
  Target: ATXN1; (-) strand; PAM type: NNGRRT; PAM sequence: CTGGGT
actgaccatagcatataccc

SEQ ID NO: 15083 - DNA, 20 bp, Artificial Sequence
  Description of Artificial Sequence: Synthetic oligonucleotide
  Target: ATXN1; (-) strand; PAM type: NNGRRT; PAM sequence: AAGAAT
cagatataaagtcacaaggt

SEQ ID NO: 15084 - DNA, 20 bp, Artificial Sequence
  Description of Artificial Sequence: Synthetic oligonucleotide
  Target: ATXN1; (-) strand; PAM type: NNGRRT; PAM sequence: CTGAGT
aatttctctaatgctcacaa

SEQ ID NO: 15085 - DNA, 20 bp, Artificial Sequence
  Description of Artificial Sequence: Synthetic oligonucleotide
  Target: ATXN1; (-) strand; PAM type: NNGRRT; PAM sequence: AAGGAT
aggtcgaggctaagcccttc

SEQ ID NO: 15086 - DNA, 20 bp, Artificial Sequence
  Description of Artificial Sequence: Synthetic oligonucleotide
  Target: ATXN1; (-) strand; PAM type: NNGRRT; PAM sequence: CTGAGT
atatatattgctttgggggc

SEQ ID NO: 15087 - DNA, 20 bp, Artificial Sequence
  Description of Artificial Sequence: Synthetic oligonucleotide
  Target: ATXN1; (-) strand; PAM type: NNGRRT; PAM sequence: ACGGAT
tgtaagaactcttagttcca

SEQ ID NO: 15088 - DNA, 20 bp, Artificial Sequence
  Description of Artificial Sequence: Synthetic oligonucleotide
  Target: ATXN1; (-) strand; PAM type: NNGRRT; PAM sequence: AAGAAT
atctatataatccttgatga

SEQ ID NO: 15089 - DNA, 20 bp, Artificial Sequence
  Description of Artificial Sequence: Synthetic oligonucleotide
  Target: ATXN1; (-) strand; PAM type: NNGRRT; PAM sequence: CAGAGT
caatgtgaaatccagggaaa

SEQ ID NO: 15090 - DNA, 20 bp, Artificial Sequence
  Description of Artificial Sequence: Synthetic oligonucleotide
  Target: ATXN1; (-) strand; PAM type: NNGRRT; PAM sequence: GTGGGT
gctgctcctggctgaaatgt

SEQ ID NO: 15091 - DNA, 20 bp, Artificial Sequence
  Description of Artificial Sequence: Synthetic oligonucleotide
  Target: ATXN1; (-) strand; PAM type: NNGRRT; PAM sequence: GAGGGT
tgtcagaatgacctggtggg

SEQ ID NO: 15092 - DNA, 20 bp, Artificial Sequence
  Description of Artificial Sequence: Synthetic oligonucleotide
  Target: ATXN1; (-) strand; PAM type: NNGRRT; PAM sequence: CAGAAT
gtgtggcacagcggctctgt

SEQ ID NO: 15093 - DNA, 20 bp, Artificial Sequence
  Description of Artificial Sequence: Synthetic oligonucleotide
  Target: ATXN1; (-) strand; PAM type: NNGRRT; PAM sequence: GAGAGT
ttagcaattgaaaggaggtg

SEQ ID NO: 15094 - DNA, 20 bp, Artificial Sequence
  Description of Artificial Sequence: Synthetic oligonucleotide
  Target: ATXN1; (-) strand; PAM type: NNGRRT; PAM sequence: CAGGGT
caggcctctgaatgggtcag

SEQ ID NO: 15095 - DNA, 20 bp, Artificial Sequence
  Description of Artificial Sequence: Synthetic oligonucleotide
  Target: ATXN1; (-) strand; PAM type: NNGRRT; PAM sequence: ATGGGT
agtgttctgcaggcctctga

SEQ ID NO: 15096 - DNA, 20 bp, Artificial Sequence
  Description of Artificial Sequence: Synthetic oligonucleotide
  Target: ATXN1; (-) strand; PAM type: NNGRRT; PAM sequence: CTGAAT
taggagtgttctgcaggcct

SEQ ID NO: 15097 - DNA, 20 bp, Artificial Sequence
  Description of Artificial Sequence: Synthetic oligonucleotide
  Target: ATXN1; (-) strand; PAM type: NNGRRT; PAM sequence: AGGAGT
agagacaaggcaatgcctgt

SEQ ID NO: 15098 - DNA, 20 bp, Artificial Sequence
  Description of Artificial Sequence: Synthetic oligonucleotide
  Target: ATXN1; (-) strand; PAM type: NNGRRT; PAM sequence: GAGAAT
cctggggcctgtgatatgcg

SEQ ID NO: 15099 - DNA, 20 bp, Artificial Sequence
  Description of Artificial Sequence: Synthetic oligonucleotide
  Target: ATXN1; (-) strand; PAM type: NNGRRT; PAM sequence: CAGGAT
gacagccagtgtatcctggg

SEQ ID NO: 15100 - DNA, 20 bp, Artificial Sequence
  Description of Artificial Sequence: Synthetic oligonucleotide
  Target: ATXN1; (-) strand; PAM type: NNGRRT; PAM sequence: CTGGGT
tttcatggtatgcaatgggg

SEQ ID NO: 15101 - DNA, 20 bp, Artificial Sequence
  Description of Artificial Sequence: Synthetic oligonucleotide
  Target: ATXN1; (-) strand; PAM type: NNGRRT; PAM sequence: GTGAGT
gcatatataccttgtaaaac

SEQ ID NO: 15102 - DNA, 20 bp, Artificial Sequence
  Description of Artificial Sequence: Synthetic oligonucleotide
  Target: ATXN1; (-) strand; PAM type: NNGRRT; PAM sequence: ATGAGT
actaaacacagatagaagcc

SEQ ID NO: 15103 - DNA, 20 bp, Artificial Sequence
  Description of Artificial Sequence: Synthetic oligonucleotide
  Target: ATXN1; (-) strand; PAM type: NNGRRT; PAM sequence: TGGGGT
tggctactttggtttccttc

SEQ ID NO: 15104 - DNA, 20 bp, Artificial Sequence
  Description of Artificial Sequence: Synthetic oligonucleotide
  Target: ATXN1; (-) strand; PAM type: NNGRRT; PAM sequence: AGGAAT
tctgaggcaagaaatggtga

SEQ ID NO: 15105 - DNA, 20 bp, Artificial Sequence
  Description of Artificial Sequence: Synthetic oligonucleotide
  Target: ATXN1; (-) strand; PAM type: NNGRRT; PAM sequence: AAGGGT
taaagaataaactggtagag

SEQ ID NO: 15106 - DNA, 20 bp, Artificial Sequence
  Description of Artificial Sequence: Synthetic oligonucleotide
  Target: ATXN1; (-) strand; PAM type: NNGRRT; PAM sequence: AAGAAT
atcataggattctttgggta

SEQ ID NO: 15107 - DNA, 20 bp, Artificial Sequence
  Description of Artificial Sequence: Synthetic oligonucleotide
  Target: ATXN1; (-) strand; PAM type: NNGRRT; PAM sequence: TTGGGT
tgcttacatcataggattct

SEQ ID NO: 15108 - DNA, 20 bp, Artificial Sequence
  Description of Artificial Sequence: Synthetic oligonucleotide
  Target: ATXN1; (-) strand; PAM type: NNGRRT; PAM sequence: TAGGAT
ccatttccatgcttacatca

SEQ ID NO: 15109 - DNA, 20 bp, Artificial Sequence
  Description of Artificial Sequence: Synthetic oligonucleotide
  Target: ATXN1; (-) strand; PAM type: NNGRRT; PAM sequence: TAGAGT
ggggactgtaaaggtctctt

SEQ ID NO: 15110 - DNA, 20 bp, Artificial Sequence
  Description of Artificial Sequence: Synthetic oligonucleotide
  Target: ATXN1; (-) strand; PAM type: NNGRRT; PAM sequence: GTGGGT
agagcacaccacagtacaat

SEQ ID NO: 15111 - DNA, 20 bp, Artificial Sequence
  Description of Artificial Sequence: Synthetic oligonucleotide
  Target: ATXN1; (-) strand; PAM type: NNGRRT; PAM sequence: ACGAGT
gtccacagagctgggtctac

SEQ ID NO: 15112 - DNA, 20 bp, Artificial Sequence
  Description of Artificial Sequence: Synthetic oligonucleotide
  Target: ATXN1; (-) strand; PAM type: NNGRRT; PAM sequence: CTGGGT
gatcgctcctgtccacagag

SEQ ID NO: 15113 - DNA, 20 bp, Artificial Sequence
  Description of Artificial Sequence: Synthetic oligonucleotide
  Target: ATXN1; (-) strand; PAM type: NNGRRT; PAM sequence: CTGAGT
gatttgtgagggatcatctg

SEQ ID NO: 15114 - DNA, 20 bp, Artificial Sequence
  Description of Artificial Sequence: Synthetic oligonucleotide
  Target: ATXN1; (-) strand; PAM type: NNGRRT; PAM sequence: AGGGAT
acatagattgctgatttgtg

SEQ ID NO: 15115 - DNA, 20 bp, Artificial Sequence
  Description of Artificial Sequence: Synthetic oligonucleotide
  Target: ATXN1; (-) strand; PAM type: NNGRRT; PAM sequence: TGGAAT
gtgtctaccaacatactgaa

SEQ ID NO: 15116 - DNA, 20 bp, Artificial Sequence
  Description of Artificial Sequence: Synthetic oligonucleotide
  Target: ATXN1; (-) strand; PAM type: NNGRRT; PAM sequence: CTGAAT
aattggtgtctaccaacata

SEQ ID NO: 15117 - DNA, 20 bp, Artificial Sequence
  Description of Artificial Sequence: Synthetic oligonucleotide
  Target: ATXN1; (-) strand; PAM type: NNGRRT; PAM sequence: TAGAGT
actttgtcttcttccctaac

SEQ ID NO: 15118 - DNA, 20 bp, Artificial Sequence
  Description of Artificial Sequence: Synthetic oligonucleotide
  Target: ATXN1; (-) strand; PAM type: NNGRRT; PAM sequence: AAGGGT
tctcacctagggagtggtca

SEQ ID NO: 15119 - DNA, 20 bp, Artificial Sequence
  Description of Artificial Sequence: Synthetic oligonucleotide
  Target: ATXN1; (-) strand; PAM type: NNGRRT; PAM sequence: GGGAGT
aaaacatttcatctcaccta

SEQ ID NO: 15120 - DNA, 20 bp, Artificial Sequence
  Description of Artificial Sequence: Synthetic oligonucleotide
  Target: ATXN1; (-) strand; PAM type: NNGRRT; PAM sequence: TAGAAT
ttaagaatatgattctcagt

SEQ ID NO: 15121 - DNA, 20 bp, Artificial Sequence
  Description of Artificial Sequence: Synthetic oligonucleotide
  Target: ATXN1; (-) strand; PAM type: NNGRRT; PAM sequence: AAGAAT
caataagatggagagaagtt

SEQ ID NO: 15122 - DNA, 20 bp, Artificial Sequence
  Description of Artificial Sequence: Synthetic oligonucleotide
  Target: ATXN1; (-) strand; PAM type: NNGRRT; PAM sequence: AAGAGT
agttatgttggtttttacat

SEQ ID NO: 15123 - DNA, 20 bp, Artificial Sequence
  Description of Artificial Sequence: Synthetic oligonucleotide
  Target: ATXN1; (-) strand; PAM type: NNGRRT; PAM sequence: TGGGAT
gcctcggcctcccaaagtgc

SEQ ID NO: 15124 - DNA, 20 bp, Artificial Sequence
  Description of Artificial Sequence: Synthetic oligonucleotide
  Target: ATXN1; (-) strand; PAM type: NNGRRT; PAM sequence: AAGGAT
atgggtttcactgtgttacc

SEQ ID NO: 15125 - DNA, 20 bp, Artificial Sequence
  Description of Artificial Sequence: Synthetic oligonucleotide
  Target: ATXN1; (-) strand; PAM type: NNGRRT; PAM sequence: ATGGGT
tttttgtatttttagtagag

SEQ ID NO: 15126 - DNA, 20 bp, Artificial Sequence
  Description of Artificial Sequence: Synthetic oligonucleotide
  Target: ATXN1; (-) strand; PAM type: NNGRRT; PAM sequence: CTGAGT
cattctcctgcctcagcctc

SEQ ID NO: 15127 - DNA, 20 bp, Artificial Sequence
  Description of Artificial Sequence: Synthetic oligonucleotide
  Target: ATXN1; (-) strand; PAM type: NNGRRT; PAM sequence: CCGGGT
ctcactgcaagctccgcctc

SEQ ID NO: 15128 - DNA, 20 bp, Artificial Sequence
  Description of Artificial Sequence: Synthetic oligonucleotide
  Target: ATXN1; (-) strand; PAM type: NNGRRT; PAM sequence: TGGAGT
tctccctctgtcgcccaggc

SEQ ID NO: 15129 - DNA, 20 bp, Artificial Sequence
  Description of Artificial Sequence: Synthetic oligonucleotide
  Target: ATXN1; (-) strand; PAM type: NNGRRT; PAM sequence: ACGGAT
gtttatttatttactttgag

SEQ ID NO: 15130 - DNA, 20 bp, Artificial Sequence
  Description of Artificial Sequence: Synthetic oligonucleotide
  Target: ATXN1; (-) strand; PAM type: NNGRRT; PAM sequence: CAGGGT
acctgcagaagaatggctaa

SEQ ID NO: 15131 - DNA, 20 bp, Artificial Sequence
  Description of Artificial Sequence: Synthetic oligonucleotide
  Target: ATXN1; (-) strand; PAM type: NNGRRT; PAM sequence: AAGAAT
gcggttgtctgcacctgcag

SEQ ID NO: 15132 - DNA, 20 bp, Artificial Sequence
  Description of Artificial Sequence: Synthetic oligonucleotide
  Target: ATXN1; (-) strand; PAM type: NNGRRT; PAM sequence: ATGGAT
gcacccagaacacttctgtt

SEQ ID NO: 15133 - DNA, 20 bp, Artificial Sequence
  Description of Artificial Sequence: Synthetic oligonucleotide
  Target: ATXN1; (-) strand; PAM type: NNGRRT; PAM sequence: GTGAGT
taagtaaaggggttggcaga

SEQ ID NO: 15134 - DNA, 20 bp, Artificial Sequence
  Description of Artificial Sequence: Synthetic oligonucleotide
  Target: ATXN1; (-) strand; PAM type: NNGRRT; PAM sequence: CAGAGT
ctactaagtaaaggggttgg

SEQ ID NO: 15135 - DNA, 20 bp, Artificial Sequence
  Description of Artificial Sequence: Synthetic oligonucleotide
  Target: ATXN1; (-) strand; PAM type: NNGRRT; PAM sequence: AGGGGT
cctagttggctactaagtaa

SEQ ID NO: 15136 - DNA, 20 bp, Artificial Sequence
  Description of Artificial Sequence: Synthetic oligonucleotide
  Target: ATXN1; (-) strand; PAM type: NNGRRT; PAM sequence: AAGGGT
ataatgatcacccctaaggc

SEQ ID NO: 15137 - DNA, 20 bp, Artificial Sequence
  Description of Artificial Sequence: Synthetic oligonucleotide
  Target: ATXN1; (-) strand; PAM type: NNGRRT; PAM sequence: TAGAGT
gcagattctttttgaggctg

SEQ ID NO: 15138 - DNA, 20 bp, Artificial Sequence
  Description of Artificial Sequence: Synthetic oligonucleotide
  Target: ATXN1; (-) strand; PAM type: NNGRRT; PAM sequence: TGGAAT
gccctgcacaagtctggttt

SEQ ID NO: 15139 - DNA, 20 bp, Artificial Sequence
  Description of Artificial Sequence: Synthetic oligonucleotide
  Target: ATXN1; (-) strand; PAM type: NNGRRT; PAM sequence: TAGGAT
ttcatggagagtagcagagc

SEQ ID NO: 15140 - DNA, 20 bp, Artificial Sequence
  Description of Artificial Sequence: Synthetic oligonucleotide
  Target: ATXN1; (-) strand; PAM type: NNGRRT; PAM sequence: GAGAGT
cacctttatggggcttcatg

SEQ ID NO: 15141 - DNA, 20 bp, Artificial Sequence
  Description of Artificial Sequence: Synthetic oligonucleotide
  Target: ATXN1; (-) strand; PAM type: NNGRRT; PAM sequence: CAGGAT
aattccatgaccaagaataa

SEQ ID NO: 15142 - DNA, 20 bp, Artificial Sequence
  Description of Artificial Sequence: Synthetic oligonucleotide
  Target: ATXN1; (-) strand; PAM type: NNGRRT; PAM sequence: AAGAAT
gtcttttgaattccatgacc

SEQ ID NO: 15143 - DNA, 20 bp, Artificial Sequence
  Description of Artificial Sequence: Synthetic oligonucleotide
  Target: ATXN1; (-) strand; PAM type: NNGRRT; PAM sequence: TTGAAT
tcaagtgactgtgatgtctt

SEQ ID NO: 15144 - DNA, 20 bp, Artificial Sequence
  Description of Artificial Sequence: Synthetic oligonucleotide
  Target: ATXN1; (-) strand; PAM type: NNGRRT; PAM sequence: GAGGAT
tcatcactgggtcctttgga

SEQ ID NO: 15145 - DNA, 20 bp, Artificial Sequence
  Description of Artificial Sequence: Synthetic oligonucleotide
  Target: ATXN1; (-) strand; PAM type: NNGRRT; PAM sequence: CTGGGT
ttctttgactctcctcatca

SEQ ID NO: 15146 - DNA, 20 bp, Artificial Sequence
  Description of Artificial Sequence: Synthetic oligonucleotide
  Target: ATXN1; (-) strand; PAM type: NNGRRT; PAM sequence: TTGAAT
ttcatagggtgagtgatcct

SEQ ID NO: 15147 - DNA, 20 bp, Artificial Sequence
  Description of Artificial Sequence: Synthetic oligonucleotide
  Target: ATXN1; (-) strand; PAM type: NNGRRT; PAM sequence: GTGAGT
cgacgtgctgttttcatagg

SEQ ID NO: 15148 - DNA, 20 bp, Artificial Sequence
  Description of Artificial Sequence: Synthetic oligonucleotide
  Target: ATXN1; (-) strand; PAM type: NNGRRT; PAM sequence: TAGGGT
aaatcgacgtgctgttttca

SEQ ID NO: 15149 - DNA, 20 bp, Artificial Sequence
  Description of Artificial Sequence: Synthetic oligonucleotide
  Target: ATXN1; (-) strand; PAM type: NNGRRT; PAM sequence: TGGAGT
atttggactgatttagagaa

SEQ ID NO: 15150 - DNA, 20 bp, Artificial Sequence
  Description of Artificial Sequence: Synthetic oligonucleotide
  Target: ATXN1; (-) strand; PAM type: NNGRRT; PAM sequence: GAGAAT
tgctcatttggactgattta

SEQ ID NO: 15151 - DNA, 20 bp, Artificial Sequence
  Description of Artificial Sequence: Synthetic oligonucleotide
  Target: ATXN1; (-) strand; PAM type: NNGRRT; PAM sequence: TGGAAT
aaggccaaagtgctaggggc

SEQ ID NO: 15152 - DNA, 20 bp, Artificial Sequence
  Description of Artificial Sequence: Synthetic oligonucleotide
  Target: ATXN1; (-) strand; PAM type: NNGRRT; PAM sequence: ATGAAT
gaccatacatctcatgataa

SEQ ID NO: 15153 - DNA, 20 bp, Artificial Sequence
  Description of Artificial Sequence: Synthetic oligonucleotide
  Target: ATXN1; (-) strand; PAM type: NNGRRT; PAM sequence: AGGAGT
tggaaggagcgcttgaggcc

SEQ ID NO: 15154 - DNA, 20 bp, Artificial Sequence
  Description of Artificial Sequence: Synthetic oligonucleotide
  Target: ATXN1; (-) strand; PAM type: NNGRRT; PAM sequence: CTGGGT
ctcaaaaaaataaaacacgg

SEQ ID NO: 15155 - DNA, 20 bp, Artificial Sequence
  Description of Artificial Sequence: Synthetic oligonucleotide
  Target: ATXN1; (-) strand; PAM type: NNGRRT; PAM sequence: CCGGGT
ggcacggatctatgacaaac

SEQ ID NO: 15156 - DNA, 20 bp, Artificial Sequence
  Description of Artificial Sequence: Synthetic oligonucleotide
  Target: ATXN1; (-) strand; PAM type: NNGRRT; PAM sequence: ACGGAT
tttccagctataaaatgggc

SEQ ID NO: 15157 - DNA, 20 bp, Artificial Sequence
  Description of Artificial Sequence: Synthetic oligonucleotide
  Target: ATXN1; (-) strand; PAM type: NNGRRT; PAM sequence: CAGGGT
tggctcagtcccctgggcct

SEQ ID NO: 15158 - DNA, 20 bp, Artificial Sequence
  Description of Artificial Sequence: Synthetic oligonucleotide
  Target: ATXN1; (-) strand; PAM type: NNGRRT; PAM sequence: CAGGGT
ggactttggagggaggatcc

SEQ ID NO: 15159 - DNA, 20 bp, Artificial Sequence
  Description of Artificial Sequence: Synthetic oligonucleotide
  Target: ATXN1; (-) strand; PAM type: NNGRRT; PAM sequence: GAGGAT
catgagagggactttggagg

SEQ ID NO: 15160 - DNA, 20 bp, Artificial Sequence
  Description of Artificial Sequence: Synthetic oligonucleotide
  Target: ATXN1; (-) strand; PAM type: NNGRRT; PAM sequence: CTGAAT
ggcatccccatccacggtca

SEQ ID NO: 15161 - DNA, 20 bp, Artificial Sequence
  Description of Artificial Sequence: Synthetic oligonucleotide
  Target: ATXN1; (-) strand; PAM type: NNGRRT; PAM sequence: AGGAGT
taaggcaggagtttgagtct

SEQ ID NO: 15162 - DNA, 20 bp, Artificial Sequence
  Description of Artificial Sequence: Synthetic oligonucleotide
  Target: ATXN1; (-) strand; PAM type: NNGRRT; PAM sequence: TTGAGT
ttggcggctaaggcaggagt

SEQ ID NO: 15163 - DNA, 20 bp, Artificial Sequence
  Description of Artificial Sequence: Synthetic oligonucleotide
  Target: ATXN1; (-) strand; PAM type: NNGRRT; PAM sequence: AGGAGT
agctacttggcggctaaggc

SEQ ID NO: 15164 - DNA, 20 bp, Artificial Sequence
  Description of Artificial Sequence: Synthetic oligonucleotide
  Target: ATXN1; (-) strand; PAM type: NNGRRT; PAM sequence: TGGGGT
gaaagagcaaagtgcaggaa

SEQ ID NO: 15165 - DNA, 20 bp, Artificial Sequence
  Description of Artificial Sequence: Synthetic oligonucleotide
  Target: ATXN1; (-) strand; PAM type: NNGRRT; PAM sequence: AGGAAT
tttgggaaagagcaaagtgc

SEQ ID NO: 15166 - DNA, 20 bp, Artificial Sequence
  Description of Artificial Sequence: Synthetic oligonucleotide
  Target: ATXN1; (-) strand; PAM type: NNGRRT; PAM sequence: GTGGGT
tcactgcagggagtgaagct

SEQ ID NO: 15167 - DNA, 20 bp, Artificial Sequence
  Description of Artificial Sequence: Synthetic oligonucleotide
  Target: ATXN1; (-) strand; PAM type: NNGRRT; PAM sequence: GGGAGT
attacatacagatcactgca

SEQ ID NO: 15168 - DNA, 20 bp, Artificial Sequence
  Description of Artificial Sequence: Synthetic oligonucleotide
  Target: ATXN1; (-) strand; PAM type: NNGRRT; PAM sequence: CGGGAT
cagacactgtggcttcctca

SEQ ID NO: 15169 - DNA, 20 bp, Artificial Sequence
  Description of Artificial Sequence: Synthetic oligonucleotide
  Target: ATXN1; (-) strand; PAM type: NNGRRT; PAM sequence: TTGGAT
ctctggagattattgttgag

SEQ ID NO: 15170 - DNA, 20 bp, Artificial Sequence
  Description of Artificial Sequence: Synthetic oligonucleotide
  Target: ATXN1; (-) strand; PAM type: NNGRRT; PAM sequence: TTGAGT
atagtctctggagattattg

SEQ ID NO: 15171 - DNA, 20 bp, Artificial Sequence
  Description of Artificial Sequence: Synthetic oligonucleotide
  Target: ATXN1; (-) strand; PAM type: NNGRRT; PAM sequence: TGGAAT
gcccacagaacatcaggagc

SEQ ID NO: 15172 - DNA, 20 bp, Artificial Sequence
  Description of Artificial Sequence: Synthetic oligonucleotide
  Target: ATXN1; (-) strand; PAM type: NNGRRT; PAM sequence: TGGAAT
agaatgaatcccaaagatgc

SEQ ID NO: 15173 - DNA, 20 bp, Artificial Sequence
  Description of Artificial Sequence: Synthetic oligonucleotide
  Target: ATXN1; (-) strand; PAM type: NNGRRT; PAM sequence: ATGAAT
ggccttccacagctcataga

SEQ ID NO: 15174 - DNA, 20 bp, Artificial Sequence
  Description of Artificial Sequence: Synthetic oligonucleotide
  Target: ATXN1; (-) strand; PAM type: NNGRRT; PAM sequence: TAGAAT
ctgtggccttccacagctca

SEQ ID NO: 15175 - DNA, 20 bp, Artificial Sequence
  Description of Artificial Sequence: Synthetic oligonucleotide
  Target: ATXN1; (-) strand; PAM type: NNGRRT; PAM sequence: GGGAAT
gattctgaggaactgagtct

SEQ ID NO: 15176 - DNA, 20 bp, Artificial Sequence
  Description of Artificial Sequence: Synthetic oligonucleotide
  Target: ATXN1; (-) strand; PAM type: NNGRRT; PAM sequence: CTGAGT
gcccttcagattctgaggaa

SEQ ID NO: 15177 - DNA, 20 bp, Artificial Sequence
  Description of Artificial Sequence: Synthetic oligonucleotide
  Target: ATXN1; (-) strand; PAM type: NNGRRT; PAM sequence: AGGAGT
ggctgctctgtgggacttgg

SEQ ID NO: 15178 - DNA, 20 bp, Artificial Sequence
  Description of Artificial Sequence: Synthetic oligonucleotide
  Target: ATXN1; (-) strand; PAM type: NNGRRT; PAM sequence: TAGGAT
ctttgcagccccacctagcc

SEQ ID NO: 15179 - DNA, 20 bp, Artificial Sequence
  Description of Artificial Sequence: Synthetic oligonucleotide
  Target: ATXN1; (-) strand; PAM type: NNGRRT; PAM sequence: GTGGAT
gaaaaggtcaatgcgtgtga

SEQ ID NO: 15180 - DNA, 20 bp, Artificial Sequence
  Description of Artificial Sequence: Synthetic oligonucleotide
  Target: ATXN1; (-) strand; PAM type: NNGRRT; PAM sequence: GTGAGT
ggatgaaaaggtcaatgcgt

SEQ ID NO: 15181 - DNA, 20 bp, Artificial Sequence
  Description of Artificial Sequence: Synthetic oligonucleotide
  Target: ATXN1; (-) strand; PAM type: NNGRRT; PAM sequence: TAGGAT
gtagacgtctcgtctgttgt

SEQ ID NO: 15182 - DNA, 20 bp, Artificial Sequence
  Description of Artificial Sequence: Synthetic oligonucleotide
  Target: ATXN1; (-) strand; PAM type: NNGRRT; PAM sequence: AAGAAT
aaatcagttttcgtggtctc

SEQ ID NO: 15183 - DNA, 20 bp, Artificial Sequence
  Description of Artificial Sequence: Synthetic oligonucleotide
  Target: ATXN1; (-) strand; PAM type: NNGRRT; PAM sequence: GAGAGT
acaaatgaggaaagggttca

SEQ ID NO: 15184 - DNA, 20 bp, Artificial Sequence
  Description of Artificial Sequence: Synthetic oligonucleotide
  Target: ATXN1; (-) strand; PAM type: NNGRRT; PAM sequence: AAGGGT
tgccattatacaaatgagga

SEQ ID NO: 15185 - DNA, 20 bp, Artificial Sequence
  Description of Artificial Sequence: Synthetic oligonucleotide
  Target: ATXN1; (-) strand; PAM type: NNGRRT; PAM sequence: AGGAGT
tcccaaagtgctgggattat

SEQ ID NO: 15186 - DNA, 20 bp, Artificial Sequence
  Description of Artificial Sequence: Synthetic oligonucleotide
  Target: ATXN1; (-) strand; PAM type: NNGRRT; PAM sequence: TGGGAT
ggcttggcctcccaaagtgc

SEQ ID NO: 15187 - DNA, 20 bp, Artificial Sequence
  Description of Artificial Sequence: Synthetic oligonucleotide
  Target: ATXN1; (-) strand; PAM type: NNGRRT; PAM sequence: TGGGGT
ttttgtatttttagtagaga

SEQ ID NO: 15188 - DNA, 20 bp, Artificial Sequence
  Description of Artificial Sequence: Synthetic oligonucleotide
  Target: ATXN1; (-) strand; PAM type: NNGRRT; PAM sequence: TGGGAT
gcctcagcttcccaaatagc

SEQ ID NO: 15189 - DNA, 20 bp, Artificial Sequence
  Description of Artificial Sequence: Synthetic oligonucleotide
  Target: ATXN1; (-) strand; PAM type: NNGRRT; PAM sequence: CCGAGT
ctcactgcaacttctgcctc

SEQ ID NO: 15190 - DNA, 20 bp, Artificial Sequence
  Description of Artificial Sequence: Synthetic oligonucleotide
  Target: ATXN1; (-) strand; PAM type: NNGRRT; PAM sequence: TGGAGT
tttgctcttgttgcccaggc

SEQ ID NO: 15191 - DNA, 20 bp, Artificial Sequence
  Description of Artificial Sequence: Synthetic oligonucleotide
  Target: ATXN1; (-) strand; PAM type: NNGRRT; PAM sequence: GGGAAT
ttgtgaggggtgaggaaaaa

SEQ ID NO: 15192 - DNA, 20 bp, Artificial Sequence
  Description of Artificial Sequence: Synthetic oligonucleotide
  Target: ATXN1; (-) strand; PAM type: NNGRRT; PAM sequence: AGGGGT
acttgtctcatttacttgtg

SEQ ID NO: 15193 - DNA, 20 bp, Artificial Sequence
  Description of Artificial Sequence: Synthetic oligonucleotide
  Target: ATXN1; (-) strand; PAM type: NNGRRT; PAM sequence: CTGGAT
tatacccagtcgtgggattt

SEQ ID NO: 15194 - DNA, 20 bp, Artificial Sequence
  Description of Artificial Sequence: Synthetic oligonucleotide
  Target: ATXN1; (-) strand; PAM type: NNGRRT; PAM sequence: TGGGAT
tttgagtatatacccagtcg

SEQ ID NO: 15195 - DNA, 20 bp, Artificial Sequence
  Description of Artificial Sequence: Synthetic oligonucleotide
  Target: ATXN1; (-) strand; PAM type: NNGRRT; PAM sequence: TTGAGT
atatactgatttcctttctt

SEQ ID NO: 15196 - DNA, 20 bp, Artificial Sequence
  Description of Artificial Sequence: Synthetic oligonucleotide
  Target: ATXN1; (-) strand; PAM type: NNGRRT; PAM sequence: CTGAAT
gatctcattcttttttatgg

SEQ ID NO: 15197 - DNA, 20 bp, Artificial Sequence
  Description of Artificial Sequence: Synthetic oligonucleotide
  Target: ATXN1; (-) strand; PAM type: NNGRRT; PAM sequence: CTGGAT
atccatgttgttgcaaatga

SEQ ID NO: 15198 - DNA, 20 bp, Artificial Sequence
  Description of Artificial Sequence: Synthetic oligonucleotide
  Target: ATXN1; (-) strand; PAM type: NNGRRT; PAM sequence: TTGAAT
gagttcagtaggtttgattt

SEQ ID NO: 15199 - DNA, 20 bp, Artificial Sequence
  Description of Artificial Sequence: Synthetic oligonucleotide
  Target: ATXN1; (-) strand; PAM type: NNGRRT; PAM sequence: ATGAGT
tcctcctactctctgtgtcc

SEQ ID NO: 15200 - DNA, 20 bp, Artificial Sequence
  Description of Artificial Sequence: Synthetic oligonucleotide
  Target: ATXN1; (-) strand; PAM type: NNGRRT; PAM sequence: TGGGGT
aataaacacatcatgaagaa

SEQ ID NO: 15201 - DNA, 20 bp, Artificial Sequence
  Description of Artificial Sequence: Synthetic oligonucleotide
  Target: ATXN1; (-) strand; PAM type: NNGRRT; PAM sequence: AAGAAT
tgtaaaataaacacatcatg

SEQ ID NO: 15202 - DNA, 20 bp, Artificial Sequence
  Description of Artificial Sequence: Synthetic oligonucleotide
  Target: ATXN1; (-) strand; PAM type: NNGRRT; PAM sequence: TGGGGT
tacataggtgtgtatatgta

SEQ ID NO: 15203 - DNA, 20 bp, Artificial Sequence
  Description of Artificial Sequence: Synthetic oligonucleotide
  Target: ATXN1; (-) strand; PAM type: NNGRRT; PAM sequence: GTGGGT
ttttaatttttaattttttt

SEQ ID NO: 15204 - DNA, 20 bp, Artificial Sequence
  Description of Artificial Sequence: Synthetic oligonucleotide
  Target: ATXN1; (-) strand; PAM type: NNGRRT; PAM sequence: TTGGGT
cttctgtggatttgtattac

SEQ ID NO: 15205 - DNA, 20 bp, Artificial Sequence
  Description of Artificial Sequence: Synthetic oligonucleotide
  Target: ATXN1; (-) strand; PAM type: NNGRRT; PAM sequence: GTGGAT
tgattattagtgggacttct

SEQ ID NO: 15206 - DNA, 20 bp, Artificial Sequence
  Description of Artificial Sequence: Synthetic oligonucleotide
  Target: ATXN1; (-) strand; PAM type: NNGRRT; PAM sequence: TGGGGT
cttgggcataggagagagtc

SEQ ID NO: 15207 - DNA, 20 bp, Artificial Sequence
  Description of Artificial Sequence: Synthetic oligonucleotide
  Target: ATXN1; (-) strand; PAM type: NNGRRT; PAM sequence: GAGAGT
ctgtatacttgggcatagga

SEQ ID NO: 15208 - DNA, 20 bp, Artificial Sequence
  Description of Artificial Sequence: Synthetic oligonucleotide
  Target: ATXN1; (-) strand; PAM type: NNGRRT; PAM sequence: ATGAAT
aaatgagacagcaaaatact

SEQ ID NO: 15209 - DNA, 20 bp, Artificial Sequence
  Description of Artificial Sequence: Synthetic oligonucleotide
  Target: ATXN1; (-) strand; PAM type: NNGRRT; PAM sequence: CTGAAT
ccaccgcgtccggccaccta

SEQ ID NO: 15210 - DNA, 20 bp, Artificial Sequence
  Description of Artificial Sequence: Synthetic oligonucleotide
  Target: ATXN1; (-) strand; PAM type: NNGRRT; PAM sequence: TGGGAT
gccttggcctcccaaagtgc

SEQ ID NO: 15211 - DNA, 20 bp, Artificial Sequence
  Description of Artificial Sequence: Synthetic oligonucleotide
  Target: ATXN1; (-) strand; PAM type: NNGRRT; PAM sequence: CAGGGT
ttttgtatttttagtagaga

SEQ ID NO: 15212 - DNA, 20 bp, Artificial Sequence
  Description of Artificial Sequence: Synthetic oligonucleotide
  Target: ATXN1; (-) strand; PAM type: NNGRRT; PAM sequence: TGGGAT
gcctcagcctcccgagtagc

SEQ ID NO: 15213 - DNA, 20 bp, Artificial Sequence
  Description of Artificial Sequence: Synthetic oligonucleotide
  Target: ATXN1; (-) strand; PAM type: NNGRRT; PAM sequence: CCGAGT
gatcctcctgcctcagcctc

SEQ ID NO: 15214 - DNA, 20 bp, Artificial Sequence
  Description of Artificial Sequence: Synthetic oligonucleotide
  Target: ATXN1; (-) strand; PAM type: NNGRRT; PAM sequence: CCGGGT
ctcactgcagcttccacctc

SEQ ID NO: 15215 - DNA, 20 bp, Artificial Sequence
  Description of Artificial Sequence: Synthetic oligonucleotide
  Target: ATXN1; (-) strand; PAM type: NNGRRT; PAM sequence: TGGAGT
tttgctcttgttgcccaggc

SEQ ID NO: 15216 - DNA, 20 bp, Artificial Sequence
  Description of Artificial Sequence: Synthetic oligonucleotide
  Target: ATXN1; (-) strand; PAM type: NNGRRT; PAM sequence: CTGAAT
ttcgatatgttgaacaccca

SEQ ID NO: 15217 - DNA, 20 bp, Artificial Sequence
  Description of Artificial Sequence: Synthetic oligonucleotide
  Target: ATXN1; (-) strand; PAM type: NNGRRT; PAM sequence: TTGAGT
attatcccgagtctttaaaa

SEQ ID NO: 15218 - DNA, 20 bp, Artificial Sequence
  Description of Artificial Sequence: Synthetic oligonucleotide
  Target: ATXN1; (-) strand; PAM type: NNGRRT; PAM sequence: CCGAGT
atccctattcacccattatc

SEQ ID NO: 15219 - DNA, 20 bp, Artificial Sequence
  Description of Artificial Sequence: Synthetic oligonucleotide
  Target: ATXN1; (-) strand; PAM type: NNGRRT; PAM sequence: TAGGAT
tcaaatagtgatttaatttc

SEQ ID NO: 15220 - DNA, 20 bp, Artificial Sequence
  Description of Artificial Sequence: Synthetic oligonucleotide
  Target: ATXN1; (-) strand; PAM type: NNGRRT; PAM sequence: ATGAAT
attagaaatattaacactga

SEQ ID NO: 15221 - DNA, 20 bp, Artificial Sequence
  Description of Artificial Sequence: Synthetic oligonucleotide
  Target: ATXN1; (-) strand; PAM type: NNGRRT; PAM sequence: CTGAAT
ttagattagaaatattaaca

SEQ ID NO: 15222 - DNA, 20 bp, Artificial Sequence
  Description of Artificial Sequence: Synthetic oligonucleotide
  Target: ATXN1; (-) strand; PAM type: NNGRRT; PAM sequence: AAGGAT
tggcacccttaattgagggc

SEQ ID NO: 15223 - DNA, 20 bp, Artificial Sequence
  Description of Artificial Sequence: Synthetic oligonucleotide
  Target: ATXN1; (-) strand; PAM type: NNGRRT; PAM sequence: TGGAAT
cctcaaaagtgagattttcc

SEQ ID NO: 15224 - DNA, 20 bp, Artificial Sequence
  Description of Artificial Sequence: Synthetic oligonucleotide
  Target: ATXN1; (-) strand; PAM type: NNGRRT; PAM sequence: GGGGAT
ccacacactctgcccattgc

SEQ ID NO: 15225 - DNA, 20 bp, Artificial Sequence
  Description of Artificial Sequence: Synthetic oligonucleotide
  Target: ATXN1; (-) strand; PAM type: NNGRRT; PAM sequence: TTGGAT
gcctgattcatggagcagtg

SEQ ID NO: 15226 - DNA, 20 bp, Artificial Sequence
  Description of Artificial Sequence: Synthetic oligonucleotide
  Target: ATXN1; (-) strand; PAM type: NNGRRT; PAM sequence: TGGGAT
atctccgcctttgatctcgc

SEQ ID NO: 15227 - DNA, 20 bp, Artificial Sequence
  Description of Artificial Sequence: Synthetic oligonucleotide
  Target: ATXN1; (-) strand; PAM type: NNGRRT; PAM sequence: AGGGAT
aaaattgcatcggctggacc

SEQ ID NO: 15228 - DNA, 20 bp, Artificial Sequence
  Description of Artificial Sequence: Synthetic oligonucleotide
  Target: ATXN1; (-) strand; PAM type: NNGRRT; PAM sequence: GTGAAT
tgatattgcaaatgcctaga

SEQ ID NO: 15229 - DNA, 20 bp, Artificial Sequence
  Description of Artificial Sequence: Synthetic oligonucleotide
  Target: ATXN1; (-) strand; PAM type: NNGRRT; PAM sequence: TAGAGT
tccatgatattgcaaatgcc

SEQ ID NO: 15230 - DNA, 20 bp, Artificial Sequence
  Description of Artificial Sequence: Synthetic oligonucleotide
  Target: ATXN1; (-) strand; PAM type: NNGRRT; PAM sequence: CTGAAT
tggaaacatctcaccaggtc

SEQ ID NO: 15231 - DNA, 20 bp, Artificial Sequence
  Description of Artificial Sequence: Synthetic oligonucleotide
  Target: ATXN1; (-) strand; PAM type: NNGRRT; PAM sequence: GAGAGT
tgtaaaagcggtgaccacga

SEQ ID NO: 15232 - DNA, 20 bp, Artificial Sequence
  Description of Artificial Sequence: Synthetic oligonucleotide
  Target: ATXN1; (-) strand; PAM type: NNGRRT; PAM sequence: TGGGAT
gccttggcctccgaaagtgc

SEQ ID NO: 15233 - DNA, 20 bp, Artificial Sequence
  Description of Artificial Sequence: Synthetic oligonucleotide
  Target: ATXN1; (-) strand; PAM type: NNGRRT; PAM sequence: CGGGGT
ttttgtatttttagtagaga

SEQ ID NO: 15234 - DNA, 20 bp, Artificial Sequence
  Description of Artificial Sequence: Synthetic oligonucleotide
  Target: ATXN1; (-) strand; PAM type: NNGRRT; PAM sequence: TGGGAT
gcctcagcctcccgagtagc

SEQ ID NO: 15235 - DNA, 20 bp, Artificial Sequence
  Description of Artificial Sequence: Synthetic oligonucleotide
  Target: ATXN1; (-) strand; PAM type: NNGRRT; PAM sequence: CCGAGT
gattctgctgcctcagcctc

SEQ ID NO: 15236 - DNA, 20 bp, Artificial Sequence
  Description of Artificial Sequence: Synthetic oligonucleotide
  Target: ATXN1; (-) strand; PAM type: NNGRRT; PAM sequence: CCGGGT
ctatctgcaacctccacctc

SEQ ID NO: 15237 - DNA, 20 bp, Artificial Sequence
  Description of Artificial Sequence: Synthetic oligonucleotide
  Target: ATXN1; (-) strand; PAM type: NNGRRT; PAM sequence: TGGAGT
tctcactctgttgcccaggt

SEQ ID NO: 15238 - DNA, 20 bp, Artificial Sequence
  Description of Artificial Sequence: Synthetic oligonucleotide
  Target: ATXN1; (-) strand; PAM type: NNGRRT; PAM sequence: GGGAGT
ttttttttttttttttgaga

SEQ ID NO: 15239 - DNA, 20 bp, Artificial Sequence
  Description of Artificial Sequence: Synthetic oligonucleotide
  Target: ATXN1; (-) strand; PAM type: NNGRRT; PAM sequence: GAGGAT
ccctcccatgtataccttca

SEQ ID NO: 15240 - DNA, 20 bp, Artificial Sequence
  Description of Artificial Sequence: Synthetic oligonucleotide
  Target: ATXN1; (-) strand; PAM type: NNGRRT; PAM sequence: TGGAAT
catggttttatggctagatc

SEQ ID NO: 15241 - DNA, 20 bp, Artificial Sequence
  Description of Artificial Sequence: Synthetic oligonucleotide
  Target: ATXN1; (-) strand; PAM type: NNGRRT; PAM sequence: TTGGAT
ccagagacacacaattggat

SEQ ID NO: 15242 - DNA, 20 bp, Artificial Sequence
  Description of Artificial Sequence: Synthetic oligonucleotide
  Target: ATXN1; (-) strand; PAM type: NNGRRT; PAM sequence: TTGGAT
tgtttaccagagacacacaa

SEQ ID NO: 15243 - DNA, 20 bp, Artificial Sequence
  Description of Artificial Sequence: Synthetic oligonucleotide
  Target: ATXN1; (-) strand; PAM type: NNGRRT; PAM sequence: CAGGAT
taaggaatttaatacttact

SEQ ID NO: 15244 - DNA, 20 bp, Artificial Sequence
  Description of Artificial Sequence: Synthetic oligonucleotide
  Target: ATXN1; (-) strand; PAM type: NNGRRT; PAM sequence: AGGAAT
aatggttgtggcaaatatta

SEQ ID NO: 15245 - DNA, 20 bp, Artificial Sequence
  Description of Artificial Sequence: Synthetic oligonucleotide
  Target: ATXN1; (-) strand; PAM type: NNGRRT; PAM sequence: CAGGAT
ctattttacagagattttgt

SEQ ID NO: 15246 - DNA, 20 bp, Artificial Sequence
  Description of Artificial Sequence: Synthetic oligonucleotide
  Target: ATXN1; (-) strand; PAM type: NNGRRT; PAM sequence: CAGAAT
agtgcttattttttgtttgt

SEQ ID NO: 15247 - DNA, 20 bp, Artificial Sequence
  Description of Artificial Sequence: Synthetic oligonucleotide
  Target: ATXN1; (-) strand; PAM type: NNGRRT; PAM sequence: TGGGGT
ttctgtatttttagtagaga

SEQ ID NO: 15248 - DNA, 20 bp, Artificial Sequence
  Description of Artificial Sequence: Synthetic oligonucleotide
  Target: ATXN1; (-) strand; PAM type: NNGRRT; PAM sequence: TGGGAT
gcctcagcctcccaagtagc

SEQ ID NO: 15249 - DNA, 20 bp, Artificial Sequence
  Description of Artificial Sequence: Synthetic oligonucleotide
  Target: ATXN1; (-) strand; PAM type: NNGRRT; PAM sequence: TGGAGT
tcttgatgtgttgtccaggc

SEQ ID NO: 15250 - DNA, 20 bp, Artificial Sequence
  Description of Artificial Sequence: Synthetic oligonucleotide
  Target: ATXN1; (-) strand; PAM type: NNGRRT; PAM sequence: CAGAGT
aaagatttttttttttttga

SEQ ID NO: 15251 - DNA, 20 bp, Artificial Sequence
  Description of Artificial Sequence: Synthetic oligonucleotide
  Target: ATXN1; (-) strand; PAM type: NNGRRT; PAM sequence: ATGGGT
acaactttccactgaatgtc

SEQ ID NO: 15252 - DNA, 20 bp, Artificial Sequence
  Description of Artificial Sequence: Synthetic oligonucleotide
  Target: ATXN1; (-) strand; PAM type: NNGRRT; PAM sequence: CTGAAT
cactaatacacaactttcca

SEQ ID NO: 15253 - DNA, 20 bp, Artificial Sequence
  Description of Artificial Sequence: Synthetic oligonucleotide
  Target: ATXN1; (-) strand; PAM type: NNGRRT; PAM sequence: CAGAAT
gcatgcttgtggctcataat

SEQ ID NO: 15254 - DNA, 20 bp, Artificial Sequence
  Description of Artificial Sequence: Synthetic oligonucleotide
  Target: ATXN1; (-) strand; PAM type: NNGRRT; PAM sequence: GCGGGT
attgcgcttaggtcagatga

SEQ ID NO: 15255 - DNA, 20 bp, Artificial Sequence
  Description of Artificial Sequence: Synthetic oligonucleotide
  Target: ATXN1; (-) strand; PAM type: NNGRRT; PAM sequence: TTGGGT
ttcctgcacattctttgtgt

SEQ ID NO: 15256 - DNA, 20 bp, Artificial Sequence
  Description of Artificial Sequence: Synthetic oligonucleotide
  Target: ATXN1; (-) strand; PAM type: NNGRRT; PAM sequence: TTGGAT
gaggtaataaatgaaaaaag

SEQ ID NO: 15257 - DNA, 20 bp, Artificial Sequence
  Description of Artificial Sequence: Synthetic oligonucleotide
  Target: ATXN1; (-) strand; PAM type: NNGRRT; PAM sequence: GTGGAT
aatttaaattgtgttagact

SEQ ID NO: 15258 - DNA, 20 bp, Artificial Sequence
  Description of Artificial Sequence: Synthetic oligonucleotide
  Target: ATXN1; (-) strand; PAM type: NNGRRT; PAM sequence: GGGAAT
atcatgccatagtaagttta

SEQ ID NO: 15259 - DNA, 20 bp, Artificial Sequence
  Description of Artificial Sequence: Synthetic oligonucleotide
  Target: ATXN1; (-) strand; PAM type: NNGRRT; PAM sequence: TGGAGT
agtacgacaaaaatttacca

SEQ ID NO: 15260 - DNA, 20 bp, Artificial Sequence
  Description of Artificial Sequence: Synthetic oligonucleotide
  Target: ATXN1; (-) strand; PAM type: NNGRRT; PAM sequence: ATGAGT
gtcacaatttagtggagaag

SEQ ID NO: 15261 - DNA, 20 bp, Artificial Sequence
  Description of Artificial Sequence: Synthetic oligonucleotide
  Target: ATXN1; (-) strand; PAM type: NNGRRT; PAM sequence: CTGGGT
taaaatccaggctatcagag

SEQ ID NO: 15262 - DNA, 20 bp, Artificial Sequence
  Description of Artificial Sequence: Synthetic oligonucleotide
  Target: ATXN1; (-) strand; PAM type: NNGRRT; PAM sequence: TTGAAT
ttcattcatttctgcatatt

SEQ ID NO: 15263 - DNA, 20 bp, Artificial Sequence
  Description of Artificial Sequence: Synthetic oligonucleotide
  Target: ATXN1; (-) strand; PAM type: NNGRRT; PAM sequence: GAGGAT
ccttttatttatgattctct

SEQ ID NO: 15264 - DNA, 20 bp, Artificial Sequence
  Description of Artificial Sequence: Synthetic oligonucleotide
  Target: ATXN1; (-) strand; PAM type: NNGRRT; PAM sequence: TGGAAT
tttcaattttagacaaattt

SEQ ID NO: 15265 - DNA, 20 bp, Artificial Sequence
  Description of Artificial Sequence: Synthetic oligonucleotide
  Target: ATXN1; (-) strand; PAM type: NNGRRT; PAM sequence: AGGAGT
ttttcttcagccaatatcag

SEQ ID NO: 15266 - DNA, 20 bp, Artificial Sequence
  Description of Artificial Sequence: Synthetic oligonucleotide
  Target: ATXN1; (-) strand; PAM type: NNGRRT; PAM sequence: AAGAGT
gttgaaaatagagctttggt

SEQ ID NO: 15267 - DNA, 20 bp, Artificial Sequence
  Description of Artificial Sequence: Synthetic oligonucleotide
  Target: ATXN1; (-) strand; PAM type: NNGRRT; PAM sequence: CTGGAT
tagcaatcagtatttctctt

SEQ ID NO: 15268 - DNA, 20 bp, Artificial Sequence
  Description of Artificial Sequence: Synthetic oligonucleotide
  Target: ATXN1; (-) strand; PAM type: NNGRRT; PAM sequence: TTGAGT
cgtactgcttcactaacttt

SEQ ID NO: 15269 - DNA, 20 bp, Artificial Sequence
  Description of Artificial Sequence: Synthetic oligonucleotide
  Target: ATXN1; (-) strand; PAM type: NNGRRT; PAM sequence: TGGAAT
atgaacccttaacccttcca

SEQ ID NO: 15270 - DNA, 20 bp, Artificial Sequence
  Description of Artificial Sequence: Synthetic oligonucleotide
  Target: ATXN1; (-) strand; PAM type: NNGRRT; PAM sequence: ATGAAT
aaataagattccgacaatgg

SEQ ID NO: 15271 - DNA, 20 bp, Artificial Sequence
  Description of Artificial Sequence: Synthetic oligonucleotide
  Target: ATXN1; (-) strand; PAM type: NNGRRT; PAM sequence: ATGGAT
gtccaaataagattccgaca

SEQ ID NO: 15272 - DNA, 20 bp, Artificial Sequence
  Description of Artificial Sequence: Synthetic oligonucleotide
  Target: ATXN1; (-) strand; PAM type: NNGRRT; PAM sequence: TGGGGT
tgttctcttaagtaaaacga

SEQ ID NO: 15273 - DNA, 20 bp, Artificial Sequence
  Description of Artificial Sequence: Synthetic oligonucleotide
  Target: ATXN1; (-) strand; PAM type: NNGRRT; PAM sequence: GGGGGT
tataggtaaacttgtgtcat

SEQ ID NO: 15274 - DNA, 20 bp, Artificial Sequence
  Description of Artificial Sequence: Synthetic oligonucleotide
  Target: ATXN1; (-) strand; PAM type: NNGRRT; PAM sequence: GTGGAT
aacctgattgacttctatgt

SEQ ID NO: 15275 - DNA, 20 bp, Artificial Sequence
  Description of Artificial Sequence: Synthetic oligonucleotide
  Target: ATXN1; (-) strand; PAM type: NNGRRT; PAM sequence: AAGAGT
atggtatgttttggcagttg

SEQ ID NO: 15276 - DNA, 20 bp, Artificial Sequence
  Description of Artificial Sequence: Synthetic oligonucleotide
  Target: ATXN1; (-) strand; PAM type: NNGRRT; PAM sequence: AAGAGT
gtgtatggacactgtctttg

SEQ ID NO: 15277 - DNA, 20 bp, Artificial Sequence
  Description of Artificial Sequence: Synthetic oligonucleotide
  Target: ATXN1; (-) strand; PAM type: NNGRRT; PAM sequence: GTGGAT
tttgggaattttgagatact

SEQ ID NO: 15278 - DNA, 20 bp, Artificial Sequence
  Description of Artificial Sequence: Synthetic oligonucleotide
  Target: ATXN1; (-) strand; PAM type: NNGRRT; PAM sequence: GGGAAT
aaggcagtgattgccaattt

SEQ ID NO: 15279 - DNA, 20 bp, Artificial Sequence
  Description of Artificial Sequence: Synthetic oligonucleotide
  Target: ATXN1; (-) strand; PAM type: NNGRRT; PAM sequence: AGGAGT
tgatctttagctgtggtgag

SEQ ID NO: 15280 - DNA, 20 bp, Artificial Sequence
  Description of Artificial Sequence: Synthetic oligonucleotide
  Target: ATXN1; (-) strand; PAM type: NNGRRT; PAM sequence: CTGAAT
actttttaaagtcacagaat

SEQ ID NO: 15281 - DNA, 20 bp, Artificial Sequence
  Description of Artificial Sequence: Synthetic oligonucleotide
  Target: ATXN1; (-) strand; PAM type: NNGRRT; PAM sequence: CAGAAT
ggttgcactttttaaagtca

SEQ ID NO: 15282 - DNA, 20 bp, Artificial Sequence
  Description of Artificial Sequence: Synthetic oligonucleotide
  Target: ATXN1; (-) strand; PAM type: NNGRRT; PAM sequence: CTGGGT
tgtgagccactgcgtcctgc

SEQ ID NO: 15283 - DNA, 20 bp, Artificial Sequence
  Description of Artificial Sequence: Synthetic oligonucleotide
  Target: ATXN1; (-) strand; PAM type: NNGRRT; PAM sequence: TAGGAT
gcctcggcctcccaaagtgt

SEQ ID NO: 15284 - DNA, 20 bp, Artificial Sequence
  Description of Artificial Sequence: Synthetic oligonucleotide
  Target: ATXN1; (-) strand; PAM type: NNGRRT; PAM sequence: CAGGGT
ttttgtatatttagtagaga

SEQ ID NO: 15285 - DNA, 20 bp, Artificial Sequence
  Description of Artificial Sequence: Synthetic oligonucleotide
  Target: ATXN1; (-) strand; PAM type: NNGRRT; PAM sequence: CTGAGT
aattctcctgcctcagcctc

SEQ ID NO: 15286 - DNA, 20 bp, Artificial Sequence
  Description of Artificial Sequence: Synthetic oligonucleotide
  Target: ATXN1; (-) strand; PAM type: NNGRRT; PAM sequence: TGGAGT
ttcgctcttgtttcccaggc

SEQ ID NO: 15287 - DNA, 20 bp, Artificial Sequence
  Description of Artificial Sequence: Synthetic oligonucleotide
  Target: ATXN1; (-) strand; PAM type: NNGRRT; PAM sequence: ATGGGT
gtgaccaaaaggtttctaac

SEQ ID NO: 15288 - DNA, 20 bp, Artificial Sequence
  Description of Artificial Sequence: Synthetic oligonucleotide
  Target: ATXN1; (-) strand; PAM type: NNGRRT; PAM sequence: CTGAAT
ttactgcttttaagtattta

SEQ ID NO: 15289 - DNA, 20 bp, Artificial Sequence
  Description of Artificial Sequence: Synthetic oligonucleotide
  Target: ATXN1; (-) strand; PAM type: NNGRRT; PAM sequence: CTGAAT
attactgttttaagtattta

SEQ ID NO: 15290 - DNA, 20 bp, Artificial Sequence
  Description of Artificial Sequence: Synthetic oligonucleotide
  Target: ATXN1; (-) strand; PAM type: NNGRRT; PAM sequence: TTGAGT
ttttgcacgacaatgacaga

SEQ ID NO: 15291 - DNA, 20 bp, Artificial Sequence
  Description of Artificial Sequence: Synthetic oligonucleotide
  Target: ATXN1; (-) strand; PAM type: NNGRRT; PAM sequence: ATGAGT
acaccgacatgcctgtttgt

SEQ ID NO: 15292 - DNA, 20 bp, Artificial Sequence
  Description of Artificial Sequence: Synthetic oligonucleotide
  Target: ATXN1; (-) strand; PAM type: NNGRRT; PAM sequence: GAGAGT
tagaggaaaggaaggaagtt

SEQ ID NO: 15293 - DNA, 20 bp, Artificial Sequence
  Description of Artificial Sequence: Synthetic oligonucleotide
  Target: ATXN1; (-) strand; PAM type: NNGRRT; PAM sequence: CAGAAT
aggttcagtggtggatgctg

SEQ ID NO: 15294 - DNA, 20 bp, Artificial Sequence
  Description of Artificial Sequence: Synthetic oligonucleotide
  Target: ATXN1; (-) strand; PAM type: NNGRRT; PAM sequence: GTGGAT
atcatggacgaggttcagtg

SEQ ID NO: 15295 - DNA, 20 bp, Artificial Sequence
  Description of Artificial Sequence: Synthetic oligonucleotide
  Target: ATXN1; (-) strand; PAM type: NNGRRT; PAM sequence: TGGAAT
taccactggaaaactgcacc

SEQ ID NO: 15296 - DNA, 20 bp, Artificial Sequence
  Description of Artificial Sequence: Synthetic oligonucleotide
  Target: ATXN1; (-) strand; PAM type: NNGRRT; PAM sequence: ATGAAT
tgcacatatgtaatgcagag

SEQ ID NO: 15297 - DNA, 20 bp, Artificial Sequence
  Description of Artificial Sequence: Synthetic oligonucleotide
  Target: ATXN1; (-) strand; PAM type: NNGRRT; PAM sequence: TGGGGT
gaggctatttagcatttatc

SEQ ID NO: 15298 - DNA, 20 bp, Artificial Sequence
  Description of Artificial Sequence: Synthetic oligonucleotide
  Target: ATXN1; (-) strand; PAM type: NNGRRT; PAM sequence: AAGAGT
tttgttttttgttgttgctc

SEQ ID NO: 15299 - DNA, 20 bp, Artificial Sequence
  Description of Artificial Sequence: Synthetic oligonucleotide
  Target: ATXN1; (-) strand; PAM type: NNGRRT; PAM sequence: TTGAGT
tttcctaatgattagtgatg

SEQ ID NO: 15300 - DNA, 20 bp, Artificial Sequence
  Description of Artificial Sequence: Synthetic oligonucleotide
  Target: ATXN1; (-) strand; PAM type: NNGRRT; PAM sequence: GTGAGT
ttaatcagagccatcttaat

SEQ ID NO: 15301 - DNA, 20 bp, Artificial Sequence
  Description of Artificial Sequence: Synthetic oligonucleotide
  Target: ATXN1; (-) strand; PAM type: NNGRRT; PAM sequence: GGGGGT
atttgttattttcttgtttt

SEQ ID NO: 15302 - DNA, 20 bp, Artificial Sequence
  Description of Artificial Sequence: Synthetic oligonucleotide
  Target: ATXN1; (-) strand; PAM type: NNGRRT; PAM sequence: CAGAGT
atttctatcagtaatgtaca

SEQ ID NO: 15303 - DNA, 20 bp, Artificial Sequence
  Description of Artificial Sequence: Synthetic oligonucleotide
  Target: ATXN1; (-) strand; PAM type: NNGRRT; PAM sequence: GTGAAT
tatacctagaagtggaattg

SEQ ID NO: 15304 - DNA, 20 bp, Artificial Sequence
  Description of Artificial Sequence: Synthetic oligonucleotide
  Target: ATXN1; (-) strand; PAM type: NNGRRT; PAM sequence: TGGAAT
tttgggtatatacctagaag

SEQ ID NO: 15305 - DNA, 20 bp, Artificial Sequence
  Description of Artificial Sequence: Synthetic oligonucleotide
  Target: ATXN1; (-) strand; PAM type: NNGRRT; PAM sequence: TTGGGT
agtgcctcctttcagttttt

SEQ ID NO: 15306 - DNA, 20 bp, Artificial Sequence
  Description of Artificial Sequence: Synthetic oligonucleotide
  Target: ATXN1; (-) strand; PAM type: NNGRRT; PAM sequence: GTGAAT
tgcttccactttaggttatt

SEQ ID NO: 15307 - DNA, 20 bp, Artificial Sequence
  Description of Artificial Sequence: Synthetic oligonucleotide
  Target: ATXN1; (-) strand; PAM type: NNGRRT; PAM sequence: CTGAAT
aatctccttcctctttaggg

SEQ ID NO: 15308 - DNA, 20 bp, Artificial Sequence
  Description of Artificial Sequence: Synthetic oligonucleotide
  Target: ATXN1; (-) strand; PAM type: NNGRRT; PAM sequence: CAGAAT
atccatgttgtagcatgtgt

SEQ ID NO: 15309 - DNA, 20 bp, Artificial Sequence
  Description of Artificial Sequence: Synthetic oligonucleotide
  Target: ATXN1; (-) strand; PAM type: NNGRRT; PAM sequence: AGGGGT
ttataaggtcaagtgatcac

SEQ ID NO: 15310 - DNA, 20 bp, Artificial Sequence
  Description of Artificial Sequence: Synthetic oligonucleotide
  Target: ATXN1; (-) strand; PAM type: NNGRRT; PAM sequence: TGGGAT
aactctcatttgaaacttct

SEQ ID NO: 15311 - DNA, 20 bp, Artificial Sequence
  Description of Artificial Sequence: Synthetic oligonucleotide
  Target: ATXN1; (-) strand; PAM type: NNGRRT; PAM sequence: CTGAAT
atctcatgtgagagctcact

SEQ ID NO: 15312 - DNA, 20 bp, Artificial Sequence
  Description of Artificial Sequence: Synthetic oligonucleotide
  Target: ATXN1; (-) strand; PAM type: NNGRRT; PAM sequence: AAGGAT
tgaggttgtaaaactcagaa

SEQ ID NO: 15313 - DNA, 20 bp, Artificial Sequence
  Description of Artificial Sequence: Synthetic oligonucleotide
  Target: ATXN1; (-) strand; PAM type: NNGRRT; PAM sequence: TTGGGT
actcctgatccactgccaaa

SEQ ID NO: 15314 - DNA, 20 bp, Artificial Sequence
  Description of Artificial Sequence: Synthetic oligonucleotide
  Target: ATXN1; (-) strand; PAM type: NNGRRT; PAM sequence: AGGGAT
gttggctttgccttaattac

SEQ ID NO: 15315 - DNA, 20 bp, Artificial Sequence
  Description of Artificial Sequence: Synthetic oligonucleotide
  Target: ATXN1; (-) strand; PAM type: NNGRRT; PAM sequence: GTGAGT
cttactcataactggagatt

SEQ ID NO: 15316 - DNA, 20 bp, Artificial Sequence
  Description of Artificial Sequence: Synthetic oligonucleotide
  Target: ATXN1; (-) strand; PAM type: NNGRRT; PAM sequence: GAGAAT
cagttatatgcgtgacgaag

SEQ ID NO: 15317 - DNA, 20 bp, Artificial Sequence
  Description of Artificial Sequence: Synthetic oligonucleotide
  Target: ATXN1; (-) strand; PAM type: NNGRRT; PAM sequence: ACGAGT
cagagcagcttacatttcaa

SEQ ID NO: 15318 - DNA, 20 bp, Artificial Sequence
  Description of Artificial Sequence: Synthetic oligonucleotide
  Target: ATXN1; (-) strand; PAM type: NNGRRT; PAM sequence: CCGAAT
atatggtgttaagtgttatg

SEQ ID NO: 15319 - DNA, 20 bp, Artificial Sequence
  Description of Artificial Sequence: Synthetic oligonucleotide
  Target: ATXN1; (-) strand; PAM type: NNGRRT; PAM sequence: GGGAAT
gatgatacctgagtaatcca

SEQ ID NO: 15320 - DNA, 20 bp, Artificial Sequence
  Description of Artificial Sequence: Synthetic oligonucleotide
  Target: ATXN1; (-) strand; PAM type: NNGRRT; PAM sequence: CTGAGT
gacttttgcaaggatgatac

SEQ ID NO: 15321 - DNA, 20 bp, Artificial Sequence
  Description of Artificial Sequence: Synthetic oligonucleotide
  Target: ATXN1; (-) strand; PAM type: NNGRRT; PAM sequence: AAGGAT
tgtatcagtttgacttttgc

SEQ ID NO: 15322 - DNA, 20 bp, Artificial Sequence
  Description of Artificial Sequence: Synthetic oligonucleotide
  Target: ATXN1; (-) strand; PAM type: NNGRRT; PAM sequence: AAGAAT
ggtatcttctgattcttacc

SEQ ID NO: 15323 - DNA, 20 bp, Artificial Sequence
  Description of Artificial Sequence: Synthetic oligonucleotide
  Target: ATXN1; (-) strand; PAM type: NNGRRT; PAM sequence: TAGGAT
gtgtcatatatatgtggtca

SEQ ID NO: 15324 - DNA, 20 bp, Artificial Sequence
  Description of Artificial Sequence: Synthetic oligonucleotide
  Target: ATXN1; (-) strand; PAM type: NNGRRT; PAM sequence: CTGAGT
ctaatggccattctcaataa

SEQ ID NO: 15325 - DNA, 20 bp, Artificial Sequence
  Description of Artificial Sequence: Synthetic oligonucleotide
  Target: ATXN1; (-) strand; PAM type: NNGRRT; PAM sequence: CTGGGT
tcagaaaattttttggttaa

SEQ ID NO: 15326 - DNA, 20 bp, Artificial Sequence
  Description of Artificial Sequence: Synthetic oligonucleotide
  Target: ATXN1; (-) strand; PAM type: NNGRRT; PAM sequence: TTGAAT
acacatttttatttggtgct

SEQ ID NO: 15327 - DNA, 20 bp, Artificial Sequence
  Description of Artificial Sequence: Synthetic oligonucleotide
  Target: ATXN1; (-) strand; PAM type: NNGRRT; PAM sequence: CTGAAT
atctagtatgtacccttacc

SEQ ID NO: 15328 - DNA, 20 bp, Artificial Sequence
  Description of Artificial Sequence: Synthetic oligonucleotide
  Target: ATXN1; (-) strand; PAM type: NNGRRT; PAM sequence: AGGGGT
gtctgcaaatgctacacatc

SEQ ID NO: 15329 - DNA, 20 bp, Artificial Sequence
  Description of Artificial Sequence: Synthetic oligonucleotide
  Target: ATXN1; (-) strand; PAM type: NNGRRT; PAM sequence: GGGAGT
accttgaaattggccatggt

SEQ ID NO: 15330 - DNA, 20 bp, Artificial Sequence
  Description of Artificial Sequence: Synthetic oligonucleotide
  Target: ATXN1; (-) strand; PAM type: NNGRRT; PAM sequence: TGGGAT
gtagggtttactgatcttgg

SEQ ID NO: 15331 - DNA, 20 bp, Artificial Sequence
  Description of Artificial Sequence: Synthetic oligonucleotide
  Target: ATXN1; (-) strand; PAM type: NNGRRT; PAM sequence: TAGGGT
ggtttattttaggtaggaag

SEQ ID NO: 15332 - DNA, 20 bp, Artificial Sequence
  Description of Artificial Sequence: Synthetic oligonucleotide
  Target: ATXN1; (-) strand; PAM type: NNGRRT; PAM sequence: TTGGGT
ataatgaaggactttgcttc

SEQ ID NO: 15333 - DNA, 20 bp, Artificial Sequence
  Description of Artificial Sequence: Synthetic oligonucleotide
  Target: ATXN1; (-) strand; PAM type: NNGRRT; PAM sequence: ATGGAT
agatagtctcttaaatatct

SEQ ID NO: 15334 - DNA, 20 bp, Artificial Sequence
  Description of Artificial Sequence: Synthetic oligonucleotide
  Target: ATXN1; (-) strand; PAM type: NNGRRT; PAM sequence: CAGAAT
agagaagtgctgtagaaaat

SEQ ID NO: 15335 - DNA, 20 bp, Artificial Sequence
  Description of Artificial Sequence: Synthetic oligonucleotide
  Target: ATXN1; (-) strand; PAM type: NNGRRT; PAM sequence: TAGAAT
cctcacagacccctgccctc

SEQ ID NO: 15336 - DNA, 20 bp, Artificial Sequence
  Description of Artificial Sequence: Synthetic oligonucleotide
  Target: ATXN1; (-) strand; PAM type: NNGRRT; PAM sequence: GTGAGT
ggagtttggtgtgtgcagta

SEQ ID NO: 15337 - DNA, 20 bp, Artificial Sequence
  Description of Artificial Sequence: Synthetic oligonucleotide
  Target: ATXN1; (-) strand; PAM type: NNGRRT; PAM sequence: GGGAGT
gctccccctcttccttttgt

SEQ ID NO: 15338 - DNA, 20 bp, Artificial Sequence
  Description of Artificial Sequence: Synthetic oligonucleotide
  Target: ATXN1; (-) strand; PAM type: NNGRRT; PAM sequence: CTGGGT
atggtgttaggaactaagtt

SEQ ID NO: 15339 - DNA, 20 bp, Artificial Sequence
  Description of Artificial Sequence: Synthetic oligonucleotide
  Target: ATXN1; (-) strand; PAM type: NNGRRT; PAM sequence: GAGAAT
acccctggtttgttttattg

SEQ ID NO: 15340 - DNA, 20 bp, Artificial Sequence
  Description of Artificial Sequence: Synthetic oligonucleotide
  Target: ATXN1; (-) strand; PAM type: NNGRRT; PAM sequence: TAGAAT
gatattccctgtcacagtac

SEQ ID NO: 15341 - DNA, 20 bp, Artificial Sequence
  Description of Artificial Sequence: Synthetic oligonucleotide
  Target: ATXN1; (-) strand; PAM type: NNGRRT; PAM sequence: TTGGAT
caagatgctccatgctcatc

SEQ ID NO: 15342 - DNA, 20 bp, Artificial Sequence
  Description of Artificial Sequence: Synthetic oligonucleotide
  Target: ATXN1; (-) strand; PAM type: NNGRRT; PAM sequence: TGGGGT
tttatatgcccccatcactg

SEQ ID NO: 15343 - DNA, 20 bp, Artificial Sequence
  Description of Artificial Sequence: Synthetic oligonucleotide
  Target: ATXN1; (-) strand; PAM type: NNGRRT; PAM sequence: AGGAAT
gcagctctttgagaaatatt

SEQ ID NO: 15344 - DNA, 20 bp, Artificial Sequence
  Description of Artificial Sequence: Synthetic oligonucleotide
  Target: ATXN1; (-) strand; PAM type: NNGRRT; PAM sequence: ATGGGT
atttatatcaatatgaactc

SEQ ID NO: 15345 - DNA, 20 bp, Artificial Sequence
  Description of Artificial Sequence: Synthetic oligonucleotide
  Target: ATXN1; (-) strand; PAM type: NNGRRT; PAM sequence: ATGAAT
tacaagggcagaacatctgc

SEQ ID NO: 15346 - DNA, 20 bp, Artificial Sequence
  Description of Artificial Sequence: Synthetic oligonucleotide
  Target: ATXN1; (-) strand; PAM type: NNGRRT; PAM sequence: AGGGGT
ctgtgcacagcccacactta

SEQ ID NO: 15347 - DNA, 20 bp, Artificial Sequence
  Description of Artificial Sequence: Synthetic oligonucleotide
  Target: ATXN1; (-) strand; PAM type: NNGRRT; PAM sequence: CAGGGT
gacctcagccgaggttgtgt

SEQ ID NO: 15348 - DNA, 20 bp, Artificial Sequence
  Description of Artificial Sequence: Synthetic oligonucleotide
  Target: ATXN1; (-) strand; PAM type: NNGRRT; PAM sequence: TGGGAT
tctttggccccacaaagtgc

SEQ ID NO: 15349 - DNA, 20 bp, Artificial Sequence
  Description of Artificial Sequence: Synthetic oligonucleotide
  Target: ATXN1; (-) strand; PAM type: NNGRRT; PAM sequence: CAGGGT
tggtttttttttggtagagt

SEQ ID NO: 15350 - DNA, 20 bp, Artificial Sequence
  Description of Artificial Sequence: Synthetic oligonucleotide
  Target: ATXN1; (-) strand; PAM type: NNGRRT; PAM sequence: TAGAGT
ggtttttggtttttttttgg

SEQ ID NO: 15351 - DNA, 20 bp, Artificial Sequence
  Description of Artificial Sequence: Synthetic oligonucleotide
  Target: ATXN1; (-) strand; PAM type: NNGRRT; PAM sequence: CTGAGT
aatcctcccatcttagcccc

SEQ ID NO: 15352 - DNA, 20 bp, Artificial Sequence
  Description of Artificial Sequence: Synthetic oligonucleotide
  Target: ATXN1; (-) strand; PAM type: NNGRRT; PAM sequence: TGGAGT
tctcactctgtcgcccaggt

SEQ ID NO: 15353 - DNA, 20 bp, Artificial Sequence
  Description of Artificial Sequence: Synthetic oligonucleotide
  Target: ATXN1; (-) strand; PAM type: NNGRRT; PAM sequence: CAGGGT
tattattattattgttgaga

SEQ ID NO: 15354 - DNA, 20 bp, Artificial Sequence
  Description of Artificial Sequence: Synthetic oligonucleotide
  Target: ATXN1; (-) strand; PAM type: NNGRRT; PAM sequence: AAGAAT
caaacatacaagtaaattgt

SEQ ID NO: 15355 - DNA, 20 bp, Artificial Sequence
  Description of Artificial Sequence: Synthetic oligonucleotide
  Target: ATXN1; (-) strand; PAM type: NNGRRT; PAM sequence: CAGAGT
gaaactcttctatgactggg

SEQ ID NO: 15356 - DNA, 20 bp, Artificial Sequence
  Description of Artificial Sequence: Synthetic oligonucleotide
  Target: ATXN1; (-) strand; PAM type: NNGRRT; PAM sequence: CAGAGT
atgtggaatataaagctctg

SEQ ID NO: 15357 - DNA, 20 bp, Artificial Sequence
  Description of Artificial Sequence: Synthetic oligonucleotide
  Target: ATXN1; (-) strand; PAM type: NNGRRT; PAM sequence: TGGAAT
aaatgattggagggtccatg

SEQ ID NO: 15358 - DNA, 20 bp, Artificial Sequence
  Description of Artificial Sequence: Synthetic oligonucleotide
  Target: ATXN1; (-) strand; PAM type: NNGRRT; PAM sequence: GAGGGT
ccaagccacaaaaatgattg

SEQ ID NO: 15359 - DNA, 20 bp, Artificial Sequence
  Description of Artificial Sequence: Synthetic oligonucleotide
  Target: ATXN1; (-) strand; PAM type: NNGRRT; PAM sequence: ATGAGT
aagtaagagttgaaggtaga

SEQ ID NO: 15360 - DNA, 20 bp, Artificial Sequence
  Description of Artificial Sequence: Synthetic oligonucleotide
  Target: ATXN1; (-) strand; PAM type: NNGRRT; PAM sequence: TAGAAT
ggccaagtaagagttgaagg

SEQ ID NO: 15361 - DNA, 20 bp, Artificial Sequence
  Description of Artificial Sequence: Synthetic oligonucleotide
  Target: ATXN1; (-) strand; PAM type: NNGRRT; PAM sequence: AAGAGT
tacatttcctaaggccaagt

SEQ ID NO: 15362 - DNA, 20 bp, Artificial Sequence
  Description of Artificial Sequence: Synthetic oligonucleotide
  Target: ATXN1; (-) strand; PAM type: NNGRRT; PAM sequence: TTGAAT
agataataataatctcatgt

SEQ ID NO: 15363 - DNA, 20 bp, Artificial Sequence
  Description of Artificial Sequence: Synthetic oligonucleotide
  Target: ATXN1; (-) strand; PAM type: NNGRRT; PAM sequence: CGGAAT
ctaatgaatttgtcaagcat

SEQ ID NO: 15364 - DNA, 20 bp, Artificial Sequence
  Description of Artificial Sequence: Synthetic oligonucleotide
  Target: ATXN1; (-) strand; PAM type: NNGRRT; PAM sequence: ATGAAT
tttaacatttgttattgcta

SEQ ID NO: 15365 - DNA, 20 bp, Artificial Sequence
  Description of Artificial Sequence: Synthetic oligonucleotide
  Target: ATXN1; (-) strand; PAM type: NNGRRT; PAM sequence: TAGAAT
gaggccattgatttgctgcg

SEQ ID NO: 15366 - DNA, 20 bp, Artificial Sequence
  Description of Artificial Sequence: Synthetic oligonucleotide
  Target: ATXN1; (-) strand; PAM type: NNGRRT; PAM sequence: CAGAAT
tgtcggtggcatcacgttgg

SEQ ID NO: 15367 - DNA, 20 bp, Artificial Sequence
  Description of Artificial Sequence: Synthetic oligonucleotide
  Target: ATXN1; (-) strand; PAM type: NNGRRT; PAM sequence: CAGAGT
agtccttctcggagggtgag

SEQ ID NO: 15368 - DNA, 20 bp, Artificial Sequence
  Description of Artificial Sequence: Synthetic oligonucleotide
  Target: ATXN1; (-) strand; PAM type: NNGRRT; PAM sequence: GAGGGT
atgcactagagtccttctcg

SEQ ID NO: 15369 - DNA, 20 bp, Artificial Sequence
  Description of Artificial Sequence: Synthetic oligonucleotide
  Target: ATXN1; (-) strand; PAM type: NNGRRT; PAM sequence: TAGAGT
ataggcagccacttatgcac

SEQ ID NO: 15370 - DNA, 20 bp, Artificial Sequence
  Description of Artificial Sequence: Synthetic oligonucleotide
  Target: ATXN1; (-) strand; PAM type: NNGRRT; PAM sequence: TGGGAT
gccccagcctcccaaagtgc

SEQ ID NO: 15371 - DNA, 20 bp, Artificial Sequence
  Description of Artificial Sequence: Synthetic oligonucleotide
  Target: ATXN1; (-) strand; PAM type: NNGRRT; PAM sequence: AGGGAT
gccccagcctgccgactagc

SEQ ID NO: 15372 - DNA, 20 bp, Artificial Sequence
  Description of Artificial Sequence: Synthetic oligonucleotide
  Target: ATXN1; (-) strand; PAM type: NNGRRT; PAM sequence: CTGGGT
ctcactgcaacctctacctc

SEQ ID NO: 15373 - DNA, 20 bp, Artificial Sequence
  Description of Artificial Sequence: Synthetic oligonucleotide
  Target: ATXN1; (-) strand; PAM type: NNGRRT; PAM sequence: TGGAGT
ttcactcttgttgcccagac

SEQ ID NO: 15374 - DNA, 20 bp, Artificial Sequence
  Description of Artificial Sequence: Synthetic oligonucleotide
  Target: ATXN1; (-) strand; PAM type: NNGRRT; PAM sequence: CAGAGT
tttttttcttttttttgaga

SEQ ID NO: 15375 - DNA, 20 bp, Artificial Sequence
  Description of Artificial Sequence: Synthetic oligonucleotide
  Target: ATXN1; (-) strand; PAM type: NNGRRT; PAM sequence: TGGGGT
ttttgtatttttagtagaga

SEQ ID NO: 15376 - DNA, 20 bp, Artificial Sequence
  Description of Artificial Sequence: Synthetic oligonucleotide
  Target: ATXN1; (-) strand; PAM type: NNGRRT; PAM sequence: CTGGGT
gaagttgccagcaagctgac

SEQ ID NO: 15377 - DNA, 20 bp, Artificial Sequence
  Description of Artificial Sequence: Synthetic oligonucleotide
  Target: ATXN1; (-) strand; PAM type: NNGRRT; PAM sequence: AGGGGT
gaaggaatttaattattaca

SEQ ID NO: 15378 - DNA, 20 bp, Artificial Sequence
  Description of Artificial Sequence: Synthetic oligonucleotide
  Target: ATXN1; (-) strand; PAM type: NNGRRT; PAM sequence: AGGAAT
atatttcttgtgccggtgga

SEQ ID NO: 15379 - DNA, 20 bp, Artificial Sequence
  Description of Artificial Sequence: Synthetic oligonucleotide
  Target: ATXN1; (-) strand; PAM type: NNGRRT; PAM sequence: CTGGGT
acttatagcctctcactgtc

SEQ ID NO: 15380 - DNA, 20 bp, Artificial Sequence
  Description of Artificial Sequence: Synthetic oligonucleotide
  Target: ATXN1; (-) strand; PAM type: NNGRRT; PAM sequence: TTGAAT
gaacaattattttggaatca

SEQ ID NO: 15381 - DNA, 20 bp, Artificial Sequence
  Description of Artificial Sequence: Synthetic oligonucleotide
  Target: ATXN1; (-) strand; PAM type: NNGRRT; PAM sequence: TGGAAT
aataaaaagaacaattattt

SEQ ID NO: 15382 - DNA, 20 bp, Artificial Sequence
  Description of Artificial Sequence: Synthetic oligonucleotide
  Target: ATXN1; (-) strand; PAM type: NNGRRT; PAM sequence: ATGGGT
taatgttaaatgacaagtta

SEQ ID NO: 15383 - DNA, 20 bp, Artificial Sequence
  Description of Artificial Sequence: Synthetic oligonucleotide
  Target: ATXN1; (-) strand; PAM type: NNGRRT; PAM sequence: AAGGAT
gtggggtggggggagggggg

SEQ ID NO: 15384 - DNA, 20 bp, Artificial Sequence
  Description of Artificial Sequence: Synthetic oligonucleotide
  Target: ATXN1; (-) strand; PAM type: NNGRRT; PAM sequence: TGGGGT
tcacacaccggggcctgttg

SEQ ID NO: 15385 - DNA, 20 bp, Artificial Sequence
  Description of Artificial Sequence: Synthetic oligonucleotide
  Target: ATXN1; (-) strand; PAM type: NNGRRT; PAM sequence: GGGAAT
ccatgttctcactcataggt

SEQ ID NO: 15386 - DNA, 20 bp, Artificial Sequence
  Description of Artificial Sequence: Synthetic oligonucleotide
  Target: ATXN1; (-) strand; PAM type: NNGRRT; PAM sequence: CTGGGT
tagtgccattgcactccatc

SEQ ID NO: 15387 - DNA, 20 bp, Artificial Sequence
  Description of Artificial Sequence: Synthetic oligonucleotide
  Target: ATXN1; (-) strand; PAM type: NNGRRT; PAM sequence: GAGGAT
tacttgggaggctgaggcga

SEQ ID NO: 15388 - DNA, 20 bp, Artificial Sequence
  Description of Artificial Sequence: Synthetic oligonucleotide
  Target: ATXN1; (-) strand; PAM type: NNGRRT; PAM sequence: AAGAAT
cctgtctctactgaaaaaac

SEQ ID NO: 15389 - DNA, 20 bp, Artificial Sequence
  Description of Artificial Sequence: Synthetic oligonucleotide
  Target: ATXN1; (-) strand; PAM type: NNGRRT; PAM sequence: AGGAGT
caggtggatcacctgaggtc

SEQ ID NO: 15390 - DNA, 20 bp, Artificial Sequence
  Description of Artificial Sequence: Synthetic oligonucleotide
  Target: ATXN1; (-) strand; PAM type: NNGRRT; PAM sequence: GTGGAT
actttgggaggccgaggcag

SEQ ID NO: 15391 - DNA, 20 bp, Artificial Sequence
  Description of Artificial Sequence: Synthetic oligonucleotide
  Target: ATXN1; (-) strand; PAM type: NNGRRT; PAM sequence: TAGAAT
gtagtgaggagaggataggt

SEQ ID NO: 15392 - DNA, 20 bp, Artificial Sequence
  Description of Artificial Sequence: Synthetic oligonucleotide
  Target: ATXN1; (-) strand; PAM type: NNGRRT; PAM sequence: GAGGAT
gtgggggtaagtagtgagga

SEQ ID NO: 15393 - DNA, 20 bp, Artificial Sequence
  Description of Artificial Sequence: Synthetic oligonucleotide
  Target: ATXN1; (-) strand; PAM type: NNGRRT; PAM sequence: GGGGGT
gttggcaggtgaaggatagt

SEQ ID NO: 15394 - DNA, 20 bp, Artificial Sequence
  Description of Artificial Sequence: Synthetic oligonucleotide
  Target: ATXN1; (-) strand; PAM type: NNGRRT; PAM sequence: AAGGAT
ttagagtgggttggcaggtg

SEQ ID NO: 15395 - DNA, 20 bp, Artificial Sequence
  Description of Artificial Sequence: Synthetic oligonucleotide
  Target: ATXN1; (-) strand; PAM type: NNGRRT; PAM sequence: GTGGGT
tctaaatgaacagacttaga

SEQ ID NO: 15396 - DNA, 20 bp, Artificial Sequence
  Description of Artificial Sequence: Synthetic oligonucleotide
  Target: ATXN1; (-) strand; PAM type: NNGRRT; PAM sequence: TAGAGT
gaagtctaaatgaacagact

SEQ ID NO: 15397 - DNA, 20 bp, Artificial Sequence
  Description of Artificial Sequence: Synthetic oligonucleotide
  Target: ATXN1; (-) strand; PAM type: NNGRRT; PAM sequence: ATGGGT
ctggtcctttctgcatggga

SEQ ID NO: 15398 - DNA, 20 bp, Artificial Sequence
  Description of Artificial Sequence: Synthetic oligonucleotide
  Target: ATXN1; (-) strand; PAM type: NNGRRT; PAM sequence: GGGAAT
tgaactggtcctttctgcat

SEQ ID NO: 15399 - DNA, 20 bp, Artificial Sequence
  Description of Artificial Sequence: Synthetic oligonucleotide
  Target: ATXN1; (-) strand; PAM type: NNGRRT; PAM sequence: AAGAGT
aacacattagccctgtgatt

SEQ ID NO: 15400 - DNA, 20 bp, Artificial Sequence
  Description of Artificial Sequence: Synthetic oligonucleotide
  Target: ATXN1; (-) strand; PAM type: NNGRRT; PAM sequence: CTGGAT
tcattagctatacatttaag

SEQ ID NO: 15401 - DNA, 20 bp, Artificial Sequence
  Description of Artificial Sequence: Synthetic oligonucleotide
  Target: ATXN1; (-) strand; PAM type: NNGRRT; PAM sequence: ATGAAT
gttataaaatgaaaagtgga

SEQ ID NO: 15402 - DNA, 20 bp, Artificial Sequence
  Description of Artificial Sequence: Synthetic oligonucleotide
  Target: ATXN1; (-) strand; PAM type: NNGRRT; PAM sequence: TGGAAT
ccttgttataaaatgaaaag

SEQ ID NO: 15403 - DNA, 20 bp, Artificial Sequence
  Description of Artificial Sequence: Synthetic oligonucleotide
  Target: ATXN1; (-) strand; PAM type: NNGRRT; PAM sequence: TGGGGT
ttttttaaaaaattcagcag

SEQ ID NO: 15404 - DNA, 20 bp, Artificial Sequence
  Description of Artificial Sequence: Synthetic oligonucleotide
  Target: ATXN1; (-) strand; PAM type: NNGRRT; PAM sequence: CTGGGT
taggcctctgagctagttgg

SEQ ID NO: 15405 - DNA, 20 bp, Artificial Sequence
  Description of Artificial Sequence: Synthetic oligonucleotide
  Target: ATXN1; (-) strand; PAM type: NNGRRT; PAM sequence: AAGGGT
agatattggggctgattttc

SEQ ID NO: 15406 - DNA, 20 bp, Artificial Sequence
  Description of Artificial Sequence: Synthetic oligonucleotide
  Target: ATXN1; (-) strand; PAM type: NNGRRT; PAM sequence: CTGGGT
agctctgaggccacccatat

SEQ ID NO: 15407 - DNA, 20 bp, Artificial Sequence
  Description of Artificial Sequence: Synthetic oligonucleotide
  Target: ATXN1; (-) strand; PAM type: NNGRRT; PAM sequence: GAGAGT
gtttaaaggtaaatcggtgt

SEQ ID NO: 15408 - DNA, 20 bp, Artificial Sequence
  Description of Artificial Sequence: Synthetic oligonucleotide
  Target: ATXN1; (-) strand; PAM type: NNGRRT; PAM sequence: TAGAAT
cagaggtggatccctggtta

SEQ ID NO: 15409 - DNA, 20 bp, Artificial Sequence
  Description of Artificial Sequence: Synthetic oligonucleotide
  Target: ATXN1; (-) strand; PAM type: NNGRRT; PAM sequence: GTGGAT
ccgatgactaagccacagag

SEQ ID NO: 15410 - DNA, 20 bp, Artificial Sequence
  Description of Artificial Sequence: Synthetic oligonucleotide
  Target: ATXN1; (-) strand; PAM type: NNGRRT; PAM sequence: GTGAAT
atagaactgttctatagtgg

SEQ ID NO: 15411 - DNA, 20 bp, Artificial Sequence
  Description of Artificial Sequence: Synthetic oligonucleotide
  Target: ATXN1; (-) strand; PAM type: NNGRRT; PAM sequence: GTGGGT
ggtgatagaactgttctata

SEQ ID NO: 15412 - DNA, 20 bp, Artificial Sequence
  Description of Artificial Sequence: Synthetic oligonucleotide
  Target: ATXN1; (-) strand; PAM type: NNGRRT; PAM sequence: CAGGGT
taatttgtttctgatgcatg

SEQ ID NO: 15413 - DNA, 20 bp, Artificial Sequence
  Description of Artificial Sequence: Synthetic oligonucleotide
  Target: ATXN1; (-) strand; PAM type: NNGRRT; PAM sequence: AAGGGT
tcggtgtgtcatctgcctct

SEQ ID NO: 15414 - DNA, 20 bp, Artificial Sequence
  Description of Artificial Sequence: Synthetic oligonucleotide
  Target: ATXN1; (-) strand; PAM type: NNGRRT; PAM sequence: GAGGAT
caaaggctttgctttgcaga

SEQ ID NO: 15415 - DNA, 20 bp, Artificial Sequence
  Description of Artificial Sequence: Synthetic oligonucleotide
  Target: ATXN1; (-) strand; PAM type: NNGRRT; PAM sequence: TTGGAT
cttttctcctttttttgagg

SEQ ID NO: 15416 - DNA, 20 bp, Artificial Sequence
  Description of Artificial Sequence: Synthetic oligonucleotide
  Target: ATXN1; (-) strand; PAM type: NNGRRT; PAM sequence: ATGGAT
cagtactctgtttctgtggc

SEQ ID NO: 15417 - DNA, 20 bp, Artificial Sequence
  Description of Artificial Sequence: Synthetic oligonucleotide
  Target: ATXN1; (-) strand; PAM type: NNGRRT; PAM sequence: AAGAGT
gggaaacatcatgtcaagaa

SEQ ID NO: 15418 - DNA, 20 bp, Artificial Sequence
  Description of Artificial Sequence: Synthetic oligonucleotide
  Target: ATXN1; (-) strand; PAM type: NNGRRT; PAM sequence: CAGAGT
taataattaagagactgaca

SEQ ID NO: 15419 - DNA, 20 bp, Artificial Sequence
  Description of Artificial Sequence: Synthetic oligonucleotide
  Target: ATXN1; (-) strand; PAM type: NNGRRT; PAM sequence: GGGAAT
tacttgggaggctgaggcag

SEQ ID NO: 15420 - DNA, 20 bp, Artificial Sequence
  Description of Artificial Sequence: Synthetic oligonucleotide
  Target: ATXN1; (-) strand; PAM type: NNGRRT; PAM sequence: AGGAGT
tgggtggatcacctgaggtc

SEQ ID NO: 15421 - DNA, 20 bp, Artificial Sequence
  Description of Artificial Sequence: Synthetic oligonucleotide
  Target: ATXN1; (-) strand; PAM type: NNGRRT; PAM sequence: GTGGAT
actctgggaggctgaggtgg

SEQ ID NO: 15422 - DNA, 20 bp, Artificial Sequence
  Description of Artificial Sequence: Synthetic oligonucleotide
  Target: ATXN1; (-) strand; PAM type: NNGRRT; PAM sequence: GTGGGT
cagcactctgggaggctgag

SEQ ID NO: 15423 - DNA, 20 bp, Artificial Sequence
  Description of Artificial Sequence: Synthetic oligonucleotide
  Target: ATXN1; (-) strand; PAM type: NNGRRT; PAM sequence: CTGAAT
tcactgggctgttgggagag

SEQ ID NO: 15424 - DNA, 20 bp, Artificial Sequence
  Description of Artificial Sequence: Synthetic oligonucleotide
  Target: ATXN1; (-) strand; PAM type: NNGRRT; PAM sequence: GGGAAT
agtactccaatctgtacaat

SEQ ID NO: 15425 - DNA, 20 bp, Artificial Sequence
  Description of Artificial Sequence: Synthetic oligonucleotide
  Target: ATXN1; (-) strand; PAM type: NNGRRT; PAM sequence: TTGAAT
tagagcctaactccttggct

SEQ ID NO: 15426 - DNA, 20 bp, Artificial Sequence
  Description of Artificial Sequence: Synthetic oligonucleotide
  Target: ATXN1; (-) strand; PAM type: NNGRRT; PAM sequence: TAGAGT
acagcaatttaaggattaat

SEQ ID NO: 15427 - DNA, 20 bp, Artificial Sequence
  Description of Artificial Sequence: Synthetic oligonucleotide
  Target: ATXN1; (-) strand; PAM type: NNGRRT; PAM sequence: AAGGAT
cctgtctcccacagcaattt

SEQ ID NO: 15428 - DNA, 20 bp, Artificial Sequence
  Description of Artificial Sequence: Synthetic oligonucleotide
  Target: ATXN1; (-) strand; PAM type: NNGRRT; PAM sequence: GTGAGT
tagtgttgcgtggtgcagta

SEQ ID NO: 15429 - DNA, 20 bp, Artificial Sequence
  Description of Artificial Sequence: Synthetic oligonucleotide
  Target: ATXN1; (-) strand; PAM type: NNGRRT; PAM sequence: CTGGGT
cctctctcaaagtttcaggg

SEQ ID NO: 15430 - DNA, 20 bp, Artificial Sequence
  Description of Artificial Sequence: Synthetic oligonucleotide
  Target: ATXN1; (-) strand; PAM type: NNGRRT; PAM sequence: ATGGGT
cccatgggtcagagtcgtaa

SEQ ID NO: 15431 - DNA, 20 bp, Artificial Sequence
  Description of Artificial Sequence: Synthetic oligonucleotide
  Target: ATXN1; (-) strand; PAM type: NNGRRT; PAM sequence: CAGAGT
ctctgccttcccccatgggt

SEQ ID NO: 15432 - DNA, 20 bp, Artificial Sequence
  Description of Artificial Sequence: Synthetic oligonucleotide
  Target: ATXN1; (-) strand; PAM type: NNGRRT; PAM sequence: ATGGGT
ttaatcctctgccttccccc

SEQ ID NO: 15433 - DNA, 20 bp, Artificial Sequence
  Description of Artificial Sequence: Synthetic oligonucleotide
  Target: ATXN1; (-) strand; PAM type: NNGRRT; PAM sequence: AAGAAT
tctgctggggtggaaggaga

SEQ ID NO: 15434 - DNA, 20 bp, Artificial Sequence
  Description of Artificial Sequence: Synthetic oligonucleotide
  Target: ATXN1; (-) strand; PAM type: NNGRRT; PAM sequence: TGGGGT
ctaagaacaggtccctctgc

SEQ ID NO: 15435 - DNA, 20 bp, Artificial Sequence
  Description of Artificial Sequence: Synthetic oligonucleotide
  Target: ATXN1; (-) strand; PAM type: NNGRRT; PAM sequence: AAGAAT
gaatgaagtctgccgcctgg

SEQ ID NO: 15436 - DNA, 20 bp, Artificial Sequence
  Description of Artificial Sequence: Synthetic oligonucleotide
  Target: ATXN1; (-) strand; PAM type: NNGRRT; PAM sequence: TGGAAT
ggccagcttttccaccactg

SEQ ID NO: 15437 - DNA, 20 bp, Artificial Sequence
  Description of Artificial Sequence: Synthetic oligonucleotide
  Target: ATXN1; (-) strand; PAM type: NNGRRT; PAM sequence: CAGGAT
ctcctctgatttggcggtgt

SEQ ID NO: 15438 - DNA, 20 bp, Artificial Sequence
  Description of Artificial Sequence: Synthetic oligonucleotide
  Target: ATXN1; (-) strand; PAM type: NNGRRT; PAM sequence: CAGGAT
accaagtcactttacgttag

SEQ ID NO: 15439 - DNA, 20 bp, Artificial Sequence
  Description of Artificial Sequence: Synthetic oligonucleotide
  Target: ATXN1; (-) strand; PAM type: NNGRRT; PAM sequence: CTGAGT
ggggcaagatgtcagaaatc

SEQ ID NO: 15440 - DNA, 20 bp, Artificial Sequence
  Description of Artificial Sequence: Synthetic oligonucleotide
  Target: ATXN1; (-) strand; PAM type: NNGRRT; PAM sequence: TTGGGT
tactttctgtcctttgagtt

SEQ ID NO: 15441 - DNA, 20 bp, Artificial Sequence
  Description of Artificial Sequence: Synthetic oligonucleotide
  Target: ATXN1; (-) strand; PAM type: NNGRRT; PAM sequence: TTGAGT
cacattgtactttctgtcct

SEQ ID NO: 15442 - DNA, 20 bp, Artificial Sequence
  Description of Artificial Sequence: Synthetic oligonucleotide
  Target: ATXN1; (-) strand; PAM type: NNGRRT; PAM sequence: GTGGAT
atctggagtgaatgcagatt

SEQ ID NO: 15443 - DNA, 20 bp, Artificial Sequence
  Description of Artificial Sequence: Synthetic oligonucleotide
  Target: ATXN1; (-) strand; PAM type: NNGRRT; PAM sequence: GTGAAT
gtgatgaaatctcatctgga

SEQ ID NO: 15444 - DNA, 20 bp, Artificial Sequence
  Description of Artificial Sequence: Synthetic oligonucleotide
  Target: ATXN1; (-) strand; PAM type: NNGRRT; PAM sequence: TGGAGT
tgcggtgatgaaatctcatc

SEQ ID NO: 15445 - DNA, 20 bp, Artificial Sequence
  Description of Artificial Sequence: Synthetic oligonucleotide
  Target: ATXN1; (-) strand; PAM type: NNGRRT; PAM sequence: TAGGAT
tatattaaggaatgaataaa

SEQ ID NO: 15446 - DNA, 20 bp, Artificial Sequence
  Description of Artificial Sequence: Synthetic oligonucleotide
  Target: ATXN1; (-) strand; PAM type: NNGRRT; PAM sequence: ATGAAT
atttagatttatattaagga

SEQ ID NO: 15447 - DNA, 20 bp, Artificial Sequence
  Description of Artificial Sequence: Synthetic oligonucleotide
  Target: ATXN1; (-) strand; PAM type: NNGRRT; PAM sequence: AGGAAT
cgcaatttagatttatatta

SEQ ID NO: 15448 - DNA, 20 bp, Artificial Sequence
  Description of Artificial Sequence: Synthetic oligonucleotide
  Target: ATXN1; (-) strand; PAM type: NNGRRT; PAM sequence: GTGAAT
aagggctccgggagcactgt

SEQ ID NO: 15449 - DNA, 20 bp, Artificial Sequence
  Description of Artificial Sequence: Synthetic oligonucleotide
  Target: ATXN1; (-) strand; PAM type: NNGRRT; PAM sequence: GGGAAT
ccttgggctcccaagtagtt

SEQ ID NO: 15450 - DNA, 20 bp, Artificial Sequence
  Description of Artificial Sequence: Synthetic oligonucleotide
  Target: ATXN1; (-) strand; PAM type: NNGRRT; PAM sequence: TTGAAT
gatgggaggacaactgtctt

SEQ ID NO: 15451 - DNA, 20 bp, Artificial Sequence
  Description of Artificial Sequence: Synthetic oligonucleotide
  Target: ATXN1; (-) strand; PAM type: NNGRRT; PAM sequence: ATGGAT
ggtcttggaacagatcctcc

SEQ ID NO: 15452 - DNA, 20 bp, Artificial Sequence
  Description of Artificial Sequence: Synthetic oligonucleotide
  Target: ATXN1; (-) strand; PAM type: NNGRRT; PAM sequence: TGGGGT
tcatggttttaggcgtccac

SEQ ID NO: 15453 - DNA, 20 bp, Artificial Sequence
  Description of Artificial Sequence: Synthetic oligonucleotide
  Target: ATXN1; (-) strand; PAM type: NNGRRT; PAM sequence: ATGGGT
tttataaattaaactctatc

SEQ ID NO: 15454 - DNA, 20 bp, Artificial Sequence
  Description of Artificial Sequence: Synthetic oligonucleotide
  Target: ATXN1; (-) strand; PAM type: NNGRRT; PAM sequence: GTGAGT
caagcgtggtacaaaaacag

SEQ ID NO: 15455 - DNA, 20 bp, Artificial Sequence
  Description of Artificial Sequence: Synthetic oligonucleotide
  Target: ATXN1; (-) strand; PAM type: NNGRRT; PAM sequence: AAGAAT
tttatgcatcaccttctgga

SEQ ID NO: 15456 - DNA, 20 bp, Artificial Sequence
  Description of Artificial Sequence: Synthetic oligonucleotide
  Target: ATXN1; (-) strand; PAM type: NNGRRT; PAM sequence: AGGAAT
gtggctgcgggacggtggga

SEQ ID NO: 15457 - DNA, 20 bp, Artificial Sequence
  Description of Artificial Sequence: Synthetic oligonucleotide
  Target: ATXN1; (-) strand; PAM type: NNGRRT; PAM sequence: CAGAAT
gccacatgtcccctcccgca

SEQ ID NO: 15458 - DNA, 20 bp, Artificial Sequence
  Description of Artificial Sequence: Synthetic oligonucleotide
  Target: ATXN1; (-) strand; PAM type: NNGRRT; PAM sequence: AAGAAT
ttgtcttatccccaaatgaa

SEQ ID NO: 15459 - DNA, 20 bp, Artificial Sequence
  Description of Artificial Sequence: Synthetic oligonucleotide
  Target: ATXN1; (-) strand; PAM type: NNGRRT; PAM sequence: AAGGAT
agcatatgtgcaagccgata

SEQ ID NO: 15460 - DNA, 20 bp, Artificial Sequence
  Description of Artificial Sequence: Synthetic oligonucleotide
  Target: ATXN1; (-) strand; PAM type: NNGRRT; PAM sequence: AAGAGT
ctcttggcatactttcctgt

SEQ ID NO: 15461 - DNA, 20 bp, Artificial Sequence
  Description of Artificial Sequence: Synthetic oligonucleotide
  Target: ATXN1; (-) strand; PAM type: NNGRRT; PAM sequence: AGGAGT
ccctggtttaaggcatattt

SEQ ID NO: 15462 - DNA, 20 bp, Artificial Sequence
  Description of Artificial Sequence: Synthetic oligonucleotide
  Target: ATXN1; (-) strand; PAM type: NNGRRT; PAM sequence: CTGAAT
aacacatgcaaacagaatta

SEQ ID NO: 15463 - DNA, 20 bp, Artificial Sequence
  Description of Artificial Sequence: Synthetic oligonucleotide
  Target: ATXN1; (-) strand; PAM type: NNGRRT; PAM sequence: CAGAAT
gtggttagaacacatgcaaa

SEQ ID NO: 15464 - DNA, 20 bp, Artificial Sequence
  Description of Artificial Sequence: Synthetic oligonucleotide
  Target: ATXN1; (-) strand; PAM type: NNGRRT; PAM sequence: TAGAGT
ctagccctaaacccagaggt

SEQ ID NO: 15465 - DNA, 20 bp, Artificial Sequence
  Description of Artificial Sequence: Synthetic oligonucleotide
  Target: ATXN1; (-) strand; PAM type: NNGRRT; PAM sequence: TTGAGT
ttacttttgttgcgagaccc

SEQ ID NO: 15466 - DNA, 20 bp, Artificial Sequence
  Description of Artificial Sequence: Synthetic oligonucleotide
  Target: ATXN1; (-) strand; PAM type: NNGRRT; PAM sequence: TCGAGT
tatgttttcccatgctgcaa

SEQ ID NO: 15467 - DNA, 20 bp, Artificial Sequence
  Description of Artificial Sequence: Synthetic oligonucleotide
  Target: ATXN1; (-) strand; PAM type: NNGRRT; PAM sequence: AAGGAT
cttcagacttgatagtaaaa

SEQ ID NO: 15468 - DNA, 20 bp, Artificial Sequence
  Description of Artificial Sequence: Synthetic oligonucleotide
  Target: ATXN1; (-) strand; PAM type: NNGRRT; PAM sequence: TGGAAT
caggatggcacacccaggac

SEQ ID NO: 15469 - DNA, 20 bp, Artificial Sequence
  Description of Artificial Sequence: Synthetic oligonucleotide
  Target: ATXN1; (-) strand; PAM type: NNGRRT; PAM sequence: CAGGAT
gaggagagctatgacttgct

SEQ ID NO: 15470 - DNA, 20 bp, Artificial Sequence
  Description of Artificial Sequence: Synthetic oligonucleotide
  Target: ATXN1; (-) strand; PAM type: NNGRRT; PAM sequence: TGGAAT
aaagagaaagacgaggagcg

SEQ ID NO: 15471 - DNA, 20 bp, Artificial Sequence
  Description of Artificial Sequence: Synthetic oligonucleotide
  Target: ATXN1; (-) strand; PAM type: NNGRRT; PAM sequence: CGGAGT
ggaagggggaggccttgagg

SEQ ID NO: 15472 - DNA, 20 bp, Artificial Sequence
  Description of Artificial Sequence: Synthetic oligonucleotide
  Target: ATXN1; (-) strand; PAM type: NNGRRT; PAM sequence: GCGGAT
tcttaggagggtcccgacct

SEQ ID NO: 15473 - DNA, 20 bp, Artificial Sequence
  Description of Artificial Sequence: Synthetic oligonucleotide
  Target: ATXN1; (-) strand; PAM type: NNGRRT; PAM sequence: GAGGGT
gctcattcttgtgttcttag

SEQ ID NO: 15474 - DNA, 20 bp, Artificial Sequence
  Description of Artificial Sequence: Synthetic oligonucleotide
  Target: ATXN1; (-) strand; PAM type: NNGRRT; PAM sequence: AAGGAT
gcccccaaaagttatttagg

SEQ ID NO: 15475 - DNA, 20 bp, Artificial Sequence
  Description of Artificial Sequence: Synthetic oligonucleotide
  Target: ATXN1; (-) strand; PAM type: NNGRRT; PAM sequence: CAGGAT
cacatgattgtagctacacc

SEQ ID NO: 15476 - DNA, 20 bp, Artificial Sequence
  Description of Artificial Sequence: Synthetic oligonucleotide
  Target: ATXN1; (-) strand; PAM type: NNGRRT; PAM sequence: GGGAGT
atcctctagctgtcattagg

SEQ ID NO: 15477 - DNA, 20 bp, Artificial Sequence
  Description of Artificial Sequence: Synthetic oligonucleotide
  Target: ATXN1; (-) strand; PAM type: NNGRRT; PAM sequence: TTGAAT
agggtcatagactcagagaa

SEQ ID NO: 15478 - DNA, 20 bp, Artificial Sequence
  Description of Artificial Sequence: Synthetic oligonucleotide
  Target: ATXN1; (-) strand; PAM type: NNGRRT; PAM sequence: GAGAAT
gatgtagggtcatagactca

SEQ ID NO: 15479 - DNA, 20 bp, Artificial Sequence
  Description of Artificial Sequence: Synthetic oligonucleotide
  Target: ATXN1; (-) strand; PAM type: NNGRRT; PAM sequence: TAGGGT
accccacagcatcccagatg

SEQ ID NO: 15480 - DNA, 20 bp, Artificial Sequence
  Description of Artificial Sequence: Synthetic oligonucleotide
  Target: ATXN1; (-) strand; PAM type: NNGRRT; PAM sequence: TTGAAT
tcttagatgttcatcctcac

SEQ ID NO: 15481 - DNA, 20 bp, Artificial Sequence
  Description of Artificial Sequence: Synthetic oligonucleotide
  Target: ATXN1; (-) strand; PAM type: NNGRRT; PAM sequence: TAGGAT
ttccagtgatcctcccttat

SEQ ID NO: 15482 - DNA, 20 bp, Artificial Sequence
  Description of Artificial Sequence: Synthetic oligonucleotide
  Target: ATXN1; (-) strand; PAM type: NNGRRT; PAM sequence: TGGAAT
tgaaaaaaaatcccacaaca

SEQ ID NO: 15483 - DNA, 20 bp, Artificial Sequence
  Description of Artificial Sequence: Synthetic oligonucleotide
  Target: ATXN1; (-) strand; PAM type: NNGRRT; PAM sequence: GTGAAT
aagctgccttcaaatcaaac

SEQ ID NO: 15484 - DNA, 20 bp, Artificial Sequence
  Description of Artificial Sequence: Synthetic oligonucleotide
  Target: ATXN1; (-) strand; PAM type: NNGRRT; PAM sequence: GGGGGT
agaccaaagaggacattttg

SEQ ID NO: 15485 - DNA, 20 bp, Artificial Sequence
  Description of Artificial Sequence: Synthetic oligonucleotide
  Target: ATXN1; (-) strand; PAM type: NNGRRT; PAM sequence: GAGAAT
acatattaaggtcatttaag

SEQ ID NO: 15486 - DNA, 20 bp, Artificial Sequence
  Description of Artificial Sequence: Synthetic oligonucleotide
  Target: ATXN1; (-) strand; PAM type: NNGRRT; PAM sequence: AAGAAT
attaccaggaccctgaattg

SEQ ID NO: 15487 - DNA, 20 bp, Artificial Sequence
  Description of Artificial Sequence: Synthetic oligonucleotide
  Target: ATXN1; (-) strand; PAM type: NNGRRT; PAM sequence: CTGAAT
ttccagtgattaccaggacc

SEQ ID NO: 15488 - DNA, 20 bp, Artificial Sequence
  Description of Artificial Sequence: Synthetic oligonucleotide
  Target: ATXN1; (-) strand; PAM type: NNGRRT; PAM sequence: AAGAGT
tgaagtggtttgtgttttat

SEQ ID NO: 15489 - DNA, 20 bp, Artificial Sequence
  Description of Artificial Sequence: Synthetic oligonucleotide
  Target: ATXN1; (-) strand; PAM type: NNGRRT; PAM sequence: TTGAAT
caccccacaaggttgtttac

SEQ ID NO: 15490 - DNA, 20 bp, Artificial Sequence
  Description of Artificial Sequence: Synthetic oligonucleotide
  Target: ATXN1; (-) strand; PAM type: NNGRRT; PAM sequence: GTGAAT
tacaactgcattcactaaat

SEQ ID NO: 15491 - DNA, 20 bp, Artificial Sequence
  Description of Artificial Sequence: Synthetic oligonucleotide
  Target: ATXN1; (-) strand; PAM type: NNGRRT; PAM sequence: TAGAGT
tagaaaagagtacaaaagat

SEQ ID NO: 15492 - DNA, 20 bp, Artificial Sequence
  Description of Artificial Sequence: Synthetic oligonucleotide
  Target: ATXN1; (-) strand; PAM type: NNGRRT; PAM sequence: AAGAGT
caccagtttgaattgtagaa

SEQ ID NO: 15493 - DNA, 20 bp, Artificial Sequence
  Description of Artificial Sequence: Synthetic oligonucleotide
  Target: ATXN1; (-) strand; PAM type: NNGRRT; PAM sequence: TTGAAT
gctctctatttctcaccagt

SEQ ID NO: 15494 - DNA, 20 bp, Artificial Sequence
  Description of Artificial Sequence: Synthetic oligonucleotide
  Target: ATXN1; (-) strand; PAM type: NNGRRT; PAM sequence: TGGAAT
gtgagtctttggtacatgtt

SEQ ID NO: 15495 - DNA, 20 bp, Artificial Sequence
  Description of Artificial Sequence: Synthetic oligonucleotide
  Target: ATXN1; (-) strand; PAM type: NNGRRT; PAM sequence: GTGAGT
tggatatttggtgttctatt

SEQ ID NO: 15496 - DNA, 20 bp, Artificial Sequence
  Description of Artificial Sequence: Synthetic oligonucleotide
  Target: ATXN1; (-) strand; PAM type: NNGRRT; PAM sequence: ATGGAT
gtcactgttgatgctgagta

SEQ ID NO: 15497 - DNA, 20 bp, Artificial Sequence
  Description of Artificial Sequence: Synthetic oligonucleotide
  Target: ATXN1; (-) strand; PAM type: NNGRRT; PAM sequence: CTGAGT
atggtttgtcactgttgatg

SEQ ID NO: 15498 - DNA, 20 bp, Artificial Sequence
  Description of Artificial Sequence: Synthetic oligonucleotide
  Target: ATXN1; (-) strand; PAM type: NNGRRT; PAM sequence: TGGGAT
tagggatgaaattacagttc

SEQ ID NO: 15499 - DNA, 20 bp, Artificial Sequence
  Description of Artificial Sequence: Synthetic oligonucleotide
  Target: ATXN1; (-) strand; PAM type: NNGRRT; PAM sequence: AGGGAT
tggttcctaatgaaatactt

SEQ ID NO: 15500 - DNA, 20 bp, Artificial Sequence
  Description of Artificial Sequence: Synthetic oligonucleotide
  Target: ATXN1; (-) strand; PAM type: NNGRRT; PAM sequence: CTGGGT
cacagttggacatgatggcc

SEQ ID NO: 15501 - DNA, 20 bp, Artificial Sequence
  Description of Artificial Sequence: Synthetic oligonucleotide
  Target: ATXN1; (-) strand; PAM type: NNGRRT; PAM sequence: GGGGGT
gtacaagagagatgggagtt

SEQ ID NO: 15502 - DNA, 20 bp, Artificial Sequence
  Description of Artificial Sequence: Synthetic oligonucleotide
  Target: ATXN1; (-) strand; PAM type: NNGRRT; PAM sequence: GGGAGT
gtggtaagtacaagagagat

SEQ ID NO: 15503 - DNA, 20 bp, Artificial Sequence
  Description of Artificial Sequence: Synthetic oligonucleotide
  Target: ATXN1; (-) strand; PAM type: NNGRRT; PAM sequence: GGGAGT
tccagttaaaaacgtctgaa

SEQ ID NO: 15504 - DNA, 20 bp, Artificial Sequence
  Description of Artificial Sequence: Synthetic oligonucleotide
  Target: ATXN1; (-) strand; PAM type: NNGRRT; PAM sequence: CAGGGT
tctgtgttaattttatggct

SEQ ID NO: 15505 - DNA, 20 bp, Artificial Sequence
  Description of Artificial Sequence: Synthetic oligonucleotide
  Target: ATXN1; (-) strand; PAM type: NNGRRT; PAM sequence: CAGGAT
gcaaagctgagattaaaatt

SEQ ID NO: 15506 - DNA, 20 bp, Artificial Sequence
  Description of Artificial Sequence: Synthetic oligonucleotide
  Target: ATXN1; (-) strand; PAM type: NNGRRT; PAM sequence: CAGGGT
acttgtcgtggcaatactct

SEQ ID NO: 15507 - DNA, 20 bp, Artificial Sequence
  Description of Artificial Sequence: Synthetic oligonucleotide
  Target: ATXN1; (-) strand; PAM type: NNGRRT; PAM sequence: GGGAAT
gcaagtccacaacaaagaga

SEQ ID NO: 15508 - DNA, 20 bp, Artificial Sequence
  Description of Artificial Sequence: Synthetic oligonucleotide
  Target: ATXN1; (-) strand; PAM type: NNGRRT; PAM sequence: AGGGAT
gttgtaagtccacttcggtc

SEQ ID NO: 15509 - DNA, 20 bp, Artificial Sequence
  Description of Artificial Sequence: Synthetic oligonucleotide
  Target: ATXN1; (-) strand; PAM type: NNGRRT; PAM sequence: GAGAAT
ccaggcttggacactttcgt

SEQ ID NO: 15510 - DNA, 20 bp, Artificial Sequence
  Description of Artificial Sequence: Synthetic oligonucleotide
  Target: ATXN1; (-) strand; PAM type: NNGRRT; PAM sequence: AGGAGT
tatgtgcatttggaaggaaa

SEQ ID NO: 15511 - DNA, 20 bp, Artificial Sequence
  Description of Artificial Sequence: Synthetic oligonucleotide
  Target: ATXN1; (-) strand; PAM type: NNGRRT; PAM sequence: TGGGAT
ggtttggggttggtttagaa

SEQ ID NO: 15512 - DNA, 20 bp, Artificial Sequence
  Description of Artificial Sequence: Synthetic oligonucleotide
  Target: ATXN1; (-) strand; PAM type: NNGRRT; PAM sequence: TAGAAT
ctcagggtttggggttggtt

SEQ ID NO: 15513 - DNA, 20 bp, Artificial Sequence
  Description of Artificial Sequence: Synthetic oligonucleotide
  Target: ATXN1; (-) strand; PAM type: NNGRRT; PAM sequence: TGGGGT
gaaagccaaatctcagggtt

SEQ ID NO: 15514 - DNA, 20 bp, Artificial Sequence
  Description of Artificial Sequence: Synthetic oligonucleotide
  Target: ATXN1; (-) strand; PAM type: NNGRRT; PAM sequence: CAGGGT
gtgcattgaaagccaaatct

SEQ ID NO: 15515 - DNA, 20 bp, Artificial Sequence
  Description of Artificial Sequence: Synthetic oligonucleotide
  Target: ATXN1; (-) strand; PAM type: NNGRRT; PAM sequence: GTGGAT
atggtaggcatttgctggcg

SEQ ID NO: 15516 - DNA, 20 bp, Artificial Sequence
  Description of Artificial Sequence: Synthetic oligonucleotide
  Target: ATXN1; (-) strand; PAM type: NNGRRT; PAM sequence: TTGGGT
tctgacgcctggtgcacagc

SEQ ID NO: 15517 - DNA, 20 bp, Artificial Sequence
  Description of Artificial Sequence: Synthetic oligonucleotide
  Target: ATXN1; (-) strand; PAM type: NNGRRT; PAM sequence: TCGGAT
gccctgcagacaccttgatc

SEQ ID NO: 15518 - DNA, 20 bp, Artificial Sequence
  Description of Artificial Sequence: Synthetic oligonucleotide
  Target: ATXN1; (-) strand; PAM type: NNGRRT; PAM sequence: TGGAGT
ggctattaccgtgtaaagac

SEQ ID NO: 15519 - DNA, 20 bp, Artificial Sequence
  Description of Artificial Sequence: Synthetic oligonucleotide
  Target: ATXN1; (-) strand; PAM type: NNGRRT; PAM sequence: TAGAGT
ccaagttcagatgaggttat

SEQ ID NO: 15520 - DNA, 20 bp, Artificial Sequence
  Description of Artificial Sequence: Synthetic oligonucleotide
  Target: ATXN1; (-) strand; PAM type: NNGRRT; PAM sequence: GAGGAT
cccaacacatgcctgtaggt

SEQ ID NO: 15521 - DNA, 20 bp, Artificial Sequence
  Description of Artificial Sequence: Synthetic oligonucleotide
  Target: ATXN1; (-) strand; PAM type: NNGRRT; PAM sequence: CAGAAT
actctacgatgttcacacaa

SEQ ID NO: 15522 - DNA, 20 bp, Artificial Sequence
  Description of Artificial Sequence: Synthetic oligonucleotide
  Target: ATXN1; (-) strand; PAM type: NNGRRT; PAM sequence: GTGAGT
gctgtcccatctaggtttgt

SEQ ID NO: 15523 - DNA, 20 bp, Artificial Sequence
  Description of Artificial Sequence: Synthetic oligonucleotide
  Target: ATXN1; (-) strand; PAM type: NNGRRT; PAM sequence: TTGAAT
ttttctatatttaggtatgt

SEQ ID NO: 15524 - DNA, 20 bp, Artificial Sequence
  Description of Artificial Sequence: Synthetic oligonucleotide
  Target: ATXN1; (-) strand; PAM type: NNGRRT; PAM sequence: AAGAGT
tttaagctaagtattattac

SEQ ID NO: 15525 - DNA, 20 bp, Artificial Sequence
  Description of Artificial Sequence: Synthetic oligonucleotide
  Target: ATXN1; (-) strand; PAM type: NNGRRT; PAM sequence: GTGGAT
tattttcgtacaactttaaa

SEQ ID NO: 15526 - DNA, 20 bp, Artificial Sequence
  Description of Artificial Sequence: Synthetic oligonucleotide
  Target: ATXN1; (-) strand; PAM type: NNGRRT; PAM sequence: TTGAAT
tgaaaatagaaaaatgttta

SEQ ID NO: 15527 - DNA, 20 bp, Artificial Sequence
  Description of Artificial Sequence: Synthetic oligonucleotide
  Target: ATXN1; (-) strand; PAM type: NNGRRT; PAM sequence: TGGGAT
gcctcggcctcccaaagtgc

SEQ ID NO: 15528 - DNA, 20 bp, Artificial Sequence
  Description of Artificial Sequence: Synthetic oligonucleotide
  Target: ATXN1; (-) strand; PAM type: NNGRRT; PAM sequence: CGGAGT
ttttgtatttttagcagaga

SEQ ID NO: 15529 - DNA, 20 bp, Artificial Sequence
  Description of Artificial Sequence: Synthetic oligonucleotide
  Target: ATXN1; (-) strand; PAM type: NNGRRT; PAM sequence: TGGGAT
gcctcagcctcctgagtagc

SEQ ID NO: 15530 - DNA, 20 bp, Artificial Sequence
  Description of Artificial Sequence: Synthetic oligonucleotide
  Target: ATXN1; (-) strand; PAM type: NNGRRT; PAM sequence: CTGAGT
cattctcctgcctcagcctc

SEQ ID NO: 15531 - DNA, 20 bp, Artificial Sequence
  Description of Artificial Sequence: Synthetic oligonucleotide
  Target: ATXN1; (-) strand; PAM type: NNGRRT; PAM sequence: CTGGGT
ctcactgcaacctctgcctc

SEQ ID NO: 15532 - DNA, 20 bp, Artificial Sequence
  Description of Artificial Sequence: Synthetic oligonucleotide
  Target: ATXN1; (-) strand; PAM type: NNGRRT; PAM sequence: TGGAGT
ccttactttgtcgcccaggc

SEQ ID NO: 15533 - DNA, 20 bp, Artificial Sequence
  Description of Artificial Sequence: Synthetic oligonucleotide
  Target: ATXN1; (-) strand; PAM type: NNGRRT; PAM sequence: ATGAAT
gatgtggaggtagaggtgat

SEQ ID NO: 15534 - DNA, 20 bp, Artificial Sequence
  Description of Artificial Sequence: Synthetic oligonucleotide
  Target: ATXN1; (-) strand; PAM type: NNGRRT; PAM sequence: AAGAGT
tactgtgctgccagtcatgt

SEQ ID NO: 15535 - DNA, 20 bp, Artificial Sequence
  Description of Artificial Sequence: Synthetic oligonucleotide
  Target: ATXN1; (-) strand; PAM type: NNGRRT; PAM sequence: AAGAAT
ataagattataatgaagctg

SEQ ID NO: 15536 - DNA, 20 bp, Artificial Sequence
  Description of Artificial Sequence: Synthetic oligonucleotide
  Target: ATXN1; (-) strand; PAM type: NNGRRT; PAM sequence: GTGGGT
taacgacatttgggtcaaca

SEQ ID NO: 15537 - DNA, 20 bp, Artificial Sequence
  Description of Artificial Sequence: Synthetic oligonucleotide
  Target: ATXN1; (-) strand; PAM type: NNGRRT; PAM sequence: TTGGGT
catgtgccgcataacgacat

SEQ ID NO: 15538 - DNA, 20 bp, Artificial Sequence
  Description of Artificial Sequence: Synthetic oligonucleotide
  Target: ATXN1; (-) strand; PAM type: NNGRRT; PAM sequence: TTGAAT
cctggccagcatgcctattc

SEQ ID NO: 15539 - DNA, 20 bp, Artificial Sequence
  Description of Artificial Sequence: Synthetic oligonucleotide
  Target: ATXN1; (-) strand; PAM type: NNGRRT; PAM sequence: TGGGAT
atctctgcctcccaaagtgc

SEQ ID NO: 15540 - DNA, 20 bp, Artificial Sequence
  Description of Artificial Sequence: Synthetic oligonucleotide
  Target: ATXN1; (-) strand; PAM type: NNGRRT; PAM sequence: CGGGGT
ttttgcatttttagtagaga

SEQ ID NO: 15541 - DNA, 20 bp, Artificial Sequence
  Description of Artificial Sequence: Synthetic oligonucleotide
  Target: ATXN1; (-) strand; PAM type: NNGRRT; PAM sequence: TGGGAT
gcctgagcctcctgagtagc

SEQ ID NO: 15542 - DNA, 20 bp, Artificial Sequence
  Description of Artificial Sequence: Synthetic oligonucleotide
  Target: ATXN1; (-) strand; PAM type: NNGRRT; PAM sequence: CTGAGT
tattctactgcctgagcctc

SEQ ID NO: 15543 - DNA, 20 bp, Artificial Sequence
  Description of Artificial Sequence: Synthetic oligonucleotide
  Target: ATXN1; (-) strand; PAM type: NNGRRT; PAM sequence: CTGAGT
gctcaccacaatctttgctc

SEQ ID NO: 15544 - DNA, 20 bp, Artificial Sequence
  Description of Artificial Sequence: Synthetic oligonucleotide
  Target: ATXN1; (-) strand; PAM type: NNGRRT; PAM sequence: TGGAGT
ttcgctcttgttgcccaggc

SEQ ID NO: 15545 - DNA, 20 bp, Artificial Sequence
  Description of Artificial Sequence: Synthetic oligonucleotide
  Target: ATXN1; (-) strand; PAM type: NNGRRT; PAM sequence: CAGAGT
ttttttttttttttttgaga

SEQ ID NO: 15546 - DNA, 20 bp, Artificial Sequence
  Description of Artificial Sequence: Synthetic oligonucleotide
  Target: ATXN1; (-) strand; PAM type: NNGRRT; PAM sequence: GAGAAT
ttcaactcccacttatgagt

SEQ ID NO: 15547 - DNA, 20 bp, Artificial Sequence
  Description of Artificial Sequence: Synthetic oligonucleotide
  Target: ATXN1; (-) strand; PAM type: NNGRRT; PAM sequence: ATGAGT
tcatttttcaactcccactt

SEQ ID NO: 15548 - DNA, 20 bp, Artificial Sequence
  Description of Artificial Sequence: Synthetic oligonucleotide
  Target: ATXN1; (-) strand; PAM type: NNGRRT; PAM sequence: TGGGGT
atttattttactttaagttc

SEQ ID NO: 15549 - DNA, 20 bp, Artificial Sequence
  Description of Artificial Sequence: Synthetic oligonucleotide
  Target: ATXN1; (-) strand; PAM type: NNGRRT; PAM sequence: TAGGGT
taaaaccagtgaccacttgc

SEQ ID NO: 15550 - DNA, 20 bp, Artificial Sequence
  Description of Artificial Sequence: Synthetic oligonucleotide
  Target: ATXN1; (-) strand; PAM type: NNGRRT; PAM sequence: GAGGGT
agccacattgccagagctga

SEQ ID NO: 15551 - DNA, 20 bp, Artificial Sequence
  Description of Artificial Sequence: Synthetic oligonucleotide
  Target: ATXN1; (-) strand; PAM type: NNGRRT; PAM sequence: GAGGAT
tgtgggctgaatatgcagaa

SEQ ID NO: 15552 - DNA, 20 bp, Artificial Sequence
  Description of Artificial Sequence: Synthetic oligonucleotide
  Target: ATXN1; (-) strand; PAM type: NNGRRT; PAM sequence: CTGAAT
gaagaaggaacaagtgtggg

SEQ ID NO: 15553 - DNA, 20 bp, Artificial Sequence
  Description of Artificial Sequence: Synthetic oligonucleotide
  Target: ATXN1; (-) strand; PAM type: NNGRRT; PAM sequence: AGGGAT
cagattgtcccaaatataca

SEQ ID NO: 15554 - DNA, 20 bp, Artificial Sequence
  Description of Artificial Sequence: Synthetic oligonucleotide
  Target: ATXN1; (-) strand; PAM type: NNGRRT; PAM sequence: TAGGAT
tgtatttggattcccttttc

SEQ ID NO: 15555 - DNA, 20 bp, Artificial Sequence
  Description of Artificial Sequence: Synthetic oligonucleotide
  Target: ATXN1; (-) strand; PAM type: NNGRRT; PAM sequence: TTGGAT
agaaatagatcaaaatgtat

SEQ ID NO: 15556 - DNA, 20 bp, Artificial Sequence
  Description of Artificial Sequence: Synthetic oligonucleotide
  Target: ATXN1; (-) strand; PAM type: NNGRRT; PAM sequence: TAGGGT
ataattatgttactatttat

SEQ ID NO: 15557 - DNA, 20 bp, Artificial Sequence
  Description of Artificial Sequence: Synthetic oligonucleotide
  Target: ATXN1; (-) strand; PAM type: NNGRRT; PAM sequence: GGGAAT
cagtttcttttctataaatt

SEQ ID NO: 15558 - DNA, 20 bp, Artificial Sequence
  Description of Artificial Sequence: Synthetic oligonucleotide
  Target: ATXN1; (-) strand; PAM type: NNGRRT; PAM sequence: ATGAGT
agaacttgacattcgaagag

SEQ ID NO: 15559 - DNA, 20 bp, Artificial Sequence
  Description of Artificial Sequence: Synthetic oligonucleotide
  Target: ATXN1; (-) strand; PAM type: NNGRRT; PAM sequence: TGGAAT
ttggaaaatgttttcaaata

SEQ ID NO: 15560 - DNA, 20 bp, Artificial Sequence
  Description of Artificial Sequence: Synthetic oligonucleotide
  Target: ATXN1; (-) strand; PAM type: NNGRRT; PAM sequence: AGGAGT
atcatctgtaaaatggggct

SEQ ID NO: 15561 - DNA, 20 bp, Artificial Sequence
  Description of Artificial Sequence: Synthetic oligonucleotide
  Target: ATXN1; (-) strand; PAM type: NNGRRT; PAM sequence: TAGGAT
agccatactagtttttgaat

SEQ ID NO: 15562 - DNA, 20 bp, Artificial Sequence
  Description of Artificial Sequence: Synthetic oligonucleotide
  Target: ATXN1; (-) strand; PAM type: NNGRRT; PAM sequence: TTGAAT
ctgaaaagccatactagttt

SEQ ID NO: 15563 - DNA, 20 bp, Artificial Sequence
  Description of Artificial Sequence: Synthetic oligonucleotide
  Target: ATXN1; (-) strand; PAM type: NNGRRT; PAM sequence: TTGAAT
atgtctccaaggatgttagg

SEQ ID NO: 15564 - DNA, 20 bp, Artificial Sequence
  Description of Artificial Sequence: Synthetic oligonucleotide
  Target: ATXN1; (-) strand; PAM type: NNGRRT; PAM sequence: AAGGAT
atctccagtgttatgtctcc

SEQ ID NO: 15565 - DNA, 20 bp, Artificial Sequence
  Description of Artificial Sequence: Synthetic oligonucleotide
  Target: ATXN1; (-) strand; PAM type: NNGRRT; PAM sequence: TGGGAT
actggcctccttcacagcgc

SEQ ID NO: 15566 - DNA, 20 bp, Artificial Sequence
  Description of Artificial Sequence: Synthetic oligonucleotide
  Target: ATXN1; (-) strand; PAM type: NNGRRT; PAM sequence: AGGGAT
agcttcctttatgtgttcta

SEQ ID NO: 15567 - DNA, 20 bp, Artificial Sequence
  Description of Artificial Sequence: Synthetic oligonucleotide
  Target: ATXN1; (-) strand; PAM type: NNGRRT; PAM sequence: TAGAAT
caagtcttgtatgacttgcc

SEQ ID NO: 15568 - DNA, 20 bp, Artificial Sequence
  Description of Artificial Sequence: Synthetic oligonucleotide
  Target: ATXN1; (-) strand; PAM type: NNGRRT; PAM sequence: ATGAAT
agggaatgttggggcctgtc

SEQ ID NO: 15569 - DNA, 20 bp, Artificial Sequence
  Description of Artificial Sequence: Synthetic oligonucleotide
  Target: ATXN1; (-) strand; PAM type: NNGRRT; PAM sequence: GGGAAT
tcagatcgtgaaagaccaaa

SEQ ID NO: 15570 - DNA, 20 bp, Artificial Sequence
  Description of Artificial Sequence: Synthetic oligonucleotide
  Target: ATXN1; (-) strand; PAM type: NNGRRT; PAM sequence: ATGAAT
ccttctggaatctttctttc

SEQ ID NO: 15571 - DNA, 20 bp, Artificial Sequence
  Description of Artificial Sequence: Synthetic oligonucleotide
  Target: ATXN1; (-) strand; PAM type: NNGRRT; PAM sequence: TGGAAT
gctcagattccacttccttc

SEQ ID NO: 15572 - DNA, 20 bp, Artificial Sequence
  Description of Artificial Sequence: Synthetic oligonucleotide
  Target: ATXN1; (-) strand; PAM type: NNGRRT; PAM sequence: CAGAAT
cagaagtccctcagatttta

SEQ ID NO: 15573 - DNA, 20 bp, Artificial Sequence
  Description of Artificial Sequence: Synthetic oligonucleotide
  Target: ATXN1; (-) strand; PAM type: NNGRRT; PAM sequence: CAGAGT
agggctcgacttgtggattt

SEQ ID NO: 15574 - DNA, 20 bp, Artificial Sequence
  Description of Artificial Sequence: Synthetic oligonucleotide
  Target: ATXN1; (-) strand; PAM type: NNGRRT; PAM sequence: GTGGAT
gagaggtcagggctcgactt

SEQ ID NO: 15575 - DNA, 20 bp, Artificial Sequence
  Description of Artificial Sequence: Synthetic oligonucleotide
  Target: ATXN1; (-) strand; PAM type: NNGRRT; PAM sequence: CAGGAT
cccagctggaagcgccacag

SEQ ID NO: 15576 - DNA, 20 bp, Artificial Sequence
  Description of Artificial Sequence: Synthetic oligonucleotide
  Target: ATXN1; (-) strand; PAM type: NNGRRT; PAM sequence: TAGAAT
ttcagacccgtaacttctgc

SEQ ID NO: 15577 - DNA, 20 bp, Artificial Sequence
  Description of Artificial Sequence: Synthetic oligonucleotide
  Target: ATXN1; (-) strand; PAM type: NNGRRT; PAM sequence: TTGAAT
tcctctttttgctcttcctc

SEQ ID NO: 15578 - DNA, 20 bp, Artificial Sequence
  Description of Artificial Sequence: Synthetic oligonucleotide
  Target: ATXN1; (-) strand; PAM type: NNGRRT; PAM sequence: GAGAGT
attgagagcatgtgtccttg

SEQ ID NO: 15579 - DNA, 20 bp, Artificial Sequence
  Description of Artificial Sequence: Synthetic oligonucleotide
  Target: ATXN1; (-) strand; PAM type: NNGRRT; PAM sequence: CTGGGT
tgagtggcaagaaaaccatt

SEQ ID NO: 15580 - DNA, 20 bp, Artificial Sequence
  Description of Artificial Sequence: Synthetic oligonucleotide
  Target: ATXN1; (-) strand; PAM type: NNGRRT; PAM sequence: TTGAGT
tccacgtgtgagtagcatct

SEQ ID NO: 15581 - DNA, 20 bp, Artificial Sequence
  Description of Artificial Sequence: Synthetic oligonucleotide
  Target: ATXN1; (-) strand; PAM type: NNGRRT; PAM sequence: GTGAGT
tagagccagcctctccacgt

SEQ ID NO: 15582 - DNA, 20 bp, Artificial Sequence
  Description of Artificial Sequence: Synthetic oligonucleotide
  Target: ATXN1; (-) strand; PAM type: NNGRRT; PAM sequence: TAGGAT
gtttaaaatattgagcaatt

SEQ ID NO: 15583 - DNA, 20 bp, Artificial Sequence
  Description of Artificial Sequence: Synthetic oligonucleotide
  Target: ATXN1; (-) strand; PAM type: NNGRRT; PAM sequence: TAGAAT
tgagttggggtacagtggca

SEQ ID NO: 15584 - DNA, 20 bp, Artificial Sequence
  Description of Artificial Sequence: Synthetic oligonucleotide
  Target: ATXN1; (-) strand; PAM type: NNGRRT; PAM sequence: TGGGGT
ttagaaagacaagtgtgagt

SEQ ID NO: 15585 - DNA, 20 bp, Artificial Sequence
  Description of Artificial Sequence: Synthetic oligonucleotide
  Target: ATXN1; (-) strand; PAM type: NNGRRT; PAM sequence: GTGAGT
agctggttagaaagacaagt

SEQ ID NO: 15586 - DNA, 20 bp, Artificial Sequence
  Description of Artificial Sequence: Synthetic oligonucleotide
  Target: ATXN1; (-) strand; PAM type: NNGRRT; PAM sequence: TAGAGT
gatgacttgctcattagaca

SEQ ID NO: 15587 - DNA, 20 bp, Artificial Sequence
  Description of Artificial Sequence: Synthetic oligonucleotide
  Target: ATXN1; (-) strand; PAM type: NNGRRT; PAM sequence: AGGGAT
acatggcttcataaggattt

SEQ ID NO: 15588 - DNA, 20 bp, Artificial Sequence
  Description of Artificial Sequence: Synthetic oligonucleotide
  Target: ATXN1; (-) strand; PAM type: NNGRRT; PAM sequence: AAGGAT
tccccactacatggcttcat

SEQ ID NO: 15589 - DNA, 20 bp, Artificial Sequence
  Description of Artificial Sequence: Synthetic oligonucleotide
  Target: ATXN1; (-) strand; PAM type: NNGRRT; PAM sequence: TGGAGT
ctcctgttaaaggagtatct

SEQ ID NO: 15590 - DNA, 20 bp, Artificial Sequence
  Description of Artificial Sequence: Synthetic oligonucleotide
  Target: ATXN1; (-) strand; PAM type: NNGRRT; PAM sequence: AGGAGT
aatacctttactcctgttaa

SEQ ID NO: 15591 - DNA, 20 bp, Artificial Sequence
  Description of Artificial Sequence: Synthetic oligonucleotide
  Target: ATXN1; (-) strand; PAM type: NNGRRT; PAM sequence: GTGAAT
ccttattcaaaacacactgt

SEQ ID NO: 15592 - DNA, 20 bp, Artificial Sequence
  Description of Artificial Sequence: Synthetic oligonucleotide
  Target: ATXN1; (-) strand; PAM type: NNGRRT; PAM sequence: TGGAGT
tcttttataaatttagtgag

SEQ ID NO: 15593 - DNA, 20 bp, Artificial Sequence
  Description of Artificial Sequence: Synthetic oligonucleotide
  Target: ATXN1; (-) strand; PAM type: NNGRRT; PAM sequence: GTGAGT
gagtatcttttataaattta

SEQ ID NO: 15594 - DNA, 20 bp, Artificial Sequence
  Description of Artificial Sequence: Synthetic oligonucleotide
  Target: ATXN1; (-) strand; PAM type: NNGRRT; PAM sequence: TTGAGT
tgtgaaaagtgtgagtatct

SEQ ID NO: 15595 - DNA, 20 bp, Artificial Sequence
  Description of Artificial Sequence: Synthetic oligonucleotide
  Target: ATXN1; (-) strand; PAM type: NNGRRT; PAM sequence: GTGAGT
ggggtagacttgtgaaaagt

SEQ ID NO: 15596 - DNA, 20 bp, Artificial Sequence
  Description of Artificial Sequence: Synthetic oligonucleotide
  Target: ATXN1; (-) strand; PAM type: NNGRRT; PAM sequence: GGGGGT
gatgctggatgtgggcagat

SEQ ID NO: 15597 - DNA, 20 bp, Artificial Sequence
  Description of Artificial Sequence: Synthetic oligonucleotide
  Target: ATXN1; (-) strand; PAM type: NNGRRT; PAM sequence: CTGGAT
tgtcacagcgaagatagatg

SEQ ID NO: 15598 - DNA, 20 bp, Artificial Sequence
  Description of Artificial Sequence: Synthetic oligonucleotide
  Target: ATXN1; (-) strand; PAM type: NNGRRT; PAM sequence: GCGGAT
ccgccagtcaaggctgtaca

SEQ ID NO: 15599 - DNA, 20 bp, Artificial Sequence
  Description of Artificial Sequence: Synthetic oligonucleotide
  Target: ATXN1; (-) strand; PAM type: NNGRRT; PAM sequence: CAGAGT
gttaaacagatgtggaagcg

SEQ ID NO: 15600 - DNA, 20 bp, Artificial Sequence
  Description of Artificial Sequence: Synthetic oligonucleotide
  Target: ATXN1; (-) strand; PAM type: NNGRRT; PAM sequence: GTGAGT
gagtagaatttagtatgagt

SEQ ID NO: 15601 - DNA, 20 bp, Artificial Sequence
  Description of Artificial Sequence: Synthetic oligonucleotide
  Target: ATXN1; (-) strand; PAM type: NNGRRT; PAM sequence: ATGAGT
gctctggagtagaatttagt

SEQ ID NO: 15602 - DNA, 20 bp, Artificial Sequence
  Description of Artificial Sequence: Synthetic oligonucleotide
  Target: ATXN1; (-) strand; PAM type: NNGRRT; PAM sequence: TAGAAT
ccagccacgttgctctggag

SEQ ID NO: 15603 - DNA, 20 bp, Artificial Sequence
  Description of Artificial Sequence: Synthetic oligonucleotide
  Target: ATXN1; (-) strand; PAM type: NNGRRT; PAM sequence: TGGAGT
gaggcccagccacgttgctc

SEQ ID NO: 15604 - DNA, 20 bp, Artificial Sequence
  Description of Artificial Sequence: Synthetic oligonucleotide
  Target: ATXN1; (-) strand; PAM type: NNGRRT; PAM sequence: CGGAAT
gcgcatagcctgaacgaaag

SEQ ID NO: 15605 - DNA, 20 bp, Artificial Sequence
  Description of Artificial Sequence: Synthetic oligonucleotide
  Target: ATXN1; (-) strand; PAM type: NNGRRT; PAM sequence: CAGGGT
gccagctggaagggccatgg

SEQ ID NO: 15606 - DNA, 20 bp, Artificial Sequence
  Description of Artificial Sequence: Synthetic oligonucleotide
  Target: ATXN1; (-) strand; PAM type: NNGRRT; PAM sequence: TGGAAT
cctttgagtcatacagtatt

SEQ ID NO: 15607 - DNA, 20 bp, Artificial Sequence
  Description of Artificial Sequence: Synthetic oligonucleotide
  Target: ATXN1; (-) strand; PAM type: NNGRRT; PAM sequence: TTGAGT
ataagtgttcgagatagcct

SEQ ID NO: 15608 - DNA, 20 bp, Artificial Sequence
  Description of Artificial Sequence: Synthetic oligonucleotide
  Target: ATXN1; (-) strand; PAM type: NNGRRT; PAM sequence: TGGAGT
ctttaatctagaaggaaaaa

SEQ ID NO: 15609 - DNA, 20 bp, Artificial Sequence
  Description of Artificial Sequence: Synthetic oligonucleotide
  Target: ATXN1; (-) strand; PAM type: NNGRRT; PAM sequence: AGGGAT
gggtgaaataacgccatgaa

SEQ ID NO: 15610 - DNA, 20 bp, Artificial Sequence
  Description of Artificial Sequence: Synthetic oligonucleotide
  Target: ATXN1; (-) strand; PAM type: NNGRRT; PAM sequence: TGGGGT
agatctaccttagagaggtt

SEQ ID NO: 15611 - DNA, 20 bp, Artificial Sequence
  Description of Artificial Sequence: Synthetic oligonucleotide
  Target: ATXN1; (-) strand; PAM type: NNGRRT; PAM sequence: AAGAGT
gcaggacttccatgagggtc

SEQ ID NO: 15612 - DNA, 20 bp, Artificial Sequence
  Description of Artificial Sequence: Synthetic oligonucleotide
  Target: ATXN1; (-) strand; PAM type: NNGRRT; PAM sequence: GAGGGT
aggccatgcaggacttccat

SEQ ID NO: 15613 - DNA, 20 bp, Artificial Sequence
  Description of Artificial Sequence: Synthetic oligonucleotide
  Target: ATXN1; (-) strand; PAM type: NNGRRT; PAM sequence: TGGAGT
aaagtatggtggaagcatcc

SEQ ID NO: 15614 - DNA, 20 bp, Artificial Sequence
  Description of Artificial Sequence: Synthetic oligonucleotide
  Target: ATXN1; (-) strand; PAM type: NNGRRT; PAM sequence: GTGGAT
attatagttattataggaga

SEQ ID NO: 15615 - DNA, 20 bp, Artificial Sequence
  Description of Artificial Sequence: Synthetic oligonucleotide
  Target: ATXN1; (-) strand; PAM type: NNGRRT; PAM sequence: GAGAGT
ctacattatagttattatag

SEQ ID NO: 15616 - DNA, 20 bp, Artificial Sequence
  Description of Artificial Sequence: Synthetic oligonucleotide
  Target: ATXN1; (-) strand; PAM type: NNGRRT; PAM sequence: CAGAGT
agagtctgccatgtaccaag

SEQ ID NO: 15617 - DNA, 20 bp, Artificial Sequence
  Description of Artificial Sequence: Synthetic oligonucleotide
  Target: ATXN1; (-) strand; PAM type: NNGRRT; PAM sequence: GAGAGT
gtctgtcaactgatattttt

SEQ ID NO: 15618 - DNA, 20 bp, Artificial Sequence
  Description of Artificial Sequence: Synthetic oligonucleotide
  Target: ATXN1; (-) strand; PAM type: NNGRRT; PAM sequence: ACGGAT
aatagccattattcagaacc

SEQ ID NO: 15619 - DNA, 20 bp, Artificial Sequence
  Description of Artificial Sequence: Synthetic oligonucleotide
  Target: ATXN1; (-) strand; PAM type: NNGRRT; PAM sequence: GTGAGT
ggtatgcatgctggactggg

SEQ ID NO: 15620 - DNA, 20 bp, Artificial Sequence
  Description of Artificial Sequence: Synthetic oligonucleotide
  Target: ATXN1; (-) strand; PAM type: NNGRRT; PAM sequence: TGGGGT
cagtggtatgcatgctggac

SEQ ID NO: 15621 - DNA, 20 bp, Artificial Sequence
  Description of Artificial Sequence: Synthetic oligonucleotide
  Target: ATXN1; (-) strand; PAM type: NNGRRT; PAM sequence: AGGGAT
gggcgtgacacattcctagt

SEQ ID NO: 15622 - DNA, 20 bp, Artificial Sequence
  Description of Artificial Sequence: Synthetic oligonucleotide
  Target: ATXN1; (-) strand; PAM type: NNGRRT; PAM sequence: TTGGAT
ttaagattttttgaggcccc

SEQ ID NO: 15623 - DNA, 20 bp, Artificial Sequence
  Description of Artificial Sequence: Synthetic oligonucleotide
  Target: ATXN1; (-) strand; PAM type: NNGRRT; PAM sequence: AGGGAT
tcaaagatgtttatgtacaa

SEQ ID NO: 15624 - DNA, 20 bp, Artificial Sequence
  Description of Artificial Sequence: Synthetic oligonucleotide
  Target: ATXN1; (-) strand; PAM type: NNGRRT; PAM sequence: TGGAGT
attagtagattattcttgtg

SEQ ID NO: 15625 - DNA, 20 bp, Artificial Sequence
  Description of Artificial Sequence: Synthetic oligonucleotide
  Target: ATXN1; (-) strand; PAM type: NNGRRT; PAM sequence: ATGAAT
ttgccaggatcatcttttcc

SEQ ID NO: 15626 - DNA, 20 bp, Artificial Sequence
  Description of Artificial Sequence: Synthetic oligonucleotide
  Target: ATXN1; (-) strand; PAM type: NNGRRT; PAM sequence: CAGGAT
aacaaaagttattgttttgc

SEQ ID NO: 15627 - DNA, 20 bp, Artificial Sequence
  Description of Artificial Sequence: Synthetic oligonucleotide
  Target: ATXN1; (-) strand; PAM type: NNGRRT; PAM sequence: CAGGGT
ggaggaaatgagctctggcc

SEQ ID NO: 15628 - DNA, 20 bp, Artificial Sequence
  Description of Artificial Sequence: Synthetic oligonucleotide
  Target: ATXN1; (-) strand; PAM type: NNGRRT; PAM sequence: GTGGGT
gtgacagtaatgtctctcgg

SEQ ID NO: 15629 - DNA, 20 bp, Artificial Sequence
  Description of Artificial Sequence: Synthetic oligonucleotide
  Target: ATXN1; (-) strand; PAM type: NNGRRT; PAM sequence: TCGGGT
aaatgtgacagtaatgtctc

SEQ ID NO: 15630 - DNA, 20 bp, Artificial Sequence
  Description of Artificial Sequence: Synthetic oligonucleotide
  Target: ATXN1; (-) strand; PAM type: NNGRRT; PAM sequence: TTGAAT
ggctgaggcaggagaattgc

SEQ ID NO: 15631 - DNA, 20 bp, Artificial Sequence
  Description of Artificial Sequence: Synthetic oligonucleotide
  Target: ATXN1; (-) strand; PAM type: NNGRRT; PAM sequence: GAGAAT
tactcaggaggctgaggcag

SEQ ID NO: 15632 - DNA, 20 bp, Artificial Sequence
  Description of Artificial Sequence: Synthetic oligonucleotide
  Target: ATXN1; (-) strand; PAM type: NNGRRT; PAM sequence: AGGAGT
tgggtgcatcacctgaggtc

SEQ ID NO: 15633 - DNA, 20 bp, Artificial Sequence
  Description of Artificial Sequence: Synthetic oligonucleotide
  Target: ATXN1; (-) strand; PAM type: NNGRRT; PAM sequence: GTGGGT
cagcactttgggacgctgag

SEQ ID NO: 15634 - DNA, 20 bp, Artificial Sequence
  Description of Artificial Sequence: Synthetic oligonucleotide
  Target: ATXN1; (-) strand; PAM type: NNGRRT; PAM sequence: AGGAGT
cgggtgcatcacctgaggtc

SEQ ID NO: 15635 - DNA, 20 bp, Artificial Sequence
  Description of Artificial Sequence: Synthetic oligonucleotide
  Target: ATXN1; (-) strand; PAM type: NNGRRT; PAM sequence: GCGGGT
cagcactttgggaggctgag

SEQ ID NO: 15636 - DNA, 20 bp, Artificial Sequence
  Description of Artificial Sequence: Synthetic oligonucleotide
  Target: ATXN1; (-) strand; PAM type: NNGRRT; PAM sequence: GAGAGT
agactatagtcacgatgatg

SEQ ID NO: 15637 - DNA, 20 bp, Artificial Sequence
  Description of Artificial Sequence: Synthetic oligonucleotide
  Target: ATXN1; (-) strand; PAM type: NNGRRT; PAM sequence: TTGAGT
acagatgagccagcgtggga

SEQ ID NO: 15638 - DNA, 20 bp, Artificial Sequence
  Description of Artificial Sequence: Synthetic oligonucleotide
  Target: ATXN1; (-) strand; PAM type: NNGRRT; PAM sequence: TGGGAT
acaggacagatgagccagcg

SEQ ID NO: 15639 - DNA, 20 bp, Artificial Sequence
  Description of Artificial Sequence: Synthetic oligonucleotide
  Target: ATXN1; (-) strand; PAM type: NNGRRT; PAM sequence: GGGAGT
cagtcccagggtatgagatg

SEQ ID NO: 15640 - DNA, 20 bp, Artificial Sequence
  Description of Artificial Sequence: Synthetic oligonucleotide
  Target: ATXN1; (-) strand; PAM type: NNGRRT; PAM sequence: CAGGGT
agtagagcatggctcagtcc

SEQ ID NO: 15641 - DNA, 20 bp, Artificial Sequence
  Description of Artificial Sequence: Synthetic oligonucleotide
  Target: ATXN1; (-) strand; PAM type: NNGRRT; PAM sequence: AGGAAT
tttcaaaggcatgggtgtgg

SEQ ID NO: 15642 - DNA, 20 bp, Artificial Sequence
  Description of Artificial Sequence: Synthetic oligonucleotide
  Target: ATXN1; (-) strand; PAM type: NNGRRT; PAM sequence: ATGGGT
agggcagcattttcaaaggc

SEQ ID NO: 15643 - DNA, 20 bp, Artificial Sequence
  Description of Artificial Sequence: Synthetic oligonucleotide
  Target: ATXN1; (-) strand; PAM type: NNGRRT; PAM sequence: ATGGAT
cctccgagatgatggttgag

SEQ ID NO: 15644 - DNA, 20 bp, Artificial Sequence
  Description of Artificial Sequence: Synthetic oligonucleotide
  Target: ATXN1; (-) strand; PAM type: NNGRRT; PAM sequence: AGGAGT
cacatcaggaccaaggatga

SEQ ID NO: 15645 - DNA, 20 bp, Artificial Sequence
  Description of Artificial Sequence: Synthetic oligonucleotide
  Target: ATXN1; (-) strand; PAM type: NNGRRT; PAM sequence: AAGGAT
aagagtatcacatcaggacc

SEQ ID NO: 15646 - DNA, 20 bp, Artificial Sequence
  Description of Artificial Sequence: Synthetic oligonucleotide
  Target: ATXN1; (-) strand; PAM type: NNGRRT; PAM sequence: AAGAGT
cacaggaagcaagggatgga

SEQ ID NO: 15647 - DNA, 20 bp, Artificial Sequence
  Description of Artificial Sequence: Synthetic oligonucleotide
  Target: ATXN1; (-) strand; PAM type: NNGRRT; PAM sequence: AGGGAT
taagtggagcacaggaagca

SEQ ID NO: 15648 - DNA, 20 bp, Artificial Sequence
  Description of Artificial Sequence: Synthetic oligonucleotide
  Target: ATXN1; (-) strand; PAM type: NNGRRT; PAM sequence: TTGAGT
taggcgagtctgccttagtg

SEQ ID NO: 15649 - DNA, 20 bp, Artificial Sequence
  Description of Artificial Sequence: Synthetic oligonucleotide
  Target: ATXN1; (-) strand; PAM type: NNGRRT; PAM sequence: GCGAGT
gctctgggtgggtgtcttag

SEQ ID NO: 15650 - DNA, 20 bp, Artificial Sequence
  Description of Artificial Sequence: Synthetic oligonucleotide
  Target: ATXN1; (-) strand; PAM type: NNGRRT; PAM sequence: GTGGGT
taggaaccactgggctctgg

SEQ ID NO: 15651 - DNA, 20 bp, Artificial Sequence
  Description of Artificial Sequence: Synthetic oligonucleotide
  Target: ATXN1; (-) strand; PAM type: NNGRRT; PAM sequence: CTGGGT
attgtaggaaccactgggct

SEQ ID NO: 15652 - DNA, 20 bp, Artificial Sequence
  Description of Artificial Sequence: Synthetic oligonucleotide
  Target: ATXN1; (-) strand; PAM type: NNGRRT; PAM sequence: AGGAGT
gtgttgtggtcataaacaaa

SEQ ID NO: 15653 - DNA, 20 bp, Artificial Sequence
  Description of Artificial Sequence: Synthetic oligonucleotide
  Target: ATXN1; (-) strand; PAM type: NNGRRT; PAM sequence: CAGAGT
tgttggaaacatctaacata

SEQ ID NO: 15654 - DNA, 20 bp, Artificial Sequence
  Description of Artificial Sequence: Synthetic oligonucleotide
  Target: ATXN1; (-) strand; PAM type: NNGRRT; PAM sequence: AAGAAT
gatggtgccattaaagaaaa

SEQ ID NO: 15655 - DNA, 20 bp, Artificial Sequence
  Description of Artificial Sequence: Synthetic oligonucleotide
  Target: ATXN1; (-) strand; PAM type: NNGRRT; PAM sequence: AAGAAT
tgagaaaccacaagaggaaa

SEQ ID NO: 15656 - DNA, 20 bp, Artificial Sequence
  Description of Artificial Sequence: Synthetic oligonucleotide
  Target: ATXN1; (-) strand; PAM type: NNGRRT; PAM sequence: CAGAGT
gtaagcaaaagataataata

SEQ ID NO: 15657 - DNA, 20 bp, Artificial Sequence
  Description of Artificial Sequence: Synthetic oligonucleotide
  Target: ATXN1; (-) strand; PAM type: NNGRRT; PAM sequence: AAGAGT
aattgtcaaccaaaatgata

SEQ ID NO: 15658 - DNA, 20 bp, Artificial Sequence
  Description of Artificial Sequence: Synthetic oligonucleotide
  Target: ATXN1; (-) strand; PAM type: NNGRRT; PAM sequence: TAGGGT
cctgataaaccaaatattac

SEQ ID NO: 15659 - DNA, 20 bp, Artificial Sequence
  Description of Artificial Sequence: Synthetic oligonucleotide
  Target: ATXN1; (-) strand; PAM type: NNGRRT; PAM sequence: TGGGAT
aaggaagaaaggtggaagaa

SEQ ID NO: 15660 - DNA, 20 bp, Artificial Sequence
  Description of Artificial Sequence: Synthetic oligonucleotide
  Target: ATXN1; (-) strand; PAM type: NNGRRT; PAM sequence: AAGAAT
gagaaaaggaagaaaggtgg

SEQ ID NO: 15661 - DNA, 20 bp, Artificial Sequence
  Description of Artificial Sequence: Synthetic oligonucleotide
  Target: ATXN1; (-) strand; PAM type: NNGRRT; PAM sequence: AGGAAT
taaaaagactaagaagctat

SEQ ID NO: 15662 - DNA, 20 bp, Artificial Sequence
  Description of Artificial Sequence: Synthetic oligonucleotide
  Target: ATXN1; (-) strand; PAM type: NNGRRT; PAM sequence: ATGAGT
accagcattgacaggagttt

SEQ ID NO: 15663 - DNA, 20 bp, Artificial Sequence
  Description of Artificial Sequence: Synthetic oligonucleotide
  Target: ATXN1; (-) strand; PAM type: NNGRRT; PAM sequence: AGGAGT
tttttcttaccagcattgac

SEQ ID NO: 15664 - DNA, 20 bp, Artificial Sequence
  Description of Artificial Sequence: Synthetic oligonucleotide
  Target: ATXN1; (-) strand; PAM type: NNGRRT; PAM sequence: CGGAAT
tttggaaatgctgaatctga

SEQ ID NO: 15665 - DNA, 20 bp, Artificial Sequence
  Description of Artificial Sequence: Synthetic oligonucleotide
  Target: ATXN1; (-) strand; PAM type: NNGRRT; PAM sequence: CTGAAT
tagaaaacgttttggaaatg

SEQ ID NO: 15666 - DNA, 20 bp, Artificial Sequence
  Description of Artificial Sequence: Synthetic oligonucleotide
  Target: ATXN1; (-) strand; PAM type: NNGRRT; PAM sequence: ATGAGT
gcgtttgtagggcttttata

SEQ ID NO: 15667 - DNA, 20 bp, Artificial Sequence
  Description of Artificial Sequence: Synthetic oligonucleotide
  Target: ATXN1; (-) strand; PAM type: NNGRRT; PAM sequence: TGGGGT
attaacagtgagcctgcctt

SEQ ID NO: 15668 - DNA, 20 bp, Artificial Sequence
  Description of Artificial Sequence: Synthetic oligonucleotide
  Target: ATXN1; (-) strand; PAM type: NNGRRT; PAM sequence: TGGGAT
catgttgttcctatttttaa

SEQ ID NO: 15669 - DNA, 20 bp, Artificial Sequence
  Description of Artificial Sequence: Synthetic oligonucleotide
  Target: ATXN1; (-) strand; PAM type: NNGRRT; PAM sequence: CAGAAT
cttttgtttcagttacccta

SEQ ID NO: 15670 - DNA, 20 bp, Artificial Sequence
  Description of Artificial Sequence: Synthetic oligonucleotide
  Target: ATXN1; (-) strand; PAM type: NNGRRT; PAM sequence: TGGGAT
tttttgttgttatttaaata

SEQ ID NO: 15671 - DNA, 20 bp, Artificial Sequence
  Description of Artificial Sequence: Synthetic oligonucleotide
  Target: ATXN1; (-) strand; PAM type: NNGRRT; PAM sequence: TGGAAT
acctcgccctcccaaagtgc

SEQ ID NO: 15672 - DNA, 20 bp, Artificial Sequence
  Description of Artificial Sequence: Synthetic oligonucleotide
  Target: ATXN1; (-) strand; PAM type: NNGRRT; PAM sequence: TGGGGT
ttttttttttttttttgaaa

SEQ ID NO: 15673 - DNA, 20 bp, Artificial Sequence
  Description of Artificial Sequence: Synthetic oligonucleotide
  Target: ATXN1; (-) strand; PAM type: NNGRRT; PAM sequence: AAGAAT
agtttatagataaatataga

SEQ ID NO: 15674 - DNA, 20 bp, Artificial Sequence
  Description of Artificial Sequence: Synthetic oligonucleotide
  Target: ATXN1; (-) strand; PAM type: NNGRRT; PAM sequence: CAGAAT
ttatttttccataggaactt

SEQ ID NO: 15675 - DNA, 20 bp, Artificial Sequence
  Description of Artificial Sequence: Synthetic oligonucleotide
  Target: ATXN1; (-) strand; PAM type: NNGRRT; PAM sequence: TTGGAT
cactgaagtccagtattcat

SEQ ID NO: 15676 - DNA, 20 bp, Artificial Sequence
  Description of Artificial Sequence: Synthetic oligonucleotide
  Target: ATXN1; (-) strand; PAM type: NNGRRT; PAM sequence: AGGGAT
tttagtgcaggatgtgaatt

SEQ ID NO: 15677 - DNA, 20 bp, Artificial Sequence
  Description of Artificial Sequence: Synthetic oligonucleotide
  Target: ATXN1; (-) strand; PAM type: NNGRRT; PAM sequence: GTGAAT
gatttattttagtgcaggat

SEQ ID NO: 15678 - DNA, 20 bp, Artificial Sequence
  Description of Artificial Sequence: Synthetic oligonucleotide
  Target: ATXN1; (-) strand; PAM type: NNGRRT; PAM sequence: CAGGAT
ccttgggatttattttagtg

SEQ ID NO: 15679 - DNA, 20 bp, Artificial Sequence
  Description of Artificial Sequence: Synthetic oligonucleotide
  Target: ATXN1; (-) strand; PAM type: NNGRRT; PAM sequence: TGGGAT
gttcaaatctttggtcacct

SEQ ID NO: 15680 - DNA, 20 bp, Artificial Sequence
  Description of Artificial Sequence: Synthetic oligonucleotide
  Target: ATXN1; (-) strand; PAM type: NNGRRT; PAM sequence: ATGGAT
ttaatctatgttttatctct

SEQ ID NO: 15681 - DNA, 20 bp, Artificial Sequence
  Description of Artificial Sequence: Synthetic oligonucleotide
  Target: ATXN1; (-) strand; PAM type: NNGRRT; PAM sequence: TAGAAT
atgggtttttaatctattca

SEQ ID NO: 15682 - DNA, 20 bp, Artificial Sequence
  Description of Artificial Sequence: Synthetic oligonucleotide
  Target: ATXN1; (-) strand; PAM type: NNGRRT; PAM sequence: ATGGGT
acaatgcagtcttttaataa

SEQ ID NO: 15683 - DNA, 20 bp, Artificial Sequence
  Description of Artificial Sequence: Synthetic oligonucleotide
  Target: ATXN1; (-) strand; PAM type: NNGRRT; PAM sequence: TAGGAT
gccttagccttctaaagtgc

SEQ ID NO: 15684 - DNA, 20 bp, Artificial Sequence
  Description of Artificial Sequence: Synthetic oligonucleotide
  Target: ATXN1; (-) strand; PAM type: NNGRRT; PAM sequence: TGGAGT
tctcgctctgtcacccaggc

SEQ ID NO: 15685 - DNA, 20 bp, Artificial Sequence
  Description of Artificial Sequence: Synthetic oligonucleotide
  Target: ATXN1; (-) strand; PAM type: NNGRRT; PAM sequence: CAGGAT
ttttttttttttttttgaca

SEQ ID NO: 15686 - DNA, 20 bp, Artificial Sequence
  Description of Artificial Sequence: Synthetic oligonucleotide
  Target: ATXN1; (-) strand; PAM type: NNGRRT; PAM sequence: CAGAGT
ctacactccagcctgggtga

SEQ ID NO: 15687 - DNA, 20 bp, Artificial Sequence
  Description of Artificial Sequence: Synthetic oligonucleotide
  Target: ATXN1; (-) strand; PAM type: NNGRRT; PAM sequence: CTGGGT
tcgtgctactacactccagc

SEQ ID NO: 15688 - DNA, 20 bp, Artificial Sequence
  Description of Artificial Sequence: Synthetic oligonucleotide
  Target: ATXN1; (-) strand; PAM type: NNGRRT; PAM sequence: GTGAGT
cccaggagtttgagactgca

SEQ ID NO: 15689 - DNA, 20 bp, Artificial Sequence
  Description of Artificial Sequence: Synthetic oligonucleotide
  Target: ATXN1; (-) strand; PAM type: NNGRRT; PAM sequence: AGGAGT
tggaaggattgtttgagccc

SEQ ID NO: 15690 - DNA, 20 bp, Artificial Sequence
  Description of Artificial Sequence: Synthetic oligonucleotide
  Target: ATXN1; (-) strand; PAM type: NNGRRT; PAM sequence: AAGGAT
tactcgggaggctgaggtgg

SEQ ID NO: 15691 - DNA, 20 bp, Artificial Sequence
  Description of Artificial Sequence: Synthetic oligonucleotide
  Target: ATXN1; (-) strand; PAM type: NNGRRT; PAM sequence: AGGAGT
cgagagcatcacttgaggcc

SEQ ID NO: 15692 - DNA, 20 bp, Artificial Sequence
  Description of Artificial Sequence: Synthetic oligonucleotide
  Target: ATXN1; (-) strand; PAM type: NNGRRT; PAM sequence: CAGGGT
gactttatgttttcttcatg

SEQ ID NO: 15693 - DNA, 20 bp, Artificial Sequence
  Description of Artificial Sequence: Synthetic oligonucleotide
  Target: ATXN1; (-) strand; PAM type: NNGRRT; PAM sequence: GTGAAT
ctacgtttttggtttatcct

SEQ ID NO: 15694 - DNA, 20 bp, Artificial Sequence
  Description of Artificial Sequence: Synthetic oligonucleotide
  Target: ATXN1; (-) strand; PAM type: NNGRRT; PAM sequence: TTGAAT
ttctgttattatagtggtgg

SEQ ID NO: 15695 - DNA, 20 bp, Artificial Sequence
  Description of Artificial Sequence: Synthetic oligonucleotide
  Target: ATXN1; (-) strand; PAM type: NNGRRT; PAM sequence: ATGGGT
tatattctagtagctttaat

SEQ ID NO: 15696 - DNA, 20 bp, Artificial Sequence
  Description of Artificial Sequence: Synthetic oligonucleotide
  Target: ATXN1; (-) strand; PAM type: NNGRRT; PAM sequence: TTGAGT
tatgttcctgctagcactgt

SEQ ID NO: 15697 - DNA, 20 bp, Artificial Sequence
  Description of Artificial Sequence: Synthetic oligonucleotide
  Target: ATXN1; (-) strand; PAM type: NNGRRT; PAM sequence: AGGAAT
aggggaattgttggatcaaa

SEQ ID NO: 15698 - DNA, 20 bp, Artificial Sequence
  Description of Artificial Sequence: Synthetic oligonucleotide
  Target: ATXN1; (-) strand; PAM type: NNGRRT; PAM sequence: TTGGAT
aaattactaaaggggaattg

SEQ ID NO: 15699 - DNA, 20 bp, Artificial Sequence
  Description of Artificial Sequence: Synthetic oligonucleotide
  Target: ATXN1; (-) strand; PAM type: NNGRRT; PAM sequence: GGGAAT
tggaggagaaattactaaag

SEQ ID NO: 15700 - DNA, 20 bp, Artificial Sequence
  Description of Artificial Sequence: Synthetic oligonucleotide
  Target: ATXN1; (-) strand; PAM type: NNGRRT; PAM sequence: AAGGAT
atagcatgttgtatgtcagc

SEQ ID NO: 15701 - DNA, 20 bp, Artificial Sequence
  Description of Artificial Sequence: Synthetic oligonucleotide
  Target: ATXN1; (-) strand; PAM type: NNGRRT; PAM sequence: AAGGAT
attttcttgtgagtcctttt

SEQ ID NO: 15702 - DNA, 20 bp, Artificial Sequence
  Description of Artificial Sequence: Synthetic oligonucleotide
  Target: ATXN1; (-) strand; PAM type: NNGRRT; PAM sequence: GTGAGT
agtaccattatcattttctt

SEQ ID NO: 15703 - DNA, 20 bp, Artificial Sequence
  Description of Artificial Sequence: Synthetic oligonucleotide
  Target: ATXN1; (-) strand; PAM type: NNGRRT; PAM sequence: TTGAAT
tatttctgtgtctaagtcac

SEQ ID NO: 15704 - DNA, 20 bp, Artificial Sequence
  Description of Artificial Sequence: Synthetic oligonucleotide
  Target: ATXN1; (-) strand; PAM type: NNGRRT; PAM sequence: TTGAAT
tttgaagcattaatattgtt

SEQ ID NO: 15705 - DNA, 20 bp, Artificial Sequence
  Description of Artificial Sequence: Synthetic oligonucleotide
  Target: ATXN1; (-) strand; PAM type: NNGRRT; PAM sequence: GAGGGT
tttcctgggcagtcaatttt

SEQ ID NO: 15706 - DNA, 20 bp, Artificial Sequence
  Description of Artificial Sequence: Synthetic oligonucleotide
  Target: ATXN1; (-) strand; PAM type: NNGRRT; PAM sequence: TGGGGT
ggtcccgtctcctgtgatgg

SEQ ID NO: 15707 - DNA, 20 bp, Artificial Sequence
  Description of Artificial Sequence: Synthetic oligonucleotide
  Target: ATXN1; (-) strand; PAM type: NNGRRT; PAM sequence: TTGAAT
atttgaatggattatgaaga

SEQ ID NO: 15708 - DNA, 20 bp, Artificial Sequence
  Description of Artificial Sequence: Synthetic oligonucleotide
  Target: ATXN1; (-) strand; PAM type: NNGRRT; PAM sequence: ATGGAT
acaacagagggcaaatttga

SEQ ID NO: 15709 - DNA, 20 bp, Artificial Sequence
  Description of Artificial Sequence: Synthetic oligonucleotide
  Target: ATXN1; (-) strand; PAM type: NNGRRT; PAM sequence: TTGAAT
agctacaacagagggcaaat

SEQ ID NO: 15710 - DNA, 20 bp, Artificial Sequence
  Description of Artificial Sequence: Synthetic oligonucleotide
  Target: ATXN1; (-) strand; PAM type: NNGRRT; PAM sequence: GAGGAT
ggtctttttctttgcatcct

SEQ ID NO: 15711 - DNA, 20 bp, Artificial Sequence
  Description of Artificial Sequence: Synthetic oligonucleotide
  Target: ATXN1; (-) strand; PAM type: NNGRRT; PAM sequence: CAGAAT
gacctaaaaattcagctacg

SEQ ID NO: 15712 - DNA, 20 bp, Artificial Sequence
  Description of Artificial Sequence: Synthetic oligonucleotide
  Target: ATXN1; (-) strand; PAM type: NNGRRT; PAM sequence: CGGGGT
ttttgtatttttagtagaga

SEQ ID NO: 15713 - DNA, 20 bp, Artificial Sequence
  Description of Artificial Sequence: Synthetic oligonucleotide
  Target: ATXN1; (-) strand; PAM type: NNGRRT; PAM sequence: TGGGAT
gcctcagcctcccgagtagc

SEQ ID NO: 15714 - DNA, 20 bp, Artificial Sequence
  Description of Artificial Sequence: Synthetic oligonucleotide
  Target: ATXN1; (-) strand; PAM type: NNGRRT; PAM sequence: CCGAGT
gattctcctgcctcagcctc

SEQ ID NO: 15715 - DNA, 20 bp, Artificial Sequence
  Description of Artificial Sequence: Synthetic oligonucleotide
  Target: ATXN1; (-) strand; PAM type: NNGRRT; PAM sequence: TGGAGT
ttcgctcttgctatccaaac

SEQ ID NO: 15716 - DNA, 20 bp, Artificial Sequence
  Description of Artificial Sequence: Synthetic oligonucleotide
  Target: ATXN1; (-) strand; PAM type: NNGRRT; PAM sequence: TGGAGT
ttttatttttatttttgagg

SEQ ID NO: 15717 - DNA, 20 bp, Artificial Sequence
  Description of Artificial Sequence: Synthetic oligonucleotide
  Target: ATXN1; (-) strand; PAM type: NNGRRT; PAM sequence: AGGAAT
ctttagaacaagcatattaa

SEQ ID NO: 15718 - DNA, 20 bp, Artificial Sequence
  Description of Artificial Sequence: Synthetic oligonucleotide
  Target: ATXN1; (-) strand; PAM type: NNGRRT; PAM sequence: ACGGGT
ctcttctaacctcctccaag

SEQ ID NO: 15719 - DNA, 20 bp, Artificial Sequence
  Description of Artificial Sequence: Synthetic oligonucleotide
  Target: ATXN1; (-) strand; PAM type: NNGRRT; PAM sequence: TGGAGT
ggtagaatgagaagcttcat

SEQ ID NO: 15720 - DNA, 20 bp, Artificial Sequence
  Description of Artificial Sequence: Synthetic oligonucleotide
  Target: ATXN1; (-) strand; PAM type: NNGRRT; PAM sequence: TAGAAT
aagaatctctgcaggagtgg

SEQ ID NO: 15721 - DNA, 20 bp, Artificial Sequence
  Description of Artificial Sequence: Synthetic oligonucleotide
  Target: ATXN1; (-) strand; PAM type: NNGRRT; PAM sequence: AGGAGT
tttgctacaagaatctctgc

SEQ ID NO: 15722 - DNA, 20 bp, Artificial Sequence
  Description of Artificial Sequence: Synthetic oligonucleotide
  Target: ATXN1; (-) strand; PAM type: NNGRRT; PAM sequence: AAGAAT
aaaacccagggatttgctac

SEQ ID NO: 15723 - DNA, 20 bp, Artificial Sequence
  Description of Artificial Sequence: Synthetic oligonucleotide
  Target: ATXN1; (-) strand; PAM type: NNGRRT; PAM sequence: AGGGAT
acaggcaaggtgaaaaaccc

SEQ ID NO: 15724 - DNA, 20 bp, Artificial Sequence
  Description of Artificial Sequence: Synthetic oligonucleotide
  Target: ATXN1; (-) strand; PAM type: NNGRRT; PAM sequence: GGGAAT
gatgctgaatgtgtcttcaa

SEQ ID NO: 15725 - DNA, 20 bp, Artificial Sequence
  Description of Artificial Sequence: Synthetic oligonucleotide
  Target: ATXN1; (-) strand; PAM type: NNGRRT; PAM sequence: CTGAAT
ttaccacctcttttgtgatg

SEQ ID NO: 15726 - DNA, 20 bp, Artificial Sequence
  Description of Artificial Sequence: Synthetic oligonucleotide
  Target: ATXN1; (-) strand; PAM type: NNGRRT; PAM sequence: GTGAAT
aaataaagttgggattacct

SEQ ID NO: 15727 - DNA, 20 bp, Artificial Sequence
  Description of Artificial Sequence: Synthetic oligonucleotide
  Target: ATXN1; (-) strand; PAM type: NNGRRT; PAM sequence: TGGGAT
atgtttgactaaaataaagt

SEQ ID NO: 15728 - DNA, 20 bp, Artificial Sequence
  Description of Artificial Sequence: Synthetic oligonucleotide
  Target: ATXN1; (-) strand; PAM type: NNGRRT; PAM sequence: TAGAAT
ggtaggaagcctgactttta

SEQ ID NO: 15729 - DNA, 20 bp, Artificial Sequence
  Description of Artificial Sequence: Synthetic oligonucleotide
  Target: ATXN1; (-) strand; PAM type: NNGRRT; PAM sequence: CTGGGT
gaaatttttccgaaggtcat

SEQ ID NO: 15730 - DNA, 20 bp, Artificial Sequence
  Description of Artificial Sequence: Synthetic oligonucleotide
  Target: ATXN1; (-) strand; PAM type: NNGRRT; PAM sequence: AGGGAT
tactggatacccaaggcatc

SEQ ID NO: 15731 - DNA, 20 bp, Artificial Sequence
  Description of Artificial Sequence: Synthetic oligonucleotide
  Target: ATXN1; (-) strand; PAM type: NNGRRT; PAM sequence: CTGGAT
tgtatcagatatactgcata

SEQ ID NO: 15732 - DNA, 20 bp, Artificial Sequence
  Description of Artificial Sequence: Synthetic oligonucleotide
  Target: ATXN1; (-) strand; PAM type: NNGRRT; PAM sequence: ATGGAT
atacagcccagaatgaactc

SEQ ID NO: 15733 - DNA, 20 bp, Artificial Sequence
  Description of Artificial Sequence: Synthetic oligonucleotide
  Target: ATXN1; (-) strand; PAM type: NNGRRT; PAM sequence: CAGAAT
tatggcatcactatacagcc

SEQ ID NO: 15734 - DNA, 20 bp, Artificial Sequence
  Description of Artificial Sequence: Synthetic oligonucleotide
  Target: ATXN1; (-) strand; PAM type: NNGRRT; PAM sequence: ATGAGT
ctcaagcttggaaaatagca

SEQ ID NO: 15735 - DNA, 20 bp, Artificial Sequence
  Description of Artificial Sequence: Synthetic oligonucleotide
  Target: ATXN1; (-) strand; PAM type: NNGRRT; PAM sequence: GAGGGT
ctgtggagaggtgggtggga

SEQ ID NO: 15736 - DNA, 20 bp, Artificial Sequence
  Description of Artificial Sequence: Synthetic oligonucleotide
  Target: ATXN1; (-) strand; PAM type: NNGRRT; PAM sequence: GTGGGT
caaaatgtatctgtggagag

SEQ ID NO: 15737 - DNA, 20 bp, Artificial Sequence
  Description of Artificial Sequence: Synthetic oligonucleotide
  Target: ATXN1; (-) strand; PAM type: NNGRRT; PAM sequence: GTGAAT
ggctctatgggaacttgttg

SEQ ID NO: 15738 - DNA, 20 bp, Artificial Sequence
  Description of Artificial Sequence: Synthetic oligonucleotide
  Target: ATXN1; (-) strand; PAM type: NNGRRT; PAM sequence: AGGAGT
gtcaatgtttgctaaatgaa

SEQ ID NO: 15739 - DNA, 20 bp, Artificial Sequence
  Description of Artificial Sequence: Synthetic oligonucleotide
  Target: ATXN1; (-) strand; PAM type: NNGRRT; PAM sequence: GAGAAT
tactcatgagacagtatatt

SEQ ID NO: 15740 - DNA, 20 bp, Artificial Sequence
  Description of Artificial Sequence: Synthetic oligonucleotide
  Target: ATXN1; (-) strand; PAM type: NNGRRT; PAM sequence: TAGGAT
catctctggtttctttcacc

SEQ ID NO: 15741 - DNA, 20 bp, Artificial Sequence
  Description of Artificial Sequence: Synthetic oligonucleotide
  Target: ATXN1; (-) strand; PAM type: NNGRRT; PAM sequence: GGGAGT
ttacatcttccaggtcctga

SEQ ID NO: 15742 - DNA, 20 bp, Artificial Sequence
  Description of Artificial Sequence: Synthetic oligonucleotide
  Target: ATXN1; (-) strand; PAM type: NNGRRT; PAM sequence: TGGGAT
gcctcggcctcccaaagtgc

SEQ ID NO: 15743 - DNA, 20 bp, Artificial Sequence
  Description of Artificial Sequence: Synthetic oligonucleotide
  Target: ATXN1; (-) strand; PAM type: NNGRRT; PAM sequence: CAGGGT
ttttgtattttttgtagagg

SEQ ID NO: 15744 - DNA, 20 bp, Artificial Sequence
  Description of Artificial Sequence: Synthetic oligonucleotide
  Target: ATXN1; (-) strand; PAM type: NNGRRT; PAM sequence: TGGGGT
ttgcccaggctggagtacag

SEQ ID NO: 15745 - DNA, 20 bp, Artificial Sequence
  Description of Artificial Sequence: Synthetic oligonucleotide
  Target: ATXN1; (-) strand; PAM type: NNGRRT; PAM sequence: TGGAGT
tctagctctgttgcccaggc

SEQ ID NO: 15746 - DNA, 20 bp, Artificial Sequence
  Description of Artificial Sequence: Synthetic oligonucleotide
  Target: ATXN1; (-) strand; PAM type: NNGRRT; PAM sequence: ATGAAT
caaaaccttctcttcagtct

SEQ ID NO: 15747 - DNA, 20 bp, Artificial Sequence
  Description of Artificial Sequence: Synthetic oligonucleotide
  Target: ATXN1; (-) strand; PAM type: NNGRRT; PAM sequence: CTGGAT
gctccaagacccctcgtttt

SEQ ID NO: 15748 - DNA, 20 bp, Artificial Sequence
  Description of Artificial Sequence: Synthetic oligonucleotide
  Target: ATXN1; (-) strand; PAM type: NNGRRT; PAM sequence: ATGAAT
aaatcttgaagaatccaggc

SEQ ID NO: 15749 - DNA, 20 bp, Artificial Sequence
  Description of Artificial Sequence: Synthetic oligonucleotide
  Target: ATXN1; (-) strand; PAM type: NNGRRT; PAM sequence: AAGAAT
cttgcttttttaaaatcttg

SEQ ID NO: 15750 - DNA, 20 bp, Artificial Sequence
  Description of Artificial Sequence: Synthetic oligonucleotide
  Target: ATXN1; (-) strand; PAM type: NNGRRT; PAM sequence: TGGGAT
gctcatagtcacatttctta

SEQ ID NO: 15751 - DNA, 20 bp, Artificial Sequence
  Description of Artificial Sequence: Synthetic oligonucleotide
  Target: ATXN1; (-) strand; PAM type: NNGRRT; PAM sequence: GAGAGT
attcttactgttaatctgag

SEQ ID NO: 15752 - DNA, 20 bp, Artificial Sequence
  Description of Artificial Sequence: Synthetic oligonucleotide
  Target: ATXN1; (-) strand; PAM type: NNGRRT; PAM sequence: ATGGGT
gaggcccccaaacccaactg

SEQ ID NO: 15753 - DNA, 20 bp, Artificial Sequence
  Description of Artificial Sequence: Synthetic oligonucleotide
  Target: ATXN1; (-) strand; PAM type: NNGRRT; PAM sequence: CTGAGT
atgaaatacttcctctgtgt

SEQ ID NO: 15754 - DNA, 20 bp, Artificial Sequence
  Description of Artificial Sequence: Synthetic oligonucleotide
  Target: ATXN1; (-) strand; PAM type: NNGRRT; PAM sequence: AGGAAT
caattgtatcctaaaaagta

SEQ ID NO: 15755 - DNA, 20 bp, Artificial Sequence
  Description of Artificial Sequence: Synthetic oligonucleotide
  Target: ATXN1; (-) strand; PAM type: NNGRRT; PAM sequence: GAGAAT
atacacctgttgaaatctta

SEQ ID NO: 15756 - DNA, 20 bp, Artificial Sequence
  Description of Artificial Sequence: Synthetic oligonucleotide
  Target: ATXN1; (-) strand; PAM type: NNGRRT; PAM sequence: TGGGAT
agctgaaaaggtagaagagc

SEQ ID NO: 15757 - DNA, 20 bp, Artificial Sequence
  Description of Artificial Sequence: Synthetic oligonucleotide
  Target: ATXN1; (-) strand; PAM type: NNGRRT; PAM sequence: ATGAAT
tcaaccaacttttgctaagt

SEQ ID NO: 15758 - DNA, 20 bp, Artificial Sequence
  Description of Artificial Sequence: Synthetic oligonucleotide
  Target: ATXN1; (-) strand; PAM type: NNGRRT; PAM sequence: AAGAAT
gaacatagttgtagaagggt

SEQ ID NO: 15759 - DNA, 20 bp, Artificial Sequence
  Description of Artificial Sequence: Synthetic oligonucleotide
  Target: ATXN1; (-) strand; PAM type: NNGRRT; PAM sequence: AAGGGT
tcttgagaacatagttgtag

SEQ ID NO: 15760 - DNA, 20 bp, Artificial Sequence
  Description of Artificial Sequence: Synthetic oligonucleotide
  Target: ATXN1; (-) strand; PAM type: NNGRRT; PAM sequence: TTGGGT
atttatcagttgatggacat

SEQ ID NO: 15761 - DNA, 20 bp, Artificial Sequence
  Description of Artificial Sequence: Synthetic oligonucleotide
  Target: ATXN1; (-) strand; PAM type: NNGRRT; PAM sequence: TGGAAT
tcattcatttcttgttatga

SEQ ID NO: 15762 - DNA, 20 bp, Artificial Sequence
  Description of Artificial Sequence: Synthetic oligonucleotide
  Target: ATXN1; (-) strand; PAM type: NNGRRT; PAM sequence: AAGGAT
tcacttagcataatgctttc

SEQ ID NO: 15763 - DNA, 20 bp, Artificial Sequence
  Description of Artificial Sequence: Synthetic oligonucleotide
  Target: ATXN1; (-) strand; PAM type: NNGRRT; PAM sequence: TAGAAT
ttctagacattccatataaa

SEQ ID NO: 15764 - DNA, 20 bp, Artificial Sequence
  Description of Artificial Sequence: Synthetic oligonucleotide
  Target: ATXN1; (-) strand; PAM type: NNGRRT; PAM sequence: ATGAAT
aaattaaaaaaaaaagtgca

SEQ ID NO: 15765 - DNA, 20 bp, Artificial Sequence
  Description of Artificial Sequence: Synthetic oligonucleotide
  Target: ATXN1; (-) strand; PAM type: NNGRRT; PAM sequence: TTGAAT
ttcataagtcaaggaactgc

SEQ ID NO: 15766 - DNA, 20 bp, Artificial Sequence
  Description of Artificial Sequence: Synthetic oligonucleotide
  Target: ATXN1; (-) strand; PAM type: NNGRRT; PAM sequence: GAGGAT
tggaaatgtctcctgagaaa

SEQ ID NO: 15767 - DNA, 20 bp, Artificial Sequence
  Description of Artificial Sequence: Synthetic oligonucleotide
  Target: ATXN1; (-) strand; PAM type: NNGRRT; PAM sequence: CAGAAT
actatgctcatatggggaaa

SEQ ID NO: 15768 - DNA, 20 bp, Artificial Sequence
  Description of Artificial Sequence: Synthetic oligonucleotide
  Target: ATXN1; (-) strand; PAM type: NNGRRT; PAM sequence: CAGAGT
agaaaaaactcacagtactc

SEQ ID NO: 15769 - DNA, 20 bp, Artificial Sequence
  Description of Artificial Sequence: Synthetic oligonucleotide
  Target: ATXN1; (-) strand; PAM type: NNGRRT; PAM sequence: GTGGAT
aaaatgatgtggcctattag

SEQ ID NO: 15770 - DNA, 20 bp, Artificial Sequence
  Description of Artificial Sequence: Synthetic oligonucleotide
  Target: ATXN1; (-) strand; PAM type: NNGRRT; PAM sequence: GGGAAT
catcaaataaatagattatg

SEQ ID NO: 15771 - DNA, 20 bp, Artificial Sequence
  Description of Artificial Sequence: Synthetic oligonucleotide
  Target: ATXN1; (-) strand; PAM type: NNGRRT; PAM sequence: ATGAAT
gattattgttatttttgcaa

SEQ ID NO: 15772 - DNA, 20 bp, Artificial Sequence
  Description of Artificial Sequence: Synthetic oligonucleotide
  Target: ATXN1; (-) strand; PAM type: NNGRRT; PAM sequence: TGGAAT
caatgttttcatttgattcc

SEQ ID NO: 15773 - DNA, 20 bp, Artificial Sequence
  Description of Artificial Sequence: Synthetic oligonucleotide
  Target: ATXN1; (-) strand; PAM type: NNGRRT; PAM sequence: CCGGAT
agtgggctattttacacttg

SEQ ID NO: 15774 - DNA, 20 bp, Artificial Sequence
  Description of Artificial Sequence: Synthetic oligonucleotide
  Target: ATXN1; (-) strand; PAM type: NNGRRT; PAM sequence: TTGGAT
gttaacagttctgatagtgc

SEQ ID NO: 15775 - DNA, 20 bp, Artificial Sequence
  Description of Artificial Sequence: Synthetic oligonucleotide
  Target: ATXN1; (-) strand; PAM type: NNGRRT; PAM sequence: CAGAGT
ccttccctccccctaccatc

SEQ ID NO: 15776 - DNA, 20 bp, Artificial Sequence
  Description of Artificial Sequence: Synthetic oligonucleotide
  Target: ATXN1; (-) strand; PAM type: NNGRRT; PAM sequence: TGGAGT
atttatgttttatgacaagt

SEQ ID NO: 15777 - DNA, 20 bp, Artificial Sequence
  Description of Artificial Sequence: Synthetic oligonucleotide
  Target: ATXN1; (-) strand; PAM type: NNGRRT; PAM sequence: ACGGAT
attataagtcattaagtgtc

SEQ ID NO: 15778 - DNA, 20 bp, Artificial Sequence
  Description of Artificial Sequence: Synthetic oligonucleotide
  Target: ATXN1; (-) strand; PAM type: NNGRRT; PAM sequence: CTGGAT
gggcattgtatttcttatat

SEQ ID NO: 15779 - DNA, 20 bp, Artificial Sequence
  Description of Artificial Sequence: Synthetic oligonucleotide
  Target: ATXN1; (-) strand; PAM type: NNGRRT; PAM sequence: CAGAAT
tagcctcacccaagcaaaaa

SEQ ID NO: 15780 - DNA, 20 bp, Artificial Sequence
  Description of Artificial Sequence: Synthetic oligonucleotide
  Target: ATXN1; (-) strand; PAM type: NNGRRT; PAM sequence: CTGAGT
ctacaaaaaacatggtggta

SEQ ID NO: 15781 - DNA, 20 bp, Artificial Sequence
  Description of Artificial Sequence: Synthetic oligonucleotide
  Target: ATXN1; (-) strand; PAM type: NNGRRT; PAM sequence: GGGGAT
caacaaaaattattaattaa

SEQ ID NO: 15782 - DNA, 20 bp, Artificial Sequence
  Description of Artificial Sequence: Synthetic oligonucleotide
  Target: ATXN1; (-) strand; PAM type: NNGRRT; PAM sequence: CAGAGT
tgcaggagtttgggggaatc

SEQ ID NO: 15783 - DNA, 20 bp, Artificial Sequence
  Description of Artificial Sequence: Synthetic oligonucleotide
  Target: ATXN1; (-) strand; PAM type: NNGRRT; PAM sequence: GGGAAT
ccaatgctgcaggagtttgg

SEQ ID NO: 15784 - DNA, 20 bp, Artificial Sequence
  Description of Artificial Sequence: Synthetic oligonucleotide
  Target: ATXN1; (-) strand; PAM type: NNGRRT; PAM sequence: AGGAGT
agaagttacaccaatgctgc

SEQ ID NO: 15785 - DNA, 20 bp, Artificial Sequence
  Description of Artificial Sequence: Synthetic oligonucleotide
  Target: ATXN1; (-) strand; PAM type: NNGRRT; PAM sequence: GAGAGT
tgagattacagcaatgttat

SEQ ID NO: 15786 - DNA, 20 bp, Artificial Sequence
  Description of Artificial Sequence: Synthetic oligonucleotide
  Target: ATXN1; (-) strand; PAM type: NNGRRT; PAM sequence: AGGAGT
cgggaggatcgcttgagccc

SEQ ID NO: 15787 - DNA, 20 bp, Artificial Sequence
  Description of Artificial Sequence: Synthetic oligonucleotide
  Target: ATXN1; (-) strand; PAM type: NNGRRT; PAM sequence: GAGGAT
tactctggaggctgaggcgg

SEQ ID NO: 15788 - DNA, 20 bp, Artificial Sequence
  Description of Artificial Sequence: Synthetic oligonucleotide
  Target: ATXN1; (-) strand; PAM type: NNGRRT; PAM sequence: TGGGAT
gccgtggcctcccaaagtgc

SEQ ID NO: 15789 - DNA, 20 bp, Artificial Sequence
  Description of Artificial Sequence: Synthetic oligonucleotide
  Target: ATXN1; (-) strand; PAM type: NNGRRT; PAM sequence: CAGGAT
cggggtttcacagtgttcgc

SEQ ID NO: 15790 - DNA, 20 bp, Artificial Sequence
  Description of Artificial Sequence: Synthetic oligonucleotide
  Target: ATXN1; (-) strand; PAM type: NNGRRT; PAM sequence: CGGGGT
ttttgtatttttagtagaga

SEQ ID NO: 15791 - DNA, 20 bp, Artificial Sequence
  Description of Artificial Sequence: Synthetic oligonucleotide
  Target: ATXN1; (-) strand; PAM type: NNGRRT; PAM sequence: CCGAGT
gattctcctgcctcagcctc

SEQ ID NO: 15792 - DNA, 20 bp, Artificial Sequence
  Description of Artificial Sequence: Synthetic oligonucleotide
  Target: ATXN1; (-) strand; PAM type: NNGRRT; PAM sequence: TGGAGT
tctcactctgttgcccaggc

SEQ ID NO: 15793 - DNA, 20 bp, Artificial Sequence
  Description of Artificial Sequence: Synthetic oligonucleotide
  Target: ATXN1; (-) strand; PAM type: NNGRRT; PAM sequence: CGGAGT
tgttgttgttgtttttgaga

SEQ ID NO: 15794 - DNA, 20 bp, Artificial Sequence
  Description of Artificial Sequence: Synthetic oligonucleotide
  Target: ATXN1; (-) strand; PAM type: NNGRRT; PAM sequence: AGGAGT
gaaagacaacttacgatgcc

SEQ ID NO: 15795 - DNA, 20 bp, Artificial Sequence
  Description of Artificial Sequence: Synthetic oligonucleotide
  Target: ATXN1; (-) strand; PAM type: NNGRRT; PAM sequence: TTGAAT
gctcaggttgttactgagca

SEQ ID NO: 15796 - DNA, 20 bp, Artificial Sequence
  Description of Artificial Sequence: Synthetic oligonucleotide
  Target: ATXN1; (-) strand; PAM type: NNGRRT; PAM sequence: TAGAGT
agaaagcactttatgaactg

SEQ ID NO: 15797 - DNA, 20 bp, Artificial Sequence
  Description of Artificial Sequence: Synthetic oligonucleotide
  Target: ATXN1; (-) strand; PAM type: NNGRRT; PAM sequence: AAGGGT
taattgacaagtacctttga

SEQ ID NO: 15798 - DNA, 20 bp, Artificial Sequence
  Description of Artificial Sequence: Synthetic oligonucleotide
  Target: ATXN1; (-) strand; PAM type: NNGRRT; PAM sequence: GAGAAT
ttctctactgtcaaaactgt

SEQ ID NO: 15799 - DNA, 20 bp, Artificial Sequence
  Description of Artificial Sequence: Synthetic oligonucleotide
  Target: ATXN1; (-) strand; PAM type: NNGRRT; PAM sequence: GTGAAT
gccagtgtagttaaaattta

SEQ ID NO: 15800 - DNA, 20 bp, Artificial Sequence
  Description of Artificial Sequence: Synthetic oligonucleotide
  Target: ATXN1; (-) strand; PAM type: NNGRRT; PAM sequence: CAGAAT
gtggaaagaaacatttattt

SEQ ID NO: 15801 - DNA, 20 bp, Artificial Sequence
  Description of Artificial Sequence: Synthetic oligonucleotide
  Target: ATXN1; (-) strand; PAM type: NNGRRT; PAM sequence: AAGAAT
tgatgtgcttccatattaaa

SEQ ID NO: 15802 - DNA, 20 bp, Artificial Sequence
  Description of Artificial Sequence: Synthetic oligonucleotide
  Target: ATXN1; (-) strand; PAM type: NNGRRT; PAM sequence: CAGGGT
gcttgtcagagttagattgt

SEQ ID NO: 15803 - DNA, 20 bp, Artificial Sequence
  Description of Artificial Sequence: Synthetic oligonucleotide
  Target: ATXN1; (-) strand; PAM type: NNGRRT; PAM sequence: CAGAGT
ctaggactatgcaagcttgt

SEQ ID NO: 15804 - DNA, 20 bp, Artificial Sequence
  Description of Artificial Sequence: Synthetic oligonucleotide
  Target: ATXN1; (-) strand; PAM type: NNGRRT; PAM sequence: TAGAAT
gttctgttaggaggtagaaa

SEQ ID NO: 15805 - DNA, 20 bp, Artificial Sequence
  Description of Artificial Sequence: Synthetic oligonucleotide
  Target: ATXN1; (-) strand; PAM type: NNGRRT; PAM sequence: CAGAAT
attgttagcagagcagctga

SEQ ID NO: 15806 - DNA, 20 bp, Artificial Sequence
  Description of Artificial Sequence: Synthetic oligonucleotide
  Target: ATXN1; (-) strand; PAM type: NNGRRT; PAM sequence: ATGGGT
tttatttctaagctgtgtgc

SEQ ID NO: 15807 - DNA, 20 bp, Artificial Sequence
  Description of Artificial Sequence: Synthetic oligonucleotide
  Target: ATXN1; (-) strand; PAM type: NNGRRT; PAM sequence: GTGAAT
tttgcttttacagatatctg

SEQ ID NO: 15808 - DNA, 20 bp, Artificial Sequence
  Description of Artificial Sequence: Synthetic oligonucleotide
  Target: ATXN1; (-) strand; PAM type: NNGRRT; PAM sequence: ATGGAT
tcaatacagagacataattc

SEQ ID NO: 15809 - DNA, 20 bp, Artificial Sequence
  Description of Artificial Sequence: Synthetic oligonucleotide
  Target: ATXN1; (-) strand; PAM type: NNGRRT; PAM sequence: CTGGGT
aatccttttctagtattact

SEQ ID NO: 15810 - DNA, 20 bp, Artificial Sequence
  Description of Artificial Sequence: Synthetic oligonucleotide
  Target: ATXN1; (-) strand; PAM type: NNGRRT; PAM sequence: TAGGAT
atctcccaatgtatctttaa

SEQ ID NO: 15811 - DNA, 20 bp, Artificial Sequence
  Description of Artificial Sequence: Synthetic oligonucleotide
  Target: ATXN1; (-) strand; PAM type: NNGRRT; PAM sequence: TGGAAT
tttcaaatattcttgcgaat

SEQ ID NO: 15812 - DNA, 20 bp, Artificial Sequence
  Description of Artificial Sequence: Synthetic oligonucleotide
  Target: ATXN1; (-) strand; PAM type: NNGRRT; PAM sequence: GCGAAT
gcagcgtttcaaatattctt

SEQ ID NO: 15813 - DNA, 20 bp, Artificial Sequence
  Description of Artificial Sequence: Synthetic oligonucleotide
  Target: ATXN1; (-) strand; PAM type: NNGRRT; PAM sequence: TGGAGT
tttctctgagaaaatgtgtt

SEQ ID NO: 15814 - DNA, 20 bp, Artificial Sequence
  Description of Artificial Sequence: Synthetic oligonucleotide
  Target: ATXN1; (-) strand; PAM type: NNGRRT; PAM sequence: TAGAGT
ctgtcccctgctcatggtac

SEQ ID NO: 15815 - DNA, 20 bp, Artificial Sequence
  Description of Artificial Sequence: Synthetic oligonucleotide
  Target: ATXN1; (-) strand; PAM type: NNGRRT; PAM sequence: TGGGAT
tggtgctctcttatatgggc

SEQ ID NO: 15816 - DNA, 20 bp, Artificial Sequence
  Description of Artificial Sequence: Synthetic oligonucleotide
  Target: ATXN1; (-) strand; PAM type: NNGRRT; PAM sequence: AAGGGT
gggaaggggagtttgggaaa

SEQ ID NO: 15817 - DNA, 20 bp, Artificial Sequence
  Description of Artificial Sequence: Synthetic oligonucleotide
  Target: ATXN1; (-) strand; PAM type: NNGRRT; PAM sequence: GGGAGT
agataactggacttgggaag

SEQ ID NO: 15818 - DNA, 20 bp, Artificial Sequence
  Description of Artificial Sequence: Synthetic oligonucleotide
  Target: ATXN1; (-) strand; PAM type: NNGRRT; PAM sequence: CTGGGT
tcatctgcacttcttaggag

SEQ ID NO: 15819 - DNA, 20 bp, Artificial Sequence
  Description of Artificial Sequence: Synthetic oligonucleotide
  Target: ATXN1; (-) strand; PAM type: NNGRRT; PAM sequence: TGGGAT
ctgccgctagaaaccaggtg

SEQ ID NO: 15820 - DNA, 20 bp, Artificial Sequence
  Description of Artificial Sequence: Synthetic oligonucleotide
  Target: ATXN1; (-) strand; PAM type: NNGRRT; PAM sequence: CCGGGT
ctcttcatcttttaaaccac

SEQ ID NO: 15821 - DNA, 20 bp, Artificial Sequence
  Description of Artificial Sequence: Synthetic oligonucleotide
  Target: ATXN1; (-) strand; PAM type: NNGRRT; PAM sequence: TGGGAT
accttggcctcccaaagtgc

SEQ ID NO: 15822 - DNA, 20 bp, Artificial Sequence
  Description of Artificial Sequence: Synthetic oligonucleotide
  Target: ATXN1; (-) strand; PAM type: NNGRRT; PAM sequence: TAGGAT
gtcttagcctccccagtagc

SEQ ID NO: 15823 - DNA, 20 bp, Artificial Sequence
  Description of Artificial Sequence: Synthetic oligonucleotide
  Target: ATXN1; (-) strand; PAM type: NNGRRT; PAM sequence: CTGGGT
ctcactacagcctccacctc

SEQ ID NO: 15824 - DNA, 20 bp, Artificial Sequence
  Description of Artificial Sequence: Synthetic oligonucleotide
  Target: ATXN1; (-) strand; PAM type: NNGRRT; PAM sequence: TGGAGT
tctcactctgtcgcccaggc

SEQ ID NO: 15825 - DNA, 20 bp, Artificial Sequence
  Description of Artificial Sequence: Synthetic oligonucleotide
  Target: ATXN1; (-) strand; PAM type: NNGRRT; PAM sequence: CGGAGT
ttttttttttttttctgaga

SEQ ID NO: 15826 - DNA, 20 bp, Artificial Sequence
  Description of Artificial Sequence: Synthetic oligonucleotide
  Target: ATXN1; (-) strand; PAM type: NNGRRT; PAM sequence: CTGAGT
tcaggaacagcaggagacca

SEQ ID NO: 15827 - DNA, 20 bp, Artificial Sequence
  Description of Artificial Sequence: Synthetic oligonucleotide
  Target: ATXN1; (-) strand; PAM type: NNGRRT; PAM sequence: ATGAGT
gccccacccgagatttggcc

SEQ ID NO: 15828 - DNA, 20 bp, Artificial Sequence
  Description of Artificial Sequence: Synthetic oligonucleotide
  Target: ATXN1; (-) strand; PAM type: NNGRRT; PAM sequence: CTGGAT
ctaaccagtttctgccacaa

SEQ ID NO: 15829 - DNA, 20 bp, Artificial Sequence
  Description of Artificial Sequence: Synthetic oligonucleotide
  Target: ATXN1; (-) strand; PAM type: NNGRRT; PAM sequence: AGGAGT
aattgtcagcctgtatgtca

SEQ ID NO: 15830 - DNA, 20 bp, Artificial Sequence
  Description of Artificial Sequence: Synthetic oligonucleotide
  Target: ATXN1; (-) strand; PAM type: NNGRRT; PAM sequence: GAGAAT
agtcaactgcaggtaaagtg

SEQ ID NO: 15831 - DNA, 20 bp, Artificial Sequence
  Description of Artificial Sequence: Synthetic oligonucleotide
  Target: ATXN1; (-) strand; PAM type: NNGRRT; PAM sequence: CAGAAT
tccttccatgttcccttgac

SEQ ID NO: 15832 - DNA, 20 bp, Artificial Sequence
  Description of Artificial Sequence: Synthetic oligonucleotide
  Target: ATXN1; (-) strand; PAM type: NNGRRT; PAM sequence: GAGAGT
agagagaagtggggaagcga

SEQ ID NO: 15833 - DNA, 20 bp, Artificial Sequence
  Description of Artificial Sequence: Synthetic oligonucleotide
  Target: ATXN1; (-) strand; PAM type: NNGRRT; PAM sequence: AAGGAT
cctcagtgttgggagaccct

SEQ ID NO: 15834 - DNA, 20 bp, Artificial Sequence
  Description of Artificial Sequence: Synthetic oligonucleotide
  Target: ATXN1; (-) strand; PAM type: NNGRRT; PAM sequence: CAGGGT
atggtggtgattccctgacc

SEQ ID NO: 15835 - DNA, 20 bp, Artificial Sequence
  Description of Artificial Sequence: Synthetic oligonucleotide
  Target: ATXN1; (-) strand; PAM type: NNGRRT; PAM sequence: TGGGGT
tgatggtgttacggataact

SEQ ID NO: 15836 - DNA, 20 bp, Artificial Sequence
  Description of Artificial Sequence: Synthetic oligonucleotide
  Target: ATXN1; (-) strand; PAM type: NNGRRT; PAM sequence: ACGGAT
agttcctttttgatggtgtt

SEQ ID NO: 15837 - DNA, 20 bp, Artificial Sequence
  Description of Artificial Sequence: Synthetic oligonucleotide
  Target: ATXN1; (-) strand; PAM type: NNGRRT; PAM sequence: CAGGGT
aacaagcaaccccaactctt

SEQ ID NO: 15838 - DNA, 20 bp, Artificial Sequence
  Description of Artificial Sequence: Synthetic oligonucleotide
  Target: ATXN1; (-) strand; PAM type: NNGRRT; PAM sequence: AAGGAT
gagatgatggtacaatgggc

SEQ ID NO: 15839 - DNA, 20 bp, Artificial Sequence
  Description of Artificial Sequence: Synthetic oligonucleotide
  Target: ATXN1; (-) strand; PAM type: NNGRRT; PAM sequence: GTGAAT
tagtggattgtccagggcag

SEQ ID NO: 15840 - DNA, 20 bp, Artificial Sequence
  Description of Artificial Sequence: Synthetic oligonucleotide
  Target: ATXN1; (-) strand; PAM type: NNGRRT; PAM sequence: GTGGAT
tttgaggacaaacaaaccta

SEQ ID NO: 15841 - DNA, 20 bp, Artificial Sequence
  Description of Artificial Sequence: Synthetic oligonucleotide
  Target: ATXN1; (-) strand; PAM type: NNGRRT; PAM sequence: TTGGGT
gaaggaataagagggctttc

SEQ ID NO: 15842 - DNA, 20 bp, Artificial Sequence
  Description of Artificial Sequence: Synthetic oligonucleotide
  Target: ATXN1; (-) strand; PAM type: NNGRRT; PAM sequence: AGGAAT
agtttcccaaatagattaga

SEQ ID NO: 15843 - DNA, 20 bp, Artificial Sequence
  Description of Artificial Sequence: Synthetic oligonucleotide
  Target: ATXN1; (-) strand; PAM type: NNGRRT; PAM sequence: CTGAAT
aaatgaccaataaaaaaatt

SEQ ID NO: 15844 - DNA, 20 bp, Artificial Sequence
  Description of Artificial Sequence: Synthetic oligonucleotide
  Target: ATXN1; (-) strand; PAM type: NNGRRT; PAM sequence: GTGGGT
tttctgtgaccctaatctac

SEQ ID NO: 15845 - DNA, 20 bp, Artificial Sequence
  Description of Artificial Sequence: Synthetic oligonucleotide
  Target: ATXN1; (-) strand; PAM type: NNGRRT; PAM sequence: CAGAAT
atgatcctagttatcttagg

SEQ ID NO: 15846 - DNA, 20 bp, Artificial Sequence
  Description of Artificial Sequence: Synthetic oligonucleotide
  Target: ATXN1; (-) strand; PAM type: NNGRRT; PAM sequence: ATGGAT
gttcacttggtgccacttcc

SEQ ID NO: 15847 - DNA, 20 bp, Artificial Sequence
  Description of Artificial Sequence: Synthetic oligonucleotide
  Target: ATXN1; (-) strand; PAM type: NNGRRT; PAM sequence: ATGAAT
actgaataaatgaatagtga

SEQ ID NO: 15848 - DNA, 20 bp, Artificial Sequence
  Description of Artificial Sequence: Synthetic oligonucleotide
  Target: ATXN1; (-) strand; PAM type: NNGRRT; PAM sequence: GTGAAT
gtaaactgaataaatgaata

SEQ ID NO: 15849 - DNA, 20 bp, Artificial Sequence
  Description of Artificial Sequence: Synthetic oligonucleotide
  Target: ATXN1; (-) strand; PAM type: NNGRRT; PAM sequence: ATGAAT
attaaaggtaaactgaataa

SEQ ID NO: 15850 - DNA, 20 bp, Artificial Sequence
  Description of Artificial Sequence: Synthetic oligonucleotide
  Target: ATXN1; (-) strand; PAM type: NNGRRT; PAM sequence: CTGAAT
cctcttccattaaaggtaaa

SEQ ID NO: 15851 - DNA, 20 bp, Artificial Sequence
  Description of Artificial Sequence: Synthetic oligonucleotide
  Target: ATXN1; (-) strand; PAM type: NNGRRT; PAM sequence: GGGAAT
tatatagagagttaggcgtg

SEQ ID NO: 15852 - DNA, 20 bp, Artificial Sequence
  Description of Artificial Sequence: Synthetic oligonucleotide
  Target: ATXN1; (-) strand; PAM type: NNGRRT; PAM sequence: GAGAGT
taaaataaggggaatatata

SEQ ID NO: 15853 - DNA, 20 bp, Artificial Sequence
  Description of Artificial Sequence: Synthetic oligonucleotide
  Target: ATXN1; (-) strand; PAM type: NNGRRT; PAM sequence: GGGAAT
caacttatgaataaaataag

SEQ ID NO: 15854 - DNA, 20 bp, Artificial Sequence
  Description of Artificial Sequence: Synthetic oligonucleotide
  Target: ATXN1; (-) strand; PAM type: NNGRRT; PAM sequence: ATGAAT
attgtaccctctaacaactt

SEQ ID NO: 15855 - DNA, 20 bp, Artificial Sequence
  Description of Artificial Sequence: Synthetic oligonucleotide
  Target: ATXN1; (-) strand; PAM type: NNGRRT; PAM sequence: TTGGAT
aagggtagaaagctagggtt

SEQ ID NO: 15856 - DNA, 20 bp, Artificial Sequence
  Description of Artificial Sequence: Synthetic oligonucleotide
  Target: ATXN1; (-) strand; PAM type: NNGRRT; PAM sequence: TAGGGT
aaggagcaagggtagaaagc

SEQ ID NO: 15857 - DNA, 20 bp, Artificial Sequence
  Description of Artificial Sequence: Synthetic oligonucleotide
  Target: ATXN1; (-) strand; PAM type: NNGRRT; PAM sequence: AAGGGT
aaaatcgctgtgcaaggagc

SEQ ID NO: 15858 - DNA, 20 bp, Artificial Sequence
  Description of Artificial Sequence: Synthetic oligonucleotide
  Target: ATXN1; (-) strand; PAM type: NNGRRT; PAM sequence: GAGGGT
tagagatgcaacaaagtgat

SEQ ID NO: 15859 - DNA, 20 bp, Artificial Sequence
  Description of Artificial Sequence: Synthetic oligonucleotide
  Target: ATXN1; (-) strand; PAM type: NNGRRT; PAM sequence: CTGGAT
agcacataattatttaatcc

SEQ ID NO: 15860 - DNA, 20 bp, Artificial Sequence
  Description of Artificial Sequence: Synthetic oligonucleotide
  Target: ATXN1; (-) strand; PAM type: NNGRRT; PAM sequence: GAGGGT
aggccatgctttgtcaaaga

SEQ ID NO: 15861 - DNA, 20 bp, Artificial Sequence
  Description of Artificial Sequence: Synthetic oligonucleotide
  Target: ATXN1; (-) strand; PAM type: NNGRRT; PAM sequence: AAGGAT
aaccctcaacagagctccat

SEQ ID NO: 15862 - DNA, 20 bp, Artificial Sequence
  Description of Artificial Sequence: Synthetic oligonucleotide
  Target: ATXN1; (-) strand; PAM type: NNGRRT; PAM sequence: CAGAAT
aattgcaaggtaaaggcagg

SEQ ID NO: 15863 - DNA, 20 bp, Artificial Sequence
  Description of Artificial Sequence: Synthetic oligonucleotide
  Target: ATXN1; (-) strand; PAM type: NNGRRT; PAM sequence: TTGAAT
tgctgaactcgggaaccatt

SEQ ID NO: 15864 - DNA, 20 bp, Artificial Sequence
  Description of Artificial Sequence: Synthetic oligonucleotide
  Target: ATXN1; (-) strand; PAM type: NNGRRT; PAM sequence: GGGAGT
gtttttttagcagcagaagt

SEQ ID NO: 15865 - DNA, 20 bp, Artificial Sequence
  Description of Artificial Sequence: Synthetic oligonucleotide
  Target: ATXN1; (-) strand; PAM type: NNGRRT; PAM sequence: TAGAGT
ttctcagagtgcctgatgag

SEQ ID NO: 15866 - DNA, 20 bp, Artificial Sequence
  Description of Artificial Sequence: Synthetic oligonucleotide
  Target: ATXN1; (-) strand; PAM type: NNGRRT; PAM sequence: ATGAGT
cttcattctcagagtgcctg

SEQ ID NO: 15867 - DNA, 20 bp, Artificial Sequence
  Description of Artificial Sequence: Synthetic oligonucleotide
  Target: ATXN1; (-) strand; PAM type: NNGRRT; PAM sequence: CAGAGT
agccaggtcaccttcattct

SEQ ID NO: 15868 - DNA, 20 bp, Artificial Sequence
  Description of Artificial Sequence: Synthetic oligonucleotide
  Target: ATXN1; (-) strand; PAM type: NNGRRT; PAM sequence: CAGAAT
agcacatatgttcacattgg

SEQ ID NO: 15869 - DNA, 20 bp, Artificial Sequence
  Description of Artificial Sequence: Synthetic oligonucleotide
  Target: ATXN1; (-) strand; PAM type: NNGRRT; PAM sequence: CAGAAT
agagcggacattggaaatgg

SEQ ID NO: 15870 - DNA, 20 bp, Artificial Sequence
  Description of Artificial Sequence: Synthetic oligonucleotide
  Target: ATXN1; (-) strand; PAM type: NNGRRT; PAM sequence: AAGAAT
taaaagaaaataatgtataa

SEQ ID NO: 15871 - DNA, 20 bp, Artificial Sequence
  Description of Artificial Sequence: Synthetic oligonucleotide
  Target: ATXN1; (-) strand; PAM type: NNGRRT; PAM sequence: CTGGGT
ttgcaccactgcacaccagt

SEQ ID NO: 15872 - DNA, 20 bp, Artificial Sequence
  Description of Artificial Sequence: Synthetic oligonucleotide
  Target: ATXN1; (-) strand; PAM type: NNGRRT; PAM sequence: AGGAGT
tgggaggattgcttgagccc

SEQ ID NO: 15873 - DNA, 20 bp, Artificial Sequence
  Description of Artificial Sequence: Synthetic oligonucleotide
  Target: ATXN1; (-) strand; PAM type: NNGRRT; PAM sequence: GAGGAT
tgctcaggaggctgaggtgg

SEQ ID NO: 15874 - DNA, 20 bp, Artificial Sequence
  Description of Artificial Sequence: Synthetic oligonucleotide
  Target: ATXN1; (-) strand; PAM type: NNGRRT; PAM sequence: GTGAGT
aattagctgagtgtaatgtt

SEQ ID NO: 15875 - DNA, 20 bp, Artificial Sequence
  Description of Artificial Sequence: Synthetic oligonucleotide
  Target: ATXN1; (-) strand; PAM type: NNGRRT; PAM sequence: CTGAGT
agttttttttttttaattag

SEQ ID NO: 15876 - DNA, 20 bp, Artificial Sequence
  Description of Artificial Sequence: Synthetic oligonucleotide
  Target: ATXN1; (-) strand; PAM type: NNGRRT; PAM sequence: CTGGGT
tcgcaccactacactccagc

SEQ ID NO: 15877 - DNA, 20 bp, Artificial Sequence
  Description of Artificial Sequence: Synthetic oligonucleotide
  Target: ATXN1; (-) strand; PAM type: NNGRRT; PAM sequence: AGGAGT
taggaggatcacttgagtct

SEQ ID NO: 15878 - DNA, 20 bp, Artificial Sequence
  Description of Artificial Sequence: Synthetic oligonucleotide
  Target: ATXN1; (-) strand; PAM type: NNGRRT; PAM sequence: TTGAGT
ggcttatgtaggaggatcac

SEQ ID NO: 15879 - DNA, 20 bp, Artificial Sequence
  Description of Artificial Sequence: Synthetic oligonucleotide
  Target: ATXN1; (-) strand; PAM type: NNGRRT; PAM sequence: GAGGAT
tacttgggaggcttatgtag

SEQ ID NO: 15880 - DNA, 20 bp, Artificial Sequence
  Description of Artificial Sequence: Synthetic oligonucleotide
  Target: ATXN1; (-) strand; PAM type: NNGRRT; PAM sequence: ACGAGT
tggaaggatcacttgaagcc

SEQ ID NO: 15881 - DNA, 20 bp, Artificial Sequence
  Description of Artificial Sequence: Synthetic oligonucleotide
  Target: ATXN1; (-) strand; PAM type: NNGRRT; PAM sequence: AAGGAT
actttggggggctgaggtgg

SEQ ID NO: 15882 - DNA, 20 bp, Artificial Sequence
  Description of Artificial Sequence: Synthetic oligonucleotide
  Target: ATXN1; (-) strand; PAM type: NNGRRT; PAM sequence: TAGAAT
tatgaatgcatgtttttttg

SEQ ID NO: 15883 - DNA, 20 bp, Artificial Sequence
  Description of Artificial Sequence: Synthetic oligonucleotide
  Target: ATXN1; (-) strand; PAM type: NNGRRT; PAM sequence: ATGAAT
atagcattgcacgatataat

SEQ ID NO: 15884 - DNA, 20 bp, Artificial Sequence
  Description of Artificial Sequence: Synthetic oligonucleotide
  Target: ATXN1; (-) strand; PAM type: NNGRRT; PAM sequence: TGGAAT
atgatgctgagaactcccca

SEQ ID NO: 15885 - DNA, 20 bp, Artificial Sequence
  Description of Artificial Sequence: Synthetic oligonucleotide
  Target: ATXN1; (-) strand; PAM type: NNGRRT; PAM sequence: GAGAAT
ggaagttctggttctagtct

SEQ ID NO: 15886 - DNA, 20 bp, Artificial Sequence
  Description of Artificial Sequence: Synthetic oligonucleotide
  Target: ATXN1; (-) strand; PAM type: NNGRRT; PAM sequence: TTGAGT
acatcattgtttcttaacag

SEQ ID NO: 15887 - DNA, 20 bp, Artificial Sequence
  Description of Artificial Sequence: Synthetic oligonucleotide
  Target: ATXN1; (-) strand; PAM type: NNGRRT; PAM sequence: ATGGGT
ttagacatacacatttgatt

SEQ ID NO: 15888 - DNA, 20 bp, Artificial Sequence
  Description of Artificial Sequence: Synthetic oligonucleotide
  Target: ATXN1; (-) strand; PAM type: NNGRRT; PAM sequence: CAGAGT
ttatagcctgttagccctca

SEQ ID NO: 15889 - DNA, 20 bp, Artificial Sequence
  Description of Artificial Sequence: Synthetic oligonucleotide
  Target: ATXN1; (-) strand; PAM type: NNGRRT; PAM sequence: AAGAAT
cgaatttccacttattactc

SEQ ID NO: 15890 - DNA, 20 bp, Artificial Sequence
  Description of Artificial Sequence: Synthetic oligonucleotide
  Target: ATXN1; (-) strand; PAM type: NNGRRT; PAM sequence: ACGAAT
ttgttttcatcacttatttc

SEQ ID NO: 15891 - DNA, 20 bp, Artificial Sequence
  Description of Artificial Sequence: Synthetic oligonucleotide
  Target: ATXN1; (-) strand; PAM type: NNGRRT; PAM sequence: AAGGGT
tcactctgtgttgggtagga

SEQ ID NO: 15892 - DNA, 20 bp, Artificial Sequence
  Description of Artificial Sequence: Synthetic oligonucleotide
  Target: ATXN1; (-) strand; PAM type: NNGRRT; PAM sequence: TTGGGT
ggcttgtgtctcactctgtg

SEQ ID NO: 15893 - DNA, 20 bp, Artificial Sequence
  Description of Artificial Sequence: Synthetic oligonucleotide
  Target: ATXN1; (-) strand; PAM type: NNGRRT; PAM sequence: GAGGAT
cacttaactctgccaagata

SEQ ID NO: 15894 - DNA, 20 bp, Artificial Sequence
  Description of Artificial Sequence: Synthetic oligonucleotide
  Target: ATXN1; (-) strand; PAM type: NNGRRT; PAM sequence: AGGAGT
tggccaggtcagcctactta

SEQ ID NO: 15895 - DNA, 20 bp, Artificial Sequence
  Description of Artificial Sequence: Synthetic oligonucleotide
  Target: ATXN1; (-) strand; PAM type: NNGRRT; PAM sequence: ATGAAT
tgtggcttaggctagactga

SEQ ID NO: 15896 - DNA, 20 bp, Artificial Sequence
  Description of Artificial Sequence: Synthetic oligonucleotide
  Target: ATXN1; (-) strand; PAM type: NNGRRT; PAM sequence: CTGAAT
agcctgtggcttaggctaga

SEQ ID NO: 15897 - DNA, 20 bp, Artificial Sequence
  Description of Artificial Sequence: Synthetic oligonucleotide
  Target: ATXN1; (-) strand; PAM type: NNGRRT; PAM sequence: TGGAAT
aacacagcatctgcttacgc

SEQ ID NO: 15898 - DNA, 20 bp, Artificial Sequence
  Description of Artificial Sequence: Synthetic oligonucleotide
  Target: ATXN1; (-) strand; PAM type: NNGRRT; PAM sequence: AAGAAT
ggtgaggaaggaggattaaa

SEQ ID NO: 15899 - DNA, 20 bp, Artificial Sequence
  Description of Artificial Sequence: Synthetic oligonucleotide
  Target: ATXN1; (-) strand; PAM type: NNGRRT; PAM sequence: GAGGAT
atgtattctaggtgaggaag

SEQ ID NO: 15900 - DNA, 20 bp, Artificial Sequence
  Description of Artificial Sequence: Synthetic oligonucleotide
  Target: ATXN1; (-) strand; PAM type: NNGRRT; PAM sequence: AGGAAT
atatttgcatgcctacatcg

SEQ ID NO: 15901 - DNA, 20 bp, Artificial Sequence
  Description of Artificial Sequence: Synthetic oligonucleotide
  Target: ATXN1; (-) strand; PAM type: NNGRRT; PAM sequence: CTGGGT
gaaggagtcaaagatgattt

SEQ ID NO: 15902 - DNA, 20 bp, Artificial Sequence
  Description of Artificial Sequence: Synthetic oligonucleotide
  Target: ATXN1; (-) strand; PAM type: NNGRRT; PAM sequence: AGGAGT
gatttggagaatggagagga

SEQ ID NO: 15903 - DNA, 20 bp, Artificial Sequence
  Description of Artificial Sequence: Synthetic oligonucleotide
  Target: ATXN1; (-) strand; PAM type: NNGRRT; PAM sequence: GAGAAT
cttagtaattgttggatttg

SEQ ID NO: 15904 - DNA, 20 bp, Artificial Sequence
  Description of Artificial Sequence: Synthetic oligonucleotide
  Target: ATXN1; (-) strand; PAM type: NNGRRT; PAM sequence: TTGGAT
ataatataacttagtaattg

SEQ ID NO: 15905 - DNA, 20 bp, Artificial Sequence
  Description of Artificial Sequence: Synthetic oligonucleotide
  Target: ATXN1; (-) strand; PAM type: NNGRRT; PAM sequence: AGGGAT
acatattcaaaggtatttga

SEQ ID NO: 15906 - DNA, 20 bp, Artificial Sequence
  Description of Artificial Sequence: Synthetic oligonucleotide
  Target: ATXN1; (-) strand; PAM type: NNGRRT; PAM sequence: GAGGAT
tattcgtttgagggtgttgg

SEQ ID NO: 15907 - DNA, 20 bp, Artificial Sequence
  Description of Artificial Sequence: Synthetic oligonucleotide
  Target: ATXN1; (-) strand; PAM type: NNGRRT; PAM sequence: GAGGGT
taatgggagcctattcgttt

SEQ ID NO: 15908 - DNA, 20 bp, Artificial Sequence
  Description of Artificial Sequence: Synthetic oligonucleotide
  Target: ATXN1; (-) strand; PAM type: NNGRRT; PAM sequence: AGGAAT
aaacaggggacaggcgagtc

SEQ ID NO: 15909 - DNA, 20 bp, Artificial Sequence
  Description of Artificial Sequence: Synthetic oligonucleotide
  Target: ATXN1; (-) strand; PAM type: NNGRRT; PAM sequence: GCGAGT
ttgggagaaacaggggacag

SEQ ID NO: 15910 - DNA, 20 bp, Artificial Sequence
  Description of Artificial Sequence: Synthetic oligonucleotide
  Target: ATXN1; (-) strand; PAM type: NNGRRT; PAM sequence: CAGAGT
gacaatgtatgtagggtggc

SEQ ID NO: 15911 - DNA, 20 bp, Artificial Sequence
  Description of Artificial Sequence: Synthetic oligonucleotide
  Target: ATXN1; (-) strand; PAM type: NNGRRT; PAM sequence: TAGGGT
gaaaccggtgacaatgtatg

SEQ ID NO: 15912 - DNA, 20 bp, Artificial Sequence
  Description of Artificial Sequence: Synthetic oligonucleotide
  Target: ATXN1; (-) strand; PAM type: NNGRRT; PAM sequence: GTGAGT
ttgtttatggaaggggctca

SEQ ID NO: 15913 - DNA, 20 bp, Artificial Sequence
  Description of Artificial Sequence: Synthetic oligonucleotide
  Target: ATXN1; (-) strand; PAM type: NNGRRT; PAM sequence: CAGAGT
agttaatgcaggaggtgaca

SEQ ID NO: 15914 - DNA, 20 bp, Artificial Sequence
  Description of Artificial Sequence: Synthetic oligonucleotide
  Target: ATXN1; (-) strand; PAM type: NNGRRT; PAM sequence: AGGAAT
ggatcactaagacctggcgg

SEQ ID NO: 15915 - DNA, 20 bp, Artificial Sequence
  Description of Artificial Sequence: Synthetic oligonucleotide
  Target: ATXN1; (-) strand; PAM type: NNGRRT; PAM sequence: AAGGAT
ctgtggggataacagagcta

SEQ ID NO: 15916 - DNA, 20 bp, Artificial Sequence
  Description of Artificial Sequence: Synthetic oligonucleotide
  Target: ATXN1; (-) strand; PAM type: NNGRRT; PAM sequence: GGGGAT
aaagagaatttgacagctgt

SEQ ID NO: 15917 - DNA, 20 bp, Artificial Sequence
  Description of Artificial Sequence: Synthetic oligonucleotide
  Target: ATXN1; (-) strand; PAM type: NNGRRT; PAM sequence: GAGAAT
tgctggagattggtatgaaa

SEQ ID NO: 15918 - DNA, 20 bp, Artificial Sequence
  Description of Artificial Sequence: Synthetic oligonucleotide
  Target: ATXN1; (-) strand; PAM type: NNGRRT; PAM sequence: CGGAGT
ggatatgttggaggggccag

SEQ ID NO: 15919 - DNA, 20 bp, Artificial Sequence
  Description of Artificial Sequence: Synthetic oligonucleotide
  Target: ATXN1; (-) strand; PAM type: NNGRRT; PAM sequence: TGGGAT
agggacacagatggcctgca

SEQ ID NO: 15920 - DNA, 20 bp, Artificial Sequence
  Description of Artificial Sequence: Synthetic oligonucleotide
  Target: ATXN1; (-) strand; PAM type: NNGRRT; PAM sequence: AGGGGT
atgatgggtggaggaaactg

SEQ ID NO: 15921 - DNA, 20 bp, Artificial Sequence
  Description of Artificial Sequence: Synthetic oligonucleotide
  Target: ATXN1; (-) strand; PAM type: NNGRRT; PAM sequence: ATGGGT
taacaggatgtgtagtgatg

SEQ ID NO: 15922 - DNA, 20 bp, Artificial Sequence
  Description of Artificial Sequence: Synthetic oligonucleotide
  Target: ATXN1; (-) strand; PAM type: NNGRRT; PAM sequence: CAGGAT
aagcctgacagggaccttaa

SEQ ID NO: 15923 - DNA, 20 bp, Artificial Sequence
  Description of Artificial Sequence: Synthetic oligonucleotide
  Target: ATXN1; (-) strand; PAM type: NNGRRT; PAM sequence: TGGAGT
aatgagaaatggctggggat

SEQ ID NO: 15924 - DNA, 20 bp, Artificial Sequence
  Description of Artificial Sequence: Synthetic oligonucleotide
  Target: ATXN1; (-) strand; PAM type: NNGRRT; PAM sequence: GGGGAT
aagaggaatgagaaatggct

SEQ ID NO: 15925 - DNA, 20 bp, Artificial Sequence
  Description of Artificial Sequence: Synthetic oligonucleotide
  Target: ATXN1; (-) strand; PAM type: NNGRRT; PAM sequence: AGGAAT
gccagtgtcaggttcagaag

SEQ ID NO: 15926 - DNA, 20 bp, Artificial Sequence
  Description of Artificial Sequence: Synthetic oligonucleotide
  Target: ATXN1; (-) strand; PAM type: NNGRRT; PAM sequence: TGGGGT
agacaactgagaatttgtaa

SEQ ID NO: 15927 - DNA, 20 bp, Artificial Sequence
  Description of Artificial Sequence: Synthetic oligonucleotide
  Target: ATXN1; (-) strand; PAM type: NNGRRT; PAM sequence: GAGAAT
atccatgacaacagacaact

SEQ ID NO: 15928 - DNA, 20 bp, Artificial Sequence
  Description of Artificial Sequence: Synthetic oligonucleotide
  Target: ATXN1; (-) strand; PAM type: NNGRRT; PAM sequence: CAGAGT
ctgcactccagcctgggtga

SEQ ID NO: 15929 - DNA, 20 bp, Artificial Sequence
  Description of Artificial Sequence: Synthetic oligonucleotide
  Target: ATXN1; (-) strand; PAM type: NNGRRT; PAM sequence: CTGGGT
tccggccactgcactccagc

SEQ ID NO: 15930 - DNA, 20 bp, Artificial Sequence
  Description of Artificial Sequence: Synthetic oligonucleotide
  Target: ATXN1; (-) strand; PAM type: NNGRRT; PAM sequence: GAGAAT
tacttgggaggctgaggcaa

SEQ ID NO: 15931 - DNA, 20 bp, Artificial Sequence
  Description of Artificial Sequence: Synthetic oligonucleotide
  Target: ATXN1; (-) strand; PAM type: NNGRRT; PAM sequence: GGGAGT
cgggcggatcacctgaggtc

SEQ ID NO: 15932 - DNA, 20 bp, Artificial Sequence
  Description of Artificial Sequence: Synthetic oligonucleotide
  Target: ATXN1; (-) strand; PAM type: NNGRRT; PAM sequence: GCGGAT
actttgggaggccgaggcgg

SEQ ID NO: 15933 - DNA, 20 bp, Artificial Sequence
  Description of Artificial Sequence: Synthetic oligonucleotide
  Target: ATXN1; (-) strand; PAM type: NNGRRT; PAM sequence: CCGGGT
ctgaaaatacaaaaattagg

SEQ ID NO: 15934 - DNA, 20 bp, Artificial Sequence
  Description of Artificial Sequence: Synthetic oligonucleotide
  Target: ATXN1; (-) strand; PAM type: NNGRRT; PAM sequence: CTGGGT
gctgttaatatagggggaaa

SEQ ID NO: 15935 - DNA, 20 bp, Artificial Sequence
  Description of Artificial Sequence: Synthetic oligonucleotide
  Target: ATXN1; (-) strand; PAM type: NNGRRT; PAM sequence: TTGAGT
ctaatacaccctacggtttg

SEQ ID NO: 15936 - DNA, 20 bp, Artificial Sequence
  Description of Artificial Sequence: Synthetic oligonucleotide
  Target: ATXN1; (-) strand; PAM type: NNGRRT; PAM sequence: AAGGAT
caaggtctttaaggataagg

SEQ ID NO: 15937 - DNA, 20 bp, Artificial Sequence
  Description of Artificial Sequence: Synthetic oligonucleotide
  Target: ATXN1; (-) strand; PAM type: NNGRRT; PAM sequence: AAGGAT
ttaaaattgtcaaggtcttt

SEQ ID NO: 15938 - DNA, 20 bp, Artificial Sequence
  Description of Artificial Sequence: Synthetic oligonucleotide
  Target: ATXN1; (-) strand; PAM type: NNGRRT; PAM sequence: CTGAGT
cctggcagacatcaccttaa

SEQ ID NO: 15939 - DNA, 20 bp, Artificial Sequence
  Description of Artificial Sequence: Synthetic oligonucleotide
  Target: ATXN1; (-) strand; PAM type: NNGRRT; PAM sequence: AAGAAT
aaaaataaaagtttacggtg

SEQ ID NO: 15940 - DNA, 20 bp, Artificial Sequence
  Description of Artificial Sequence: Synthetic oligonucleotide
  Target: ATXN1; (-) strand; PAM type: NNGRRT; PAM sequence: TAGAAT
atgcagaaacaggaaattcg

SEQ ID NO: 15941 - DNA, 20 bp, Artificial Sequence
  Description of Artificial Sequence: Synthetic oligonucleotide
  Target: ATXN1; (-) strand; PAM type: NNGRRT; PAM sequence: TAGAAT
cagatgtggattagatggat

SEQ ID NO: 15942 - DNA, 20 bp, Artificial Sequence
  Description of Artificial Sequence: Synthetic oligonucleotide
  Target: ATXN1; (-) strand; PAM type: NNGRRT; PAM sequence: ATGGAT
gatgggcagatgtggattag

SEQ ID NO: 15943 - DNA, 20 bp, Artificial Sequence
  Description of Artificial Sequence: Synthetic oligonucleotide
  Target: ATXN1; (-) strand; PAM type: NNGRRT; PAM sequence: GTGGAT
gatgcattagatgggcagat

SEQ ID NO: 15944 - DNA, 20 bp, Artificial Sequence
  Description of Artificial Sequence: Synthetic oligonucleotide
  Target: ATXN1; (-) strand; PAM type: NNGRRT; PAM sequence: ATGGAT
gccacgagaaagtcccaccg

SEQ ID NO: 15945 - DNA, 20 bp, Artificial Sequence
  Description of Artificial Sequence: Synthetic oligonucleotide
  Target: ATXN1; (-) strand; PAM type: NNGRRT; PAM sequence: AAGAAT
acatcattagaactcatagt

SEQ ID NO: 15946 - DNA, 20 bp, Artificial Sequence
  Description of Artificial Sequence: Synthetic oligonucleotide
  Target: ATXN1; (-) strand; PAM type: NNGRRT; PAM sequence: CAGAAT
ggaatgactcttccctgcag

SEQ ID NO: 15947 - DNA, 20 bp, Artificial Sequence
  Description of Artificial Sequence: Synthetic oligonucleotide
  Target: ATXN1; (-) strand; PAM type: NNGRRT; PAM sequence: AGGAAT
gaataaataaataagggaaa

SEQ ID NO: 15948 - DNA, 20 bp, Artificial Sequence
  Description of Artificial Sequence: Synthetic oligonucleotide
  Target: ATXN1; (-) strand; PAM type: NNGRRT; PAM sequence: ATGAAT
taaaatatccaacgagtcca

SEQ ID NO: 15949 - DNA, 20 bp, Artificial Sequence
  Description of Artificial Sequence: Synthetic oligonucleotide
  Target: ATXN1; (-) strand; PAM type: NNGRRT; PAM sequence: ACGAGT
cccaaagaataaaatatcca

SEQ ID NO: 15950 - DNA, 20 bp, Artificial Sequence
  Description of Artificial Sequence: Synthetic oligonucleotide
  Target: ATXN1; (-) strand; PAM type: NNGRRT; PAM sequence: AAGAAT
aaatgctggattataaccca

SEQ ID NO: 15951 - DNA, 20 bp, Artificial Sequence
  Description of Artificial Sequence: Synthetic oligonucleotide
  Target: ATXN1; (-) strand; PAM type: NNGRRT; PAM sequence: CTGGAT
actgggtaaggaaataaatg

SEQ ID NO: 15952 - DNA, 20 bp, Artificial Sequence
  Description of Artificial Sequence: Synthetic oligonucleotide
  Target: ATXN1; (-) strand; PAM type: NNGRRT; PAM sequence: CTGGGT
ctagctacagcttagaataa

SEQ ID NO: 15953 - DNA, 20 bp, Artificial Sequence
  Description of Artificial Sequence: Synthetic oligonucleotide
  Target: ATXN1; (-) strand; PAM type: NNGRRT; PAM sequence: TAGAAT
tagaatatctagctacagct

SEQ ID NO: 15954 - DNA, 20 bp, Artificial Sequence
  Description of Artificial Sequence: Synthetic oligonucleotide
  Target: ATXN1; (-) strand; PAM type: NNGRRT; PAM sequence: TAGAAT
ctgtgtctgctctgaaatgg

SEQ ID NO: 15955 - DNA, 20 bp, Artificial Sequence
  Description of Artificial Sequence: Synthetic oligonucleotide
  Target: ATXN1; (-) strand; PAM type: NNGRRT; PAM sequence: CTGAAT
caaatgaatgaacagatgag

SEQ ID NO: 15956 - DNA, 20 bp, Artificial Sequence
  Description of Artificial Sequence: Synthetic oligonucleotide
  Target: ATXN1; (-) strand; PAM type: NNGRRT; PAM sequence: ATGAAT
ccctcaagataacctgtcaa

SEQ ID NO: 15957 - DNA, 20 bp, Artificial Sequence
  Description of Artificial Sequence: Synthetic oligonucleotide
  Target: ATXN1; (-) strand; PAM type: NNGRRT; PAM sequence: AGGAAT
gctgtaaaccactcggacag

SEQ ID NO: 15958 - DNA, 20 bp, Artificial Sequence
  Description of Artificial Sequence: Synthetic oligonucleotide
  Target: ATXN1; (-) strand; PAM type: NNGRRT; PAM sequence: TAGAGT
cacacccctttttctccagg

SEQ ID NO: 15959 - DNA, 20 bp, Artificial Sequence
  Description of Artificial Sequence: Synthetic oligonucleotide
  Target: ATXN1; (-) strand; PAM type: NNGRRT; PAM sequence: CAGGAT
gcagtacaatagaagggaag

SEQ ID NO: 15960 - DNA, 20 bp, Artificial Sequence
  Description of Artificial Sequence: Synthetic oligonucleotide
  Target: ATXN1; (-) strand; PAM type: NNGRRT; PAM sequence: TGGAGT
gtttagaagattcaggggct

SEQ ID NO: 15961 - DNA, 20 bp, Artificial Sequence
  Description of Artificial Sequence: Synthetic oligonucleotide
  Target: ATXN1; (-) strand; PAM type: NNGRRT; PAM sequence: GGGAAT
tgcccttgaggtttgatgtg

SEQ ID NO: 15962 - DNA, 20 bp, Artificial Sequence
  Description of Artificial Sequence: Synthetic oligonucleotide
  Target: ATXN1; (-) strand; PAM type: NNGRRT; PAM sequence: CTGAGT
atagtcactatataaagagt

SEQ ID NO: 15963 - DNA, 20 bp, Artificial Sequence
  Description of Artificial Sequence: Synthetic oligonucleotide
  Target: ATXN1; (-) strand; PAM type: NNGRRT; PAM sequence: AAGAGT
aagcacatagtcactatata

SEQ ID NO: 15964 - DNA, 20 bp, Artificial Sequence
  Description of Artificial Sequence: Synthetic oligonucleotide
  Target: ATXN1; (-) strand; PAM type: NNGRRT; PAM sequence: CTGGAT
gatgaaattggatttgaaga

SEQ ID NO: 15965 - DNA, 20 bp, Artificial Sequence
  Description of Artificial Sequence: Synthetic oligonucleotide
  Target: ATXN1; (-) strand; PAM type: NNGRRT; PAM sequence: TTGGAT
aaggaataaaaacgatgaaa

SEQ ID NO: 15966 - DNA, 20 bp, Artificial Sequence
  Description of Artificial Sequence: Synthetic oligonucleotide
  Target: ATXN1; (-) strand; PAM type: NNGRRT; PAM sequence: AGGAAT
ctcttcattattccctgtga

SEQ ID NO: 15967 - DNA, 20 bp, Artificial Sequence
  Description of Artificial Sequence: Synthetic oligonucleotide
  Target: ATXN1; (-) strand; PAM type: NNGRRT; PAM sequence: GGGAGT
gaattaagtaaagagactta

SEQ ID NO: 15968 - DNA, 20 bp, Artificial Sequence
  Description of Artificial Sequence: Synthetic oligonucleotide
  Target: ATXN1; (-) strand; PAM type: NNGRRT; PAM sequence: TTGAAT
gtaagagcagtacaagaaaa

SEQ ID NO: 15969 - DNA, 20 bp, Artificial Sequence
  Description of Artificial Sequence: Synthetic oligonucleotide
  Target: ATXN1; (-) strand; PAM type: NNGRRT; PAM sequence: CAGAGT
gctttggatgaagaatgttg

SEQ ID NO: 15970 - DNA, 20 bp, Artificial Sequence
  Description of Artificial Sequence: Synthetic oligonucleotide
  Target: ATXN1; (-) strand; PAM type: NNGRRT; PAM sequence: AAGAAT
aattgaaaatgctttggatg

SEQ ID NO: 15971 - DNA, 20 bp, Artificial Sequence
  Description of Artificial Sequence: Synthetic oligonucleotide
  Target: ATXN1; (-) strand; PAM type: NNGRRT; PAM sequence: TTGGAT
tgcttggaattgaaaatgct

SEQ ID NO: 15972 - DNA, 20 bp, Artificial Sequence
  Description of Artificial Sequence: Synthetic oligonucleotide
  Target: ATXN1; (-) strand; PAM type: NNGRRT; PAM sequence: TGGAAT
tccttgtgtctttgcttgct

SEQ ID NO: 15973 - DNA, 20 bp, Artificial Sequence
  Description of Artificial Sequence: Synthetic oligonucleotide
  Target: ATXN1; (-) strand; PAM type: NNGRRT; PAM sequence: CTGAAT
gtttaagtgtcaataagtgt

SEQ ID NO: 15974 - DNA, 20 bp, Artificial Sequence
  Description of Artificial Sequence: Synthetic oligonucleotide
  Target: ATXN1; (-) strand; PAM type: NNGRRT; PAM sequence: AGGAGT
tcatcctttagaacaatagt

SEQ ID NO: 15975 - DNA, 20 bp, Artificial Sequence
  Description of Artificial Sequence: Synthetic oligonucleotide
  Target: ATXN1; (-) strand; PAM type: NNGRRT; PAM sequence: GAGAAT
atgtaacattatatgtgcag

SEQ ID NO: 15976 - DNA, 20 bp, Artificial Sequence
  Description of Artificial Sequence: Synthetic oligonucleotide
  Target: ATXN1; (-) strand; PAM type: NNGRRT; PAM sequence: ATGAAT
gcttatttgtatgtgcattc

SEQ ID NO: 15977 - DNA, 20 bp, Artificial Sequence
  Description of Artificial Sequence: Synthetic oligonucleotide
  Target: ATXN1; (-) strand; PAM type: NNGRRT; PAM sequence: GGGGGT
ttataaatgcatgctaacat

SEQ ID NO: 15978 - DNA, 20 bp, Artificial Sequence
  Description of Artificial Sequence: Synthetic oligonucleotide
  Target: ATXN1; (-) strand; PAM type: NNGRRT; PAM sequence: CGGGGT
gtgtatactccatgcatgct

SEQ ID NO: 15979 - DNA, 20 bp, Artificial Sequence
  Description of Artificial Sequence: Synthetic oligonucleotide
  Target: ATXN1; (-) strand; PAM type: NNGRRT; PAM sequence: CTGAGT
tgaagcacggtaaatcttta

SEQ ID NO: 15980 - DNA, 20 bp, Artificial Sequence
  Description of Artificial Sequence: Synthetic oligonucleotide
  Target: ATXN1; (-) strand; PAM type: NNGRRT; PAM sequence: AAGAGT
tgtgtctgtggtctggggac

SEQ ID NO: 15981 - DNA, 20 bp, Artificial Sequence
  Description of Artificial Sequence: Synthetic oligonucleotide
  Target: ATXN1; (-) strand; PAM type: NNGRRT; PAM sequence: CGGGGT
gaggtctgggcagagaaaag

SEQ ID NO: 15982 - DNA, 20 bp, Artificial Sequence
  Description of Artificial Sequence: Synthetic oligonucleotide
  Target: ATXN1; (-) strand; PAM type: NNGRRT; PAM sequence: TTGAAT
atattgcctgtgagtaaacc

SEQ ID NO: 15983 - DNA, 20 bp, Artificial Sequence
  Description of Artificial Sequence: Synthetic oligonucleotide
  Target: ATXN1; (-) strand; PAM type: NNGRRT; PAM sequence: GTGAGT
ttttatagtaaatattgcct

SEQ ID NO: 15984 - DNA, 20 bp, Artificial Sequence
  Description of Artificial Sequence: Synthetic oligonucleotide
  Target: ATXN1; (-) strand; PAM type: NNGRRT; PAM sequence: TGGGAT
tcctcggcctcccaaagggc

SEQ ID NO: 15985 - DNA, 20 bp, Artificial Sequence
  Description of Artificial Sequence: Synthetic oligonucleotide
  Target: ATXN1; (-) strand; PAM type: NNGRRT; PAM sequence: TGGGGT
ttttgtatttttagtagaga

SEQ ID NO: 15986 - DNA, 20 bp, Artificial Sequence
  Description of Artificial Sequence: Synthetic oligonucleotide
  Target: ATXN1; (-) strand; PAM type: NNGRRT; PAM sequence: TGGAGT
tcttgctctgttgcccaagc

SEQ ID NO: 15987 - DNA, 20 bp, Artificial Sequence
  Description of Artificial Sequence: Synthetic oligonucleotide
  Target: ATXN1; (-) strand; PAM type: NNGRRT; PAM sequence: CAGAGT
ttttttttttttttttgaga

SEQ ID NO: 15988 - DNA, 20 bp, Artificial Sequence
  Description of Artificial Sequence: Synthetic oligonucleotide
  Target: ATXN1; (-) strand; PAM type: NNGRRT; PAM sequence: CAGAAT
tattctggtaagccctgtaa

SEQ ID NO: 15989 - DNA, 20 bp, Artificial Sequence
  Description of Artificial Sequence: Synthetic oligonucleotide
  Target: ATXN1; (-) strand; PAM type: NNGRRT; PAM sequence: CAGAAT
cagaaattcttctatgttta

SEQ ID NO: 15990 - DNA, 20 bp, Artificial Sequence
  Description of Artificial Sequence: Synthetic oligonucleotide
  Target: ATXN1; (-) strand; PAM type: NNGRRT; PAM sequence: ATGAAT
ataaaaatttaaaaattcat

SEQ ID NO: 15991 - DNA, 20 bp, Artificial Sequence
  Description of Artificial Sequence: Synthetic oligonucleotide
  Target: ATXN1; (-) strand; PAM type: NNGRRT; PAM sequence: TGGAGT
ctctgcaatttcttatggca

SEQ ID NO: 15992 - DNA, 20 bp, Artificial Sequence
  Description of Artificial Sequence: Synthetic oligonucleotide
  Target: ATXN1; (-) strand; PAM type: NNGRRT; PAM sequence: AGGGGT
aattataatatctgtctcac

SEQ ID NO: 15993 - DNA, 20 bp, Artificial Sequence
  Description of Artificial Sequence: Synthetic oligonucleotide
  Target: ATXN1; (-) strand; PAM type: NNGRRT; PAM sequence: GAGGGT
agggaaatcactcaaaatct

SEQ ID NO: 15994 - DNA, 20 bp, Artificial Sequence
  Description of Artificial Sequence: Synthetic oligonucleotide
  Target: ATXN1; (-) strand; PAM type: NNGRRT; PAM sequence: TTGAAT
caatatcagaaattctagtt

SEQ ID NO: 15995 - DNA, 20 bp, Artificial Sequence
  Description of Artificial Sequence: Synthetic oligonucleotide
  Target: ATXN1; (-) strand; PAM type: NNGRRT; PAM sequence: ATGAAT
attataaaatagaaccaaaa

SEQ ID NO: 15996 - DNA, 20 bp, Artificial Sequence
  Description of Artificial Sequence: Synthetic oligonucleotide
  Target: ATXN1; (-) strand; PAM type: NNGRRT; PAM sequence: TAGAGT
tatgtaatgagcagaattta

SEQ ID NO: 15997 - DNA, 20 bp, Artificial Sequence
  Description of Artificial Sequence: Synthetic oligonucleotide
  Target: ATXN1; (-) strand; PAM type: NNGRRT; PAM sequence: CAGAAT
taaaatgtttatgtaatgag

SEQ ID NO: 15998 - DNA, 20 bp, Artificial Sequence
  Description of Artificial Sequence: Synthetic oligonucleotide
  Target: ATXN1; (-) strand; PAM type: NNGRRT; PAM sequence: AAGAGT
accaaaaaatttagagatta

SEQ ID NO: 15999 - DNA, 20 bp, Artificial Sequence
  Description of Artificial Sequence: Synthetic oligonucleotide
  Target: ATXN1; (-) strand; PAM type: NNGRRT; PAM sequence: GGGAAT
ctctcaaaaggaagattcca

SEQ ID NO: 16000 - DNA, 20 bp, Artificial Sequence
  Description of Artificial Sequence: Synthetic oligonucleotide
  Target: ATXN1; (-) strand; PAM type: NNGRRT; PAM sequence: GTGGAT
atatgagcgtggaagtcgta

SEQ ID NO: 16001 - DNA, 20 bp, Artificial Sequence
  Description of Artificial Sequence: Synthetic oligonucleotide
  Target: ATXN1; (-) strand; PAM type: NNGRRT; PAM sequence: TAGGAT
gtagccattgtgataaatat

SEQ ID NO: 16002 - DNA, 20 bp, Artificial Sequence
  Description of Artificial Sequence: Synthetic oligonucleotide
  Target: ATXN1; (-) strand; PAM type: NNGRRT; PAM sequence: TGGGGT
actcttcagattttctggaa

SEQ ID NO: 16003 - DNA, 20 bp, Artificial Sequence
  Description of Artificial Sequence: Synthetic oligonucleotide
  Target: ATXN1; (-) strand; PAM type: NNGRRT; PAM sequence: TGGAAT
gtagaactcttcagattttc

SEQ ID NO: 16004 - DNA, 20 bp, Artificial Sequence
  Description of Artificial Sequence: Synthetic oligonucleotide
  Target: ATXN1; (-) strand; PAM type: NNGRRT; PAM sequence: TTGAGT
gattcgagaagtagatgtgg

SEQ ID NO: 16005 - DNA, 20 bp, Artificial Sequence
  Description of Artificial Sequence: Synthetic oligonucleotide
  Target: ATXN1; (-) strand; PAM type: NNGRRT; PAM sequence: GGGAAT
ctgtttaattccaggatctt

SEQ ID NO: 16006 - DNA, 20 bp, Artificial Sequence
  Description of Artificial Sequence: Synthetic oligonucleotide
  Target: ATXN1; (-) strand; PAM type: NNGRRT; PAM sequence: CAGGAT
aaaactcttctgtttaattc

SEQ ID NO: 16007 - DNA, 20 bp, Artificial Sequence
  Description of Artificial Sequence: Synthetic oligonucleotide
  Target: ATXN1; (-) strand; PAM type: NNGRRT; PAM sequence: AAGGAT
accctttgggctggctctgg

SEQ ID NO: 16008 - DNA, 20 bp, Artificial Sequence
  Description of Artificial Sequence: Synthetic oligonucleotide
  Target: ATXN1; (-) strand; PAM type: NNGRRT; PAM sequence: AGGAGT
cagaaagtactcagctgaga

SEQ ID NO: 16009 - DNA, 20 bp, Artificial Sequence
  Description of Artificial Sequence: Synthetic oligonucleotide
  Target: ATXN1; (-) strand; PAM type: NNGRRT; PAM sequence: ATGGAT
caggctgtgctggcacataa

SEQ ID NO: 16010 - DNA, 20 bp, Artificial Sequence
  Description of Artificial Sequence: Synthetic oligonucleotide
  Target: ATXN1; (-) strand; PAM type: NNGRRT; PAM sequence: AAGAAT
ggaatatagtgaccacagtc

SEQ ID NO: 16011 - DNA, 20 bp, Artificial Sequence
  Description of Artificial Sequence: Synthetic oligonucleotide
  Target: ATXN1; (-) strand; PAM type: NNGRRT; PAM sequence: TGGAAT
gctctaacttgtgtcactgc

SEQ ID NO: 16012 - DNA, 20 bp, Artificial Sequence
  Description of Artificial Sequence: Synthetic oligonucleotide
  Target: ATXN1; (-) strand; PAM type: NNGRRT; PAM sequence: GAGGAT
ggaattgggcaataagatgg

SEQ ID NO: 16013 - DNA, 20 bp, Artificial Sequence
  Description of Artificial Sequence: Synthetic oligonucleotide
  Target: ATXN1; (-) strand; PAM type: NNGRRT; PAM sequence: TGGAAT
cattaaaacagcagggaaag

SEQ ID NO: 16014 - DNA, 20 bp, Artificial Sequence
  Description of Artificial Sequence: Synthetic oligonucleotide
  Target: ATXN1; (-) strand; PAM type: NNGRRT; PAM sequence: AGGAGT
tatatgacagtttggggaaa

SEQ ID NO: 16015 - DNA, 20 bp, Artificial Sequence
  Description of Artificial Sequence: Synthetic oligonucleotide
  Target: ATXN1; (-) strand; PAM type: NNGRRT; PAM sequence: TGGAGT
cactgaaatacagccatctc

SEQ ID NO: 16016 - DNA, 20 bp, Artificial Sequence
  Description of Artificial Sequence: Synthetic oligonucleotide
  Target: ATXN1; (-) strand; PAM type: NNGRRT; PAM sequence: AGGGAT
tgagtatttcgatgacacag

SEQ ID NO: 16017 - DNA, 20 bp, Artificial Sequence
  Description of Artificial Sequence: Synthetic oligonucleotide
  Target: ATXN1; (-) strand; PAM type: NNGRRT; PAM sequence: ATGAGT
ccagatgcttaaccccttaa

SEQ ID NO: 16018 - DNA, 20 bp, Artificial Sequence
  Description of Artificial Sequence: Synthetic oligonucleotide
  Target: ATXN1; (-) strand; PAM type: NNGRRT; PAM sequence: CAGGAT
gagctaatgacctccttctc

SEQ ID NO: 16019 - DNA, 20 bp, Artificial Sequence
  Description of Artificial Sequence: Synthetic oligonucleotide
  Target: ATXN1; (-) strand; PAM type: NNGRRT; PAM sequence: TAGAGT
cgtgcattttagtggctgca

SEQ ID NO: 16020 - DNA, 20 bp, Artificial Sequence
  Description of Artificial Sequence: Synthetic oligonucleotide
  Target: ATXN1; (-) strand; PAM type: NNGRRT; PAM sequence: ATGAGT
ccaagttctccatctgtaac

SEQ ID NO: 16021 - DNA, 20 bp, Artificial Sequence
  Description of Artificial Sequence: Synthetic oligonucleotide
  Target: ATXN1; (-) strand; PAM type: NNGRRT; PAM sequence: GCGGGT
ttggacttgggaatgaatcg

SEQ ID NO: 16022 - DNA, 20 bp, Artificial Sequence
  Description of Artificial Sequence: Synthetic oligonucleotide
  Target: ATXN1; (-) strand; PAM type: NNGRRT; PAM sequence: ATGAAT
aaacgcccttggacttggga

SEQ ID NO: 16023 - DNA, 20 bp, Artificial Sequence
  Description of Artificial Sequence: Synthetic oligonucleotide
  Target: ATXN1; (-) strand; PAM type: NNGRRT; PAM sequence: GGGAAT
agtgaaacgcccttggactt

SEQ ID NO: 16024 - DNA, 20 bp, Artificial Sequence
  Description of Artificial Sequence: Synthetic oligonucleotide
  Target: ATXN1; (-) strand; PAM type: NNGRRT; PAM sequence: CTGAGT
actgacggagatgtgatact

SEQ ID NO: 16025 - DNA, 20 bp, Artificial Sequence
  Description of Artificial Sequence: Synthetic oligonucleotide
  Target: ATXN1; (-) strand; PAM type: NNGRRT; PAM sequence: CTGGGT
gatgccgtgtgctttagaag

SEQ ID NO: 16026 - DNA, 20 bp, Artificial Sequence
  Description of Artificial Sequence: Synthetic oligonucleotide
  Target: ATXN1; (-) strand; PAM type: NNGRRT; PAM sequence: AAGAAT
taaacatagccaaacaaaac

SEQ ID NO: 16027 - DNA, 20 bp, Artificial Sequence
  Description of Artificial Sequence: Synthetic oligonucleotide
  Target: ATXN1; (-) strand; PAM type: NNGRRT; PAM sequence: CTGAGT
ttttcctggtggagattttc

SEQ ID NO: 16028 - DNA, 20 bp, Artificial Sequence
  Description of Artificial Sequence: Synthetic oligonucleotide
  Target: ATXN1; (-) strand; PAM type: NNGRRT; PAM sequence: CAGAAT
gggagccacagagccactgt

SEQ ID NO: 16029 - DNA, 20 bp, Artificial Sequence
  Description of Artificial Sequence: Synthetic oligonucleotide
  Target: ATXN1; (-) strand; PAM type: NNGRRT; PAM sequence: TTGAGT
tttgggaaggtagttttttt

SEQ ID NO: 16030 - DNA, 20 bp, Artificial Sequence
  Description of Artificial Sequence: Synthetic oligonucleotide
  Target: ATXN1; (-) strand; PAM type: NNGRRT; PAM sequence: CTGAAT
ggtaattttttagatttttg

SEQ ID NO: 16031 - DNA, 20 bp, Artificial Sequence
  Description of Artificial Sequence: Synthetic oligonucleotide
  Target: ATXN1; (-) strand; PAM type: NNGRRT; PAM sequence: CAGAAT
attaagaaggatcatctctt

SEQ ID NO: 16032 - DNA, 20 bp, Artificial Sequence
  Description of Artificial Sequence: Synthetic oligonucleotide
  Target: ATXN1; (-) strand; PAM type: NNGRRT; PAM sequence: AAGGAT
tatatgccaaaagtattaag

SEQ ID NO: 16033 - DNA, 20 bp, Artificial Sequence
  Description of Artificial Sequence: Synthetic oligonucleotide
  Target: ATXN1; (-) strand; PAM type: NNGRRT; PAM sequence: GTGAAT
atttcatcagtgttcaaata

SEQ ID NO: 16034 - DNA, 20 bp, Artificial Sequence
  Description of Artificial Sequence: Synthetic oligonucleotide
  Target: ATXN1; (-) strand; PAM type: NNGRRT; PAM sequence: CTGAAT
taactcaagatctgtgctcc

SEQ ID NO: 16035 - DNA, 20 bp, Artificial Sequence
  Description of Artificial Sequence: Synthetic oligonucleotide
  Target: ATXN1; (-) strand; PAM type: NNGRRT; PAM sequence: TAGGAT
taggagagcttttgacatta

SEQ ID NO: 16036 - DNA, 20 bp, Artificial Sequence
  Description of Artificial Sequence: Synthetic oligonucleotide
  Target: ATXN1; (-) strand; PAM type: NNGRRT; PAM sequence: AGGAAT
taaatatgttttctaaattc

SEQ ID NO: 16037 - DNA, 20 bp, Artificial Sequence
  Description of Artificial Sequence: Synthetic oligonucleotide
  Target: ATXN1; (-) strand; PAM type: NNGRRT; PAM sequence: TTGGAT
ggcgtagcttttaaactatt

SEQ ID NO: 16038 - DNA, 20 bp, Artificial Sequence
  Description of Artificial Sequence: Synthetic oligonucleotide
  Target: ATXN1; (-) strand; PAM type: NNGRRT; PAM sequence: AAGAGT
aaatgtagggtcaaagattc

SEQ ID NO: 16039 - DNA, 20 bp, Artificial Sequence
  Description of Artificial Sequence: Synthetic oligonucleotide
  Target: ATXN1; (-) strand; PAM type: NNGRRT; PAM sequence: TAGGGT
ttaggaaaagcgaaaaaatg

SEQ ID NO: 16040 - DNA, 20 bp, Artificial Sequence
  Description of Artificial Sequence: Synthetic oligonucleotide
  Target: ATXN1; (-) strand; PAM type: NNGRRT; PAM sequence: TTGGGT
ctccataattcatagccagt

SEQ ID NO: 16041 - DNA, 20 bp, Artificial Sequence
  Description of Artificial Sequence: Synthetic oligonucleotide
  Target: ATXN1; (-) strand; PAM type: NNGRRT; PAM sequence: GTGAGT
aaaagaaaaactgtagggtt

SEQ ID NO: 16042 - DNA, 20 bp, Artificial Sequence
  Description of Artificial Sequence: Synthetic oligonucleotide
  Target: ATXN1; (-) strand; PAM type: NNGRRT; PAM sequence: TAGGGT
aaacacaaaaagaaaaactg

SEQ ID NO: 16043 - DNA, 20 bp, Artificial Sequence
  Description of Artificial Sequence: Synthetic oligonucleotide
  Target: ATXN1; (-) strand; PAM type: NNGRRT; PAM sequence: TGGGGT
acacagtgcattctcgaaca

SEQ ID NO: 16044 - DNA, 20 bp, Artificial Sequence
  Description of Artificial Sequence: Synthetic oligonucleotide
  Target: ATXN1; (-) strand; PAM type: NNGRRT; PAM sequence: TTGAGT
tctttctttaacatgtccag

SEQ ID NO: 16045 - DNA, 20 bp, Artificial Sequence
  Description of Artificial Sequence: Synthetic oligonucleotide
  Target: ATXN1; (-) strand; PAM type: NNGRRT; PAM sequence: TCGGAT
taaaggctgcatttttagct

SEQ ID NO: 16046 - DNA, 20 bp, Artificial Sequence
  Description of Artificial Sequence: Synthetic oligonucleotide
  Target: ATXN1; (-) strand; PAM type: NNGRRT; PAM sequence: CTGGGT
ttaccttcctccctccattc

SEQ ID NO: 16047 - DNA, 20 bp, Artificial Sequence
  Description of Artificial Sequence: Synthetic oligonucleotide
  Target: ATXN1; (-) strand; PAM type: NNGRRT; PAM sequence: TGGGAT
cttccactcagcattgtttg

SEQ ID NO: 16048 - DNA, 20 bp, Artificial Sequence
  Description of Artificial Sequence: Synthetic oligonucleotide
  Target: ATXN1; (-) strand; PAM type: NNGRRT; PAM sequence: GAGAGT
acccactataattcacctca

SEQ ID NO: 16049 - DNA, 20 bp, Artificial Sequence
  Description of Artificial Sequence: Synthetic oligonucleotide
  Target: ATXN1; (-) strand; PAM type: NNGRRT; PAM sequence: AAGAAT
ttttcttaaccacccaaagg

SEQ ID NO: 16050 - DNA, 20 bp, Artificial Sequence
  Description of Artificial Sequence: Synthetic oligonucleotide
  Target: ATXN1; (-) strand; PAM type: NNGRRT; PAM sequence: ATGGAT
tctacaaacatgttagaaag

SEQ ID NO: 16051 - DNA, 20 bp, Artificial Sequence
  Description of Artificial Sequence: Synthetic oligonucleotide
  Target: ATXN1; (-) strand; PAM type: NNGRRT; PAM sequence: ATGAGT
tatccttaagaaattgtgaa

SEQ ID NO: 16052 - DNA, 20 bp, Artificial Sequence
  Description of Artificial Sequence: Synthetic oligonucleotide
  Target: ATXN1; (-) strand; PAM type: NNGRRT; PAM sequence: TCGAAT
agcgtactgtctaacacccc

SEQ ID NO: 16053 - DNA, 20 bp, Artificial Sequence
  Description of Artificial Sequence: Synthetic oligonucleotide
  Target: ATXN1; (-) strand; PAM type: NNGRRT; PAM sequence: GAGAAT
gcatagaacagaaagaacca

SEQ ID NO: 16054 - DNA, 20 bp, Artificial Sequence
  Description of Artificial Sequence: Synthetic oligonucleotide
  Target: ATXN1; (-) strand; PAM type: NNGRRT; PAM sequence: TGGAGT
tgacaaaagactggccctaa

SEQ ID NO: 16055 - DNA, 20 bp, Artificial Sequence
  Description of Artificial Sequence: Synthetic oligonucleotide
  Target: ATXN1; (-) strand; PAM type: NNGRRT; PAM sequence: TTGAAT
acaaagttaaagcacaactt

SEQ ID NO: 16056 - DNA, 20 bp, Artificial Sequence
  Description of Artificial Sequence: Synthetic oligonucleotide
  Target: ATXN1; (-) strand; PAM type: NNGRRT; PAM sequence: TAGGAT
atggggactttggggtgtct

SEQ ID NO: 16057 - DNA, 20 bp, Artificial Sequence
  Description of Artificial Sequence: Synthetic oligonucleotide
  Target: ATXN1; (-) strand; PAM type: NNGRRT; PAM sequence: TGGGGT
gcaaagtcccatggggactt

SEQ ID NO: 16058 - DNA, 20 bp, Artificial Sequence
  Description of Artificial Sequence: Synthetic oligonucleotide
  Target: ATXN1; (-) strand; PAM type: NNGRRT; PAM sequence: CAGAAT
gacctatctgcaagaccagg

SEQ ID NO: 16059 - DNA, 20 bp, Artificial Sequence
  Description of Artificial Sequence: Synthetic oligonucleotide
  Target: ATXN1; (-) strand; PAM type: NNGRRT; PAM sequence: GAGAGT
aaatttctctagggagacag

SEQ ID NO: 16060 - DNA, 20 bp, Artificial Sequence
  Description of Artificial Sequence: Synthetic oligonucleotide
  Target: ATXN1; (-) strand; PAM type: NNGRRT; PAM sequence: CAGAAT
gttggttgtcaagggcttac

SEQ ID NO: 16061 - DNA, 20 bp, Artificial Sequence
  Description of Artificial Sequence: Synthetic oligonucleotide
  Target: ATXN1; (-) strand; PAM type: NNGRRT; PAM sequence: GTGGAT
gaagaaaggattctcttgct

SEQ ID NO: 16062 - DNA, 20 bp, Artificial Sequence
  Description of Artificial Sequence: Synthetic oligonucleotide
  Target: ATXN1; (-) strand; PAM type: NNGRRT; PAM sequence: AAGGAT
taaagactcagagaggaaga

SEQ ID NO: 16063 - DNA, 20 bp, Artificial Sequence
  Description of Artificial Sequence: Synthetic oligonucleotide
  Target: ATXN1; (-) strand; PAM type: NNGRRT; PAM sequence: TTGAAT
ccatatggaacatttggtat

SEQ ID NO: 16064 - DNA, 20 bp, Artificial Sequence
  Description of Artificial Sequence: Synthetic oligonucleotide
  Target: ATXN1; (-) strand; PAM type: NNGRRT; PAM sequence: GGGAAT
aggcctcaagtaacggtagt

SEQ ID NO: 16065 - DNA, 20 bp, Artificial Sequence
  Description of Artificial Sequence: Synthetic oligonucleotide
  Target: ATXN1; (-) strand; PAM type: NNGRRT; PAM sequence: ATGAGT
agattctgatgaggcacctc

SEQ ID NO: 16066 - DNA, 20 bp, Artificial Sequence
  Description of Artificial Sequence: Synthetic oligonucleotide
  Target: ATXN1; (-) strand; PAM type: NNGRRT; PAM sequence: AAGAGT
tagcaaatataggtcaggaa

SEQ ID NO: 16067 - DNA, 20 bp, Artificial Sequence
  Description of Artificial Sequence: Synthetic oligonucleotide
  Target: ATXN1; (-) strand; PAM type: NNGRRT; PAM sequence: TTGGAT
gatgaataagaaaacaaaac

SEQ ID NO: 16068 - DNA, 20 bp, Artificial Sequence
  Description of Artificial Sequence: Synthetic oligonucleotide
  Target: ATXN1; (-) strand; PAM type: NNGRRT; PAM sequence: ATGAAT
attcccctgtgactatgagg

SEQ ID NO: 16069 - DNA, 20 bp, Artificial Sequence
  Description of Artificial Sequence: Synthetic oligonucleotide
  Target: ATXN1; (-) strand; PAM type: NNGRRT; PAM sequence: GAGGAT
aatcattcccctgtgactat

SEQ ID NO: 16070 - DNA, 20 bp, Artificial Sequence
  Description of Artificial Sequence: Synthetic oligonucleotide
  Target: ATXN1; (-) strand; PAM type: NNGRRT; PAM sequence: AAGAAT
taattaagacatgttagctt

SEQ ID NO: 16071 - DNA, 20 bp, Artificial Sequence
  Description of Artificial Sequence: Synthetic oligonucleotide
  Target: ATXN1; (-) strand; PAM type: NNGRRT; PAM sequence: CTGAAT
tctcagcagaagaggaatat

SEQ ID NO: 16072 - DNA, 20 bp, Artificial Sequence
  Description of Artificial Sequence: Synthetic oligonucleotide
  Target: ATXN1; (-) strand; PAM type: NNGRRT; PAM sequence: AGGAAT
tctgtatttctcagcagaag

SEQ ID NO: 16073 - DNA, 20 bp, Artificial Sequence
  Description of Artificial Sequence: Synthetic oligonucleotide
  Target: ATXN1; (-) strand; PAM type: NNGRRT; PAM sequence: AAGAAT
agtgaaaggaaaagtggtca

SEQ ID NO: 16074 - DNA, 20 bp, Artificial Sequence
  Description of Artificial Sequence: Synthetic oligonucleotide
  Target: ATXN1; (-) strand; PAM type: NNGRRT; PAM sequence: GTGAAT
aaggggaaggctgtaggttt

SEQ ID NO: 16075 - DNA, 20 bp, Artificial Sequence
  Description of Artificial Sequence: Synthetic oligonucleotide
  Target: ATXN1; (-) strand; PAM type: NNGRRT; PAM sequence: CAGAGT
tacagcaagtgccttgggca

SEQ ID NO: 16076 - DNA, 20 bp, Artificial Sequence
  Description of Artificial Sequence: Synthetic oligonucleotide
  Target: ATXN1; (-) strand; PAM type: NNGRRT; PAM sequence: TTGGGT
gggcacccttggagcagccg

SEQ ID NO: 16077 - DNA, 20 bp, Artificial Sequence
  Description of Artificial Sequence: Synthetic oligonucleotide
  Target: ATXN1; (-) strand; PAM type: NNGRRT; PAM sequence: CTGGAT
agctttgaaaccatggctgt

SEQ ID NO: 16078 - DNA, 20 bp, Artificial Sequence
  Description of Artificial Sequence: Synthetic oligonucleotide
  Target: ATXN1; (-) strand; PAM type: NNGRRT; PAM sequence: TGGAGT
atggatttaatttgtattag

SEQ ID NO: 16079 - DNA, 20 bp, Artificial Sequence
  Description of Artificial Sequence: Synthetic oligonucleotide
  Target: ATXN1; (-) strand; PAM type: NNGRRT; PAM sequence: ATGGAT
agggtttagcatacttctga

SEQ ID NO: 16080 - DNA, 20 bp, Artificial Sequence
  Description of Artificial Sequence: Synthetic oligonucleotide
  Target: ATXN1; (-) strand; PAM type: NNGRRT; PAM sequence: CTGAAT
aaaaagggtttagcatactt

SEQ ID NO: 16081 - DNA, 20 bp, Artificial Sequence
  Description of Artificial Sequence: Synthetic oligonucleotide
  Target: ATXN1; (-) strand; PAM type: NNGRRT; PAM sequence: AAGGGT
cctcctctagtatctacaaa

SEQ ID NO: 16082 - DNA, 20 bp, Artificial Sequence
  Description of Artificial Sequence: Synthetic oligonucleotide
  Target: ATXN1; (-) strand; PAM type: NNGRRT; PAM sequence: TAGGGT
aatatagaagtaaacaaatg

SEQ ID NO: 16083 - DNA, 20 bp, Artificial Sequence
  Description of Artificial Sequence: Synthetic oligonucleotide
  Target: ATXN1; (-) strand; PAM type: NNGRRT; PAM sequence: AGGAGT
atcgttaaaactcctatttc

SEQ ID NO: 16084 - DNA, 20 bp, Artificial Sequence
  Description of Artificial Sequence: Synthetic oligonucleotide
  Target: ATXN1; (-) strand; PAM type: NNGRRT; PAM sequence: TTGGGT
aataatagtacccttctccc

SEQ ID NO: 16085 - DNA, 20 bp, Artificial Sequence
  Description of Artificial Sequence: Synthetic oligonucleotide
  Target: ATXN1; (-) strand; PAM type: NNGRRT; PAM sequence: TCGGAT
agttactttgcatgtaaaat

SEQ ID NO: 16086 - DNA, 20 bp, Artificial Sequence
  Description of Artificial Sequence: Synthetic oligonucleotide
  Target: ATXN1; (-) strand; PAM type: NNGRRT; PAM sequence: GGGAAT
gaaggagtagaagggtccta

SEQ ID NO: 16087 - DNA, 20 bp, Artificial Sequence
  Description of Artificial Sequence: Synthetic oligonucleotide
  Target: ATXN1; (-) strand; PAM type: NNGRRT; PAM sequence: AAGGGT
attaaatccagaaggagtag

SEQ ID NO: 16088 - DNA, 20 bp, Artificial Sequence
  Description of Artificial Sequence: Synthetic oligonucleotide
  Target: ATXN1; (-) strand; PAM type: NNGRRT; PAM sequence: AGGAGT
gaaataatattaaatccaga

SEQ ID NO: 16089 - DNA, 20 bp, Artificial Sequence
  Description of Artificial Sequence: Synthetic oligonucleotide
  Target: ATXN1; (-) strand; PAM type: NNGRRT; PAM sequence: GGGGGT
ttttgggttttgggggtggg

SEQ ID NO: 16090 - DNA, 20 bp, Artificial Sequence
  Description of Artificial Sequence: Synthetic oligonucleotide
  Target: ATXN1; (-) strand; PAM type: NNGRRT; PAM sequence: GGGGGT
ttccatgtattttgggtttt

SEQ ID NO: 16091 - DNA, 20 bp, Artificial Sequence
  Description of Artificial Sequence: Synthetic oligonucleotide
  Target: ATXN1; (-) strand; PAM type: NNGRRT; PAM sequence: TTGGGT
aaatggtgtttccatgtatt

SEQ ID NO: 16092 - DNA, 20 bp, Artificial Sequence
  Description of Artificial Sequence: Synthetic oligonucleotide
  Target: ATXN1; (-) strand; PAM type: NNGRRT; PAM sequence: AAGAGT
ctgagaattttgaaaacaaa

SEQ ID NO: 16093 - DNA, 20 bp, Artificial Sequence
  Description of Artificial Sequence: Synthetic oligonucleotide
  Target: ATXN1; (-) strand; PAM type: NNGRRT; PAM sequence: GAGAAT
taatacagttttccaatgct

SEQ ID NO: 16094 - DNA, 20 bp, Artificial Sequence
  Description of Artificial Sequence: Synthetic oligonucleotide
  Target: ATXN1; (-) strand; PAM type: NNGRRT; PAM sequence: AAGAGT
agcagcatactggtaaatgt

SEQ ID NO: 16095 - DNA, 20 bp, Artificial Sequence
  Description of Artificial Sequence: Synthetic oligonucleotide
  Target: ATXN1; (-) strand; PAM type: NNGRRT; PAM sequence: TGGGAT
acctcagcctcccaaagtgt

SEQ ID NO: 16096 - DNA, 20 bp, Artificial Sequence
  Description of Artificial Sequence: Synthetic oligonucleotide
  Target: ATXN1; (-) strand; PAM type: NNGRRT; PAM sequence: TGGAGT
tctcactctgtcacccaggc

SEQ ID NO: 16097 - DNA, 20 bp, Artificial Sequence
  Description of Artificial Sequence: Synthetic oligonucleotide
  Target: ATXN1; (-) strand; PAM type: NNGRRT; PAM sequence: TAGGGT
gcctttttattttcttgaga

SEQ ID NO: 16098 - DNA, 20 bp, Artificial Sequence
  Description of Artificial Sequence: Synthetic oligonucleotide
  Target: ATXN1; (-) strand; PAM type: NNGRRT; PAM sequence: TTGAGT
tattaatgattagtatacca

SEQ ID NO: 16099 - DNA, 20 bp, Artificial Sequence
  Description of Artificial Sequence: Synthetic oligonucleotide
  Target: ATXN1; (-) strand; PAM type: NNGRRT; PAM sequence: AAGAGT
tagaagtagtagagattatt

SEQ ID NO: 16100 - DNA, 20 bp, Artificial Sequence
  Description of Artificial Sequence: Synthetic oligonucleotide
  Target: ATXN1; (-) strand; PAM type: NNGRRT; PAM sequence: TAGGAT
cttattttgaggtcactagt

SEQ ID NO: 16101 - DNA, 20 bp, Artificial Sequence
  Description of Artificial Sequence: Synthetic oligonucleotide
  Target: ATXN1; (-) strand; PAM type: NNGRRT; PAM sequence: GGGGGT
aaagtccccaagatagtggt

SEQ ID NO: 16102 - DNA, 20 bp, Artificial Sequence
  Description of Artificial Sequence: Synthetic oligonucleotide
  Target: ATXN1; (-) strand; PAM type: NNGRRT; PAM sequence: TTGAGT
ttaaaggaaaataattatca

SEQ ID NO: 16103 - DNA, 20 bp, Artificial Sequence
  Description of Artificial Sequence: Synthetic oligonucleotide
  Target: ATXN1; (-) strand; PAM type: NNGRRT; PAM sequence: GAGAAT
cagaagcagcctaactcagt

SEQ ID NO: 16104 - DNA, 20 bp, Artificial Sequence
  Description of Artificial Sequence: Synthetic oligonucleotide
  Target: ATXN1; (-) strand; PAM type: NNGRRT; PAM sequence: GTGAAT
tttctgtgacttcagcgaat

SEQ ID NO: 16105 - DNA, 20 bp, Artificial Sequence
  Description of Artificial Sequence: Synthetic oligonucleotide
  Target: ATXN1; (-) strand; PAM type: NNGRRT; PAM sequence: GCGAAT
ttcccgtttctgtgacttca

SEQ ID NO: 16106 - DNA, 20 bp, Artificial Sequence
  Description of Artificial Sequence: Synthetic oligonucleotide
  Target: ATXN1; (-) strand; PAM type: NNGRRT; PAM sequence: CTGAGT
acctgctgtgtctctgcctg

SEQ ID NO: 16107 - DNA, 20 bp, Artificial Sequence
  Description of Artificial Sequence: Synthetic oligonucleotide
  Target: ATXN1; (-) strand; PAM type: NNGRRT; PAM sequence: GGGGAT
gccagaacccactcatccct

SEQ ID NO: 16108 - DNA, 20 bp, Artificial Sequence
  Description of Artificial Sequence: Synthetic oligonucleotide
  Target: ATXN1; (-) strand; PAM type: NNGRRT; PAM sequence: TGGGGT
gtgtcctcaaggggaggaga

SEQ ID NO: 16109 - DNA, 20 bp, Artificial Sequence
  Description of Artificial Sequence: Synthetic oligonucleotide
  Target: ATXN1; (-) strand; PAM type: NNGRRT; PAM sequence: CGGGAT
cagggaaggaggggcaggaa

SEQ ID NO: 16110 - DNA, 20 bp, Artificial Sequence
  Description of Artificial Sequence: Synthetic oligonucleotide
  Target: ATXN1; (-) strand; PAM type: NNGRRT; PAM sequence: TAGAAT
ttgttatttcttagaaatct

SEQ ID NO: 16111 - DNA, 20 bp, Artificial Sequence
  Description of Artificial Sequence: Synthetic oligonucleotide
  Target: ATXN1; (-) strand; PAM type: NNGRRT; PAM sequence: AGGAGT
tgcataattttgtggctaga

SEQ ID NO: 16112 - DNA, 20 bp, Artificial Sequence
  Description of Artificial Sequence: Synthetic oligonucleotide
  Target: ATXN1; (-) strand; PAM type: NNGRRT; PAM sequence: CTGAAT
cggaatggtaaatacatgca

SEQ ID NO: 16113 - DNA, 20 bp, Artificial Sequence
  Description of Artificial Sequence: Synthetic oligonucleotide
  Target: ATXN1; (-) strand; PAM type: NNGRRT; PAM sequence: CGGAAT
ttcaaaagtgaaagtgaggc

SEQ ID NO: 16114 - DNA, 20 bp, Artificial Sequence
  Description of Artificial Sequence: Synthetic oligonucleotide
  Target: ATXN1; (-) strand; PAM type: NNGRRT; PAM sequence: CTGAGT
tcactgacatcatgtcttaa

SEQ ID NO: 16115 - DNA, 20 bp, Artificial Sequence
  Description of Artificial Sequence: Synthetic oligonucleotide
  Target: ATXN1; (-) strand; PAM type: NNGRRT; PAM sequence: TGGAGT
ggccacctcacagactgcag

SEQ ID NO: 16116 - DNA, 20 bp, Artificial Sequence
  Description of Artificial Sequence: Synthetic oligonucleotide
  Target: ATXN1; (-) strand; PAM type: NNGRRT; PAM sequence: TAGAAT
ttgaagagatggtatagtac

SEQ ID NO: 16117 - DNA, 20 bp, Artificial Sequence
  Description of Artificial Sequence: Synthetic oligonucleotide
  Target: ATXN1; (-) strand; PAM type: NNGRRT; PAM sequence: TGGGAT
acctcagcctcccaaagtgc

SEQ ID NO: 16118 - DNA, 20 bp, Artificial Sequence
  Description of Artificial Sequence: Synthetic oligonucleotide
  Target: ATXN1; (-) strand; PAM type: NNGRRT; PAM sequence: CAGGAT
tggggttacaccatgttggc

SEQ ID NO: 16119 - DNA, 20 bp, Artificial Sequence
  Description of Artificial Sequence: Synthetic oligonucleotide
  Target: ATXN1; (-) strand; PAM type: NNGRRT; PAM sequence: TGGGGT
ttttgtatttttagtagaga

SEQ ID NO: 16120 - DNA, 20 bp, Artificial Sequence
  Description of Artificial Sequence: Synthetic oligonucleotide
  Target: ATXN1; (-) strand; PAM type: NNGRRT; PAM sequence: TGGGAT
gcctcagcttcctgagtagc

SEQ ID NO: 16121 - DNA, 20 bp, Artificial Sequence
  Description of Artificial Sequence: Synthetic oligonucleotide
  Target: ATXN1; (-) strand; PAM type: NNGRRT; PAM sequence: CTGAGT
gattctcctgcctcagcttc

SEQ ID NO: 16122 - DNA, 20 bp, Artificial Sequence
  Description of Artificial Sequence: Synthetic oligonucleotide
  Target: ATXN1; (-) strand; PAM type: NNGRRT; PAM sequence: TGGAGT
gtcttgctttgtcaccaggc

SEQ ID NO: 16123 - DNA, 20 bp, Artificial Sequence
  Description of Artificial Sequence: Synthetic oligonucleotide
  Target: ATXN1; (-) strand; PAM type: NNGRRT; PAM sequence: CAGAGT
tactttttttttttttgaga

SEQ ID NO: 16124 - DNA, 20 bp, Artificial Sequence
  Description of Artificial Sequence: Synthetic oligonucleotide
  Target: ATXN1; (-) strand; PAM type: NNGRRT; PAM sequence: GGGAAT
tgtcggtttcacttgagctt

SEQ ID NO: 16125 - DNA, 20 bp, Artificial Sequence
  Description of Artificial Sequence: Synthetic oligonucleotide
  Target: ATXN1; (-) strand; PAM type: NNGRRT; PAM sequence: TGGGAT
agtgttttggcatctggatt

SEQ ID NO: 16126 - DNA, 20 bp, Artificial Sequence
  Description of Artificial Sequence: Synthetic oligonucleotide
  Target: ATXN1; (-) strand; PAM type: NNGRRT; PAM sequence: CTGGAT
tctgcttagtgttttggcat

SEQ ID NO: 16127 - DNA, 20 bp, Artificial Sequence
  Description of Artificial Sequence: Synthetic oligonucleotide
  Target: ATXN1; (-) strand; PAM type: NNGRRT; PAM sequence: GTGGAT
tttagccgcttaggcaggac

SEQ ID NO: 16128 - DNA, 20 bp, Artificial Sequence
  Description of Artificial Sequence: Synthetic oligonucleotide
  Target: ATXN1; (-) strand; PAM type: NNGRRT; PAM sequence: TGGAAT
tcattttcatatctttactt

SEQ ID NO: 16129 - DNA, 20 bp, Artificial Sequence
  Description of Artificial Sequence: Synthetic oligonucleotide
  Target: ATXN1; (-) strand; PAM type: NNGRRT; PAM sequence: AAGAAT
gtgaacaggtaaacatgttt

SEQ ID NO: 16130 - DNA, 20 bp, Artificial Sequence
  Description of Artificial Sequence: Synthetic oligonucleotide
  Target: ATXN1; (-) strand; PAM type: NNGRRT; PAM sequence: GAGAGT
tgcctacacatatacaaaag

SEQ ID NO: 16131 - DNA, 20 bp, Artificial Sequence
  Description of Artificial Sequence: Synthetic oligonucleotide
  Target: ATXN1; (-) strand; PAM type: NNGRRT; PAM sequence: GGGAGT
ggcaaagcatgttaatcaaa

SEQ ID NO: 16132 - DNA, 20 bp, Artificial Sequence
  Description of Artificial Sequence: Synthetic oligonucleotide
  Target: ATXN1; (-) strand; PAM type: NNGRRT; PAM sequence: AGGAAT
tgtccagctgaaaaatgagt

SEQ ID NO: 16133 - DNA, 20 bp, Artificial Sequence
  Description of Artificial Sequence: Synthetic oligonucleotide
  Target: ATXN1; (-) strand; PAM type: NNGRRT; PAM sequence: ATGAGT
ccactgtgtccagctgaaaa

SEQ ID NO: 16134 - DNA, 20 bp, Artificial Sequence
  Description of Artificial Sequence: Synthetic oligonucleotide
  Target: ATXN1; (-) strand; PAM type: NNGRRT; PAM sequence: CTGGAT
cgccttggccccccaaagtg

SEQ ID NO: 16135 - DNA, 20 bp, Artificial Sequence
  Description of Artificial Sequence: Synthetic oligonucleotide
  Target: ATXN1; (-) strand; PAM type: NNGRRT; PAM sequence: TGGGGT
gtttttttttttagtataga

SEQ ID NO: 16136 - DNA, 20 bp, Artificial Sequence
  Description of Artificial Sequence: Synthetic oligonucleotide
  Target: ATXN1; (-) strand; PAM type: NNGRRT; PAM sequence: TGGGAT
gcctcagcctcccgggtcac

SEQ ID NO: 16137 - DNA, 20 bp, Artificial Sequence
  Description of Artificial Sequence: Synthetic oligonucleotide
  Target: ATXN1; (-) strand; PAM type: NNGRRT; PAM sequence: CCGGGT
gattctcctgcctcagcctc

SEQ ID NO: 16138 - DNA, 20 bp, Artificial Sequence
  Description of Artificial Sequence: Synthetic oligonucleotide
  Target: ATXN1; (-) strand; PAM type: NNGRRT; PAM sequence: CAGAGT
tctttttttttttttttaga

SEQ ID NO: 16139 - DNA, 20 bp, Artificial Sequence
  Description of Artificial Sequence: Synthetic oligonucleotide
  Target: ATXN1; (-) strand; PAM type: NNGRRT; PAM sequence: AGGAAT
gttggccttgaaaaatgagt

SEQ ID NO: 16140 - DNA, 20 bp, Artificial Sequence
  Description of Artificial Sequence: Synthetic oligonucleotide
  Target: ATXN1; (-) strand; PAM type: NNGRRT; PAM sequence: ATGAGT
ctcaaggttggccttgaaaa

SEQ ID NO: 16141 - DNA, 20 bp, Artificial Sequence
  Description of Artificial Sequence: Synthetic oligonucleotide
  Target: ATXN1; (-) strand; PAM type: NNGRRT; PAM sequence: TGGAAT
agatgaggatgacatcacaa

SEQ ID NO: 16142 - DNA, 20 bp, Artificial Sequence
  Description of Artificial Sequence: Synthetic oligonucleotide
  Target: ATXN1; (-) strand; PAM type: NNGRRT; PAM sequence: GAGGAT
gaaaacattaggggatagat

SEQ ID NO: 16143 - DNA, 20 bp, Artificial Sequence
  Description of Artificial Sequence: Synthetic oligonucleotide
  Target: ATXN1; (-) strand; PAM type: NNGRRT; PAM sequence: GGGGAT
tagatttccagaaaacatta

SEQ ID NO: 16144 - DNA, 20 bp, Artificial Sequence
  Description of Artificial Sequence: Synthetic oligonucleotide
  Target: ATXN1; (-) strand; PAM type: NNGRRT; PAM sequence: CAGAAT
gctaggaaacgtaggtgagg

SEQ ID NO: 16145 - DNA, 20 bp, Artificial Sequence
  Description of Artificial Sequence: Synthetic oligonucleotide
  Target: ATXN1; (-) strand; PAM type: NNGRRT; PAM sequence: CAGAGT
aatttgggagaggaagacgt

SEQ ID NO: 16146 - DNA, 20 bp, Artificial Sequence
  Description of Artificial Sequence: Synthetic oligonucleotide
  Target: ATXN1; (-) strand; PAM type: NNGRRT; PAM sequence: TTGAAT
tgaggagtatggctgcatgg

SEQ ID NO: 16147 - DNA, 20 bp, Artificial Sequence
  Description of Artificial Sequence: Synthetic oligonucleotide
  Target: ATXN1; (-) strand; PAM type: NNGRRT; PAM sequence: AGGAGT
gagaggagcggagggagttg

SEQ ID NO: 16148 - DNA, 20 bp, Artificial Sequence
  Description of Artificial Sequence: Synthetic oligonucleotide
  Target: ATXN1; (-) strand; PAM type: NNGRRT; PAM sequence: GGGAGT
tggtgccggagaggagcgga

SEQ ID NO: 16149 - DNA, 20 bp, Artificial Sequence
  Description of Artificial Sequence: Synthetic oligonucleotide
  Target: ATXN1; (-) strand; PAM type: NNGRRT; PAM sequence: CAGGGT
gggaaagagtccagatgagc

SEQ ID NO: 16150 - DNA, 20 bp, Artificial Sequence
  Description of Artificial Sequence: Synthetic oligonucleotide
  Target: ATXN1; (-) strand; PAM type: NNGRRT; PAM sequence: AAGAGT
acgtgttagggggccaggga

SEQ ID NO: 16151 - DNA, 20 bp, Artificial Sequence
  Description of Artificial Sequence: Synthetic oligonucleotide
  Target: ATXN1; (-) strand; PAM type: NNGRRT; PAM sequence: CAGGGT
caaggaaggtagtagggtgg

SEQ ID NO: 16152 - DNA, 20 bp, Artificial Sequence
  Description of Artificial Sequence: Synthetic oligonucleotide
  Target: ATXN1; (-) strand; PAM type: NNGRRT; PAM sequence: TAGGGT
gcaggagccaaggaaggtag

SEQ ID NO: 16153 - DNA, 20 bp, Artificial Sequence
  Description of Artificial Sequence: Synthetic oligonucleotide
  Target: ATXN1; (-) strand; PAM type: NNGRRT; PAM sequence: GAGAAT
tgctgtagtgcaagttggaa

SEQ ID NO: 16154 - DNA, 20 bp, Artificial Sequence
  Description of Artificial Sequence: Synthetic oligonucleotide
  Target: ATXN1; (-) strand; PAM type: NNGRRT; PAM sequence: AGGAAT
gggaaagcaaggtcctttta

SEQ ID NO: 16155 - DNA, 20 bp, Artificial Sequence
  Description of Artificial Sequence: Synthetic oligonucleotide
  Target: ATXN1; (-) strand; PAM type: NNGRRT; PAM sequence: GTGGGT
aaggtcatttgatagaaggg

SEQ ID NO: 16156 - DNA, 20 bp, Artificial Sequence
  Description of Artificial Sequence: Synthetic oligonucleotide
  Target: ATXN1; (-) strand; PAM type: NNGRRT; PAM sequence: AGGGGT
atacaaggtcatttgataga

SEQ ID NO: 16157 - DNA, 20 bp, Artificial Sequence
  Description of Artificial Sequence: Synthetic oligonucleotide
  Target: ATXN1; (-) strand; PAM type: NNGRRT; PAM sequence: AAGAAT
agctgagagctgaaggagaa

SEQ ID NO: 16158 - DNA, 20 bp, Artificial Sequence
  Description of Artificial Sequence: Synthetic oligonucleotide
  Target: ATXN1; (-) strand; PAM type: NNGRRT; PAM sequence: GAGGGT
aaatgactactataaccagg

SEQ ID NO: 16159 - DNA, 20 bp, Artificial Sequence
  Description of Artificial Sequence: Synthetic oligonucleotide
  Target: ATXN1; (-) strand; PAM type: NNGRRT; PAM sequence: ATGAAT
gggaaaacaagcattaatca

SEQ ID NO: 16160 - DNA, 20 bp, Artificial Sequence
  Description of Artificial Sequence: Synthetic oligonucleotide
  Target: ATXN1; (-) strand; PAM type: NNGRRT; PAM sequence: TGGAGT
tggacacagttctccctttc

SEQ ID NO: 16161 - DNA, 20 bp, Artificial Sequence
  Description of Artificial Sequence: Synthetic oligonucleotide
  Target: ATXN1; (-) strand; PAM type: NNGRRT; PAM sequence: GAGAGT
ccaaagatgaaaggaggggt

SEQ ID NO: 16162 - DNA, 20 bp, Artificial Sequence
  Description of Artificial Sequence: Synthetic oligonucleotide
  Target: ATXN1; (-) strand; PAM type: NNGRRT; PAM sequence: AGGGGT
tgaatcccaaagatgaaagg

SEQ ID NO: 16163 - DNA, 20 bp, Artificial Sequence
  Description of Artificial Sequence: Synthetic oligonucleotide
  Target: ATXN1; (-) strand; PAM type: NNGRRT; PAM sequence: TTGAAT
ataatgtgcaaagctttcca

SEQ ID NO: 16164 - DNA, 20 bp, Artificial Sequence
  Description of Artificial Sequence: Synthetic oligonucleotide
  Target: ATXN1; (-) strand; PAM type: NNGRRT; PAM sequence: TTGAGT
tattcactcagaagatttta

SEQ ID NO: 16165 - DNA, 20 bp, Artificial Sequence
  Description of Artificial Sequence: Synthetic oligonucleotide
  Target: ATXN1; (-) strand; PAM type: NNGRRT; PAM sequence: AGGGAT
taattaaatcagtatgatta

SEQ ID NO: 16166 - DNA, 20 bp, Artificial Sequence
  Description of Artificial Sequence: Synthetic oligonucleotide
  Target: ATXN1; (-) strand; PAM type: NNGRRT; PAM sequence: ATGAAT
tgctggaaaacgatttacag

SEQ ID NO: 16167 - DNA, 20 bp, Artificial Sequence
  Description of Artificial Sequence: Synthetic oligonucleotide
  Target: ATXN1; (-) strand; PAM type: NNGRRT; PAM sequence: AGGAAT
gagccttgcatgttacccaa

SEQ ID NO: 16168 - DNA, 20 bp, Artificial Sequence
  Description of Artificial Sequence: Synthetic oligonucleotide
  Target: ATXN1; (-) strand; PAM type: NNGRRT; PAM sequence: TGGGGT
ggaggagagacccggctggc

SEQ ID NO: 16169 - DNA, 20 bp, Artificial Sequence
  Description of Artificial Sequence: Synthetic oligonucleotide
  Target: ATXN1; (-) strand; PAM type: NNGRRT; PAM sequence: GAGGGT
gggagggacttggaggtgct

SEQ ID NO: 16170 - DNA, 20 bp, Artificial Sequence
  Description of Artificial Sequence: Synthetic oligonucleotide
  Target: ATXN1; (-) strand; PAM type: NNGRRT; PAM sequence: TGGGGT
tggagatgagggaaacaaga

SEQ ID NO: 16171 - DNA, 20 bp, Artificial Sequence
  Description of Artificial Sequence: Synthetic oligonucleotide
  Target: ATXN1; (-) strand; PAM type: NNGRRT; PAM sequence: AAGGGT
gtggggggaacagaagagag

SEQ ID NO: 16172 - DNA, 20 bp, Artificial Sequence
  Description of Artificial Sequence: Synthetic oligonucleotide
  Target: ATXN1; (-) strand; PAM type: NNGRRT; PAM sequence: GTGAGT
ccctgagacttgaagactga

SEQ ID NO: 16173 - DNA, 20 bp, Artificial Sequence
  Description of Artificial Sequence: Synthetic oligonucleotide
  Target: ATXN1; (-) strand; PAM type: NNGRRT; PAM sequence: CTGAGT
ccagccctgagacttgaaga

SEQ ID NO: 16174 - DNA, 20 bp, Artificial Sequence
  Description of Artificial Sequence: Synthetic oligonucleotide
  Target: ATXN1; (-) strand; PAM type: NNGRRT; PAM sequence: GGGAGT
ccacttcccagaaggtgtca

SEQ ID NO: 16175 - DNA, 20 bp, Artificial Sequence
  Description of Artificial Sequence: Synthetic oligonucleotide
  Target: ATXN1; (-) strand; PAM type: NNGRRT; PAM sequence: AGGGGT
gctttaatagggataggtac

SEQ ID NO: 16176 - DNA, 20 bp, Artificial Sequence
  Description of Artificial Sequence: Synthetic oligonucleotide
  Target: ATXN1; (-) strand; PAM type: NNGRRT; PAM sequence: AGGGAT
aatatgataattgctttaat

SEQ ID NO: 16177 - DNA, 20 bp, Artificial Sequence
  Description of Artificial Sequence: Synthetic oligonucleotide
  Target: ATXN1; (-) strand; PAM type: NNGRRT; PAM sequence: GGGGAT
actctggggtactatgatga

SEQ ID NO: 16178 - DNA, 20 bp, Artificial Sequence
  Description of Artificial Sequence: Synthetic oligonucleotide
  Target: ATXN1; (-) strand; PAM type: NNGRRT; PAM sequence: TGGGGT
cacgctgctgtacgaaactc

SEQ ID NO: 16179 - DNA, 20 bp, Artificial Sequence
  Description of Artificial Sequence: Synthetic oligonucleotide
  Target: ATXN1; (-) strand; PAM type: NNGRRT; PAM sequence: ATGAAT
gttattagcccgtttcacag

SEQ ID NO: 16180 - DNA, 20 bp, Artificial Sequence
  Description of Artificial Sequence: Synthetic oligonucleotide
  Target: ATXN1; (-) strand; PAM type: NNGRRT; PAM sequence: TGGAGT
ggctgtacaattaatattta

SEQ ID NO: 16181 - DNA, 20 bp, Artificial Sequence
  Description of Artificial Sequence: Synthetic oligonucleotide
  Target: ATXN1; (-) strand; PAM type: NNGRRT; PAM sequence: ACGGAT
tcattagtccttcagttgca

SEQ ID NO: 16182 - DNA, 20 bp, Artificial Sequence
  Description of Artificial Sequence: Synthetic oligonucleotide
  Target: ATXN1; (-) strand; PAM type: NNGRRT; PAM sequence: TTGAAT
cagctcaatgtttacagcac

SEQ ID NO: 16183 - DNA, 20 bp, Artificial Sequence
  Description of Artificial Sequence: Synthetic oligonucleotide
  Target: ATXN1; (-) strand; PAM type: NNGRRT; PAM sequence: ATGAAT
ccagtaattaacagaagtgg

SEQ ID NO: 16184 - DNA, 20 bp, Artificial Sequence
  Description of Artificial Sequence: Synthetic oligonucleotide
  Target: ATXN1; (-) strand; PAM type: NNGRRT; PAM sequence: GTGGAT
ctgtccagtaattaacagaa

SEQ ID NO: 16185 - DNA, 20 bp, Artificial Sequence
  Description of Artificial Sequence: Synthetic oligonucleotide
  Target: ATXN1; (-) strand; PAM type: NNGRRT; PAM sequence: TAGAAT
aaatttctgcaattctaaat

SEQ ID NO: 16186 - DNA, 20 bp, Artificial Sequence
  Description of Artificial Sequence: Synthetic oligonucleotide
  Target: ATXN1; (-) strand; PAM type: NNGRRT; PAM sequence: ATGAGT
aagcaacatagggcagaatt

SEQ ID NO: 16187 - DNA, 20 bp, Artificial Sequence
  Description of Artificial Sequence: Synthetic oligonucleotide
  Target: ATXN1; (-) strand; PAM type: NNGRRT; PAM sequence: CAGAAT
aagagaaaagcaacataggg

SEQ ID NO: 16188 - DNA, 20 bp, Artificial Sequence
  Description of Artificial Sequence: Synthetic oligonucleotide
  Target: ATXN1; (-) strand; PAM type: NNGRRT; PAM sequence: GAGAAT
atcagtgataaatgtgaatt

SEQ ID NO: 16189 - DNA, 20 bp, Artificial Sequence
  Description of Artificial Sequence: Synthetic oligonucleotide
  Target: ATXN1; (-) strand; PAM type: NNGRRT; PAM sequence: GTGAAT
atcttttatcagtgataaat

SEQ ID NO: 16190 - DNA, 20 bp, Artificial Sequence
  Description of Artificial Sequence: Synthetic oligonucleotide
  Target: ATXN1; (-) strand; PAM type: NNGRRT; PAM sequence: TGGGGT
atcagaaaaatgatttgctt

SEQ ID NO: 16191 - DNA, 20 bp, Artificial Sequence
  Description of Artificial Sequence: Synthetic oligonucleotide
  Target: ATXN1; (-) strand; PAM type: NNGRRT; PAM sequence: ATGAAT
gaaaaaaaaaaaagaatgtt

SEQ ID NO: 16192 - DNA, 20 bp, Artificial Sequence
  Description of Artificial Sequence: Synthetic oligonucleotide
  Target: ATXN1; (-) strand; PAM type: NNGRRT; PAM sequence: AAGAAT
tgtctcaaagaaaaaaaaaa

SEQ ID NO: 16193 - DNA, 20 bp, Artificial Sequence
  Description of Artificial Sequence: Synthetic oligonucleotide
  Target: ATXN1; (-) strand; PAM type: NNGRRT; PAM sequence: CAGAGT
ctgcactccaacctgggaaa

SEQ ID NO: 16194 - DNA, 20 bp, Artificial Sequence
  Description of Artificial Sequence: Synthetic oligonucleotide
  Target: ATXN1; (-) strand; PAM type: NNGRRT; PAM sequence: AGGAGT
tgcactccagcctgggcaac

SEQ ID NO: 16195 - DNA, 20 bp, Artificial Sequence
  Description of Artificial Sequence: Synthetic oligonucleotide
  Target: ATXN1; (-) strand; PAM type: NNGRRT; PAM sequence: GTGAGT
cctggaaggcggaggttatg

SEQ ID NO: 16196 - DNA, 20 bp, Artificial Sequence
  Description of Artificial Sequence: Synthetic oligonucleotide
  Target: ATXN1; (-) strand; PAM type: NNGRRT; PAM sequence: CAGGAT
agctactcaggaggctgagg

SEQ ID NO: 16197 - DNA, 20 bp, Artificial Sequence
  Description of Artificial Sequence: Synthetic oligonucleotide
  Target: ATXN1; (-) strand; PAM type: NNGRRT; PAM sequence: TTGAGT
gattgctggagaccagtagt

SEQ ID NO: 16198 - DNA, 20 bp, Artificial Sequence
  Description of Artificial Sequence: Synthetic oligonucleotide
  Target: ATXN1; (-) strand; PAM type: NNGRRT; PAM sequence: ATGAAT
gtttaatagtctcatggtaa

SEQ ID NO: 16199 - DNA, 20 bp, Artificial Sequence
  Description of Artificial Sequence: Synthetic oligonucleotide
  Target: ATXN1; (-) strand; PAM type: NNGRRT; PAM sequence: AGGAGT
gaattataattcaatttaaa

SEQ ID NO: 16200 - DNA, 20 bp, Artificial Sequence
  Description of Artificial Sequence: Synthetic oligonucleotide
  Target: ATXN1; (-) strand; PAM type: NNGRRT; PAM sequence: TAGAAT
caatagctgtggccatggaa

SEQ ID NO: 16201 - DNA, 20 bp, Artificial Sequence
  Description of Artificial Sequence: Synthetic oligonucleotide
  Target: ATXN1; (-) strand; PAM type: NNGRRT; PAM sequence: TGGAAT
ctggtcaatagctgtggcca

SEQ ID NO: 16202 - DNA, 20 bp, Artificial Sequence
  Description of Artificial Sequence: Synthetic oligonucleotide
  Target: ATXN1; (-) strand; PAM type: NNGRRT; PAM sequence: TAGGGT
gttgcaaagaaccatatact

SEQ ID NO: 16203 - DNA, 20 bp, Artificial Sequence
  Description of Artificial Sequence: Synthetic oligonucleotide
  Target: ATXN1; (-) strand; PAM type: NNGRRT; PAM sequence: AAGAAT
aaggaccagcataatgaaca

SEQ ID NO: 16204 - DNA, 20 bp, Artificial Sequence
  Description of Artificial Sequence: Synthetic oligonucleotide
  Target: ATXN1; (-) strand; PAM type: NNGRRT; PAM sequence: ATGAAT
aaaggaagagcaatgcttga

SEQ ID NO: 16205 - DNA, 20 bp, Artificial Sequence
  Description of Artificial Sequence: Synthetic oligonucleotide
  Target: ATXN1; (-) strand; PAM type: NNGRRT; PAM sequence: TTGAAT
tcttaaaggaagagcaatgc

SEQ ID NO: 16206 - DNA, 20 bp, Artificial Sequence
  Description of Artificial Sequence: Synthetic oligonucleotide
  Target: ATXN1; (-) strand; PAM type: NNGRRT; PAM sequence: CTGAAT
acaaaggaagtgacatcgag

SEQ ID NO: 16207 - DNA, 20 bp, Artificial Sequence
  Description of Artificial Sequence: Synthetic oligonucleotide
  Target: ATXN1; (-) strand; PAM type: NNGRRT; PAM sequence: AAGAAT
ctgagagtatattctgtgca

SEQ ID NO: 16208 - DNA, 20 bp, Artificial Sequence
  Description of Artificial Sequence: Synthetic oligonucleotide
  Target: ATXN1; (-) strand; PAM type: NNGRRT; PAM sequence: GAGAGT
acatcaaaccagtgtttact

SEQ ID NO: 16209 - DNA, 20 bp, Artificial Sequence
  Description of Artificial Sequence: Synthetic oligonucleotide
  Target: ATXN1; (-) strand; PAM type: NNGRRT; PAM sequence: AAGAGT
ggccttttcaccatagtcat

SEQ ID NO: 16210 - DNA, 20 bp, Artificial Sequence
  Description of Artificial Sequence: Synthetic oligonucleotide
  Target: ATXN1; (-) strand; PAM type: NNGRRT; PAM sequence: ATGGAT
gagtttcatttcactaaaaa

SEQ ID NO: 16211 - DNA, 20 bp, Artificial Sequence
  Description of Artificial Sequence: Synthetic oligonucleotide
  Target: ATXN1; (-) strand; PAM type: NNGRRT; PAM sequence: AAGAGT
catctggaagtgaaaacgct

SEQ ID NO: 16212 - DNA, 20 bp, Artificial Sequence
  Description of Artificial Sequence: Synthetic oligonucleotide
  Target: ATXN1; (-) strand; PAM type: NNGRRT; PAM sequence: GGGAAT
agaacacccaggggcccctg

SEQ ID NO: 16213 - DNA, 20 bp, Artificial Sequence
  Description of Artificial Sequence: Synthetic oligonucleotide
  Target: ATXN1; (-) strand; PAM type: NNGRRT; PAM sequence: TGGAAT
atttccattaaatgagtgca

SEQ ID NO: 16214 - DNA, 20 bp, Artificial Sequence
  Description of Artificial Sequence: Synthetic oligonucleotide
  Target: ATXN1; (-) strand; PAM type: NNGRRT; PAM sequence: ATGAGT
ttactccggatttccattaa

SEQ ID NO: 16215 - DNA, 20 bp, Artificial Sequence
  Description of Artificial Sequence: Synthetic oligonucleotide
  Target: ATXN1; (-) strand; PAM type: NNGRRT; PAM sequence: CCGGAT
tggggaggttgagtcttact

SEQ ID NO: 16216 - DNA, 20 bp, Artificial Sequence
  Description of Artificial Sequence: Synthetic oligonucleotide
  Target: ATXN1; (-) strand; PAM type: NNGRRT; PAM sequence: TTGAGT
acaggctggtggtggggagg

SEQ ID NO: 16217 - DNA, 20 bp, Artificial Sequence
  Description of Artificial Sequence: Synthetic oligonucleotide
  Target: ATXN1; (-) strand; PAM type: NNGRRT; PAM sequence: ATGAGT
tgaaacagctgagcagaata

SEQ ID NO: 16218 - DNA, 20 bp, Artificial Sequence
  Description of Artificial Sequence: Synthetic oligonucleotide
  Target: ATXN1; (-) strand; PAM type: NNGRRT; PAM sequence: CAGAAT
cttattctgaaacagctgag

SEQ ID NO: 16219 - DNA, 20 bp, Artificial Sequence
  Description of Artificial Sequence: Synthetic oligonucleotide
  Target: ATXN1; (-) strand; PAM type: NNGRRT; PAM sequence: GGGAGT
gaggggggcagagctctccc

SEQ ID NO: 16220 - DNA, 20 bp, Artificial Sequence
  Description of Artificial Sequence: Synthetic oligonucleotide
  Target: ATXN1; (-) strand; PAM type: NNGRRT; PAM sequence: TCGGAT
gtactgaaattctctgctgc

SEQ ID NO: 16221 - DNA, 20 bp, Artificial Sequence
  Description of Artificial Sequence: Synthetic oligonucleotide
  Target: ATXN1; (-) strand; PAM type: NNGRRT; PAM sequence: TTGAGT
gggactgatgttctgctgct

SEQ ID NO: 16222 - DNA, 20 bp, Artificial Sequence
  Description of Artificial Sequence: Synthetic oligonucleotide
  Target: ATXN1; (-) strand; PAM type: NNGRRT; PAM sequence: AAGAAT
aaataagcccatataggaat

SEQ ID NO: 16223 - DNA, 20 bp, Artificial Sequence
  Description of Artificial Sequence: Synthetic oligonucleotide
  Target: ATXN1; (-) strand; PAM type: NNGRRT; PAM sequence: AGGAAT
tgtgagaaataagcccatat

SEQ ID NO: 16224 - DNA, 20 bp, Artificial Sequence
  Description of Artificial Sequence: Synthetic oligonucleotide
  Target: ATXN1; (-) strand; PAM type: NNGRRT; PAM sequence: GTGGAT
tcgatcttgaaaaatcaaag

SEQ ID NO: 16225 - DNA, 20 bp, Artificial Sequence
  Description of Artificial Sequence: Synthetic oligonucleotide
  Target: ATXN1; (-) strand; PAM type: NNGRRT; PAM sequence: AGGAGT
cgtggtcttctgagtgaggc

SEQ ID NO: 16226 - DNA, 20 bp, Artificial Sequence
  Description of Artificial Sequence: Synthetic oligonucleotide
  Target: ATXN1; (-) strand; PAM type: NNGRRT; PAM sequence: CTGAGT
tctgagcaacacgtggtctt

SEQ ID NO: 16227 - DNA, 20 bp, Artificial Sequence
  Description of Artificial Sequence: Synthetic oligonucleotide
  Target: ATXN1; (-) strand; PAM type: NNGRRT; PAM sequence: TAGGAT
cgtctaactgtgggcctggg

SEQ ID NO: 16228 - DNA, 20 bp, Artificial Sequence
  Description of Artificial Sequence: Synthetic oligonucleotide
  Target: ATXN1; (-) strand; PAM type: NNGRRT; PAM sequence: CTGGGT
taatacgtctaactgtgggc

SEQ ID NO: 16229 - DNA, 20 bp, Artificial Sequence
  Description of Artificial Sequence: Synthetic oligonucleotide
  Target: ATXN1; (-) strand; PAM type: NNGRRT; PAM sequence: GTGGGT
cacagaatcagctaggagac

SEQ ID NO: 16230 - DNA, 20 bp, Artificial Sequence
  Description of Artificial Sequence: Synthetic oligonucleotide
  Target: ATXN1; (-) strand; PAM type: NNGRRT; PAM sequence: CAGAAT
gaaggaaccaactccagaca

SEQ ID NO: 16231 - DNA, 20 bp, Artificial Sequence
  Description of Artificial Sequence: Synthetic oligonucleotide
  Target: ATXN1; (-) strand; PAM type: NNGRRT; PAM sequence: TTGGGT
tcttgctgctgttcagtctt

SEQ ID NO: 16232 - DNA, 20 bp, Artificial Sequence
  Description of Artificial Sequence: Synthetic oligonucleotide
  Target: ATXN1; (-) strand; PAM type: NNGRRT; PAM sequence: TGGAAT
gacatggacgggaaaaataa

SEQ ID NO: 16233 - DNA, 20 bp, Artificial Sequence
  Description of Artificial Sequence: Synthetic oligonucleotide
  Target: ATXN1; (-) strand; PAM type: NNGRRT; PAM sequence: GAGGAT
taaaagtaaccaatcatggg

SEQ ID NO: 16234 - DNA, 20 bp, Artificial Sequence
  Description of Artificial Sequence: Synthetic oligonucleotide
  Target: ATXN1; (-) strand; PAM type: NNGRRT; PAM sequence: CAGGGT
ttgtaaaatggaccaatcag

SEQ ID NO: 16235 - DNA, 20 bp, Artificial Sequence
  Description of Artificial Sequence: Synthetic oligonucleotide
  Target: ATXN1; (-) strand; PAM type: NNGRRT; PAM sequence: AAGGGT
ggagaacttttctgtcttcc

SEQ ID NO: 16236 - DNA, 20 bp, Artificial Sequence
  Description of Artificial Sequence: Synthetic oligonucleotide
  Target: ATXN1; (-) strand; PAM type: NNGRRT; PAM sequence: TCGAGT
agccagctggacttcctggg

SEQ ID NO: 16237 - DNA, 20 bp, Artificial Sequence
  Description of Artificial Sequence: Synthetic oligonucleotide
  Target: ATXN1; (-) strand; PAM type: NNGRRT; PAM sequence: CTGGGT
ggtgaagccagctggacttc

SEQ ID NO: 16238 - DNA, 20 bp, Artificial Sequence
  Description of Artificial Sequence: Synthetic oligonucleotide
  Target: ATXN1; (-) strand; PAM type: NNGRRT; PAM sequence: TGGAAT
ggctgacagtaactactgag

SEQ ID NO: 16239 - DNA, 20 bp, Artificial Sequence
  Description of Artificial Sequence: Synthetic oligonucleotide
  Target: ATXN1; (-) strand; PAM type: NNGRRT; PAM sequence: CTGAGT
ggggaggctgacagtaacta

SEQ ID NO: 16240 - DNA, 20 bp, Artificial Sequence
  Description of Artificial Sequence: Synthetic oligonucleotide
  Target: ATXN1; (-) strand; PAM type: NNGRRT; PAM sequence: TTGAGT
gcttctgacagtgtcgctcc

SEQ ID NO: 16241 - DNA, 20 bp, Artificial Sequence
  Description of Artificial Sequence: Synthetic oligonucleotide
  Target: ATXN1; (-) strand; PAM type: NNGRRT; PAM sequence: AGGAGT
gagggggcttgagatcacac

SEQ ID NO: 16242 - DNA, 20 bp, Artificial Sequence
  Description of Artificial Sequence: Synthetic oligonucleotide
  Target: ATXN1; (-) strand; PAM type: NNGRRT; PAM sequence: CAGAAT
tttttaaagtgatagcatgt

SEQ ID NO: 16243 - DNA, 20 bp, Artificial Sequence
  Description of Artificial Sequence: Synthetic oligonucleotide
  Target: ATXN1; (-) strand; PAM type: NNGRRT; PAM sequence: GTGGGT
acatgttagtgcattctttt

SEQ ID NO: 16244 - DNA, 20 bp, Artificial Sequence
  Description of Artificial Sequence: Synthetic oligonucleotide
  Target: ATXN1; (-) strand; PAM type: NNGRRT; PAM sequence: TAGGGT
ctaaatgtctagttctcaaa

SEQ ID NO: 16245 - DNA, 20 bp, Artificial Sequence
  Description of Artificial Sequence: Synthetic oligonucleotide
  Target: ATXN1; (-) strand; PAM type: NNGRRT; PAM sequence: ATGGAT
gggaaatagcaaataggtag

SEQ ID NO: 16246 - DNA, 20 bp, Artificial Sequence
  Description of Artificial Sequence: Synthetic oligonucleotide
  Target: ATXN1; (-) strand; PAM type: NNGRRT; PAM sequence: GAGGAT
tacccctggagagaaggcag

SEQ ID NO: 16247 - DNA, 20 bp, Artificial Sequence
  Description of Artificial Sequence: Synthetic oligonucleotide
  Target: ATXN1; (-) strand; PAM type: NNGRRT; PAM sequence: GAGAGT
caattaaactatgtatttta

SEQ ID NO: 16248 - DNA, 20 bp, Artificial Sequence
  Description of Artificial Sequence: Synthetic oligonucleotide
  Target: ATXN1; (-) strand; PAM type: NNGRRT; PAM sequence: GTGAAT
gaatggaatattatacagca

SEQ ID NO: 16249 - DNA, 20 bp, Artificial Sequence
  Description of Artificial Sequence: Synthetic oligonucleotide
  Target: ATXN1; (-) strand; PAM type: NNGRRT; PAM sequence: TGGAAT
taattttttgcttcacagaa

SEQ ID NO: 16250 - DNA, 20 bp, Artificial Sequence
  Description of Artificial Sequence: Synthetic oligonucleotide
  Target: ATXN1; (-) strand; PAM type: NNGRRT; PAM sequence: CAGAAT
atatataattttttgcttca

SEQ ID NO: 16251 - DNA, 20 bp, Artificial Sequence
  Description of Artificial Sequence: Synthetic oligonucleotide
  Target: ATXN1; (-) strand; PAM type: NNGRRT; PAM sequence: ATGGGT
acccagggaaacttatgctg

SEQ ID NO: 16252 - DNA, 20 bp, Artificial Sequence
  Description of Artificial Sequence: Synthetic oligonucleotide
  Target: ATXN1; (-) strand; PAM type: NNGRRT; PAM sequence: GTGAAT
tttggcactattgtttaaca

SEQ ID NO: 16253 - DNA, 20 bp, Artificial Sequence
  Description of Artificial Sequence: Synthetic oligonucleotide
  Target: ATXN1; (-) strand; PAM type: NNGRRT; PAM sequence: GGGAGT
tggtggggtgcactgctggt

SEQ ID NO: 16254 - DNA, 20 bp, Artificial Sequence
  Description of Artificial Sequence: Synthetic oligonucleotide
  Target: ATXN1; (-) strand; PAM type: NNGRRT; PAM sequence: TGGGGT
ttatcagttttaaaaaatgg

SEQ ID NO: 16255 - DNA, 20 bp, Artificial Sequence
  Description of Artificial Sequence: Synthetic oligonucleotide
  Target: ATXN1; (-) strand; PAM type: NNGRRT; PAM sequence: AGGAAT
aaaaaaaaaaaaggaaaaaa

SEQ ID NO: 16256 - DNA, 20 bp, Artificial Sequence
  Description of Artificial Sequence: Synthetic oligonucleotide
  Target: ATXN1; (-) strand; PAM type: NNGRRT; PAM sequence: CAGAAT
actgcactccagcctggcga

SEQ ID NO: 16257 - DNA, 20 bp, Artificial Sequence
  Description of Artificial Sequence: Synthetic oligonucleotide
  Target: ATXN1; (-) strand; PAM type: NNGRRT; PAM sequence: GAGAAT
tactcgggaggctgaggcag

SEQ ID NO: 16258 - DNA, 20 bp, Artificial Sequence
  Description of Artificial Sequence: Synthetic oligonucleotide
  Target: ATXN1; (-) strand; PAM type: NNGRRT; PAM sequence: GGGGGT
taaaaatacaaaaattaggt

SEQ ID NO: 16259 - DNA, 20 bp, Artificial Sequence
  Description of Artificial Sequence: Synthetic oligonucleotide
  Target: ATXN1; (-) strand; PAM type: NNGRRT; PAM sequence: GCGGAT
actttgggaggccgaggcag

SEQ ID NO: 16260 - DNA, 20 bp, Artificial Sequence
  Description of Artificial Sequence: Synthetic oligonucleotide
  Target: ATXN1; (-) strand; PAM type: NNGRRT; PAM sequence: TAGAAT
cttatttctttatggatatt

SEQ ID NO: 16261 - DNA, 20 bp, Artificial Sequence
  Description of Artificial Sequence: Synthetic oligonucleotide
  Target: ATXN1; (-) strand; PAM type: NNGRRT; PAM sequence: ATGGAT
gacaggatgcttatttcttt

SEQ ID NO: 16262 - DNA, 20 bp, Artificial Sequence
  Description of Artificial Sequence: Synthetic oligonucleotide
  Target: ATXN1; (-) strand; PAM type: NNGRRT; PAM sequence: CAGGAT
accaatgtgagagacaggga

SEQ ID NO: 16263 - DNA, 20 bp, Artificial Sequence
  Description of Artificial Sequence: Synthetic oligonucleotide
  Target: ATXN1; (-) strand; PAM type: NNGRRT; PAM sequence: GGGAGT
gactaggaaagaaggtcatg

SEQ ID NO: 16264 - DNA, 20 bp, Artificial Sequence
  Description of Artificial Sequence: Synthetic oligonucleotide
  Target: ATXN1; (-) strand; PAM type: NNGRRT; PAM sequence: TTGAAT
gtatccaccttgcttaagaa

SEQ ID NO: 16265 - DNA, 20 bp, Artificial Sequence
  Description of Artificial Sequence: Synthetic oligonucleotide
  Target: ATXN1; (-) strand; PAM type: NNGRRT; PAM sequence: AAGAAT
ttttggtatccaccttgctt

SEQ ID NO: 16266 - DNA, 20 bp, Artificial Sequence
  Description of Artificial Sequence: Synthetic oligonucleotide
  Target: ATXN1; (-) strand; PAM type: NNGRRT; PAM sequence: GTGGGT
tacatgatttcctgttctaa

SEQ ID NO: 16267 - DNA, 20 bp, Artificial Sequence
  Description of Artificial Sequence: Synthetic oligonucleotide
  Target: ATXN1; (-) strand; PAM type: NNGRRT; PAM sequence: AAGAAT
ccttattcttttggagagga

SEQ ID NO: 16268 - DNA, 20 bp, Artificial Sequence
  Description of Artificial Sequence: Synthetic oligonucleotide
  Target: ATXN1; (-) strand; PAM type: NNGRRT; PAM sequence: GGGAGT
tgagccaggaccaaaggttt

SEQ ID NO: 16269 - DNA, 20 bp, Artificial Sequence
  Description of Artificial Sequence: Synthetic oligonucleotide
  Target: ATXN1; (-) strand; PAM type: NNGRRT; PAM sequence: GAGGAT
agatctataggtatatgtag

SEQ ID NO: 16270 - DNA, 20 bp, Artificial Sequence
  Description of Artificial Sequence: Synthetic oligonucleotide
  Target: ATXN1; (-) strand; PAM type: NNGRRT; PAM sequence: GAGAAT
ctacttaattaaaacagtgt

SEQ ID NO: 16271 - DNA, 20 bp, Artificial Sequence
  Description of Artificial Sequence: Synthetic oligonucleotide
  Target: ATXN1; (-) strand; PAM type: NNGRRT; PAM sequence: CTGGGT
tcctgtttaacactgcctgg

SEQ ID NO: 16272 - DNA, 20 bp, Artificial Sequence
  Description of Artificial Sequence: Synthetic oligonucleotide
  Target: ATXN1; (-) strand; PAM type: NNGRRT; PAM sequence: CTGGGT
tgatcgtgccattgcacagc

SEQ ID NO: 16273 - DNA, 20 bp, Artificial Sequence
  Description of Artificial Sequence: Synthetic oligonucleotide
  Target: ATXN1; (-) strand; PAM type: NNGRRT; PAM sequence: AGGAGT
caggaggattgcttgagccc

SEQ ID NO: 16274 - DNA, 20 bp, Artificial Sequence
  Description of Artificial Sequence: Synthetic oligonucleotide
  Target: ATXN1; (-) strand; PAM type: NNGRRT; PAM sequence: GAGGAT
tcctctggaggctgaggcag

SEQ ID NO: 16275 - DNA, 20 bp, Artificial Sequence
  Description of Artificial Sequence: Synthetic oligonucleotide
  Target: ATXN1; (-) strand; PAM type: NNGRRT; PAM sequence: AGGAGT
tgagaggattgcttgaggcc

SEQ ID NO: 16276 - DNA, 20 bp, Artificial Sequence
  Description of Artificial Sequence: Synthetic oligonucleotide
  Target: ATXN1; (-) strand; PAM type: NNGRRT; PAM sequence: GAGGAT
actttgggaggccaagatga

SEQ ID NO: 16277 - DNA, 20 bp, Artificial Sequence
  Description of Artificial Sequence: Synthetic oligonucleotide
  Target: ATXN1; (-) strand; PAM type: NNGRRT; PAM sequence: TTGGAT
ctcactttgtttaccaggct

SEQ ID NO: 16278 - DNA, 20 bp, Artificial Sequence
  Description of Artificial Sequence: Synthetic oligonucleotide
  Target: ATXN1; (-) strand; PAM type: NNGRRT; PAM sequence: TGGGGT
gatgattttaatgtttttgc

SEQ ID NO: 16279 - DNA, 20 bp, Artificial Sequence
  Description of Artificial Sequence: Synthetic oligonucleotide
  Target: ATXN1; (-) strand; PAM type: NNGRRT; PAM sequence: TGGGAT
ggagaatggctgtgttttaa

SEQ ID NO: 16280 - DNA, 20 bp, Artificial Sequence
  Description of Artificial Sequence: Synthetic oligonucleotide
  Target: ATXN1; (-) strand; PAM type: NNGRRT; PAM sequence: GAGAAT
caaagatttttgtagttgtg

SEQ ID NO: 16281 - DNA, 20 bp, Artificial Sequence
  Description of Artificial Sequence: Synthetic oligonucleotide
  Target: ATXN1; (-) strand; PAM type: NNGRRT; PAM sequence: AGGAAT
acacacttttaacgtgacat

SEQ ID NO: 16282 - DNA, 20 bp, Artificial Sequence
  Description of Artificial Sequence: Synthetic oligonucleotide
  Target: ATXN1; (-) strand; PAM type: NNGRRT; PAM sequence: CTGGAT
tgaaaggataatctaagtca

SEQ ID NO: 16283 - DNA, 20 bp, Artificial Sequence
  Description of Artificial Sequence: Synthetic oligonucleotide
  Target: ATXN1; (-) strand; PAM type: NNGRRT; PAM sequence: AAGGAT
aagtacagtatttctcctga

SEQ ID NO: 16284 - DNA, 20 bp, Artificial Sequence
  Description of Artificial Sequence: Synthetic oligonucleotide
  Target: ATXN1; (-) strand; PAM type: NNGRRT; PAM sequence: AGGAAT
attctgacctcatttcccag

SEQ ID NO: 16285 - DNA, 20 bp, Artificial Sequence
  Description of Artificial Sequence: Synthetic oligonucleotide
  Target: ATXN1; (-) strand; PAM type: NNGRRT; PAM sequence: GTGGAT
tgaggtgctttgggtgggaa

SEQ ID NO: 16286 - DNA, 20 bp, Artificial Sequence
  Description of Artificial Sequence: Synthetic oligonucleotide
  Target: ATXN1; (-) strand; PAM type: NNGRRT; PAM sequence: TTGGGT
tgcagcctccatgaggtgct

SEQ ID NO: 16287 - DNA, 20 bp, Artificial Sequence
  Description of Artificial Sequence: Synthetic oligonucleotide
  Target: ATXN1; (-) strand; PAM type: NNGRRT; PAM sequence: GTGGGT
gagtcgctgagatgaaattc

SEQ ID NO: 16288 - DNA, 20 bp, Artificial Sequence
  Description of Artificial Sequence: Synthetic oligonucleotide
  Target: ATXN1; (-) strand; PAM type: NNGRRT; PAM sequence: GAGAGT
ctgtggcagcaggtaaaaga

SEQ ID NO: 16289 - DNA, 20 bp, Artificial Sequence
  Description of Artificial Sequence: Synthetic oligonucleotide
  Target: ATXN1; (-) strand; PAM type: NNGRRT; PAM sequence: GTGAGT
ggacaccctgcgccctgcag

SEQ ID NO: 16290 - DNA, 20 bp, Artificial Sequence
  Description of Artificial Sequence: Synthetic oligonucleotide
  Target: ATXN1; (-) strand; PAM type: NNGRRT; PAM sequence: GGGGAT
tgatgcagatggagcaggag

SEQ ID NO: 16291 - DNA, 20 bp, Artificial Sequence
  Description of Artificial Sequence: Synthetic oligonucleotide
  Target: ATXN1; (-) strand; PAM type: NNGRRT; PAM sequence: CTGAGT
cagagcagtggcactcccct

SEQ ID NO: 16292 - DNA, 20 bp, Artificial Sequence
  Description of Artificial Sequence: Synthetic oligonucleotide
  Target: ATXN1; (-) strand; PAM type: NNGRRT; PAM sequence: AGGAGT
ctcaccatgcttctagtgga

SEQ ID NO: 16293 - DNA, 20 bp, Artificial Sequence
  Description of Artificial Sequence: Synthetic oligonucleotide
  Target: ATXN1; (-) strand; PAM type: NNGRRT; PAM sequence: AGGAAT
ggttcccttacaaagcccaa

SEQ ID NO: 16294 - DNA, 20 bp, Artificial Sequence
  Description of Artificial Sequence: Synthetic oligonucleotide
  Target: ATXN1; (-) strand; PAM type: NNGRRT; PAM sequence: AAGGGT
gcccaacagggccaaggggc

SEQ ID NO: 16295 - DNA, 20 bp, Artificial Sequence
  Description of Artificial Sequence: Synthetic oligonucleotide
  Target: ATXN1; (-) strand; PAM type: NNGRRT; PAM sequence: CTGGAT
acatgtgaagcagcattttc

SEQ ID NO: 16296 - DNA, 20 bp, Artificial Sequence
  Description of Artificial Sequence: Synthetic oligonucleotide
  Target: ATXN1; (-) strand; PAM type: NNGRRT; PAM sequence: CTGGGT
ttgcgccactgcactccagc

SEQ ID NO: 16297 - DNA, 20 bp, Artificial Sequence
  Description of Artificial Sequence: Synthetic oligonucleotide
  Target: ATXN1; (-) strand; PAM type: NNGRRT; PAM sequence: TAGAAT
ggcagaggcaggagaatcgc

SEQ ID NO: 16298 - DNA, 20 bp, Artificial Sequence
  Description of Artificial Sequence: Synthetic oligonucleotide
  Target: ATXN1; (-) strand; PAM type: NNGRRT; PAM sequence: GAGAAT
tactggggaggcagaggcag

SEQ ID NO: 16299 - DNA, 20 bp, Artificial Sequence
  Description of Artificial Sequence: Synthetic oligonucleotide
  Target: ATXN1; (-) strand; PAM type: NNGRRT; PAM sequence: GGGAGT
cgggtggatcacctgaggtc

SEQ ID NO: 16300 - DNA, 20 bp, Artificial Sequence
  Description of Artificial Sequence: Synthetic oligonucleotide
  Target: ATXN1; (-) strand; PAM type: NNGRRT; PAM sequence: GTGGAT
accttgggaggccgaggcgg

SEQ ID NO: 16301 - DNA, 20 bp, Artificial Sequence
  Description of Artificial Sequence: Synthetic oligonucleotide
  Target: ATXN1; (-) strand; PAM type: NNGRRT; PAM sequence: GCGGGT
cagcaccttgggaggccgag

SEQ ID NO: 16302 - DNA, 20 bp, Artificial Sequence
  Description of Artificial Sequence: Synthetic oligonucleotide
  Target: ATXN1; (-) strand; PAM type: NNGRRT; PAM sequence: AAGAAT
aatatgtttctccttacatc

SEQ ID NO: 16303 - DNA, 20 bp, Artificial Sequence
  Description of Artificial Sequence: Synthetic oligonucleotide
  Target: ATXN1; (-) strand; PAM type: NNGRRT; PAM sequence: AGGAAT
cagcactgcctttagcattt

SEQ ID NO: 16304 - DNA, 20 bp, Artificial Sequence
  Description of Artificial Sequence: Synthetic oligonucleotide
  Target: ATXN1; (-) strand; PAM type: NNGRRT; PAM sequence: ATGGAT
tttagcctatgctgggagcc

SEQ ID NO: 16305 - DNA, 20 bp, Artificial Sequence
  Description of Artificial Sequence: Synthetic oligonucleotide
  Target: ATXN1; (-) strand; PAM type: NNGRRT; PAM sequence: TGGGGT
gcaataattatgtatattta

SEQ ID NO: 16306 - DNA, 20 bp, Artificial Sequence
  Description of Artificial Sequence: Synthetic oligonucleotide
  Target: ATXN1; (-) strand; PAM type: NNGRRT; PAM sequence: TGGAGT
aaggaaataactcttaatta

SEQ ID NO: 16307 - DNA, 20 bp, Artificial Sequence
  Description of Artificial Sequence: Synthetic oligonucleotide
  Target: ATXN1; (-) strand; PAM type: NNGRRT; PAM sequence: CTGGAT
tatgcatatattttggagat

SEQ ID NO: 16308 - DNA, 20 bp, Artificial Sequence
  Description of Artificial Sequence: Synthetic oligonucleotide
  Target: ATXN1; (-) strand; PAM type: NNGRRT; PAM sequence: TAGGAT
gagctggaaagtggtaaagt

SEQ ID NO: 16309 - DNA, 20 bp, Artificial Sequence
  Description of Artificial Sequence: Synthetic oligonucleotide
  Target: ATXN1; (-) strand; PAM type: NNGRRT; PAM sequence: GAGGGT
cttttacagcggatgaactt

SEQ ID NO: 16310 - DNA, 20 bp, Artificial Sequence
  Description of Artificial Sequence: Synthetic oligonucleotide
  Target: ATXN1; (-) strand; PAM type: NNGRRT; PAM sequence: GCGGAT
cgttagtgactccttttaca

SEQ ID NO: 16311 - DNA, 20 bp, Artificial Sequence
  Description of Artificial Sequence: Synthetic oligonucleotide
  Target: ATXN1; (-) strand; PAM type: NNGRRT; PAM sequence: GTGGGT
ccagtgtccgagtggctgct

SEQ ID NO: 16312 - DNA, 20 bp, Artificial Sequence
  Description of Artificial Sequence: Synthetic oligonucleotide
  Target: ATXN1; (-) strand; PAM type: NNGRRT; PAM sequence: CCGAGT
agagaggggaaaaccagtgt

SEQ ID NO: 16313 - DNA, 20 bp, Artificial Sequence
  Description of Artificial Sequence: Synthetic oligonucleotide
  Target: ATXN1; (-) strand; PAM type: NNGRRT; PAM sequence: TTGAGT
acaccaggaagccagcatcc

SEQ ID NO: 16314 - DNA, 20 bp, Artificial Sequence
  Description of Artificial Sequence: Synthetic oligonucleotide
  Target: ATXN1; (-) strand; PAM type: NNGRRT; PAM sequence: TGGGGT
tactaccttgcaggtgccct

SEQ ID NO: 16315 - DNA, 20 bp, Artificial Sequence
  Description of Artificial Sequence: Synthetic oligonucleotide
  Target: ATXN1; (-) strand; PAM type: NNGRRT; PAM sequence: TGGGGT
caggaaagtctccaaatcag

SEQ ID NO: 16316 - DNA, 20 bp, Artificial Sequence
  Description of Artificial Sequence: Synthetic oligonucleotide
  Target: ATXN1; (-) strand; PAM type: NNGRRT; PAM sequence: TTGGGT
aaacatctttggtgacacca

SEQ ID NO: 16317 - DNA, 20 bp, Artificial Sequence
  Description of Artificial Sequence: Synthetic oligonucleotide
  Target: ATXN1; (-) strand; PAM type: NNGRRT; PAM sequence: CTGGGT
aggtgaaggaagactgatcc

SEQ ID NO: 16318 - DNA, 20 bp, Artificial Sequence
  Description of Artificial Sequence: Synthetic oligonucleotide
  Target: ATXN1; (-) strand; PAM type: NNGRRT; PAM sequence: TAGAGT
ggcaatgatggctggccctt

SEQ ID NO: 16319 - DNA, 20 bp, Artificial Sequence
  Description of Artificial Sequence: Synthetic oligonucleotide
  Target: ATXN1; (-) strand; PAM type: NNGRRT; PAM sequence: GTGAGT
tctgtggcctgttcacctga

SEQ ID NO: 16320 - DNA, 20 bp, Artificial Sequence
  Description of Artificial Sequence: Synthetic oligonucleotide
  Target: ATXN1; (-) strand; PAM type: NNGRRT; PAM sequence: CTGAGT
gtcctctgtggcctgttcac

SEQ ID NO: 16321 - DNA, 20 bp, Artificial Sequence
  Description of Artificial Sequence: Synthetic oligonucleotide
  Target: ATXN1; (-) strand; PAM type: NNGRRT; PAM sequence: GAGGGT
atgatagaaggaaatctttg

SEQ ID NO: 16322 - DNA, 20 bp, Artificial Sequence
  Description of Artificial Sequence: Synthetic oligonucleotide
  Target: ATXN1; (-) strand; PAM type: NNGRRT; PAM sequence: ATGAAT
ctaagcttgtttttttttta

SEQ ID NO: 16323 - DNA, 20 bp, Artificial Sequence
  Description of Artificial Sequence: Synthetic oligonucleotide
  Target: ATXN1; (-) strand; PAM type: NNGRRT; PAM sequence: TGGGAT
gcctcagcctcccaaaatgc

SEQ ID NO: 16324 - DNA, 20 bp, Artificial Sequence
  Description of Artificial Sequence: Synthetic oligonucleotide
  Target: ATXN1; (-) strand; PAM type: NNGRRT; PAM sequence: CAGGAT
caaggtttcagcatgttggc

SEQ ID NO: 16325 - DNA, 20 bp, Artificial Sequence
  Description of Artificial Sequence: Synthetic oligonucleotide
  Target: ATXN1; (-) strand; PAM type: NNGRRT; PAM sequence: TGGGAT
gtctcaccctcctgagtagc

SEQ ID NO: 16326 - DNA, 20 bp, Artificial Sequence
  Description of Artificial Sequence: Synthetic oligonucleotide
  Target: ATXN1; (-) strand; PAM type: NNGRRT; PAM sequence: CTGAGT
tgttctcctgtctcaccctc

SEQ ID NO: 16327 - DNA, 20 bp, Artificial Sequence
  Description of Artificial Sequence: Synthetic oligonucleotide
  Target: ATXN1; (-) strand; PAM type: NNGRRT; PAM sequence: TGGAGT
gtttcactctgtcaccaggc

SEQ ID NO: 16328 - DNA, 20 bp, Artificial Sequence
  Description of Artificial Sequence: Synthetic oligonucleotide
  Target: ATXN1; (-) strand; PAM type: NNGRRT; PAM sequence: CGGAGT
ctttttttttttttttgaga

SEQ ID NO: 16329 - DNA, 20 bp, Artificial Sequence
  Description of Artificial Sequence: Synthetic oligonucleotide
  Target: ATXN1; (-) strand; PAM type: NNGRRT; PAM sequence: AAGAAT
ttaaataaaaaacaatggcc

SEQ ID NO: 16330 - DNA, 20 bp, Artificial Sequence
  Description of Artificial Sequence: Synthetic oligonucleotide
  Target: ATXN1; (-) strand; PAM type: NNGRRT; PAM sequence: ATGGAT
ctaccacagatacatataca

SEQ ID NO: 16331 - DNA, 20 bp, Artificial Sequence
  Description of Artificial Sequence: Synthetic oligonucleotide
  Target: ATXN1; (-) strand; PAM type: NNGRRT; PAM sequence: TGGAAT
ggggctagggaaaggtcaac

SEQ ID NO: 16332 - DNA, 20 bp, Artificial Sequence
  Description of Artificial Sequence: Synthetic oligonucleotide
  Target: ATXN1; (-) strand; PAM type: NNGRRT; PAM sequence: CCGGAT
tcctttggctttgagaagca

SEQ ID NO: 16333 - DNA, 20 bp, Artificial Sequence
  Description of Artificial Sequence: Synthetic oligonucleotide
  Target: ATXN1; (-) strand; PAM type: NNGRRT; PAM sequence: TGGAAT
cttttaattatctgtattaa

SEQ ID NO: 16334 - DNA, 20 bp, Artificial Sequence
  Description of Artificial Sequence: Synthetic oligonucleotide
  Target: ATXN1; (-) strand; PAM type: NNGRRT; PAM sequence: ATGAAT
tacgctgctcttaagaggag

SEQ ID NO: 16335 - DNA, 20 bp, Artificial Sequence
  Description of Artificial Sequence: Synthetic oligonucleotide
  Target: ATXN1; (-) strand; PAM type: NNGRRT; PAM sequence: TAGAAT
ctttgttggagttttaaatt

SEQ ID NO: 16336 - DNA, 20 bp, Artificial Sequence
  Description of Artificial Sequence: Synthetic oligonucleotide
  Target: ATXN1; (-) strand; PAM type: NNGRRT; PAM sequence: TGGAGT
agaataatcctttcctttgt

SEQ ID NO: 16337 - DNA, 20 bp, Artificial Sequence
  Description of Artificial Sequence: Synthetic oligonucleotide
  Target: ATXN1; (-) strand; PAM type: NNGRRT; PAM sequence: AAGAAT
tcacgaatcttgaaccttag

SEQ ID NO: 16338 - DNA, 20 bp, Artificial Sequence
  Description of Artificial Sequence: Synthetic oligonucleotide
  Target: ATXN1; (-) strand; PAM type: NNGRRT; PAM sequence: ACGAAT
aatttcgttaccaaatcctc

SEQ ID NO: 16339 - DNA, 20 bp, Artificial Sequence
  Description of Artificial Sequence: Synthetic oligonucleotide
  Target: ATXN1; (-) strand; PAM type: NNGRRT; PAM sequence: AGGAAT
tttttaatttgctgtcctta

SEQ ID NO: 16340 - DNA, 20 bp, Artificial Sequence
  Description of Artificial Sequence: Synthetic oligonucleotide
  Target: ATXN1; (-) strand; PAM type: NNGRRT; PAM sequence: ATGGGT
aaacaaacatttgttgttga

SEQ ID NO: 16341 - DNA, 20 bp, Artificial Sequence
  Description of Artificial Sequence: Synthetic oligonucleotide
  Target: ATXN1; (-) strand; PAM type: NNGRRT; PAM sequence: TTGAAT
ttccaaacaaacatttgttg

SEQ ID NO: 16342 - DNA, 20 bp, Artificial Sequence
  Description of Artificial Sequence: Synthetic oligonucleotide
  Target: ATXN1; (-) strand; PAM type: NNGRRT; PAM sequence: GGGAAT
ggtaaatgattcaatcattt

SEQ ID NO: 16343 - DNA, 20 bp, Artificial Sequence
  Description of Artificial Sequence: Synthetic oligonucleotide
  Target: ATXN1; (-) strand; PAM type: NNGRRT; PAM sequence: TTGAGT
ctaagaatcaaaggaattac

SEQ ID NO: 16344 - DNA, 20 bp, Artificial Sequence
  Description of Artificial Sequence: Synthetic oligonucleotide
  Target: ATXN1; (-) strand; PAM type: NNGRRT; PAM sequence: AGGAAT
cgtcattttctaagaatcaa

SEQ ID NO: 16345 - DNA, 20 bp, Artificial Sequence
  Description of Artificial Sequence: Synthetic oligonucleotide
  Target: ATXN1; (-) strand; PAM type: NNGRRT; PAM sequence: AAGAAT
taacaactgcgtcattttct

SEQ ID NO: 16346 - DNA, 20 bp, Artificial Sequence
  Description of Artificial Sequence: Synthetic oligonucleotide
  Target: ATXN1; (-) strand; PAM type: NNGRRT; PAM sequence: GAGAGT
catgccttccaaattgtatt

SEQ ID NO: 16347 - DNA, 20 bp, Artificial Sequence
  Description of Artificial Sequence: Synthetic oligonucleotide
  Target: ATXN1; (-) strand; PAM type: NNGRRT; PAM sequence: TGGGGT
catagcttagtaggtgatgg

SEQ ID NO: 16348 - DNA, 20 bp, Artificial Sequence
  Description of Artificial Sequence: Synthetic oligonucleotide
  Target: ATXN1; (-) strand; PAM type: NNGRRT; PAM sequence: ATGAAT
accctattttgaaattacac

SEQ ID NO: 16349 - DNA, 20 bp, Artificial Sequence
  Description of Artificial Sequence: Synthetic oligonucleotide
  Target: ATXN1; (-) strand; PAM type: NNGRRT; PAM sequence: AAGAAT
agatagcaacatacttaaat

SEQ ID NO: 16350 - DNA, 20 bp, Artificial Sequence
  Description of Artificial Sequence: Synthetic oligonucleotide
  Target: ATXN1; (-) strand; PAM type: NNGRRT; PAM sequence: TAGAGT
atttgttccacgtatctcat

SEQ ID NO: 16351 - DNA, 20 bp, Artificial Sequence
  Description of Artificial Sequence: Synthetic oligonucleotide
  Target: ATXN1; (-) strand; PAM type: NNGRRT; PAM sequence: AAGAAT
atgcattttagcagtgttgg

SEQ ID NO: 16352 - DNA, 20 bp, Artificial Sequence
  Description of Artificial Sequence: Synthetic oligonucleotide
  Target: ATXN1; (-) strand; PAM type: NNGRRT; PAM sequence: CAGAAT
attgcatcctgttagaaagt

SEQ ID NO: 16353 - DNA, 20 bp, Artificial Sequence
  Description of Artificial Sequence: Synthetic oligonucleotide
  Target: ATXN1; (-) strand; PAM type: NNGRRT; PAM sequence: TGGGAT
gcctcggcctcactaagtgc

SEQ ID NO: 16354 - DNA, 20 bp, Artificial Sequence
  Description of Artificial Sequence: Synthetic oligonucleotide
  Target: ATXN1; (-) strand; PAM type: NNGRRT; PAM sequence: CAGGAT
tggggtttcaccgtgttagc

SEQ ID NO: 16355 - DNA, 20 bp, Artificial Sequence
  Description of Artificial Sequence: Synthetic oligonucleotide
  Target: ATXN1; (-) strand; PAM type: NNGRRT; PAM sequence: TGGGGT
tttgtattttttagtagaga

SEQ ID NO: 16356 - DNA, 20 bp, Artificial Sequence
  Description of Artificial Sequence: Synthetic oligonucleotide
  Target: ATXN1; (-) strand; PAM type: NNGRRT; PAM sequence: CCGAGT
cattttcctgcctcagcctc

SEQ ID NO: 16357 - DNA, 20 bp, Artificial Sequence
  Description of Artificial Sequence: Synthetic oligonucleotide
  Target: ATXN1; (-) strand; PAM type: NNGRRT; PAM sequence: CTGGGT
ctcactgcaagctccgcctc

SEQ ID NO: 16358 - DNA, 20 bp, Artificial Sequence
  Description of Artificial Sequence: Synthetic oligonucleotide
  Target: ATXN1; (-) strand; PAM type: NNGRRT; PAM sequence: TGGAAT
tctcactctgtcatccaggc

SEQ ID NO: 16359 - DNA, 20 bp, Artificial Sequence
  Description of Artificial Sequence: Synthetic oligonucleotide
  Target: ATXN1; (-) strand; PAM type: NNGRRT; PAM sequence: CTGGAT
cttctacttgtatttctact

SEQ ID NO: 16360 - DNA, 20 bp, Artificial Sequence
  Description of Artificial Sequence: Synthetic oligonucleotide
  Target: ATXN1; (-) strand; PAM type: NNGRRT; PAM sequence: GAGAAT
accctgactctaaaatacgt

SEQ ID NO: 16361 - DNA, 20 bp, Artificial Sequence
  Description of Artificial Sequence: Synthetic oligonucleotide
  Target: ATXN1; (-) strand; PAM type: NNGRRT; PAM sequence: ATGGAT
attttcttaagtcccttggc

SEQ ID NO: 16362 - DNA, 20 bp, Artificial Sequence
  Description of Artificial Sequence: Synthetic oligonucleotide
  Target: ATXN1; (-) strand; PAM type: NNGRRT; PAM sequence: AAGGAT
cacctagagggcctaagggg

SEQ ID NO: 16363 - DNA, 20 bp, Artificial Sequence
  Description of Artificial Sequence: Synthetic oligonucleotide
  Target: ATXN1; (-) strand; PAM type: NNGRRT; PAM sequence: CGGAGT
gcaggggtgggaaagaatta

SEQ ID NO: 16364 - DNA, 20 bp, Artificial Sequence
  Description of Artificial Sequence: Synthetic oligonucleotide
  Target: ATXN1; (-) strand; PAM type: NNGRRT; PAM sequence: AAGAAT
ttgacagggcaggggtggga

SEQ ID NO: 16365 - DNA, 20 bp, Artificial Sequence
  Description of Artificial Sequence: Synthetic oligonucleotide
  Target: ATXN1; (-) strand; PAM type: NNGRRT; PAM sequence: AGGGGT
ggtgttcaagttgacagggc

SEQ ID NO: 16366 - DNA, 20 bp, Artificial Sequence
  Description of Artificial Sequence: Synthetic oligonucleotide
  Target: ATXN1; (-) strand; PAM type: NNGRRT; PAM sequence: ATGGAT
aaaattaaaagctttaaagt

SEQ ID NO: 16367 - DNA, 20 bp, Artificial Sequence
  Description of Artificial Sequence: Synthetic oligonucleotide
  Target: ATXN1; (-) strand; PAM type: NNGRRT; PAM sequence: TAGAAT
ttttggctgctcactgatgt

SEQ ID NO: 16368 - DNA, 20 bp, Artificial Sequence
  Description of Artificial Sequence: Synthetic oligonucleotide
  Target: ATXN1; (-) strand; PAM type: NNGRRT; PAM sequence: AAGAAT
tccatctaaaaaaaaaaaaa

SEQ ID NO: 16369 - DNA, 20 bp, Artificial Sequence
  Description of Artificial Sequence: Synthetic oligonucleotide
  Target: ATXN1; (-) strand; PAM type: NNGRRT; PAM sequence: CTGGGT
tcatgccactgcactccagc

SEQ ID NO: 16370 - DNA, 20 bp, Artificial Sequence
  Description of Artificial Sequence: Synthetic oligonucleotide
  Target: ATXN1; (-) strand; PAM type: NNGRRT; PAM sequence: GCGGGT
cagcactttgggaggccgaa

SEQ ID NO: 16371 - DNA, 20 bp, Artificial Sequence
  Description of Artificial Sequence: Synthetic oligonucleotide
  Target: ATXN1; (-) strand; PAM type: NNGRRT; PAM sequence: CAGAAT
ccttatcctctttccccgtt

SEQ ID NO: 16372 - DNA, 20 bp, Artificial Sequence
  Description of Artificial Sequence: Synthetic oligonucleotide
  Target: ATXN1; (-) strand; PAM type: NNGRRT; PAM sequence: ATGAGT
tgataattcctgttttgtaa

SEQ ID NO: 16373 - DNA, 20 bp, Artificial Sequence
  Description of Artificial Sequence: Synthetic oligonucleotide
  Target: ATXN1; (-) strand; PAM type: NNGRRT; PAM sequence: CTGGGT
gaggcccttagcagaggtgg

SEQ ID NO: 16374 - DNA, 20 bp, Artificial Sequence
  Description of Artificial Sequence: Synthetic oligonucleotide
  Target: ATXN1; (-) strand; PAM type: NNGRRT; PAM sequence: AAGAAT
tcaagctctcagaaactggt

SEQ ID NO: 16375 - DNA, 20 bp, Artificial Sequence
  Description of Artificial Sequence: Synthetic oligonucleotide
  Target: ATXN1; (-) strand; PAM type: NNGRRT; PAM sequence: GAGAAT
ggagaaaagccaggggaaag

SEQ ID NO: 16376 - DNA, 20 bp, Artificial Sequence
  Description of Artificial Sequence: Synthetic oligonucleotide
  Target: ATXN1; (-) strand; PAM type: NNGRRT; PAM sequence: AGGAGT
ggaccagaaggagaggaggg

SEQ ID NO: 16377 - DNA, 20 bp, Artificial Sequence
  Description of Artificial Sequence: Synthetic oligonucleotide
  Target: ATXN1; (-) strand; PAM type: NNGRRT; PAM sequence: GTGAGT
actgcattctcagtctctgg

SEQ ID NO: 16378 - DNA, 20 bp, Artificial Sequence
  Description of Artificial Sequence: Synthetic oligonucleotide
  Target: ATXN1; (-) strand; PAM type: NNGRRT; PAM sequence: CTGGGT
tggtactgcattctcagtct

SEQ ID NO: 16379 - DNA, 20 bp, Artificial Sequence
  Description of Artificial Sequence: Synthetic oligonucleotide
  Target: ATXN1; (-) strand; PAM type: NNGRRT; PAM sequence: AGGAAT
aaagggaaggtggcccagtg

SEQ ID NO: 16380 - DNA, 20 bp, Artificial Sequence
  Description of Artificial Sequence: Synthetic oligonucleotide
  Target: ATXN1; (-) strand; PAM type: NNGRRT; PAM sequence: TGGAGT
atgagaactttattacagaa

SEQ ID NO: 16381 - DNA, 20 bp, Artificial Sequence
  Description of Artificial Sequence: Synthetic oligonucleotide
  Target: ATXN1; (-) strand; PAM type: NNGRRT; PAM sequence: CAGAAT
tccccatgagaactttatta

SEQ ID NO: 16382 - DNA, 20 bp, Artificial Sequence
  Description of Artificial Sequence: Synthetic oligonucleotide
  Target: ATXN1; (-) strand; PAM type: NNGRRT; PAM sequence: TGGGGT
cggagaggcgcccctttgca

SEQ ID NO: 16383 - DNA, 20 bp, Artificial Sequence
  Description of Artificial Sequence: Synthetic oligonucleotide
  Target: ATXN1; (-) strand; PAM type: NNGRRT; PAM sequence: GTGGAT
gataaggagacccttggttt

SEQ ID NO: 16384 - DNA, 20 bp, Artificial Sequence
  Description of Artificial Sequence: Synthetic oligonucleotide
  Target: ATXN1; (-) strand; PAM type: NNGRRT; PAM sequence: AGGAAT
gacttggttaaaagaccttg

SEQ ID NO: 16385 - DNA, 20 bp, Artificial Sequence
  Description of Artificial Sequence: Synthetic oligonucleotide
  Target: ATXN1; (-) strand; PAM type: NNGRRT; PAM sequence: TTGAAT
ctgtgttgcccaggctggtc

SEQ ID NO: 16386 - DNA, 20 bp, Artificial Sequence
  Description of Artificial Sequence: Synthetic oligonucleotide
  Target: ATXN1; (-) strand; PAM type: NNGRRT; PAM sequence: CAGAGT
ttttttttttttttttgaga

SEQ ID NO: 16387 - DNA, 20 bp, Artificial Sequence
  Description of Artificial Sequence: Synthetic oligonucleotide
  Target: ATXN1; (-) strand; PAM type: NNGRRT; PAM sequence: TTGAGT
ggtcctaccacctcagtcag

SEQ ID NO: 16388 - DNA, 20 bp, Artificial Sequence
  Description of Artificial Sequence: Synthetic oligonucleotide
  Target: ATXN1; (-) strand; PAM type: NNGRRT; PAM sequence: CAGGGT
tgttttcttttttttagata

SEQ ID NO: 16389 - DNA, 20 bp, Artificial Sequence
  Description of Artificial Sequence: Synthetic oligonucleotide
  Target: ATXN1; (-) strand; PAM type: NNGRRT; PAM sequence: GAGGAT
tactcagaaggctgaagtgg

SEQ ID NO: 16390 - DNA, 20 bp, Artificial Sequence
  Description of Artificial Sequence: Synthetic oligonucleotide
  Target: ATXN1; (-) strand; PAM type: NNGRRT; PAM sequence: AGGAGT
gtgggaggattgcttagggc

SEQ ID NO: 16391 - DNA, 20 bp, Artificial Sequence
  Description of Artificial Sequence: Synthetic oligonucleotide
  Target: ATXN1; (-) strand; PAM type: NNGRRT; PAM sequence: GAGGAT
actttgtgaagccaaagtgg

SEQ ID NO: 16392 - DNA, 20 bp, Artificial Sequence
  Description of Artificial Sequence: Synthetic oligonucleotide
  Target: ATXN1; (-) strand; PAM type: NNGRRT; PAM sequence: TTGAGT
ggtcagctgggtgcagtggc

SEQ ID NO: 16393 - DNA, 20 bp, Artificial Sequence
  Description of Artificial Sequence: Synthetic oligonucleotide
  Target: ATXN1; (-) strand; PAM type: NNGRRT; PAM sequence: CTGGGT
tccaaaatccaggtggtcag

SEQ ID NO: 16394 - DNA, 20 bp, Artificial Sequence
  Description of Artificial Sequence: Synthetic oligonucleotide
  Target: ATXN1; (-) strand; PAM type: NNGRRT; PAM sequence: TCGGAT
aacttatacaagtgagtcaa

SEQ ID NO: 16395 - DNA, 20 bp, Artificial Sequence
  Description of Artificial Sequence: Synthetic oligonucleotide
  Target: ATXN1; (-) strand; PAM type: NNGRRT; PAM sequence: GTGAGT
ataaaatgtaacttatacaa

SEQ ID NO: 16396 - DNA, 20 bp, Artificial Sequence
  Description of Artificial Sequence: Synthetic oligonucleotide
  Target: ATXN1; (-) strand; PAM type: NNGRRT; PAM sequence: GAGAAT
gggagcctgaacatataaag

SEQ ID NO: 16397 - DNA, 20 bp, Artificial Sequence
  Description of Artificial Sequence: Synthetic oligonucleotide
  Target: ATXN1; (-) strand; PAM type: NNGRRT; PAM sequence: AGGGAT
gaagtgaaagcgttggcgta

SEQ ID NO: 16398 - DNA, 20 bp, Artificial Sequence
  Description of Artificial Sequence: Synthetic oligonucleotide
  Target: ATXN1; (-) strand; PAM type: NNGRRT; PAM sequence: AAGAAT
gtctaagtgcagaggatctt

SEQ ID NO: 16399 - DNA, 20 bp, Artificial Sequence
  Description of Artificial Sequence: Synthetic oligonucleotide
  Target: ATXN1; (-) strand; PAM type: NNGRRT; PAM sequence: GAGGAT
tgcagcattgtctaagtgca

SEQ ID NO: 16400 - DNA, 20 bp, Artificial Sequence
  Description of Artificial Sequence: Synthetic oligonucleotide
  Target: ATXN1; (-) strand; PAM type: NNGRRT; PAM sequence: GAGAGT
tgttcttacaaaataaagaa

SEQ ID NO: 16401 - DNA, 20 bp, Artificial Sequence
  Description of Artificial Sequence: Synthetic oligonucleotide
  Target: ATXN1; (-) strand; PAM type: NNGRRT; PAM sequence: TTGAAT
cccattctctttgaataatt

SEQ ID NO: 16402 - DNA, 20 bp, Artificial Sequence
  Description of Artificial Sequence: Synthetic oligonucleotide
  Target: ATXN1; (-) strand; PAM type: NNGRRT; PAM sequence: TTGAAT
atacctgtttcccattctct

SEQ ID NO: 16403 - DNA, 20 bp, Artificial Sequence
  Description of Artificial Sequence: Synthetic oligonucleotide
  Target: ATXN1; (-) strand; PAM type: NNGRRT; PAM sequence: CTGAAT
ttaaccaagagctccagcat

SEQ ID NO: 16404 - DNA, 20 bp, Artificial Sequence
  Description of Artificial Sequence: Synthetic oligonucleotide
  Target: ATXN1; (-) strand; PAM type: NNGRRT; PAM sequence: TTGAAT
gctcatcctagggtcactgc

SEQ ID NO: 16405 - DNA, 20 bp, Artificial Sequence
  Description of Artificial Sequence: Synthetic oligonucleotide
  Target: ATXN1; (-) strand; PAM type: NNGRRT; PAM sequence: TAGGGT
gtaagctttgaggctcatcc

SEQ ID NO: 16406 - DNA, 20 bp, Artificial Sequence
  Description of Artificial Sequence: Synthetic oligonucleotide
  Target: ATXN1; (-) strand; PAM type: NNGRRT; PAM sequence: GGGAAT
cttggccattttacggttaa

SEQ ID NO: 16407 - DNA, 20 bp, Artificial Sequence
  Description of Artificial Sequence: Synthetic oligonucleotide
  Target: ATXN1; (-) strand; PAM type: NNGRRT; PAM sequence: TGGGAT
atctcagcctcccaaagtgc

SEQ ID NO: 16408 - DNA, 20 bp, Artificial Sequence
  Description of Artificial Sequence: Synthetic oligonucleotide
  Target: ATXN1; (-) strand; PAM type: NNGRRT; PAM sequence: TAGGGT
ttaaacattatttgtaaagt

SEQ ID NO: 16409 - DNA, 20 bp, Artificial Sequence
  Description of Artificial Sequence: Synthetic oligonucleotide
  Target: ATXN1; (-) strand; PAM type: NNGRRT; PAM sequence: CTGAGT
gatccccccacctcatcctc

SEQ ID NO: 16410 - DNA, 20 bp, Artificial Sequence
  Description of Artificial Sequence: Synthetic oligonucleotide
  Target: ATXN1; (-) strand; PAM type: NNGRRT; PAM sequence: CTGGGT
ctcacagcagccttgaactc

SEQ ID NO: 16411 - DNA, 20 bp, Artificial Sequence
  Description of Artificial Sequence: Synthetic oligonucleotide
  Target: ATXN1; (-) strand; PAM type: NNGRRT; PAM sequence: TGGAGT
tgacacactgtactccaggc

SEQ ID NO: 16412 - DNA, 20 bp, Artificial Sequence
  Description of Artificial Sequence: Synthetic oligonucleotide
  Target: ATXN1; (-) strand; PAM type: NNGRRT; PAM sequence: CAGAGT
acagggtctcgctctgtctc

SEQ ID NO: 16413 - DNA, 20 bp, Artificial Sequence
  Description of Artificial Sequence: Synthetic oligonucleotide
  Target: ATXN1; (-) strand; PAM type: NNGRRT; PAM sequence: CAGGGT
ttgtttgtttgtttttgaga

SEQ ID NO: 16414 - DNA, 20 bp, Artificial Sequence
  Description of Artificial Sequence: Synthetic oligonucleotide
  Target: ATXN1; (-) strand; PAM type: NNGRRT; PAM sequence: TTGAGT
ttatctcatcccataactct

SEQ ID NO: 16415 - DNA, 20 bp, Artificial Sequence
  Description of Artificial Sequence: Synthetic oligonucleotide
  Target: ATXN1; (-) strand; PAM type: NNGRRT; PAM sequence: CTGAAT
aaagaaatatttattgaata

SEQ ID NO: 16416 - DNA, 20 bp, Artificial Sequence
  Description of Artificial Sequence: Synthetic oligonucleotide
  Target: ATXN1; (-) strand; PAM type: NNGRRT; PAM sequence: TTGAAT
acatagtaaagaaatattta

SEQ ID NO: 16417 - DNA, 20 bp, Artificial Sequence
  Description of Artificial Sequence: Synthetic oligonucleotide
  Target: ATXN1; (-) strand; PAM type: NNGRRT; PAM sequence: TTGGAT
ttcttaagatcctctgcact

SEQ ID NO: 16418 - DNA, 20 bp, Artificial Sequence
  Description of Artificial Sequence: Synthetic oligonucleotide
  Target: ATXN1; (-) strand; PAM type: NNGRRT; PAM sequence: AGGAGT
caggagaatcacttgaaccc

SEQ ID NO: 16419 - DNA, 20 bp, Artificial Sequence
  Description of Artificial Sequence: Synthetic oligonucleotide
  Target: ATXN1; (-) strand; PAM type: NNGRRT; PAM sequence: GAGAAT
tacttgggaggctgaggcag

SEQ ID NO: 16420 - DNA, 20 bp, Artificial Sequence
  Description of Artificial Sequence: Synthetic oligonucleotide
  Target: ATXN1; (-) strand; PAM type: NNGRRT; PAM sequence: GCGGAT
acttcgggaggctgaggcgg

SEQ ID NO: 16421 - DNA, 20 bp, Artificial Sequence
  Description of Artificial Sequence: Synthetic oligonucleotide
  Target: ATXN1; (-) strand; PAM type: NNGRRT; PAM sequence: GAGAAT
tacttgggaggctgaggcag

SEQ ID NO: 16422 - DNA, 20 bp, Artificial Sequence
  Description of Artificial Sequence: Synthetic oligonucleotide
  Target: ATXN1; (-) strand; PAM type: NNGRRT; PAM sequence: AGGAGT
cgggtggatcacctgaggtc

SEQ ID NO: 16423 - DNA, 20 bp, Artificial Sequence
  Description of Artificial Sequence: Synthetic oligonucleotide
  Target: ATXN1; (-) strand; PAM type: NNGRRT; PAM sequence: GTGGAT
actttgggaggccaaggcgg

SEQ ID NO: 16424 - DNA, 20 bp, Artificial Sequence
  Description of Artificial Sequence: Synthetic oligonucleotide
  Target: ATXN1; (-) strand; PAM type: NNGRRT; PAM sequence: GCGGGT
caacactttgggaggccaag

SEQ ID NO: 16425 - DNA, 20 bp, Artificial Sequence
  Description of Artificial Sequence: Synthetic oligonucleotide
  Target: ATXN1; (-) strand; PAM type: NNGRRT; PAM sequence: GAGGGT
tgtagaaactgaggcttaga

SEQ ID NO: 16426 - DNA, 20 bp, Artificial Sequence
  Description of Artificial Sequence: Synthetic oligonucleotide
  Target: ATXN1; (-) strand; PAM type: NNGRRT; PAM sequence: TAGAAT
taattgcagaacttgggagc

SEQ ID NO: 16427 - DNA, 20 bp, Artificial Sequence
  Description of Artificial Sequence: Synthetic oligonucleotide
  Target: ATXN1; (-) strand; PAM type: NNGRRT; PAM sequence: GTGGAT
tgcagcgcaatatcaattaa

SEQ ID NO: 16428 - DNA, 20 bp, Artificial Sequence
  Description of Artificial Sequence: Synthetic oligonucleotide
  Target: ATXN1; (-) strand; PAM type: NNGRRT; PAM sequence: ATGAAT
attccattttgaagttacac

SEQ ID NO: 16429 - DNA, 20 bp, Artificial Sequence
  Description of Artificial Sequence: Synthetic oligonucleotide
  Target: ATXN1; (-) strand; PAM type: NNGRRT; PAM sequence: TTGGAT
ttcactcttagaacttccct

SEQ ID NO: 16430 - DNA, 20 bp, Artificial Sequence
  Description of Artificial Sequence: Synthetic oligonucleotide
  Target: ATXN1; (-) strand; PAM type: NNGRRT; PAM sequence: ATGGGT
gaccatggttgcctagagag

SEQ ID NO: 16431 - DNA, 20 bp, Artificial Sequence
  Description of Artificial Sequence: Synthetic oligonucleotide
  Target: ATXN1; (-) strand; PAM type: NNGRRT; PAM sequence: GGGGAT
agagccatctttaggaattt

SEQ ID NO: 16432 - DNA, 20 bp, Artificial Sequence
  Description of Artificial Sequence: Synthetic oligonucleotide
  Target: ATXN1; (-) strand; PAM type: NNGRRT; PAM sequence: AGGAAT
atgagcaaagagccatcttt

SEQ ID NO: 16433 - DNA, 20 bp, Artificial Sequence
  Description of Artificial Sequence: Synthetic oligonucleotide
  Target: ATXN1; (-) strand; PAM type: NNGRRT; PAM sequence: TAGGAT
agacctgtggttgaccatat

SEQ ID NO: 16434 - DNA, 20 bp, Artificial Sequence
  Description of Artificial Sequence: Synthetic oligonucleotide
  Target: ATXN1; (-) strand; PAM type: NNGRRT; PAM sequence: TCGGAT
gaccaagcacgtctttttcc

SEQ ID NO: 16435 - DNA, 20 bp, Artificial Sequence
  Description of Artificial Sequence: Synthetic oligonucleotide
  Target: ATXN1; (-) strand; PAM type: NNGRRT; PAM sequence: TAGAAT
tggatgtcataagaagactg

SEQ ID NO: 16436 - DNA, 20 bp, Artificial Sequence
  Description of Artificial Sequence: Synthetic oligonucleotide
  Target: ATXN1; (-) strand; PAM type: NNGRRT; PAM sequence: GTGGAT
aacaagattatatatgggaa

SEQ ID NO: 16437 - DNA, 20 bp, Artificial Sequence
  Description of Artificial Sequence: Synthetic oligonucleotide
  Target: ATXN1; (-) strand; PAM type: NNGRRT; PAM sequence: CAGGGT
tagaacagaggtaatattgc

SEQ ID NO: 16438 - DNA, 20 bp, Artificial Sequence
  Description of Artificial Sequence: Synthetic oligonucleotide
  Target: ATXN1; (-) strand; PAM type: NNGRRT; PAM sequence: CTGGAT
agagacagaaagagagagag

SEQ ID NO: 16439 - DNA, 20 bp, Artificial Sequence
  Description of Artificial Sequence: Synthetic oligonucleotide
  Target: ATXN1; (-) strand; PAM type: NNGRRT; PAM sequence: GAGGGT
aaatcaagtgtgcatgggca

SEQ ID NO: 16440 - DNA, 20 bp, Artificial Sequence
  Description of Artificial Sequence: Synthetic oligonucleotide
  Target: ATXN1; (-) strand; PAM type: NNGRRT; PAM sequence: AAGAGT
agtgtcacacgtctttgaat

SEQ ID NO: 16441 - DNA, 20 bp, Artificial Sequence
  Description of Artificial Sequence: Synthetic oligonucleotide
  Target: ATXN1; (-) strand; PAM type: NNGRRT; PAM sequence: TTGAAT
aataatagtgtcacacgtct

SEQ ID NO: 16442 - DNA, 20 bp, Artificial Sequence
  Description of Artificial Sequence: Synthetic oligonucleotide
  Target: ATXN1; (-) strand; PAM type: NNGRRT; PAM sequence: AAGAAT
caacatattttaaggaaaca

SEQ ID NO: 16443 - DNA, 20 bp, Artificial Sequence
  Description of Artificial Sequence: Synthetic oligonucleotide
  Target: ATXN1; (-) strand; PAM type: NNGRRT; PAM sequence: AAGAAT
cgctctcctactagggagag

SEQ ID NO: 16444 - DNA, 20 bp, Artificial Sequence
  Description of Artificial Sequence: Synthetic oligonucleotide
  Target: ATXN1; (-) strand; PAM type: NNGRRT; PAM sequence: CAGAGT
ctgtaataatgtttatgatt

SEQ ID NO: 16445 - DNA, 20 bp, Artificial Sequence
  Description of Artificial Sequence: Synthetic oligonucleotide
  Target: ATXN1; (-) strand; PAM type: NNGRRT; PAM sequence: AGGAGT
gtatccctgtaatggtcccc

SEQ ID NO: 16446 - DNA, 20 bp, Artificial Sequence
  Description of Artificial Sequence: Synthetic oligonucleotide
  Target: ATXN1; (-) strand; PAM type: NNGRRT; PAM sequence: TGGAGT
gaattttacaaaagtattta

SEQ ID NO: 16447 - DNA, 20 bp, Artificial Sequence
  Description of Artificial Sequence: Synthetic oligonucleotide
  Target: ATXN1; (-) strand; PAM type: NNGRRT; PAM sequence: GTGAAT
aaacacaaatggagaggaat

SEQ ID NO: 16448 - DNA, 20 bp, Artificial Sequence
  Description of Artificial Sequence: Synthetic oligonucleotide
  Target: ATXN1; (-) strand; PAM type: NNGRRT; PAM sequence: AGGAAT
tttacaaaacacaaatggag

SEQ ID NO: 16449 - DNA, 20 bp, Artificial Sequence
  Description of Artificial Sequence: Synthetic oligonucleotide
  Target: ATXN1; (-) strand; PAM type: NNGRRT; PAM sequence: ATGGAT
catctttatatttgtgggaa

SEQ ID NO: 16450 - DNA, 20 bp, Artificial Sequence
  Description of Artificial Sequence: Synthetic oligonucleotide
  Target: ATXN1; (-) strand; PAM type: NNGRRT; PAM sequence: CTGGGT
atgtcttaatgttaaaaatg

SEQ ID NO: 16451 - DNA, 20 bp, Artificial Sequence
  Description of Artificial Sequence: Synthetic oligonucleotide
  Target: ATXN1; (-) strand; PAM type: NNGRRT; PAM sequence: GAGAAT
tgtgccaccttttcaagaaa

SEQ ID NO: 16452 - DNA, 20 bp, Artificial Sequence
  Description of Artificial Sequence: Synthetic oligonucleotide
  Target: ATXN1; (-) strand; PAM type: NNGRRT; PAM sequence: CAGAAT
atttctaaccagtgctctgt

SEQ ID NO: 16453 - DNA, 20 bp, Artificial Sequence
  Description of Artificial Sequence: Synthetic oligonucleotide
  Target: ATXN1; (-) strand; PAM type: NNGRRT; PAM sequence: GTGAAT
cttcttagtgccttccgaat

SEQ ID NO: 16454 - DNA, 20 bp, Artificial Sequence
  Description of Artificial Sequence: Synthetic oligonucleotide
  Target: ATXN1; (-) strand; PAM type: NNGRRT; PAM sequence: CCGAAT
ggttctcttcttagtgcctt

SEQ ID NO: 16455 - DNA, 20 bp, Artificial Sequence
  Description of Artificial Sequence: Synthetic oligonucleotide
  Target: ATXN1; (-) strand; PAM type: NNGRRT; PAM sequence: CAGAGT
aggatgcatttttctggcat

SEQ ID NO: 16456 - DNA, 20 bp, Artificial Sequence
  Description of Artificial Sequence: Synthetic oligonucleotide
  Target: ATXN1; (-) strand; PAM type: NNGRRT; PAM sequence: GAGGAT
tccaagccccctttgtagca

SEQ ID NO: 16457 - DNA, 20 bp, Artificial Sequence
  Description of Artificial Sequence: Synthetic oligonucleotide
  Target: ATXN1; (-) strand; PAM type: NNGRRT; PAM sequence: ATGGGT
tgcatggttgctgcttggca

SEQ ID NO: 16458 - DNA, 20 bp, Artificial Sequence
  Description of Artificial Sequence: Synthetic oligonucleotide
  Target: ATXN1; (-) strand; PAM type: NNGRRT; PAM sequence: TGGGGT
agccacagggcaatctctat

SEQ ID NO: 16459 - DNA, 20 bp, Artificial Sequence
  Description of Artificial Sequence: Synthetic oligonucleotide
  Target: ATXN1; (-) strand; PAM type: NNGRRT; PAM sequence: TTGAAT
agttttgggtctgctcatca

SEQ ID NO: 16460 - DNA, 20 bp, Artificial Sequence
  Description of Artificial Sequence: Synthetic oligonucleotide
  Target: ATXN1; (-) strand; PAM type: NNGRRT; PAM sequence: TTGGGT
taagcccaatgttgccagtt

SEQ ID NO: 16461 - DNA, 20 bp, Artificial Sequence
  Description of Artificial Sequence: Synthetic oligonucleotide
  Target: ATXN1; (-) strand; PAM type: NNGRRT; PAM sequence: TTGGAT
tcgtcttcttcctttatttc

SEQ ID NO: 16462 - DNA, 20 bp, Artificial Sequence
  Description of Artificial Sequence: Synthetic oligonucleotide
  Target: ATXN1; (-) strand; PAM type: NNGRRT; PAM sequence: CTGGGT
cttgtcattcacgcctaagt

SEQ ID NO: 16463 - DNA, 20 bp, Artificial Sequence
  Description of Artificial Sequence: Synthetic oligonucleotide
  Target: ATXN1; (-) strand; PAM type: NNGRRT; PAM sequence: TCGAAT
tgtttttccttttcattgca

SEQ ID NO: 16464 - DNA, 20 bp, Artificial Sequence
  Description of Artificial Sequence: Synthetic oligonucleotide
  Target: ATXN1; (-) strand; PAM type: NNGRRT; PAM sequence: GTGAGT
tttttttcttcttgtataga

SEQ ID NO: 16465 - DNA, 20 bp, Artificial Sequence
  Description of Artificial Sequence: Synthetic oligonucleotide
  Target: ATXN1; (-) strand; PAM type: NNGRRT; PAM sequence: TAGAGT
ttcatttttttcttcttgta

SEQ ID NO: 16466 - DNA, 20 bp, Artificial Sequence
  Description of Artificial Sequence: Synthetic oligonucleotide
  Target: ATXN1; (-) strand; PAM type: NNGRRT; PAM sequence: ATGAGT
ttcctcctcactgaatgctt

SEQ ID NO: 16467 - DNA, 20 bp, Artificial Sequence
  Description of Artificial Sequence: Synthetic oligonucleotide
  Target: ATXN1; (-) strand; PAM type: NNGRRT; PAM sequence: CTGAAT
tgtatttcttttcctcctca

SEQ ID NO: 16468 - DNA, 20 bp, Artificial Sequence
  Description of Artificial Sequence: Synthetic oligonucleotide
  Target: ATXN1; (-) strand; PAM type: NNGRRT; PAM sequence: TGGAAT
agtaggaaagttggttagtt

SEQ ID NO: 16469 - DNA, 20 bp, Artificial Sequence
  Description of Artificial Sequence: Synthetic oligonucleotide
  Target: ATXN1; (-) strand; PAM type: NNGRRT; PAM sequence: AAGAAT
tttgttgctccttgggatcc

SEQ ID NO: 16470 - DNA, 20 bp, Artificial Sequence
  Description of Artificial Sequence: Synthetic oligonucleotide
  Target: ATXN1; (-) strand; PAM type: NNGRRT; PAM sequence: TGGGAT
attgtgtttttgttgctcct

SEQ ID NO: 16471 - DNA, 20 bp, Artificial Sequence
  Description of Artificial Sequence: Synthetic oligonucleotide
  Target: ATXN1; (-) strand; PAM type: NNGRRT; PAM sequence: CTGAAT
gatgagcccctgtgctgggc

SEQ ID NO: 16472 - DNA, 20 bp, Artificial Sequence
  Description of Artificial Sequence: Synthetic oligonucleotide
  Target: ATXN1; (-) strand; PAM type: NNGRRT; PAM sequence: AGGGAT
tcccaaagttctgggattac

SEQ ID NO: 16473 - DNA, 20 bp, Artificial Sequence
  Description of Artificial Sequence: Synthetic oligonucleotide
  Target: ATXN1; (-) strand; PAM type: NNGRRT; PAM sequence: TGGGAT
acctcggcctcccaaagttc

SEQ ID NO: 16474 - DNA, 20 bp, Artificial Sequence
  Description of Artificial Sequence: Synthetic oligonucleotide
  Target: ATXN1; (-) strand; PAM type: NNGRRT; PAM sequence: CCGGGT
tgacgtctcgatgtgttgtc

SEQ ID NO: 16475 - DNA, 20 bp, Artificial Sequence
  Description of Artificial Sequence: Synthetic oligonucleotide
  Target: ATXN1; (-) strand; PAM type: NNGRRT; PAM sequence: AAGGAT
gccttgacctcctggctcta

SEQ ID NO: 16476 - DNA, 20 bp, Artificial Sequence
  Description of Artificial Sequence: Synthetic oligonucleotide
  Target: ATXN1; (-) strand; PAM type: NNGRRT; PAM sequence: TGGGAT
tgcagcctggagtgcactgg

SEQ ID NO: 16477 - DNA, 20 bp, Artificial Sequence
  Description of Artificial Sequence: Synthetic oligonucleotide
  Target: ATXN1; (-) strand; PAM type: NNGRRT; PAM sequence: TGGAGT
tcttgctctgtggtgcagcc

SEQ ID NO: 16478 - DNA, 20 bp, Artificial Sequence
  Description of Artificial Sequence: Synthetic oligonucleotide
  Target: ATXN1; (-) strand; PAM type: NNGRRT; PAM sequence: CAGGGT
tatatatttttctctagaga

SEQ ID NO: 16479 - DNA, 20 bp, Artificial Sequence
  Description of Artificial Sequence: Synthetic oligonucleotide
  Target: ATXN1; (-) strand; PAM type: NNGRRT; PAM sequence: AAGGAT
attatgtaacttttcttaat

SEQ ID NO: 16480 - DNA, 20 bp, Artificial Sequence
  Description of Artificial Sequence: Synthetic oligonucleotide
  Target: ATXN1; (-) strand; PAM type: NNGRRT; PAM sequence: TGGAAT
taacacattttattctcctt

SEQ ID NO: 16481 - DNA, 20 bp, Artificial Sequence
  Description of Artificial Sequence: Synthetic oligonucleotide
  Target: ATXN1; (-) strand; PAM type: NNGRRT; PAM sequence: ACGAAT
agattcttttgcttttcaaa

SEQ ID NO: 16482 - DNA, 20 bp, Artificial Sequence
  Description of Artificial Sequence: Synthetic oligonucleotide
  Target: ATXN1; (-) strand; PAM type: NNGRRT; PAM sequence: ATGGGT
ccaatcttcttgtaactttt

SEQ ID NO: 16483 - DNA, 20 bp, Artificial Sequence
  Description of Artificial Sequence: Synthetic oligonucleotide
  Target: ATXN1; (-) strand; PAM type: NNGRRT; PAM sequence: TTGAAT
cagtaaaaatttcacccctg

SEQ ID NO: 16484 - DNA, 20 bp, Artificial Sequence
  Description of Artificial Sequence: Synthetic oligonucleotide
  Target: ATXN1; (-) strand; PAM type: NNGRRT; PAM sequence: TGGAAT
acaattttgacttaattctt

SEQ ID NO: 16485 - DNA, 20 bp, Artificial Sequence
  Description of Artificial Sequence: Synthetic oligonucleotide
  Target: ATXN1; (-) strand; PAM type: NNGRRT; PAM sequence: TGGGGT
tttccaaggactgaatgcag

SEQ ID NO: 16486 - DNA, 20 bp, Artificial Sequence
  Description of Artificial Sequence: Synthetic oligonucleotide
  Target: ATXN1; (-) strand; PAM type: NNGRRT; PAM sequence: CTGAAT
tctgcttatttttccaagga

SEQ ID NO: 16487 - DNA, 20 bp, Artificial Sequence
  Description of Artificial Sequence: Synthetic oligonucleotide
  Target: ATXN1; (-) strand; PAM type: NNGRRT; PAM sequence: CAGAGT
ctgcactccagaatgggcaa

SEQ ID NO: 16488 - DNA, 20 bp, Artificial Sequence
  Description of Artificial Sequence: Synthetic oligonucleotide
  Target: ATXN1; (-) strand; PAM type: NNGRRT; PAM sequence: CAGAAT
gagatggagccactgcactc

SEQ ID NO: 16489 - DNA, 20 bp, Artificial Sequence
  Description of Artificial Sequence: Synthetic oligonucleotide
  Target: ATXN1; (-) strand; PAM type: NNGRRT; PAM sequence: GAGAAT
tactcgaaaggctgaggcag

SEQ ID NO: 16490 - DNA, 20 bp, Artificial Sequence
  Description of Artificial Sequence: Synthetic oligonucleotide
  Target: ATXN1; (-) strand; PAM type: NNGRRT; PAM sequence: CCGGGT
ctaaaaatacaaaaaattag

SEQ ID NO: 16491 - DNA, 20 bp, Artificial Sequence
  Description of Artificial Sequence: Synthetic oligonucleotide
  Target: ATXN1; (-) strand; PAM type: NNGRRT; PAM sequence: CAGGAT
atttattttatgttccaata

SEQ ID NO: 16492 - DNA, 20 bp, Artificial Sequence
  Description of Artificial Sequence: Synthetic oligonucleotide
  Target: ATXN1; (-) strand; PAM type: NNGRRT; PAM sequence: CAGAAT
gttttgttgcattgtggtca

SEQ ID NO: 16493 - DNA, 20 bp, Artificial Sequence
  Description of Artificial Sequence: Synthetic oligonucleotide
  Target: ATXN1; (-) strand; PAM type: NNGRRT; PAM sequence: ATGAGT
gtttacacttctgtctatta

SEQ ID NO: 16494 - DNA, 20 bp, Artificial Sequence
  Description of Artificial Sequence: Synthetic oligonucleotide
  Target: ATXN1; (-) strand; PAM type: NNGRRT; PAM sequence: TTGAAT
ttttgaatgtacaagttaat

SEQ ID NO: 16495 - DNA, 20 bp, Artificial Sequence
  Description of Artificial Sequence: Synthetic oligonucleotide
  Target: ATXN1; (-) strand; PAM type: NNGRRT; PAM sequence: TTGAAT
cctatttagaagaattcttt

SEQ ID NO: 16496 - DNA, 20 bp, Artificial Sequence
  Description of Artificial Sequence: Synthetic oligonucleotide
  Target: ATXN1; (-) strand; PAM type: NNGRRT; PAM sequence: AAGAAT
tatactctacacctatttag

SEQ ID NO: 16497 - DNA, 20 bp, Artificial Sequence
  Description of Artificial Sequence: Synthetic oligonucleotide
  Target: ATXN1; (-) strand; PAM type: NNGRRT; PAM sequence: TTGAGT
ccacccccttttctaattta

SEQ ID NO: 16498 - DNA, 20 bp, Artificial Sequence
  Description of Artificial Sequence: Synthetic oligonucleotide
  Target: ATXN1; (-) strand; PAM type: NNGRRT; PAM sequence: TGGGAT
tgcccgacctcccaaagtgc

SEQ ID NO: 16499 - DNA, 20 bp, Artificial Sequence
  Description of Artificial Sequence: Synthetic oligonucleotide
  Target: ATXN1; (-) strand; PAM type: NNGRRT; PAM sequence: CAGGAT
tggagttttgccatgttggc

SEQ ID NO: 16500 - DNA, 20 bp, Artificial Sequence
  Description of Artificial Sequence: Synthetic oligonucleotide
  Target: ATXN1; (-) strand; PAM type: NNGRRT; PAM sequence: TGGAGT
ttttgtatttttagtacaga

SEQ ID NO: 16501 - DNA, 20 bp, Artificial Sequence
  Description of Artificial Sequence: Synthetic oligonucleotide
  Target: ATXN1; (-) strand; PAM type: NNGRRT; PAM sequence: ACGGGT
ctcactgcaacctccacctt

SEQ ID NO: 16502 - DNA, 20 bp, Artificial Sequence
  Description of Artificial Sequence: Synthetic oligonucleotide
  Target: ATXN1; (-) strand; PAM type: NNGRRT; PAM sequence: TGGAGT
gtctctctctgtcaccaggc

SEQ ID NO: 16503 - DNA, 20 bp, Artificial Sequence
  Description of Artificial Sequence: Synthetic oligonucleotide
  Target: ATXN1; (-) strand; PAM type: NNGRRT; PAM sequence: CAGAGT
ctttttttttttttttaaga

SEQ ID NO: 16504 - DNA, 20 bp, Artificial Sequence
  Description of Artificial Sequence: Synthetic oligonucleotide
  Target: ATXN1; (-) strand; PAM type: NNGRRT; PAM sequence: TTGGAT
aaataatttttatctcacat

SEQ ID NO: 16505 - DNA, 20 bp, Artificial Sequence
  Description of Artificial Sequence: Synthetic oligonucleotide
  Target: ATXN1; (-) strand; PAM type: NNGRRT; PAM sequence: TGGGAT
gcctcggcctcccaaagtgc

SEQ ID NO: 16506 - DNA, 20 bp, Artificial Sequence
  Description of Artificial Sequence: Synthetic oligonucleotide
  Target: ATXN1; (-) strand; PAM type: NNGRRT; PAM sequence: CAGGAT
cggggtttcaccttgttagc

SEQ ID NO: 16507 - DNA, 20 bp, Artificial Sequence
  Description of Artificial Sequence: Synthetic oligonucleotide
  Target: ATXN1; (-) strand; PAM type: NNGRRT; PAM sequence: CGGGGT
ttttgtatttttagtagaga

SEQ ID NO: 16508 - DNA, 20 bp, Artificial Sequence
  Description of Artificial Sequence: Synthetic oligonucleotide
  Target: ATXN1; (-) strand; PAM type: NNGRRT; PAM sequence: CCGAGT
cattctcctgcctcagcctc

SEQ ID NO: 16509 - DNA, 20 bp, Artificial Sequence
  Description of Artificial Sequence: Synthetic oligonucleotide
  Target: ATXN1; (-) strand; PAM type: NNGRRT; PAM sequence: CCGGGT
ctcactgcaagctccgcttc

SEQ ID NO: 16510 - DNA, 20 bp, Artificial Sequence
  Description of Artificial Sequence: Synthetic oligonucleotide
  Target: ATXN1; (-) strand; PAM type: NNGRRT; PAM sequence: CGGAGT
ttttttttttttttttgaga

SEQ ID NO: 16511 - DNA, 20 bp, Artificial Sequence
  Description of Artificial Sequence: Synthetic oligonucleotide
  Target: ATXN1; (-) strand; PAM type: NNGRRT; PAM sequence: GTGAAT
ttaaaacattctcaatattt

SEQ ID NO: 16512 - DNA, 20 bp, Artificial Sequence
  Description of Artificial Sequence: Synthetic oligonucleotide
  Target: ATXN1; (-) strand; PAM type: NNGRRT; PAM sequence: GGGGAT
gcctcagcctcccaaagcat

SEQ ID NO: 16513 - DNA, 20 bp, Artificial Sequence
  Description of Artificial Sequence: Synthetic oligonucleotide
  Target: ATXN1; (-) strand; PAM type: NNGRRT; PAM sequence: TGGGGT
ttttaacttttttgtagaga

SEQ ID NO: 16514 - DNA, 20 bp, Artificial Sequence
  Description of Artificial Sequence: Synthetic oligonucleotide
  Target: ATXN1; (-) strand; PAM type: NNGRRT; PAM sequence: TGGAGT
tcttgctctgttgcccaggc

SEQ ID NO: 16515 - DNA, 20 bp, Artificial Sequence
  Description of Artificial Sequence: Synthetic oligonucleotide
  Target: ATXN1; (-) strand; PAM type: NNGRRT; PAM sequence: CAGGGT
attattttattttatcaaga

SEQ ID NO: 16516 - DNA, 20 bp, Artificial Sequence
  Description of Artificial Sequence: Synthetic oligonucleotide
  Target: ATXN1; (-) strand; PAM type: NNGRRT; PAM sequence: CAGGAT
tctataataatttttttgat

SEQ ID NO: 16517 - DNA, 20 bp, Artificial Sequence
  Description of Artificial Sequence: Synthetic oligonucleotide
  Target: ATXN1; (-) strand; PAM type: NNGRRT; PAM sequence: TAGAAT
ttacctgtccccaaagttat

SEQ ID NO: 16518 - DNA, 20 bp, Artificial Sequence
  Description of Artificial Sequence: Synthetic oligonucleotide
  Target: ATXN1; (-) strand; PAM type: NNGRRT; PAM sequence: AAGGGT
gaagaaaagtgagagaaagg

SEQ ID NO: 16519 - DNA, 20 bp, Artificial Sequence
  Description of Artificial Sequence: Synthetic oligonucleotide
  Target: ATXN1; (-) strand; PAM type: NNGRRT; PAM sequence: CTGAGT
aaatttccacaatcgctcct

SEQ ID NO: 16520 - DNA, 20 bp, Artificial Sequence
  Description of Artificial Sequence: Synthetic oligonucleotide
  Target: ATXN1; (-) strand; PAM type: NNGRRT; PAM sequence: GGGGAT
agagtcatgtaccatcaagc

SEQ ID NO: 16521 - DNA, 20 bp, Artificial Sequence
  Description of Artificial Sequence: Synthetic oligonucleotide
  Target: ATXN1; (-) strand; PAM type: NNGRRT; PAM sequence: AAGAGT
aaagagaaccattcttaaga

SEQ ID NO: 16522 - DNA, 20 bp, Artificial Sequence
  Description of Artificial Sequence: Synthetic oligonucleotide
  Target: ATXN1; (-) strand; PAM type: NNGRRT; PAM sequence: CTGAGT
gggcccaccaagaggtagag

SEQ ID NO: 16523 - DNA, 20 bp, Artificial Sequence
  Description of Artificial Sequence: Synthetic oligonucleotide
  Target: ATXN1; (-) strand; PAM type: NNGRRT; PAM sequence: CAGGAT
aatggtgatgctgtgatttt

SEQ ID NO: 16524 - DNA, 20 bp, Artificial Sequence
  Description of Artificial Sequence: Synthetic oligonucleotide
  Target: ATXN1; (-) strand; PAM type: NNGRRT; PAM sequence: TTGAAT
ataatgataatttttgtcta

SEQ ID NO: 16525 - DNA, 20 bp, Artificial Sequence
  Description of Artificial Sequence: Synthetic oligonucleotide
  Target: ATXN1; (-) strand; PAM type: NNGRRT; PAM sequence: CAGAAT
attttcaaccctctttccca

SEQ ID NO: 16526 - DNA, 20 bp, Artificial Sequence
  Description of Artificial Sequence: Synthetic oligonucleotide
  Target: ATXN1; (-) strand; PAM type: NNGRRT; PAM sequence: CTGAAT
catgagccaccgcatgtggc

SEQ ID NO: 16527 - DNA, 20 bp, Artificial Sequence
  Description of Artificial Sequence: Synthetic oligonucleotide
  Target: ATXN1; (-) strand; PAM type: NNGRRT; PAM sequence: TGGGGT
gcttcagcctcccaaagtgc

SEQ ID NO: 16528 - DNA, 20 bp, Artificial Sequence
  Description of Artificial Sequence: Synthetic oligonucleotide
  Target: ATXN1; (-) strand; PAM type: NNGRRT; PAM sequence: CGGAGT
ttttgtatttttagtagaga

SEQ ID NO: 16529 - DNA, 20 bp, Artificial Sequence
  Description of Artificial Sequence: Synthetic oligonucleotide
  Target: ATXN1; (-) strand; PAM type: NNGRRT; PAM sequence: TGGGAT
gcctcagactcccaagtatc

SEQ ID NO: 16530 - DNA, 20 bp, Artificial Sequence
  Description of Artificial Sequence: Synthetic oligonucleotide
  Target: ATXN1; (-) strand; PAM type: NNGRRT; PAM sequence: TGGAGT
tcttgctctgttgcccaggc

SEQ ID NO: 16531 - DNA, 20 bp, Artificial Sequence
  Description of Artificial Sequence: Synthetic oligonucleotide
  Target: ATXN1; (-) strand; PAM type: NNGRRT; PAM sequence: CAGGGT
ttcattttattttatcaaga

SEQ ID NO: 16532 - DNA, 20 bp, Artificial Sequence
  Description of Artificial Sequence: Synthetic oligonucleotide
  Target: ATXN1; (-) strand; PAM type: NNGRRT; PAM sequence: CAGGAT
tctataataatttttttgat

SEQ ID NO: 16533 - DNA, 20 bp, Artificial Sequence
  Description of Artificial Sequence: Synthetic oligonucleotide
  Target: ATXN1; (-) strand; PAM type: NNGRRT; PAM sequence: TAGAAT
ttacctgtccccaaagttat

SEQ ID NO: 16534 - DNA, 20 bp, Artificial Sequence
  Description of Artificial Sequence: Synthetic oligonucleotide
  Target: ATXN1; (-) strand; PAM type: NNGRRT; PAM sequence: AAGGGT
gaagaaaagtgagagaaagg

SEQ ID NO: 16535 - DNA, 20 bp, Artificial Sequence
  Description of Artificial Sequence: Synthetic oligonucleotide
  Target: ATXN1; (-) strand; PAM type: NNGRRT; PAM sequence: CTGAGT
aaatttccacaatcgctcct

SEQ ID NO: 16536 - DNA, 20 bp, Artificial Sequence
  Description of Artificial Sequence: Synthetic oligonucleotide
  Target: ATXN1; (-) strand; PAM type: NNGRRT; PAM sequence: GGGGAT
agagtcatgtaccatcaagc

SEQ ID NO: 16537 - DNA, 20 bp, Artificial Sequence
  Description of Artificial Sequence: Synthetic oligonucleotide
  Target: ATXN1; (-) strand; PAM type: NNGRRT; PAM sequence: AAGAGT
aaagagaaccattcttaaga

SEQ ID NO: 16538 - DNA, 20 bp, Artificial Sequence
  Description of Artificial Sequence: Synthetic oligonucleotide
  Target: ATXN1; (-) strand; PAM type: NNGRRT; PAM sequence: CTGAGT
gggcccaccaagaggtagag

SEQ ID NO: 16539 - DNA, 20 bp, Artificial Sequence
  Description of Artificial Sequence: Synthetic oligonucleotide
  Target: ATXN1; (-) strand; PAM type: NNGRRT; PAM sequence: CAGGAT
aatggtgatgctgtgatttt

SEQ ID NO: 16540 - DNA, 20 bp, Artificial Sequence
  Description of Artificial Sequence: Synthetic oligonucleotide
  Target: ATXN1; (-) strand; PAM type: NNGRRT; PAM sequence: TTGAAT
ataatgataatttttgtcta

SEQ ID NO: 16541 - DNA, 20 bp, Artificial Sequence
  Description of Artificial Sequence: Synthetic oligonucleotide
  Target: ATXN1; (-) strand; PAM type: NNGRRT; PAM sequence: CAGAAT
attttcaaccctctttccca

SEQ ID NO: 16542 - DNA, 20 bp, Artificial Sequence
  Description of Artificial Sequence: Synthetic oligonucleotide
  Target: ATXN1; (-) strand; PAM type: NNGRRT; PAM sequence: CTGAAT
catgagccaccgcatgcagc

SEQ ID NO: 16543 - DNA, 20 bp, Artificial Sequence
  Description of Artificial Sequence: Synthetic oligonucleotide
  Target: ATXN1; (-) strand; PAM type: NNGRRT; PAM sequence: TGGGGT
cgctcagcctcccaaagtgc

SEQ ID NO: 16544 - DNA, 20 bp, Artificial Sequence
  Description of Artificial Sequence: Synthetic oligonucleotide
  Target: ATXN1; (-) strand; PAM type: NNGRRT; PAM sequence: CGGAGT
ttttgtatttttagtagaga

SEQ ID NO: 16545 - DNA, 20 bp, Artificial Sequence
  Description of Artificial Sequence: Synthetic oligonucleotide
  Target: ATXN1; (-) strand; PAM type: NNGRRT; PAM sequence: TGGGAT
gccacagactcccaaatatc

SEQ ID NO: 16546 - DNA, 20 bp, Artificial Sequence
  Description of Artificial Sequence: Synthetic oligonucleotide
  Target: ATXN1; (-) strand; PAM type: NNGRRT; PAM sequence: TGGAGT
tcttgctctgtcacccaggc

SEQ ID NO: 16547 - DNA, 20 bp, Artificial Sequence
  Description of Artificial Sequence: Synthetic oligonucleotide
  Target: ATXN1; (-) strand; PAM type: NNGRRT; PAM sequence: CAGAGT
aatttttttttttcttgaga

SEQ ID NO: 16548 - DNA, 20 bp, Artificial Sequence
  Description of Artificial Sequence: Synthetic oligonucleotide
  Target: ATXN1; (-) strand; PAM type: NNGRRT; PAM sequence: CTGAAT
aaatacacttgactttattc

SEQ ID NO: 16549 - DNA, 20 bp, Artificial Sequence
  Description of Artificial Sequence: Synthetic oligonucleotide
  Target: ATXN1; (-) strand; PAM type: NNGRRT; PAM sequence: TAGAGT
cataatattgatctcagttc

SEQ ID NO: 16550 - DNA, 20 bp, Artificial Sequence
  Description of Artificial Sequence: Synthetic oligonucleotide
  Target: ATXN1; (-) strand; PAM type: NNGRRT; PAM sequence: TGGGAT
accttggcctcccaaaatgc

SEQ ID NO: 16551 - DNA, 20 bp, Artificial Sequence
  Description of Artificial Sequence: Synthetic oligonucleotide
  Target: ATXN1; (-) strand; PAM type: NNGRRT; PAM sequence: CAGGGT
ttttgtatttttagtagaga

SEQ ID NO: 16552 - DNA, 20 bp, Artificial Sequence
  Description of Artificial Sequence: Synthetic oligonucleotide
  Target: ATXN1; (-) strand; PAM type: NNGRRT; PAM sequence: TGGGAT
gtctcagcctcccaagtatc

SEQ ID NO: 16553 - DNA, 20 bp, Artificial Sequence
  Description of Artificial Sequence: Synthetic oligonucleotide
  Target: ATXN1; (-) strand; PAM type: NNGRRT; PAM sequence: TGGAGT
tctccttctgtcacccaggc

SEQ ID NO: 16554 - DNA, 20 bp, Artificial Sequence
  Description of Artificial Sequence: Synthetic oligonucleotide
  Target: ATXN1; (-) strand; PAM type: NNGRRT; PAM sequence: AGGGGT
gtctatgtaagtgtgtgtgg

SEQ ID NO: 16555 - DNA, 20 bp, Artificial Sequence
  Description of Artificial Sequence: Synthetic oligonucleotide
  Target: ATXN1; (-) strand; PAM type: NNGRRT; PAM sequence: GTGGAT
tatactataataaaagttat

SEQ ID NO: 16556 - DNA, 20 bp, Artificial Sequence
  Description of Artificial Sequence: Synthetic oligonucleotide
  Target: ATXN1; (-) strand; PAM type: NNGRRT; PAM sequence: GTGGAT
gggcatgttccatacccctg

SEQ ID NO: 16557 - DNA, 20 bp, Artificial Sequence
  Description of Artificial Sequence: Synthetic oligonucleotide
  Target: ATXN1; (-) strand; PAM type: NNGRRT; PAM sequence: TAGAAT
taatgcattttctgttttta

SEQ ID NO: 16558 - DNA, 20 bp, Artificial Sequence
  Description of Artificial Sequence: Synthetic oligonucleotide
  Target: ATXN1; (-) strand; PAM type: NNGRRT; PAM sequence: GAGAAT
agattagatatcaattcaga

SEQ ID NO: 16559 - DNA, 20 bp, Artificial Sequence
  Description of Artificial Sequence: Synthetic oligonucleotide
  Target: ATXN1; (-) strand; PAM type: NNGRRT; PAM sequence: ATGAGT
tctattttgcttttgattct

SEQ ID NO: 16560 - DNA, 20 bp, Artificial Sequence
  Description of Artificial Sequence: Synthetic oligonucleotide
  Target: ATXN1; (-) strand; PAM type: NNGRRT; PAM sequence: CAGGAT
cggggtttcactgtgttagc

SEQ ID NO: 16561 - DNA, 20 bp, Artificial Sequence
  Description of Artificial Sequence: Synthetic oligonucleotide
  Target: ATXN1; (-) strand; PAM type: NNGRRT; PAM sequence: CGGGGT
gtgtgtgtttttagtagaga

SEQ ID NO: 16562 - DNA, 20 bp, Artificial Sequence
  Description of Artificial Sequence: Synthetic oligonucleotide
  Target: ATXN1; (-) strand; PAM type: NNGRRT; PAM sequence: CCGAGT
cattctcctgcctcagcctc

SEQ ID NO: 16563 - DNA, 20 bp, Artificial Sequence
  Description of Artificial Sequence: Synthetic oligonucleotide
  Target: ATXN1; (-) strand; PAM type: NNGRRT; PAM sequence: ACGGGT
ctcactgcaagctccgcctc

SEQ ID NO: 16564 - DNA, 20 bp, Artificial Sequence
  Description of Artificial Sequence: Synthetic oligonucleotide
  Target: ATXN1; (-) strand; PAM type: NNGRRT; PAM sequence: AGGAGT
tttctctctattgcccaggc

SEQ ID NO: 16565 - DNA, 20 bp, Artificial Sequence
  Description of Artificial Sequence: Synthetic oligonucleotide
  Target: ATXN1; (-) strand; PAM type: NNGRRT; PAM sequence: CAGAGT
ttttttttttttttttgaga

SEQ ID NO: 16566 - DNA, 20 bp, Artificial Sequence
  Description of Artificial Sequence: Synthetic oligonucleotide
  Target: ATXN1; (-) strand; PAM type: NNGRRT; PAM sequence: ATGAGT
aactaaatgtttttagaaac

SEQ ID NO: 16567 - DNA, 20 bp, Artificial Sequence
  Description of Artificial Sequence: Synthetic oligonucleotide
  Target: ATXN1; (-) strand; PAM type: NNGRRT; PAM sequence: GAGGAT
tgatgtgcgatcttagacat

SEQ ID NO: 16568 - DNA, 20 bp, Artificial Sequence
  Description of Artificial Sequence: Synthetic oligonucleotide
  Target: ATXN1; (-) strand; PAM type: NNGRRT; PAM sequence: TAGGGT
tagaaaagccttccattcac

SEQ ID NO: 16569 - DNA, 20 bp, Artificial Sequence
  Description of Artificial Sequence: Synthetic oligonucleotide
  Target: ATXN1; (-) strand; PAM type: NNGRRT; PAM sequence: GAGAAT
tgttcctgggttagtttgct

SEQ ID NO: 16570 - DNA, 20 bp, Artificial Sequence
  Description of Artificial Sequence: Synthetic oligonucleotide
  Target: ATXN1; (-) strand; PAM type: NNGRRT; PAM sequence: CTGGGT
cggtgtttggttttctgttc

SEQ ID NO: 16571 - DNA, 20 bp, Artificial Sequence
  Description of Artificial Sequence: Synthetic oligonucleotide
  Target: ATXN1; (-) strand; PAM type: NNGRRT; PAM sequence: ATGAGT
tcaatgttaaactcccactt

SEQ ID NO: 16572 - DNA, 20 bp, Artificial Sequence
  Description of Artificial Sequence: Synthetic oligonucleotide
  Target: ATXN1; (-) strand; PAM type: NNGRRT; PAM sequence: TGGGAT
gtttgttttactttaagttc

SEQ ID NO: 16573 - DNA, 20 bp, Artificial Sequence
  Description of Artificial Sequence: Synthetic oligonucleotide
  Target: ATXN1; (-) strand; PAM type: NNGRRT; PAM sequence: CTGAAT
catgagccaccacaccctgc

SEQ ID NO: 16574 - DNA, 20 bp, Artificial Sequence
  Description of Artificial Sequence: Synthetic oligonucleotide
  Target: ATXN1; (-) strand; PAM type: NNGRRT; PAM sequence: TGGGAT
gcctcggcctcccaaagtgc

SEQ ID NO: 16575 - DNA, 20 bp, Artificial Sequence
  Description of Artificial Sequence: Synthetic oligonucleotide
  Target: ATXN1; (-) strand; PAM type: NNGRRT; PAM sequence: TGGGGT
tcttgtatttttagtagaga

SEQ ID NO: 16576 - DNA, 20 bp, Artificial Sequence
  Description of Artificial Sequence: Synthetic oligonucleotide
  Target: ATXN1; (-) strand; PAM type: NNGRRT; PAM sequence: CCGGGT
ctcactgcaacctccgcctc

SEQ ID NO: 16577 - DNA, 20 bp, Artificial Sequence
  Description of Artificial Sequence: Synthetic oligonucleotide
  Target: ATXN1; (-) strand; PAM type: NNGRRT; PAM sequence: CGGAGT
ttttttttttttttttgaga

SEQ ID NO: 16578 - DNA, 20 bp, Artificial Sequence
  Description of Artificial Sequence: Synthetic oligonucleotide
  Target: ATXN1; (-) strand; PAM type: NNGRRT; PAM sequence: TTGAAT
gctttttttttttcccacag

SEQ ID NO: 16579 - DNA, 20 bp, Artificial Sequence
  Description of Artificial Sequence: Synthetic oligonucleotide
  Target: ATXN1; (-) strand; PAM type: NNGRRT; PAM sequence: TTGAAT
tcccactttgatattttcct

SEQ ID NO: 16580 - DNA, 20 bp, Artificial Sequence
  Description of Artificial Sequence: Synthetic oligonucleotide
  Target: ATXN1; (-) strand; PAM type: NNGRRT; PAM sequence: AAGGAT
acatgtatttattttgtatt

SEQ ID NO: 16581 - DNA, 20 bp, Artificial Sequence
  Description of Artificial Sequence: Synthetic oligonucleotide
  Target: ATXN1; (-) strand; PAM type: NNGRRT; PAM sequence: GTGGAT
tagtgtagtttcaagtgagg

SEQ ID NO: 16582 - DNA, 20 bp, Artificial Sequence
  Description of Artificial Sequence: Synthetic oligonucleotide
  Target: ATXN1; (-) strand; PAM type: NNGRRT; PAM sequence: GAGGGT
tttttagtgtagtttcaagt

SEQ ID NO: 16583 - DNA, 20 bp, Artificial Sequence
  Description of Artificial Sequence: Synthetic oligonucleotide
  Target: ATXN1; (-) strand; PAM type: NNGRRT; PAM sequence: TAGGAT
aacatctctggttgtttcct

SEQ ID NO: 16584 - DNA, 20 bp, Artificial Sequence
  Description of Artificial Sequence: Synthetic oligonucleotide
  Target: ATXN1; (-) strand; PAM type: NNGRRT; PAM sequence: AGGGGT
ctagctgcctgatatttacc

SEQ ID NO: 16585 - DNA, 20 bp, Artificial Sequence
  Description of Artificial Sequence: Synthetic oligonucleotide
  Target: ATXN1; (-) strand; PAM type: NNGRRT; PAM sequence: TGGGAT
agtcatatagattttttaac

SEQ ID NO: 16586 - DNA, 20 bp, Artificial Sequence
  Description of Artificial Sequence: Synthetic oligonucleotide
  Target: ATXN1; (-) strand; PAM type: NNGRRT; PAM sequence: AAGAAT
gaaaaactggaaatacagaa

SEQ ID NO: 16587 - DNA, 20 bp, Artificial Sequence
  Description of Artificial Sequence: Synthetic oligonucleotide
  Target: ATXN1; (-) strand; PAM type: NNGRRT; PAM sequence: AGGGAT
attgtttccctgatcacaga

SEQ ID NO: 16588 - DNA, 20 bp, Artificial Sequence
  Description of Artificial Sequence: Synthetic oligonucleotide
  Target: ATXN1; (-) strand; PAM type: NNGRRT; PAM sequence: TTGAAT
catggctatagagctatgat

SEQ ID NO: 16589 - DNA, 20 bp, Artificial Sequence
  Description of Artificial Sequence: Synthetic oligonucleotide
  Target: ATXN1; (-) strand; PAM type: NNGRRT; PAM sequence: CGGAGT
ttttttttttcccttagaga

SEQ ID NO: 16590 - DNA, 20 bp, Artificial Sequence
  Description of Artificial Sequence: Synthetic oligonucleotide
  Target: ATXN1; (-) strand; PAM type: NNGRRT; PAM sequence: GAGGAT
acaggaagttgaggctcaga

SEQ ID NO: 16591 - DNA, 20 bp, Artificial Sequence
  Description of Artificial Sequence: Synthetic oligonucleotide
  Target: ATXN1; (-) strand; PAM type: NNGRRT; PAM sequence: GGGGGT
actgtaaaagtttggttgag

SEQ ID NO: 16592 - DNA, 20 bp, Artificial Sequence
  Description of Artificial Sequence: Synthetic oligonucleotide
  Target: ATXN1; (-) strand; PAM type: NNGRRT; PAM sequence: GTGAAT
gagagagagagaatatgtat

SEQ ID NO: 16593 - DNA, 20 bp, Artificial Sequence
  Description of Artificial Sequence: Synthetic oligonucleotide
  Target: ATXN1; (-) strand; PAM type: NNGRRT; PAM sequence: GAGAAT
gagagacagagagagagaga

SEQ ID NO: 16594 - DNA, 20 bp, Artificial Sequence
  Description of Artificial Sequence: Synthetic oligonucleotide
  Target: ATXN1; (-) strand; PAM type: NNGRRT; PAM sequence: TTGAAT
atagcacaatatctggagaa

SEQ ID NO: 16595 - DNA, 20 bp, Artificial Sequence
  Description of Artificial Sequence: Synthetic oligonucleotide
  Target: ATXN1; (-) strand; PAM type: NNGRRT; PAM sequence: GAGAAT
aaacgatagcacaatatctg

SEQ ID NO: 16596 - DNA, 20 bp, Artificial Sequence
  Description of Artificial Sequence: Synthetic oligonucleotide
  Target: ATXN1; (-) strand; PAM type: NNGRRT; PAM sequence: GAGAAT
ttcttaggatcctaggatat

SEQ ID NO: 16597 - DNA, 20 bp, Artificial Sequence
  Description of Artificial Sequence: Synthetic oligonucleotide
  Target: ATXN1; (-) strand; PAM type: NNGRRT; PAM sequence: TAGGAT
gccccaatttcttaggatcc

SEQ ID NO: 16598 - DNA, 20 bp, Artificial Sequence
  Description of Artificial Sequence: Synthetic oligonucleotide
  Target: ATXN1; (-) strand; PAM type: NNGRRT; PAM sequence: TAGGAT
taaagattgccccaatttct

SEQ ID NO: 16599 - DNA, 20 bp, Artificial Sequence
  Description of Artificial Sequence: Synthetic oligonucleotide
  Target: ATXN1; (-) strand; PAM type: NNGRRT; PAM sequence: TTGGGT
atataacgtacctcttcgac

SEQ ID NO: 16600 - DNA, 20 bp, Artificial Sequence
  Description of Artificial Sequence: Synthetic oligonucleotide
  Target: ATXN1; (-) strand; PAM type: NNGRRT; PAM sequence: GGGGGT
tgctggccagcggagtaggt

SEQ ID NO: 16601 - DNA, 20 bp, Artificial Sequence
  Description of Artificial Sequence: Synthetic oligonucleotide
  Target: ATXN1; (-) strand; PAM type: NNGRRT; PAM sequence: CGGAGT
ccacatgtggtgctggccag

SEQ ID NO: 16602 - DNA, 20 bp, Artificial Sequence
  Description of Artificial Sequence: Synthetic oligonucleotide
  Target: ATXN1; (-) strand; PAM type: NNGRRT; PAM sequence: GAGAGT
gttctcctttgcttatagag

SEQ ID NO: 16603 - DNA, 20 bp, Artificial Sequence
  Description of Artificial Sequence: Synthetic oligonucleotide
  Target: ATXN1; (-) strand; PAM type: NNGRRT; PAM sequence: GAGAGT
cagatctagaaagggcccca

SEQ ID NO: 16604 - DNA, 20 bp, Artificial Sequence
  Description of Artificial Sequence: Synthetic oligonucleotide
  Target: ATXN1; (-) strand; PAM type: NNGRRT; PAM sequence: TGGAGT
cgggatgtagaagcccactt

SEQ ID NO: 16605 - DNA, 20 bp, Artificial Sequence
  Description of Artificial Sequence: Synthetic oligonucleotide
  Target: ATXN1; (-) strand; PAM type: NNGRRT; PAM sequence: CGGGAT
taattttctttcatttgttt

SEQ ID NO: 16606 - DNA, 20 bp, Artificial Sequence
  Description of Artificial Sequence: Synthetic oligonucleotide
  Target: ATXN1; (-) strand; PAM type: NNGRRT; PAM sequence: AGGAAT
caaatgctttcatggatgcc

SEQ ID NO: 16607 - DNA, 20 bp, Artificial Sequence
  Description of Artificial Sequence: Synthetic oligonucleotide
  Target: ATXN1; (-) strand; PAM type: NNGRRT; PAM sequence: ATGGAT
cagggaaagcaaatgctttc

SEQ ID NO: 16608 - DNA, 20 bp, Artificial Sequence
  Description of Artificial Sequence: Synthetic oligonucleotide
  Target: ATXN1; (-) strand; PAM type: NNGRRT; PAM sequence: AAGGAT
ccgacaaggtgtcaagaagg

SEQ ID NO: 16609 - DNA, 20 bp, Artificial Sequence
  Description of Artificial Sequence: Synthetic oligonucleotide
  Target: ATXN1; (-) strand; PAM type: NNGRRT; PAM sequence: TGGGAT
gccttggcctcccaaagtgt

SEQ ID NO: 16610 - DNA, 20 bp, Artificial Sequence
  Description of Artificial Sequence: Synthetic oligonucleotide
  Target: ATXN1; (-) strand; PAM type: NNGRRT; PAM sequence: CAGGGT
acggcattctccatgttggc

SEQ ID NO: 16611 - DNA, 20 bp, Artificial Sequence
  Description of Artificial Sequence: Synthetic oligonucleotide
  Target: ATXN1; (-) strand; PAM type: NNGRRT; PAM sequence: TGGGAT
gcctcagcctccctagtagc

SEQ ID NO: 16612 - DNA, 20 bp, Artificial Sequence
  Description of Artificial Sequence: Synthetic oligonucleotide
  Target: ATXN1; (-) strand; PAM type: NNGRRT; PAM sequence: CCGGGT
actgcaacctccattgcctc

SEQ ID NO: 16613 - DNA, 20 bp, Artificial Sequence
  Description of Artificial Sequence: Synthetic oligonucleotide
  Target: ATXN1; (-) strand; PAM type: NNGRRT; PAM sequence: TGGAGT
tctcgctctgtctcccaggc

SEQ ID NO: 16614 - DNA, 20 bp, Artificial Sequence
  Description of Artificial Sequence: Synthetic oligonucleotide
  Target: ATXN1; (-) strand; PAM type: NNGRRT; PAM sequence: TGGAAT
tttgttttttgtttttgaga

SEQ ID NO: 16615 - DNA, 20 bp, Artificial Sequence
  Description of Artificial Sequence: Synthetic oligonucleotide
  Target: ATXN1; (-) strand; PAM type: NNGRRT; PAM sequence: TAGAAT
agcttgtgggtggtggaggc

SEQ ID NO: 16616 - DNA, 20 bp, Artificial Sequence
  Description of Artificial Sequence: Synthetic oligonucleotide
  Target: ATXN1; (-) strand; PAM type: NNGRRT; PAM sequence: GTGGGT
cgcccacatttacccagctt

SEQ ID NO: 16617 - DNA, 20 bp, Artificial Sequence
  Description of Artificial Sequence: Synthetic oligonucleotide
  Target: ATXN1; (-) strand; PAM type: NNGRRT; PAM sequence: CTGAAT
atcatcaagtgaatgaatgc

SEQ ID NO: 16618 - DNA, 20 bp, Artificial Sequence
  Description of Artificial Sequence: Synthetic oligonucleotide
  Target: ATXN1; (-) strand; PAM type: NNGRRT; PAM sequence: ATGAAT
aatcagtgatcatcaagtga

SEQ ID NO: 16619 - DNA, 20 bp, Artificial Sequence
  Description of Artificial Sequence: Synthetic oligonucleotide
  Target: ATXN1; (-) strand; PAM type: NNGRRT; PAM sequence: GTGAAT
tcataatcagtgatcatcaa

SEQ ID NO: 16620 - DNA, 20 bp, Artificial Sequence
  Description of Artificial Sequence: Synthetic oligonucleotide
  Target: ATXN1; (-) strand; PAM type: NNGRRT; PAM sequence: GAGAGT
ttctcatttcactaaaattt

SEQ ID NO: 16621 - DNA, 20 bp, Artificial Sequence
  Description of Artificial Sequence: Synthetic oligonucleotide
  Target: ATXN1; (-) strand; PAM type: NNGRRT; PAM sequence: CAGGGT
atgcaaacatgttcctccct

SEQ ID NO: 16622 - DNA, 20 bp, Artificial Sequence
  Description of Artificial Sequence: Synthetic oligonucleotide
  Target: ATXN1; (-) strand; PAM type: NNGRRT; PAM sequence: AAGGAT
tcttgaatgatgttagattg

SEQ ID NO: 16623 - DNA, 20 bp, Artificial Sequence
  Description of Artificial Sequence: Synthetic oligonucleotide
  Target: ATXN1; (-) strand; PAM type: NNGRRT; PAM sequence: TTGAAT
tttttggagagaagcttttc

SEQ ID NO: 16624 - DNA, 20 bp, Artificial Sequence
  Description of Artificial Sequence: Synthetic oligonucleotide
  Target: ATXN1; (-) strand; PAM type: NNGRRT; PAM sequence: TAGAAT
aaaaatttacattcctgaaa

SEQ ID NO: 16625 - DNA, 20 bp, Artificial Sequence
  Description of Artificial Sequence: Synthetic oligonucleotide
  Target: ATXN1; (-) strand; PAM type: NNGRRT; PAM sequence: CTGGGT
aaaaaccaacagaaagatgg

SEQ ID NO: 16626 - DNA, 20 bp, Artificial Sequence
  Description of Artificial Sequence: Synthetic oligonucleotide
  Target: ATXN1; (-) strand; PAM type: NNGRRT; PAM sequence: GAGAGT
aactcgtttttctctgttct

SEQ ID NO: 16627 - DNA, 20 bp, Artificial Sequence
  Description of Artificial Sequence: Synthetic oligonucleotide
  Target: ATXN1; (-) strand; PAM type: NNGRRT; PAM sequence: ATGGAT
ggctagaagcttagaaagac

SEQ ID NO: 16628 - DNA, 20 bp, Artificial Sequence
  Description of Artificial Sequence: Synthetic oligonucleotide
  Target: ATXN1; (-) strand; PAM type: NNGRRT; PAM sequence: TGGAAT
gcatcattaaacaagtaaag

SEQ ID NO: 16629 - DNA, 20 bp, Artificial Sequence
  Description of Artificial Sequence: Synthetic oligonucleotide
  Target: ATXN1; (-) strand; PAM type: NNGRRT; PAM sequence: ATGAAT
gttgcagaaaaattcaaaat

SEQ ID NO: 16630 - DNA, 20 bp, Artificial Sequence
  Description of Artificial Sequence: Synthetic oligonucleotide
  Target: ATXN1; (-) strand; PAM type: NNGRRT; PAM sequence: GTGAAT
aacacaatacaacaatgaaa

SEQ ID NO: 16631 - DNA, 20 bp, Artificial Sequence
  Description of Artificial Sequence: Synthetic oligonucleotide
  Target: ATXN1; (-) strand; PAM type: NNGRRT; PAM sequence: TTGAAT
aaaaaataaacccaaactac

SEQ ID NO: 16632 - DNA, 20 bp, Artificial Sequence
  Description of Artificial Sequence: Synthetic oligonucleotide
  Target: ATXN1; (-) strand; PAM type: NNGRRT; PAM sequence: AGGAAT
catgtttatgtactgctgat

SEQ ID NO: 16633 - DNA, 20 bp, Artificial Sequence
  Description of Artificial Sequence: Synthetic oligonucleotide
  Target: ATXN1; (-) strand; PAM type: NNGRRT; PAM sequence: ATGAAT
gagatctggagttcccagta

SEQ ID NO: 16634 - DNA, 20 bp, Artificial Sequence
  Description of Artificial Sequence: Synthetic oligonucleotide
  Target: ATXN1; (-) strand; PAM type: NNGRRT; PAM sequence: TGGAGT
cacttgacttatttgagatc

SEQ ID NO: 16635 - DNA, 20 bp, Artificial Sequence
  Description of Artificial Sequence: Synthetic oligonucleotide
  Target: ATXN1; (-) strand; PAM type: NNGRRT; PAM sequence: CTGGAT
gaatggaaatttcttcaagt

SEQ ID NO: 16636 - DNA, 20 bp, Artificial Sequence
  Description of Artificial Sequence: Synthetic oligonucleotide
  Target: ATXN1; (-) strand; PAM type: NNGRRT; PAM sequence: CAGAAT
tgagttggctagaaatttaa

SEQ ID NO: 16637 - DNA, 20 bp, Artificial Sequence
  Description of Artificial Sequence: Synthetic oligonucleotide
  Target: ATXN1; (-) strand; PAM type: NNGRRT; PAM sequence: ATGAGT
tgcttgcgtagttgattgtg

SEQ ID NO: 16638 - DNA, 20 bp, Artificial Sequence
  Description of Artificial Sequence: Synthetic oligonucleotide
  Target: ATXN1; (-) strand; PAM type: NNGRRT; PAM sequence: TGGGGT
attacttattgttgttctta

SEQ ID NO: 16639 - DNA, 20 bp, Artificial Sequence
  Description of Artificial Sequence: Synthetic oligonucleotide
  Target: ATXN1; (-) strand; PAM type: NNGRRT; PAM sequence: CAGAAT
ttcagattaattgagatagc

SEQ ID NO: 16640 - DNA, 20 bp, Artificial Sequence
  Description of Artificial Sequence: Synthetic oligonucleotide
  Target: ATXN1; (-) strand; PAM type: NNGRRT; PAM sequence: TCGGAT
tggtttttagtctattcaca

SEQ ID NO: 16641 - DNA, 20 bp, Artificial Sequence
  Description of Artificial Sequence: Synthetic oligonucleotide
  Target: ATXN1; (-) strand; PAM type: NNGRRT; PAM sequence: TTGAAT
ataattcacaaactgcagaa

SEQ ID NO: 16642 - DNA, 20 bp, Artificial Sequence
  Description of Artificial Sequence: Synthetic oligonucleotide
  Target: ATXN1; (-) strand; PAM type: NNGRRT; PAM sequence: CAGAAT
gggatataattcacaaactg

SEQ ID NO: 16643 - DNA, 20 bp, Artificial Sequence
  Description of Artificial Sequence: Synthetic oligonucleotide
  Target: ATXN1; (-) strand; PAM type: NNGRRT; PAM sequence: GGGGAT
attattaataccagctttct

SEQ ID NO: 16644 - DNA, 20 bp, Artificial Sequence
  Description of Artificial Sequence: Synthetic oligonucleotide
  Target: ATXN1; (-) strand; PAM type: NNGRRT; PAM sequence: GTGAAT
ctctagatacctcatagagg

SEQ ID NO: 16645 - DNA, 20 bp, Artificial Sequence
  Description of Artificial Sequence: Synthetic oligonucleotide
  Target: ATXN1; (-) strand; PAM type: NNGRRT; PAM sequence: GAGGGT
tctactctagatacctcata

SEQ ID NO: 16646 - DNA, 20 bp, Artificial Sequence
  Description of Artificial Sequence: Synthetic oligonucleotide
  Target: ATXN1; (-) strand; PAM type: NNGRRT; PAM sequence: TGGGAT
acctcggcctcccaaagtgc

SEQ ID NO: 16647 - DNA, 20 bp, Artificial Sequence
  Description of Artificial Sequence: Synthetic oligonucleotide
  Target: ATXN1; (-) strand; PAM type: NNGRRT; PAM sequence: CAGGGT
ttctgtatttttagtagaga

SEQ ID NO: 16648 - DNA, 20 bp, Artificial Sequence
  Description of Artificial Sequence: Synthetic oligonucleotide
  Target: ATXN1; (-) strand; PAM type: NNGRRT; PAM sequence: TGGGAT
gccccagcctcccaagtagc

SEQ ID NO: 16649 - DNA, 20 bp, Artificial Sequence
  Description of Artificial Sequence: Synthetic oligonucleotide
  Target: ATXN1; (-) strand; PAM type: NNGRRT; PAM sequence: CTGGGT
ttcactgcaacctctgcttc

SEQ ID NO: 16650 - DNA, 20 bp, Artificial Sequence
  Description of Artificial Sequence: Synthetic oligonucleotide
  Target: ATXN1; (-) strand; PAM type: NNGRRT; PAM sequence: TGGAGT
ctcgctctcatcccccaggc

SEQ ID NO: 16651 - DNA, 20 bp, Artificial Sequence
  Description of Artificial Sequence: Synthetic oligonucleotide
  Target: ATXN1; (-) strand; PAM type: NNGRRT; PAM sequence: CTGAAT
tgtacattcagtggtattaa

SEQ ID NO: 16652 - DNA, 20 bp, Artificial Sequence
  Description of Artificial Sequence: Synthetic oligonucleotide
  Target: ATXN1; (-) strand; PAM type: NNGRRT; PAM sequence: AGGAAT
cagaatgtatatgattatga

SEQ ID NO: 16653 - DNA, 20 bp, Artificial Sequence
  Description of Artificial Sequence: Synthetic oligonucleotide
  Target: ATXN1; (-) strand; PAM type: NNGRRT; PAM sequence: CAGAAT
gcaatgctcaatctatggtg

SEQ ID NO: 16654 - DNA, 20 bp, Artificial Sequence
  Description of Artificial Sequence: Synthetic oligonucleotide
  Target: ATXN1; (-) strand; PAM type: NNGRRT; PAM sequence: CAGAGT
aatttaagcccttgtttttg

SEQ ID NO: 16655 - DNA, 20 bp, Artificial Sequence
  Description of Artificial Sequence: Synthetic oligonucleotide
  Target: ATXN1; (-) strand; PAM type: NNGRRT; PAM sequence: CTGAAT
gcatatggtagtagcatttt

SEQ ID NO: 16656 - DNA, 20 bp, Artificial Sequence
  Description of Artificial Sequence: Synthetic oligonucleotide
  Target: ATXN1; (-) strand; PAM type: NNGRRT; PAM sequence: AGGAGT
atacagaagtcaaaaaattc

SEQ ID NO: 16657 - DNA, 20 bp, Artificial Sequence
  Description of Artificial Sequence: Synthetic oligonucleotide
  Target: ATXN1; (-) strand; PAM type: NNGRRT; PAM sequence: GAGAAT
ggttgaagctgcagtttgat

SEQ ID NO: 16658 - DNA, 20 bp, Artificial Sequence
  Description of Artificial Sequence: Synthetic oligonucleotide
  Target: ATXN1; (-) strand; PAM type: NNGRRT; PAM sequence: AAGGAT
gggaagatttttctaggcat

SEQ ID NO: 16659 - DNA, 20 bp, Artificial Sequence
  Description of Artificial Sequence: Synthetic oligonucleotide
  Target: ATXN1; (-) strand; PAM type: NNGRRT; PAM sequence: GGGAGT
cacttgatcgatgtgggagt

SEQ ID NO: 16660 - DNA, 20 bp, Artificial Sequence
  Description of Artificial Sequence: Synthetic oligonucleotide
  Target: ATXN1; (-) strand; PAM type: NNGRRT; PAM sequence: GGGAGT
gcagctcacttgatcgatgt

SEQ ID NO: 16661 - DNA, 20 bp, Artificial Sequence
  Description of Artificial Sequence: Synthetic oligonucleotide
  Target: ATXN1; (-) strand; PAM type: NNGRRT; PAM sequence: GTGAAT
cattatagaatcatagagaa

SEQ ID NO: 16662 - DNA, 20 bp, Artificial Sequence
  Description of Artificial Sequence: Synthetic oligonucleotide
  Target: ATXN1; (-) strand; PAM type: NNGRRT; PAM sequence: TAGAAT
aatcacagctgccttcatta

SEQ ID NO: 16663 - DNA, 20 bp, Artificial Sequence
  Description of Artificial Sequence: Synthetic oligonucleotide
  Target: ATXN1; (-) strand; PAM type: NNGRRT; PAM sequence: CAGGGT
gccataaattaacttgctcc

SEQ ID NO: 16664 - DNA, 20 bp, Artificial Sequence
  Description of Artificial Sequence: Synthetic oligonucleotide
  Target: ATXN1; (-) strand; PAM type: NNGRRT; PAM sequence: CAGGAT
cctaaatccctagccccctc

SEQ ID NO: 16665 - DNA, 20 bp, Artificial Sequence
  Description of Artificial Sequence: Synthetic oligonucleotide
  Target: ATXN1; (-) strand; PAM type: NNGRRT; PAM sequence: AGGAAT
ctcagcgccttgtaaataat

SEQ ID NO: 16666 - DNA, 20 bp, Artificial Sequence
  Description of Artificial Sequence: Synthetic oligonucleotide
  Target: ATXN1; (-) strand; PAM type: NNGRRT; PAM sequence: CTGAAT
aggtcttcagtaaatatttg

SEQ ID NO: 16667 - DNA, 20 bp, Artificial Sequence
  Description of Artificial Sequence: Synthetic oligonucleotide
  Target: ATXN1; (-) strand; PAM type: NNGRRT; PAM sequence: CTGGAT
ccagaatgctcactcagtga

SEQ ID NO: 16668 - DNA, 20 bp, Artificial Sequence
  Description of Artificial Sequence: Synthetic oligonucleotide
  Target: ATXN1; (-) strand; PAM type: NNGRRT; PAM sequence: CAGAAT
caaatatgttttttcattgc

SEQ ID NO: 16669 - DNA, 20 bp, Artificial Sequence
  Description of Artificial Sequence: Synthetic oligonucleotide
  Target: ATXN1; (-) strand; PAM type: NNGRRT; PAM sequence: TAGAGT
tatctggaatgcttggtacc

SEQ ID NO: 16670 - DNA, 20 bp, Artificial Sequence
  Description of Artificial Sequence: Synthetic oligonucleotide
  Target: ATXN1; (-) strand; PAM type: NNGRRT; PAM sequence: TGGAAT
gatcagaacatttatgtatc

SEQ ID NO: 16671 - DNA, 20 bp, Artificial Sequence
  Description of Artificial Sequence: Synthetic oligonucleotide
  Target: ATXN1; (-) strand; PAM type: NNGRRT; PAM sequence: GGGGAT
gccggtcaattgccactcaa

SEQ ID NO: 16672 - DNA, 20 bp, Artificial Sequence
  Description of Artificial Sequence: Synthetic oligonucleotide
  Target: ATXN1; (-) strand; PAM type: NNGRRT; PAM sequence: ACGAGT
actgttatgaaacaggaagt

SEQ ID NO: 16673 - DNA, 20 bp, Artificial Sequence
  Description of Artificial Sequence: Synthetic oligonucleotide
  Target: ATXN1; (-) strand; PAM type: NNGRRT; PAM sequence: AAGGGT
aggaaaggcagacatttaaa

SEQ ID NO: 16674 - DNA, 20 bp, Artificial Sequence
  Description of Artificial Sequence: Synthetic oligonucleotide
  Target: ATXN1; (-) strand; PAM type: NNGRRT; PAM sequence: GAGAAT
tgcttgggaggctgaggcag

SEQ ID NO: 16675 - DNA, 20 bp, Artificial Sequence
  Description of Artificial Sequence: Synthetic oligonucleotide
  Target: ATXN1; (-) strand; PAM type: NNGRRT; PAM sequence: AGGAGT
tgggcacatcatctgaggtc

SEQ ID NO: 16676 - DNA, 20 bp, Artificial Sequence
  Description of Artificial Sequence: Synthetic oligonucleotide
  Target: ATXN1; (-) strand; PAM type: NNGRRT; PAM sequence: GTGGGT
cagtactttgggaggccgag

SEQ ID NO: 16677 - DNA, 20 bp, Artificial Sequence
  Description of Artificial Sequence: Synthetic oligonucleotide
  Target: ATXN1; (-) strand; PAM type: NNGRRT; PAM sequence: TTGAGT
agggcttcaacacatgaatt

SEQ ID NO: 16678 - DNA, 20 bp, Artificial Sequence
  Description of Artificial Sequence: Synthetic oligonucleotide
  Target: ATXN1; (-) strand; PAM type: NNGRRT; PAM sequence: ATGAAT
ggaagttagggcttcaacac

SEQ ID NO: 16679 - DNA, 20 bp, Artificial Sequence
  Description of Artificial Sequence: Synthetic oligonucleotide
  Target: ATXN1; (-) strand; PAM type: NNGRRT; PAM sequence: TGGAAT
tacaaggacaccagtcatag

SEQ ID NO: 16680 - DNA, 20 bp, Artificial Sequence
  Description of Artificial Sequence: Synthetic oligonucleotide
  Target: ATXN1; (-) strand; PAM type: NNGRRT; PAM sequence: CTGAGT
ccataacaaagtaacccaga

SEQ ID NO: 16681 - DNA, 20 bp, Artificial Sequence
  Description of Artificial Sequence: Synthetic oligonucleotide
  Target: ATXN1; (-) strand; PAM type: NNGRRT; PAM sequence: TTGAGT
tcacatcttagaaggtaaca

SEQ ID NO: 16682 - DNA, 20 bp, Artificial Sequence
  Description of Artificial Sequence: Synthetic oligonucleotide
  Target: ATXN1; (-) strand; PAM type: NNGRRT; PAM sequence: TTGGGT
accctgtctttaatgggatg

SEQ ID NO: 16683 - DNA, 20 bp, Artificial Sequence
  Description of Artificial Sequence: Synthetic oligonucleotide
  Target: ATXN1; (-) strand; PAM type: NNGRRT; PAM sequence: TGGGAT
gccgaggaccctgtctttaa

SEQ ID NO: 16684 - DNA, 20 bp, Artificial Sequence
  Description of Artificial Sequence: Synthetic oligonucleotide
  Target: ATXN1; (-) strand; PAM type: NNGRRT; PAM sequence: TGGGAT
acctcggcctcccaaagtgc

SEQ ID NO: 16685 - DNA, 20 bp, Artificial Sequence
  Description of Artificial Sequence: Synthetic oligonucleotide
  Target: ATXN1; (-) strand; PAM type: NNGRRT; PAM sequence: TGGGAT
gtttgtatttttagtagaga

SEQ ID NO: 16686 - DNA, 20 bp, Artificial Sequence
  Description of Artificial Sequence: Synthetic oligonucleotide
  Target: ATXN1; (-) strand; PAM type: NNGRRT; PAM sequence: CCGAGT
gattctcctgcctcagcctc

SEQ ID NO: 16687 - DNA, 20 bp, Artificial Sequence
  Description of Artificial Sequence: Synthetic oligonucleotide
  Target: ATXN1; (-) strand; PAM type: NNGRRT; PAM sequence: TGGAGT
tcttgctctgccacccaggc

SEQ ID NO: 16688 - DNA, 20 bp, Artificial Sequence
  Description of Artificial Sequence: Synthetic oligonucleotide
  Target: ATXN1; (-) strand; PAM type: NNGRRT; PAM sequence: TGGAGT
tttgtttgtttgctttgaga

SEQ ID NO: 16689 - DNA, 20 bp, Artificial Sequence
  Description of Artificial Sequence: Synthetic oligonucleotide
  Target: ATXN1; (-) strand; PAM type: NNGRRT; PAM sequence: GAGGAT
tgataggagacttgctgaga

SEQ ID NO: 16690 - DNA, 20 bp, Artificial Sequence
  Description of Artificial Sequence: Synthetic oligonucleotide
  Target: ATXN1; (-) strand; PAM type: NNGRRT; PAM sequence: TGGGGT
gttgacctcccccttagagc

SEQ ID NO: 16691 - DNA, 20 bp, Artificial Sequence
  Description of Artificial Sequence: Synthetic oligonucleotide
  Target: ATXN1; (-) strand; PAM type: NNGRRT; PAM sequence: TGGAAT
atgagcagctcttttctggt

SEQ ID NO: 16692 - DNA, 20 bp, Artificial Sequence
  Description of Artificial Sequence: Synthetic oligonucleotide
  Target: ATXN1; (-) strand; PAM type: NNGRRT; PAM sequence: CAGAAT
ggctcattaacatctttgat

SEQ ID NO: 16693 - DNA, 20 bp, Artificial Sequence
  Description of Artificial Sequence: Synthetic oligonucleotide
  Target: ATXN1; (-) strand; PAM type: NNGRRT; PAM sequence: AAGGAT
atctgtacggaggctgtacc

SEQ ID NO: 16694 - DNA, 20 bp, Artificial Sequence
  Description of Artificial Sequence: Synthetic oligonucleotide
  Target: ATXN1; (-) strand; PAM type: NNGRRT; PAM sequence: ATGGAT
tgctgaatgaacagtccagt

SEQ ID NO: 16695 - DNA, 20 bp, Artificial Sequence
  Description of Artificial Sequence: Synthetic oligonucleotide
  Target: ATXN1; (-) strand; PAM type: NNGRRT; PAM sequence: CTGAAT
aaattccagaatactgggtg

SEQ ID NO: 16696 - DNA, 20 bp, Artificial Sequence
  Description of Artificial Sequence: Synthetic oligonucleotide
  Target: ATXN1; (-) strand; PAM type: NNGRRT; PAM sequence: CTGGGT
aataggcaaattccagaata

SEQ ID NO: 16697 - DNA, 20 bp, Artificial Sequence
  Description of Artificial Sequence: Synthetic oligonucleotide
  Target: ATXN1; (-) strand; PAM type: NNGRRT; PAM sequence: CAGAAT
ctgcattaataggcaaattc

SEQ ID NO: 16698 - DNA, 20 bp, Artificial Sequence
  Description of Artificial Sequence: Synthetic oligonucleotide
  Target: ATXN1; (-) strand; PAM type: NNGRRT; PAM sequence: TTGGGT
attcacattgaatttggagt

SEQ ID NO: 16699 - DNA, 20 bp, Artificial Sequence
  Description of Artificial Sequence: Synthetic oligonucleotide
  Target: ATXN1; (-) strand; PAM type: NNGRRT; PAM sequence: TGGAGT
ccaaaaattcacattgaatt

SEQ ID NO: 16700 - DNA, 20 bp, Artificial Sequence
  Description of Artificial Sequence: Synthetic oligonucleotide
  Target: ATXN1; (-) strand; PAM type: NNGRRT; PAM sequence: TTGAAT
atcaaaaccaaaaattcaca

SEQ ID NO: 16701 - DNA, 20 bp, Artificial Sequence
  Description of Artificial Sequence: Synthetic oligonucleotide
  Target: ATXN1; (-) strand; PAM type: NNGRRT; PAM sequence: ATGGAT
tgagggcacgtggatatccc

SEQ ID NO: 16702 - DNA, 20 bp, Artificial Sequence
  Description of Artificial Sequence: Synthetic oligonucleotide
  Target: ATXN1; (-) strand; PAM type: NNGRRT; PAM sequence: GTGGAT
ggggattttgatgagggcac

SEQ ID NO: 16703 - DNA, 20 bp, Artificial Sequence
  Description of Artificial Sequence: Synthetic oligonucleotide
  Target: ATXN1; (-) strand; PAM type: NNGRRT; PAM sequence: GGGGAT
agagggagcttctaagaaac

SEQ ID NO: 16704 - DNA, 20 bp, Artificial Sequence
  Description of Artificial Sequence: Synthetic oligonucleotide
  Target: ATXN1; (-) strand; PAM type: NNGRRT; PAM sequence: ATGAGT
gtacaacaaacccccatggc

SEQ ID NO: 16705 - DNA, 20 bp, Artificial Sequence
  Description of Artificial Sequence: Synthetic oligonucleotide
  Target: ATXN1; (-) strand; PAM type: NNGRRT; PAM sequence: CTGGGT
ttgggtactaggcttagtat

SEQ ID NO: 16706 - DNA, 20 bp, Artificial Sequence
  Description of Artificial Sequence: Synthetic oligonucleotide
  Target: ATXN1; (-) strand; PAM type: NNGRRT; PAM sequence: TTGGGT
aggagcagaaaaaacaatta

SEQ ID NO: 16707 - DNA, 20 bp, Artificial Sequence
  Description of Artificial Sequence: Synthetic oligonucleotide
  Target: ATXN1; (-) strand; PAM type: NNGRRT; PAM sequence: GAGGGT
ctgggtcctacttgagggta

SEQ ID NO: 16708 - DNA, 20 bp, Artificial Sequence
  Description of Artificial Sequence: Synthetic oligonucleotide
  Target: ATXN1; (-) strand; PAM type: NNGRRT; PAM sequence: GAGGGT
gcagacactgggtcctactt

SEQ ID NO: 16709 - DNA, 20 bp, Artificial Sequence
  Description of Artificial Sequence: Synthetic oligonucleotide
  Target: ATXN1; (-) strand; PAM type: NNGRRT; PAM sequence: CTGGGT
aaagaagggaacagcagaca

SEQ ID NO: 16710 - DNA, 20 bp, Artificial Sequence
  Description of Artificial Sequence: Synthetic oligonucleotide
  Target: ATXN1; (-) strand; PAM type: NNGRRT; PAM sequence: AGGAGT
aatgagatcatgtcttttgc

SEQ ID NO: 16711 - DNA, 20 bp, Artificial Sequence
  Description of Artificial Sequence: Synthetic oligonucleotide
  Target: ATXN1; (-) strand; PAM type: NNGRRT; PAM sequence: AGGAAT
atactatgcagccataaaaa

SEQ ID NO: 16712 - DNA, 20 bp, Artificial Sequence
  Description of Artificial Sequence: Synthetic oligonucleotide
  Target: ATXN1; (-) strand; PAM type: NNGRRT; PAM sequence: TGGAAT
aaatgtggtacatattacca

SEQ ID NO: 16713 - DNA, 20 bp, Artificial Sequence
  Description of Artificial Sequence: Synthetic oligonucleotide
  Target: ATXN1; (-) strand; PAM type: NNGRRT; PAM sequence: CAGAAT
tattcacagtagcaaagaca

SEQ ID NO: 16714 - DNA, 20 bp, Artificial Sequence
  Description of Artificial Sequence: Synthetic oligonucleotide
  Target: ATXN1; (-) strand; PAM type: NNGRRT; PAM sequence: AGGAAT
attactgggtatctacccag

SEQ ID NO: 16715 - DNA, 20 bp, Artificial Sequence
  Description of Artificial Sequence: Synthetic oligonucleotide
  Target: ATXN1; (-) strand; PAM type: NNGRRT; PAM sequence: CTGGGT
tcgacccagcaatcccatta

SEQ ID NO: 16716 - DNA, 20 bp, Artificial Sequence
  Description of Artificial Sequence: Synthetic oligonucleotide
  Target: ATXN1; (-) strand; PAM type: NNGRRT; PAM sequence: GTGAGT
ggaacacttatacactgttg

SEQ ID NO: 16717 - DNA, 20 bp, Artificial Sequence
  Description of Artificial Sequence: Synthetic oligonucleotide
  Target: ATXN1; (-) strand; PAM type: NNGRRT; PAM sequence: TTGGAT
aaaagtcaaaaaataaccag

SEQ ID NO: 16718 - DNA, 20 bp, Artificial Sequence
  Description of Artificial Sequence: Synthetic oligonucleotide
  Target: ATXN1; (-) strand; PAM type: NNGRRT; PAM sequence: CAGAAT
agatactatctcataccagt

SEQ ID NO: 16719 - DNA, 20 bp, Artificial Sequence
  Description of Artificial Sequence: Synthetic oligonucleotide
  Target: ATXN1; (-) strand; PAM type: NNGRRT; PAM sequence: AAGAAT
aaagaagacatatggccaat

SEQ ID NO: 16720 - DNA, 20 bp, Artificial Sequence
  Description of Artificial Sequence: Synthetic oligonucleotide
  Target: ATXN1; (-) strand; PAM type: NNGRRT; PAM sequence: CTGGGT
ttgcaccactatgctccagc

SEQ ID NO: 16721 - DNA, 20 bp, Artificial Sequence
  Description of Artificial Sequence: Synthetic oligonucleotide
  Target: ATXN1; (-) strand; PAM type: NNGRRT; PAM sequence: GAGAAT
tacgcgggaggctgaggcag

SEQ ID NO: 16722 - DNA, 20 bp, Artificial Sequence
  Description of Artificial Sequence: Synthetic oligonucleotide
  Target: ATXN1; (-) strand; PAM type: NNGRRT; PAM sequence: GCGAGT
aacaattagctgggctggtg

SEQ ID NO: 16723 - DNA, 20 bp, Artificial Sequence
  Description of Artificial Sequence: Synthetic oligonucleotide
  Target: ATXN1; (-) strand; PAM type: NNGRRT; PAM sequence: AGGAGT
ggtgggcagatcacaaagtc

SEQ ID NO: 16724 - DNA, 20 bp, Artificial Sequence
  Description of Artificial Sequence: Synthetic oligonucleotide
  Target: ATXN1; (-) strand; PAM type: NNGRRT; PAM sequence: AGGGAT
acttcagcctcccaaagtgc

SEQ ID NO: 16725 - DNA, 20 bp, Artificial Sequence
  Description of Artificial Sequence: Synthetic oligonucleotide
  Target: ATXN1; (-) strand; PAM type: NNGRRT; PAM sequence: GGGGAT
gtctcgaactcctgacctca

SEQ ID NO: 16726 - DNA, 20 bp, Artificial Sequence
  Description of Artificial Sequence: Synthetic oligonucleotide
  Target: ATXN1; (-) strand; PAM type: NNGRRT; PAM sequence: CAGGAT
cagggtttcatcatgttggc

SEQ ID NO: 16727 - DNA, 20 bp, Artificial Sequence
  Description of Artificial Sequence: Synthetic oligonucleotide
  Target: ATXN1; (-) strand; PAM type: NNGRRT; PAM sequence: CAGGGT
ttttgtatttttagtagaga

SEQ ID NO: 16728 - DNA, 20 bp, Artificial Sequence
  Description of Artificial Sequence: Synthetic oligonucleotide
  Target: ATXN1; (-) strand; PAM type: NNGRRT; PAM sequence: TGGGAT
gcctcagcctcccaagtagc

SEQ ID NO: 16729 - DNA, 20 bp, Artificial Sequence
  Description of Artificial Sequence: Synthetic oligonucleotide
  Target: ATXN1; (-) strand; PAM type: NNGRRT; PAM sequence: CTGGGT
ctcactgcaacctctgcctc

SEQ ID NO: 16730 - DNA, 20 bp, Artificial Sequence
  Description of Artificial Sequence: Synthetic oligonucleotide
  Target: ATXN1; (-) strand; PAM type: NNGRRT; PAM sequence: TGGAGT
tttgcttttgttgcccaggc

SEQ ID NO: 16731 - DNA, 20 bp, Artificial Sequence
  Description of Artificial Sequence: Synthetic oligonucleotide
  Target: ATXN1; (-) strand; PAM type: NNGRRT; PAM sequence: TGGAGT
gaatttttttttttttgaga

SEQ ID NO: 16732 - DNA, 20 bp, Artificial Sequence
  Description of Artificial Sequence: Synthetic oligonucleotide
  Target: ATXN1; (-) strand; PAM type: NNGRRT; PAM sequence: TTGAAT
aaggcaacattaagaaattt

SEQ ID NO: 16733 - DNA, 20 bp, Artificial Sequence
  Description of Artificial Sequence: Synthetic oligonucleotide
  Target: ATXN1; (-) strand; PAM type: NNGRRT; PAM sequence: AGGAGT
gaaggaagttgcctgagagg

SEQ ID NO: 16734 - DNA, 20 bp, Artificial Sequence
  Description of Artificial Sequence: Synthetic oligonucleotide
  Target: ATXN1; (-) strand; PAM type: NNGRRT; PAM sequence: GGGAAT
gagtgtaagagggcacccaa

SEQ ID NO: 16735 - DNA, 20 bp, Artificial Sequence
  Description of Artificial Sequence: Synthetic oligonucleotide
  Target: ATXN1; (-) strand; PAM type: NNGRRT; PAM sequence: GTGAGT
agtgaatgttgggtgaatca

SEQ ID NO: 16736 - DNA, 20 bp, Artificial Sequence
  Description of Artificial Sequence: Synthetic oligonucleotide
  Target: ATXN1; (-) strand; PAM type: NNGRRT; PAM sequence: GTGAAT
agtgcccaagtgaatgttgg

SEQ ID NO: 16737 - DNA, 20 bp, Artificial Sequence
  Description of Artificial Sequence: Synthetic oligonucleotide
  Target: ATXN1; (-) strand; PAM type: NNGRRT; PAM sequence: TTGGGT
cagaagtgcccaagtgaatg

SEQ ID NO: 16738 - DNA, 20 bp, Artificial Sequence
  Description of Artificial Sequence: Synthetic oligonucleotide
  Target: ATXN1; (-) strand; PAM type: NNGRRT; PAM sequence: GTGAAT
tacaatgcagaagtgcccaa

SEQ ID NO: 16739 - DNA, 20 bp, Artificial Sequence
  Description of Artificial Sequence: Synthetic oligonucleotide
  Target: ATXN1; (-) strand; PAM type: NNGRRT; PAM sequence: GAGAGT
gtttttcctgtttgcctcaa

SEQ ID NO: 16740 - DNA, 20 bp, Artificial Sequence
  Description of Artificial Sequence: Synthetic oligonucleotide
  Target: ATXN1; (-) strand; PAM type: NNGRRT; PAM sequence: ATGGGT
ttaggcccttgaattttttt

SEQ ID NO: 16741 - DNA, 20 bp, Artificial Sequence
  Description of Artificial Sequence: Synthetic oligonucleotide
  Target: ATXN1; (-) strand; PAM type: NNGRRT; PAM sequence: TTGAAT
tcatccactcacttaggccc

SEQ ID NO: 16742 - DNA, 20 bp, Artificial Sequence
  Description of Artificial Sequence: Synthetic oligonucleotide
  Target: ATXN1; (-) strand; PAM type: NNGRRT; PAM sequence: ATGAAT
cttctgttagcttttcctcc

SEQ ID NO: 16743 - DNA, 20 bp, Artificial Sequence
  Description of Artificial Sequence: Synthetic oligonucleotide
  Target: ATXN1; (-) strand; PAM type: NNGRRT; PAM sequence: TGGAGT
ctctgatatcatcaatgcat

SEQ ID NO: 16744 - DNA, 20 bp, Artificial Sequence
  Description of Artificial Sequence: Synthetic oligonucleotide
  Target: ATXN1; (-) strand; PAM type: NNGRRT; PAM sequence: ATGAGT
attctaatgtttatgattgc

SEQ ID NO: 16745 - DNA, 20 bp, Artificial Sequence
  Description of Artificial Sequence: Synthetic oligonucleotide
  Target: ATXN1; (-) strand; PAM type: NNGRRT; PAM sequence: TAGAAT
caatctgaccattttgtatt

SEQ ID NO: 16746 - DNA, 20 bp, Artificial Sequence
  Description of Artificial Sequence: Synthetic oligonucleotide
  Target: ATXN1; (-) strand; PAM type: NNGRRT; PAM sequence: CTGAGT
ttctattaatagcaatactt

SEQ ID NO: 16747 - DNA, 20 bp, Artificial Sequence
  Description of Artificial Sequence: Synthetic oligonucleotide
  Target: ATXN1; (-) strand; PAM type: NNGRRT; PAM sequence: CTGGGT
agcagaaatgcaaattatta

SEQ ID NO: 16748 - DNA, 20 bp, Artificial Sequence
  Description of Artificial Sequence: Synthetic oligonucleotide
  Target: ATXN1; (-) strand; PAM type: NNGRRT; PAM sequence: AAGGGT
aaactgtggcttaccaatga

SEQ ID NO: 16749 - DNA, 20 bp, Artificial Sequence
  Description of Artificial Sequence: Synthetic oligonucleotide
  Target: ATXN1; (-) strand; PAM type: NNGRRT; PAM sequence: ACGAGT
cagcgcagtgccaggcacac

SEQ ID NO: 16750 - DNA, 20 bp, Artificial Sequence
  Description of Artificial Sequence: Synthetic oligonucleotide
  Target: ATXN1; (-) strand; PAM type: NNGRRT; PAM sequence: ATGAAT
tgttttctcagctttaaaac

SEQ ID NO: 16751 - DNA, 20 bp, Artificial Sequence
  Description of Artificial Sequence: Synthetic oligonucleotide
  Target: ATXN1; (-) strand; PAM type: NNGRRT; PAM sequence: TGGAGT
aagtggaaggagagtgggca

SEQ ID NO: 16752 - DNA, 20 bp, Artificial Sequence
  Description of Artificial Sequence: Synthetic oligonucleotide
  Target: ATXN1; (-) strand; PAM type: NNGRRT; PAM sequence: GAGAGT
gtttacgctgcaagtggaag

SEQ ID NO: 16753 - DNA, 20 bp, Artificial Sequence
  Description of Artificial Sequence: Synthetic oligonucleotide
  Target: ATXN1; (-) strand; PAM type: NNGRRT; PAM sequence: CAGAGT
acattatattcatgaagcca

SEQ ID NO: 16754 - DNA, 20 bp, Artificial Sequence
  Description of Artificial Sequence: Synthetic oligonucleotide
  Target: ATXN1; (-) strand; PAM type: NNGRRT; PAM sequence: AGGAGT
agatttgcaatgcagtgtcc

SEQ ID NO: 16755 - DNA, 20 bp, Artificial Sequence
  Description of Artificial Sequence: Synthetic oligonucleotide
  Target: ATXN1; (-) strand; PAM type: NNGRRT; PAM sequence: GTGAGT
aggggcaaatataggtgtca

SEQ ID NO: 16756 - DNA, 20 bp, Artificial Sequence
  Description of Artificial Sequence: Synthetic oligonucleotide
  Target: ATXN1; (-) strand; PAM type: NNGRRT; PAM sequence: CAGAGT
gcaccatatcaagagctgag

SEQ ID NO: 16757 - DNA, 20 bp, Artificial Sequence
  Description of Artificial Sequence: Synthetic oligonucleotide
  Target: ATXN1; (-) strand; PAM type: NNGRRT; PAM sequence: CAGAAT
aagtcagctttggaatgata

SEQ ID NO: 16758 - DNA, 20 bp, Artificial Sequence
  Description of Artificial Sequence: Synthetic oligonucleotide
  Target: ATXN1; (-) strand; PAM type: NNGRRT; PAM sequence: TGGAAT
gatgggggacaagtcagctt

SEQ ID NO: 16759 - DNA, 20 bp, Artificial Sequence
  Description of Artificial Sequence: Synthetic oligonucleotide
  Target: ATXN1; (-) strand; PAM type: NNGRRT; PAM sequence: CAGAGT
tttcagtgagacttctgggg

SEQ ID NO: 16760 - DNA, 20 bp, Artificial Sequence
  Description of Artificial Sequence: Synthetic oligonucleotide
  Target: ATXN1; (-) strand; PAM type: NNGRRT; PAM sequence: AGGAGT
taaaaccaaggatgtgaatg

SEQ ID NO: 16761 - DNA, 20 bp, Artificial Sequence
  Description of Artificial Sequence: Synthetic oligonucleotide
  Target: ATXN1; (-) strand; PAM type: NNGRRT; PAM sequence: GTGAAT
tgggtcataaaaccaaggat

SEQ ID NO: 16762 - DNA, 20 bp, Artificial Sequence
  Description of Artificial Sequence: Synthetic oligonucleotide
  Target: ATXN1; (-) strand; PAM type: NNGRRT; PAM sequence: AAGGAT
gaagtgtgggtcataaaacc

SEQ ID NO: 16763 - DNA, 20 bp, Artificial Sequence
  Description of Artificial Sequence: Synthetic oligonucleotide
  Target: ATXN1; (-) strand; PAM type: NNGRRT; PAM sequence: GTGGGT
agggagagtcctatagaagt

SEQ ID NO: 16764 - DNA, 20 bp, Artificial Sequence
  Description of Artificial Sequence: Synthetic oligonucleotide
  Target: ATXN1; (-) strand; PAM type: NNGRRT; PAM sequence: GAGAGT
ataattagaactaaagaagg

SEQ ID NO: 16765 - DNA, 20 bp, Artificial Sequence
  Description of Artificial Sequence: Synthetic oligonucleotide
  Target: ATXN1; (-) strand; PAM type: NNGRRT; PAM sequence: TGGGAT
tgggagttttgcaatcacct

SEQ ID NO: 16766 - DNA, 20 bp, Artificial Sequence
  Description of Artificial Sequence: Synthetic oligonucleotide
  Target: ATXN1; (-) strand; PAM type: NNGRRT; PAM sequence: GGGAGT
tgaagatttgtggctgagat

SEQ ID NO: 16767 - DNA, 20 bp, Artificial Sequence
  Description of Artificial Sequence: Synthetic oligonucleotide
  Target: ATXN1; (-) strand; PAM type: NNGRRT; PAM sequence: TGGGAT
atacagaggaaataaagtgg

SEQ ID NO: 16768 - DNA, 20 bp, Artificial Sequence
  Description of Artificial Sequence: Synthetic oligonucleotide
  Target: ATXN1; (-) strand; PAM type: NNGRRT; PAM sequence: TTGAGT
ttcctctttcctgttgatgc

SEQ ID NO: 16769 - DNA, 20 bp, Artificial Sequence
  Description of Artificial Sequence: Synthetic oligonucleotide
  Target: ATXN1; (-) strand; PAM type: NNGRRT; PAM sequence: ATGGAT
tagctacgatgcagtggagc

SEQ ID NO: 16770 - DNA, 20 bp, Artificial Sequence
  Description of Artificial Sequence: Synthetic oligonucleotide
  Target: ATXN1; (-) strand; PAM type: NNGRRT; PAM sequence: AAGAAT
gaatgagactaattaataat

SEQ ID NO: 16771 - DNA, 20 bp, Artificial Sequence
  Description of Artificial Sequence: Synthetic oligonucleotide
  Target: ATXN1; (-) strand; PAM type: NNGRRT; PAM sequence: AGGAAT
gtggtgtgagacaaaagtga

SEQ ID NO: 16772 - DNA, 20 bp, Artificial Sequence
  Description of Artificial Sequence: Synthetic oligonucleotide
  Target: ATXN1; (-) strand; PAM type: NNGRRT; PAM sequence: GTGAAT
ggattagttggggaagaaga

SEQ ID NO: 16773 - DNA, 20 bp, Artificial Sequence
  Description of Artificial Sequence: Synthetic oligonucleotide
  Target: ATXN1; (-) strand; PAM type: NNGRRT; PAM sequence: AAGAGT
gaggggattagttggggaag

SEQ ID NO: 16774 - DNA, 20 bp, Artificial Sequence
  Description of Artificial Sequence: Synthetic oligonucleotide
  Target: ATXN1; (-) strand; PAM type: NNGRRT; PAM sequence: GGGGAT
aacatggtgccagtggctga

SEQ ID NO: 16775 - DNA, 20 bp, Artificial Sequence
  Description of Artificial Sequence: Synthetic oligonucleotide
  Target: ATXN1; (-) strand; PAM type: NNGRRT; PAM sequence: AAGGAT
atgtgtctcactgccccagg

SEQ ID NO: 16776 - DNA, 20 bp, Artificial Sequence
  Description of Artificial Sequence: Synthetic oligonucleotide
  Target: ATXN1; (-) strand; PAM type: NNGRRT; PAM sequence: CAGGAT
ttagggtgacaaggctgatt

SEQ ID NO: 16777 - DNA, 20 bp, Artificial Sequence
  Description of Artificial Sequence: Synthetic oligonucleotide
  Target: ATXN1; (-) strand; PAM type: NNGRRT; PAM sequence: TAGGGT
aaacgttgcaaggtcccctt

SEQ ID NO: 16778 - DNA, 20 bp, Artificial Sequence
  Description of Artificial Sequence: Synthetic oligonucleotide
  Target: ATXN1; (-) strand; PAM type: NNGRRT; PAM sequence: GTGAAT
ttgacaagaatcttgcctgt

SEQ ID NO: 16779 - DNA, 20 bp, Artificial Sequence
  Description of Artificial Sequence: Synthetic oligonucleotide
  Target: ATXN1; (-) strand; PAM type: NNGRRT; PAM sequence: AAGAAT
agtgattctgggtcattgac

SEQ ID NO: 16780 - DNA, 20 bp, Artificial Sequence
  Description of Artificial Sequence: Synthetic oligonucleotide
  Target: ATXN1; (-) strand; PAM type: NNGRRT; PAM sequence: CTGGGT
ccctcggggcttaagtgatt

SEQ ID NO: 16781 - DNA, 20 bp, Artificial Sequence
  Description of Artificial Sequence: Synthetic oligonucleotide
  Target: ATXN1; (-) strand; PAM type: NNGRRT; PAM sequence: TGGGAT
gtctcagcctcccaagtagc

SEQ ID NO: 16782 - DNA, 20 bp, Artificial Sequence
  Description of Artificial Sequence: Synthetic oligonucleotide
  Target: ATXN1; (-) strand; PAM type: NNGRRT; PAM sequence: CGGAGT
tcttttttttttttttgagg

SEQ ID NO: 16783 - DNA, 20 bp, Artificial Sequence
  Description of Artificial Sequence: Synthetic oligonucleotide
  Target: ATXN1; (-) strand; PAM type: NNGRRT; PAM sequence: GAGAAT
tctgtaaatctacccaacaa

SEQ ID NO: 16784 - DNA, 20 bp, Artificial Sequence
  Description of Artificial Sequence: Synthetic oligonucleotide
  Target: ATXN1; (-) strand; PAM type: NNGRRT; PAM sequence: CCGAAT
gtcaatgggtgacttgtttg

SEQ ID NO: 16785 - DNA, 20 bp, Artificial Sequence
  Description of Artificial Sequence: Synthetic oligonucleotide
  Target: ATXN1; (-) strand; PAM type: NNGRRT; PAM sequence: ATGGGT
atttttttctaggcttgtca

SEQ ID NO: 16786 - DNA, 20 bp, Artificial Sequence
  Description of Artificial Sequence: Synthetic oligonucleotide
  Target: ATXN1; (-) strand; PAM type: NNGRRT; PAM sequence: TTGGGT
gaaaactgataaaacaaaca

SEQ ID NO: 16787 - DNA, 20 bp, Artificial Sequence
  Description of Artificial Sequence: Synthetic oligonucleotide
  Target: ATXN1; (-) strand; PAM type: NNGRRT; PAM sequence: ATGGGT
acattacaatgaggactcat

SEQ ID NO: 16788 - DNA, 20 bp, Artificial Sequence
  Description of Artificial Sequence: Synthetic oligonucleotide
  Target: ATXN1; (-) strand; PAM type: NNGRRT; PAM sequence: GTGGGT
aattgggaggacctggaatt

SEQ ID NO: 16789 - DNA, 20 bp, Artificial Sequence
  Description of Artificial Sequence: Synthetic oligonucleotide
  Target: ATXN1; (-) strand; PAM type: NNGRRT; PAM sequence: TGGAAT
ggaagcaaattgggaggacc

SEQ ID NO: 16790 - DNA, 20 bp, Artificial Sequence
  Description of Artificial Sequence: Synthetic oligonucleotide
  Target: ATXN1; (-) strand; PAM type: NNGRRT; PAM sequence: AAGAGT
gcagatagtaggcattggtt

SEQ ID NO: 16791 - DNA, 20 bp, Artificial Sequence
  Description of Artificial Sequence: Synthetic oligonucleotide
  Target: ATXN1; (-) strand; PAM type: NNGRRT; PAM sequence: CCGAAT
ttttccttggactgtcttta

SEQ ID NO: 16792 - DNA, 20 bp, Artificial Sequence
  Description of Artificial Sequence: Synthetic oligonucleotide
  Target: ATXN1; (-) strand; PAM type: NNGRRT; PAM sequence: TGGAGT
gacaccttgtaacatctctc

SEQ ID NO: 16793 - DNA, 20 bp, Artificial Sequence
  Description of Artificial Sequence: Synthetic oligonucleotide
  Target: ATXN1; (-) strand; PAM type: NNGRRT; PAM sequence: TAGAGT
taatcagaagcaagtgaatt

SEQ ID NO: 16794 - DNA, 20 bp, Artificial Sequence
  Description of Artificial Sequence: Synthetic oligonucleotide
  Target: ATXN1; (-) strand; PAM type: NNGRRT; PAM sequence: GTGAAT
aggtaggtaatcagaagcaa

SEQ ID NO: 16795 - DNA, 20 bp, Artificial Sequence
  Description of Artificial Sequence: Synthetic oligonucleotide
  Target: ATXN1; (-) strand; PAM type: NNGRRT; PAM sequence: AAGAAT
aggtttgttcaactggagtg

SEQ ID NO: 16796 - DNA, 20 bp, Artificial Sequence
  Description of Artificial Sequence: Synthetic oligonucleotide
  Target: ATXN1; (-) strand; PAM type: NNGRRT; PAM sequence: TGGAGT
atctaataggtttgttcaac

SEQ ID NO: 16797 - DNA, 20 bp, Artificial Sequence
  Description of Artificial Sequence: Synthetic oligonucleotide
  Target: ATXN1; (-) strand; PAM type: NNGRRT; PAM sequence: GAGAGT
agctggagataattgcttgt

SEQ ID NO: 16798 - DNA, 20 bp, Artificial Sequence
  Description of Artificial Sequence: Synthetic oligonucleotide
  Target: ATXN1; (-) strand; PAM type: NNGRRT; PAM sequence: AAGAGT
aactgtgttttctaagaaga

SEQ ID NO: 16799 - DNA, 20 bp, Artificial Sequence
  Description of Artificial Sequence: Synthetic oligonucleotide
  Target: ATXN1; (-) strand; PAM type: NNGRRT; PAM sequence: ATGGAT
actagatggggttagtttag

SEQ ID NO: 16800 - DNA, 20 bp, Artificial Sequence
  Description of Artificial Sequence: Synthetic oligonucleotide
  Target: ATXN1; (-) strand; PAM type: NNGRRT; PAM sequence: TGGGGT
gcatggatgccagaactaga

SEQ ID NO: 16801 - DNA, 20 bp, Artificial Sequence
  Description of Artificial Sequence: Synthetic oligonucleotide
  Target: ATXN1; (-) strand; PAM type: NNGRRT; PAM sequence: ATGGAT
atgctaaatctattgattgc

SEQ ID NO: 16802 - DNA, 20 bp, Artificial Sequence
  Description of Artificial Sequence: Synthetic oligonucleotide
  Target: ATXN1; (-) strand; PAM type: NNGRRT; PAM sequence: TAGGAT
gattacatataaggcatatg

SEQ ID NO: 16803 - DNA, 20 bp, Artificial Sequence
  Description of Artificial Sequence: Synthetic oligonucleotide
  Target: ATXN1; (-) strand; PAM type: NNGRRT; PAM sequence: GGGAGT
agaaacaaccctatgaggta

SEQ ID NO: 16804 - DNA, 20 bp, Artificial Sequence
  Description of Artificial Sequence: Synthetic oligonucleotide
  Target: ATXN1; (-) strand; PAM type: NNGRRT; PAM sequence: TTGAGT
aaaacatttgagttatacac

SEQ ID NO: 16805 - DNA, 20 bp, Artificial Sequence
  Description of Artificial Sequence: Synthetic oligonucleotide
  Target: ATXN1; (-) strand; PAM type: NNGRRT; PAM sequence: TTGAGT
gtgactatactaaaaaacat

SEQ ID NO: 16806 - DNA, 20 bp, Artificial Sequence
  Description of Artificial Sequence: Synthetic oligonucleotide
  Target: ATXN1; (-) strand; PAM type: NNGRRT; PAM sequence: CAGGGT
agagtgactgctaatgtaca

SEQ ID NO: 16807 - DNA, 20 bp, Artificial Sequence
  Description of Artificial Sequence: Synthetic oligonucleotide
  Target: ATXN1; (-) strand; PAM type: NNGRRT; PAM sequence: CAGAGT
ccggaggtgggagaggaatg

SEQ ID NO: 16808 - DNA, 20 bp, Artificial Sequence
  Description of Artificial Sequence: Synthetic oligonucleotide
  Target: ATXN1; (-) strand; PAM type: NNGRRT; PAM sequence: AGGAAT
gcagaggccggaggtgggag

SEQ ID NO: 16809 - DNA, 20 bp, Artificial Sequence
  Description of Artificial Sequence: Synthetic oligonucleotide
  Target: ATXN1; (-) strand; PAM type: NNGRRT; PAM sequence: GGGGGT
atagagacagaagttagttt

SEQ ID NO: 16810 - DNA, 20 bp, Artificial Sequence
  Description of Artificial Sequence: Synthetic oligonucleotide
  Target: ATXN1; (-) strand; PAM type: NNGRRT; PAM sequence: CAGAAT
tttcatttatatgaaaggtc

SEQ ID NO: 16811 - DNA, 20 bp, Artificial Sequence
  Description of Artificial Sequence: Synthetic oligonucleotide
  Target: ATXN1; (-) strand; PAM type: NNGRRT; PAM sequence: GTGAAT
gatgaacctcaaaacatcat

SEQ ID NO: 16812 - DNA, 20 bp, Artificial Sequence
  Description of Artificial Sequence: Synthetic oligonucleotide
  Target: ATXN1; (-) strand; PAM type: NNGRRT; PAM sequence: TGGAAT
cacgcaaaataaatgtttaa

SEQ ID NO: 16813 - DNA, 20 bp, Artificial Sequence
  Description of Artificial Sequence: Synthetic oligonucleotide
  Target: ATXN1; (-) strand; PAM type: NNGRRT; PAM sequence: CAGAGT
atgaaagctacagacatttt

SEQ ID NO: 16814 - DNA, 20 bp, Artificial Sequence
  Description of Artificial Sequence: Synthetic oligonucleotide
  Target: ATXN1; (-) strand; PAM type: NNGRRT; PAM sequence: AGGGGT
gtgcaggaggtctgtagccc

SEQ ID NO: 16815 - DNA, 20 bp, Artificial Sequence
  Description of Artificial Sequence: Synthetic oligonucleotide
  Target: ATXN1; (-) strand; PAM type: NNGRRT; PAM sequence: GGGAGT
aggtggtaatttgaacaatg

SEQ ID NO: 16816 - DNA, 20 bp, Artificial Sequence
  Description of Artificial Sequence: Synthetic oligonucleotide
  Target: ATXN1; (-) strand; PAM type: NNGRRT; PAM sequence: GAGAAT
aatagggttcacgctcctat

SEQ ID NO: 16817 - DNA, 20 bp, Artificial Sequence
  Description of Artificial Sequence: Synthetic oligonucleotide
  Target: ATXN1; (-) strand; PAM type: NNGRRT; PAM sequence: TAGGGT
ctcacatgtgcagttcacaa

SEQ ID NO: 16818 - DNA, 20 bp, Artificial Sequence
  Description of Artificial Sequence: Synthetic oligonucleotide
  Target: ATXN1; (-) strand; PAM type: NNGRRT; PAM sequence: GAGGGT
aggcattagattctcataaa

SEQ ID NO: 16819 - DNA, 20 bp, Artificial Sequence
  Description of Artificial Sequence: Synthetic oligonucleotide
  Target: ATXN1; (-) strand; PAM type: NNGRRT; PAM sequence: AGGGGT
gcaacaaaacggtcccatct

SEQ ID NO: 16820 - DNA, 20 bp, Artificial Sequence
  Description of Artificial Sequence: Synthetic oligonucleotide
  Target: ATXN1; (-) strand; PAM type: NNGRRT; PAM sequence: TAGAAT
ttatgcaactcaccataatg

SEQ ID NO: 16821 - DNA, 20 bp, Artificial Sequence
  Description of Artificial Sequence: Synthetic oligonucleotide
  Target: ATXN1; (-) strand; PAM type: NNGRRT; PAM sequence: TGGGAT
ggtggagcgggggatggttt

SEQ ID NO: 16822 - DNA, 20 bp, Artificial Sequence
  Description of Artificial Sequence: Synthetic oligonucleotide
  Target: ATXN1; (-) strand; PAM type: NNGRRT; PAM sequence: GGGGAT
ccacagactagggtggagcg

SEQ ID NO: 16823 - DNA, 20 bp, Artificial Sequence
  Description of Artificial Sequence: Synthetic oligonucleotide
  Target: ATXN1; (-) strand; PAM type: NNGRRT; PAM sequence: TAGGGT
aagacagtttttccacagac

SEQ ID NO: 16824 - DNA, 20 bp, Artificial Sequence
  Description of Artificial Sequence: Synthetic oligonucleotide
  Target: ATXN1; (-) strand; PAM type: NNGRRT; PAM sequence: ATGAAT
ttttgcctgaactcacacat

SEQ ID NO: 16825 - DNA, 20 bp, Artificial Sequence
  Description of Artificial Sequence: Synthetic oligonucleotide
  Target: ATXN1; (-) strand; PAM type: NNGRRT; PAM sequence: AAGAAT
tctggtcaatgtcctgccta

SEQ ID NO: 16826 - DNA, 20 bp, Artificial Sequence
  Description of Artificial Sequence: Synthetic oligonucleotide
  Target: ATXN1; (-) strand; PAM type: NNGRRT; PAM sequence: GTGGAT
tttggatgcttctggctaca

SEQ ID NO: 16827 - DNA, 20 bp, Artificial Sequence
  Description of Artificial Sequence: Synthetic oligonucleotide
  Target: ATXN1; (-) strand; PAM type: NNGRRT; PAM sequence: TTGGAT
ctcatgttttcaggatgctt

SEQ ID NO: 16828 - DNA, 20 bp, Artificial Sequence
  Description of Artificial Sequence: Synthetic oligonucleotide
  Target: ATXN1; (-) strand; PAM type: NNGRRT; PAM sequence: CAGGAT
ccttcctccactcatgtttt

SEQ ID NO: 16829 - DNA, 20 bp, Artificial Sequence
  Description of Artificial Sequence: Synthetic oligonucleotide
  Target: ATXN1; (-) strand; PAM type: NNGRRT; PAM sequence: CGGGGT
tgtttgtgctggctgctgtg

SEQ ID NO: 16830 - DNA, 20 bp, Artificial Sequence
  Description of Artificial Sequence: Synthetic oligonucleotide
  Target: ATXN1; (-) strand; PAM type: NNGRRT; PAM sequence: TAGGGT
aactgtgcactgcctgaggt

SEQ ID NO: 16831 - DNA, 20 bp, Artificial Sequence
  Description of Artificial Sequence: Synthetic oligonucleotide
  Target: ATXN1; (-) strand; PAM type: NNGRRT; PAM sequence: GCGAGT
gtgttcggtgatctccacgg

SEQ ID NO: 16832 - DNA, 20 bp, Artificial Sequence
  Description of Artificial Sequence: Synthetic oligonucleotide
  Target: ATXN1; (-) strand; PAM type: NNGRRT; PAM sequence: GAGGGT
taagggaggcaggtcatggg

SEQ ID NO: 16833 - DNA, 20 bp, Artificial Sequence
  Description of Artificial Sequence: Synthetic oligonucleotide
  Target: ATXN1; (-) strand; PAM type: NNGRRT; PAM sequence: AAGAGT
ctgtgacattttgcatttga

SEQ ID NO: 16834 - DNA, 20 bp, Artificial Sequence
  Description of Artificial Sequence: Synthetic oligonucleotide
  Target: ATXN1; (-) strand; PAM type: NNGRRT; PAM sequence: TGGAAT
gggaaagttaccaacctctc

SEQ ID NO: 16835 - DNA, 20 bp, Artificial Sequence
  Description of Artificial Sequence: Synthetic oligonucleotide
  Target: ATXN1; (-) strand; PAM type: NNGRRT; PAM sequence: GAGAGT
ctaaattgctttgggaggag

SEQ ID NO: 16836 - DNA, 20 bp, Artificial Sequence
  Description of Artificial Sequence: Synthetic oligonucleotide
  Target: ATXN1; (-) strand; PAM type: NNGRRT; PAM sequence: GGGAGT
agcagggtgaccacaaagtg

SEQ ID NO: 16837 - DNA, 20 bp, Artificial Sequence
  Description of Artificial Sequence: Synthetic oligonucleotide
  Target: ATXN1; (-) strand; PAM type: NNGRRT; PAM sequence: CAGGGT
tgcccatgcatcaggcagag

SEQ ID NO: 16838 - DNA, 20 bp, Artificial Sequence
  Description of Artificial Sequence: Synthetic oligonucleotide
  Target: ATXN1; (-) strand; PAM type: NNGRRT; PAM sequence: GCGAAT
gatggcatagactattcagg

SEQ ID NO: 16839 - DNA, 20 bp, Artificial Sequence
  Description of Artificial Sequence: Synthetic oligonucleotide
  Target: ATXN1; (-) strand; PAM type: NNGRRT; PAM sequence: AGGAAT
atcccaagaaaatataactg

SEQ ID NO: 16840 - DNA, 20 bp, Artificial Sequence
  Description of Artificial Sequence: Synthetic oligonucleotide
  Target: ATXN1; (-) strand; PAM type: NNGRRT; PAM sequence: AAGAGT
tccactttcttcctttttca

SEQ ID NO: 16841 - DNA, 20 bp, Artificial Sequence
  Description of Artificial Sequence: Synthetic oligonucleotide
  Target: ATXN1; (-) strand; PAM type: NNGRRT; PAM sequence: AGGAAT
tttctagttctagatccttg

SEQ ID NO: 16842 - DNA, 20 bp, Artificial Sequence
  Description of Artificial Sequence: Synthetic oligonucleotide
  Target: ATXN1; (-) strand; PAM type: NNGRRT; PAM sequence: CTGGGT
tatccccagtaatgggatgg

SEQ ID NO: 16843 - DNA, 20 bp, Artificial Sequence
  Description of Artificial Sequence: Synthetic oligonucleotide
  Target: ATXN1; (-) strand; PAM type: NNGRRT; PAM sequence: TGGGAT
tttgggtatatccccagtaa

SEQ ID NO: 16844 - DNA, 20 bp, Artificial Sequence
  Description of Artificial Sequence: Synthetic oligonucleotide
  Target: ATXN1; (-) strand; PAM type: NNGRRT; PAM sequence: TTGGGT
gcagcatgatttataatcct

SEQ ID NO: 16845 - DNA, 20 bp, Artificial Sequence
  Description of Artificial Sequence: Synthetic oligonucleotide
  Target: ATXN1; (-) strand; PAM type: NNGRRT; PAM sequence: GTGAAT
ggttccaagtctttgctatt

SEQ ID NO: 16846 - DNA, 20 bp, Artificial Sequence
  Description of Artificial Sequence: Synthetic oligonucleotide
  Target: ATXN1; (-) strand; PAM type: NNGRRT; PAM sequence: TTGGGT
agtctatcattgatggacat

SEQ ID NO: 16847 - DNA, 20 bp, Artificial Sequence
  Description of Artificial Sequence: Synthetic oligonucleotide
  Target: ATXN1; (-) strand; PAM type: NNGRRT; PAM sequence: GAGAAT
tgtccttgcgataatttgct

SEQ ID NO: 16848 - DNA, 20 bp, Artificial Sequence
  Description of Artificial Sequence: Synthetic oligonucleotide
  Target: ATXN1; (-) strand; PAM type: NNGRRT; PAM sequence: ATGAGT
tcattgttcaattcccacct

SEQ ID NO: 16849 - DNA, 20 bp, Artificial Sequence
  Description of Artificial Sequence: Synthetic oligonucleotide
  Target: ATXN1; (-) strand; PAM type: NNGRRT; PAM sequence: TAGGGT
ttttattatactttaagttc

SEQ ID NO: 16850 - DNA, 20 bp, Artificial Sequence
  Description of Artificial Sequence: Synthetic oligonucleotide
  Target: ATXN1; (-) strand; PAM type: NNGRRT; PAM sequence: AAGAAT
ttaaggtgattttccctgct

SEQ ID NO: 16851 - DNA, 20 bp, Artificial Sequence
  Description of Artificial Sequence: Synthetic oligonucleotide
  Target: ATXN1; (-) strand; PAM type: NNGRRT; PAM sequence: ATGGAT
acattttttcctaactcgac

SEQ ID NO: 16852 - DNA, 20 bp, Artificial Sequence
  Description of Artificial Sequence: Synthetic oligonucleotide
  Target: ATXN1; (-) strand; PAM type: NNGRRT; PAM sequence: CAGAGT
ctggcgtagctgtagtatat

SEQ ID NO: 16853 - DNA, 20 bp, Artificial Sequence
  Description of Artificial Sequence: Synthetic oligonucleotide
  Target: ATXN1; (-) strand; PAM type: NNGRRT; PAM sequence: GGGAAT
atcgtgattcacatatttct

SEQ ID NO: 16854 - DNA, 20 bp, Artificial Sequence
  Description of Artificial Sequence: Synthetic oligonucleotide
  Target: ATXN1; (-) strand; PAM type: NNGRRT; PAM sequence: ATGAGT
gtcctaaatttcccaaactg

SEQ ID NO: 16855 - DNA, 20 bp, Artificial Sequence
  Description of Artificial Sequence: Synthetic oligonucleotide
  Target: ATXN1; (-) strand; PAM type: NNGRRT; PAM sequence: ATGAAT
gactggatccacccctgatt

SEQ ID NO: 16856 - DNA, 20 bp, Artificial Sequence
  Description of Artificial Sequence: Synthetic oligonucleotide
  Target: ATXN1; (-) strand; PAM type: NNGRRT; PAM sequence: CTGGAT
taaactgcagacctcacaga

SEQ ID NO: 16857 - DNA, 20 bp, Artificial Sequence
  Description of Artificial Sequence: Synthetic oligonucleotide
  Target: ATXN1; (-) strand; PAM type: NNGRRT; PAM sequence: GTGAGT
aaagttctgggattacaggc

SEQ ID NO: 16858 - DNA, 20 bp, Artificial Sequence
  Description of Artificial Sequence: Synthetic oligonucleotide
  Target: ATXN1; (-) strand; PAM type: NNGRRT; PAM sequence: TGGGAT
acttcagcctcccaaagttc

SEQ ID NO: 16859 - DNA, 20 bp, Artificial Sequence
  Description of Artificial Sequence: Synthetic oligonucleotide
  Target: ATXN1; (-) strand; PAM type: NNGRRT; PAM sequence: GGGGGT
ttgtatttttttgtagagat

SEQ ID NO: 16860 - DNA, 20 bp, Artificial Sequence
  Description of Artificial Sequence: Synthetic oligonucleotide
  Target: ATXN1; (-) strand; PAM type: NNGRRT; PAM sequence: CTGAGT
gatcctcccacctgagcctt

SEQ ID NO: 16861 - DNA, 20 bp, Artificial Sequence
  Description of Artificial Sequence: Synthetic oligonucleotide
  Target: ATXN1; (-) strand; PAM type: NNGRRT; PAM sequence: CTGGAT
gtctagctctgtcatccagg

SEQ ID NO: 16862 - DNA, 20 bp, Artificial Sequence
  Description of Artificial Sequence: Synthetic oligonucleotide
  Target: ATXN1; (-) strand; PAM type: NNGRRT; PAM sequence: GGGAAT
accatatacttggcattgaa

SEQ ID NO: 16863 - DNA, 20 bp, Artificial Sequence
  Description of Artificial Sequence: Synthetic oligonucleotide
  Target: ATXN1; (-) strand; PAM type: NNGRRT; PAM sequence: TGGAAT
gaggtagtaaagccacatat

SEQ ID NO: 16864 - DNA, 20 bp, Artificial Sequence
  Description of Artificial Sequence: Synthetic oligonucleotide
  Target: ATXN1; (-) strand; PAM type: NNGRRT; PAM sequence: TGGGAT
tgctgcctgataaatgactg

SEQ ID NO: 16865 - DNA, 20 bp, Artificial Sequence
  Description of Artificial Sequence: Synthetic oligonucleotide
  Target: ATXN1; (-) strand; PAM type: NNGRRT; PAM sequence: ATGGGT
acttgcttaggaacctgcag

SEQ ID NO: 16866 - DNA, 20 bp, Artificial Sequence
  Description of Artificial Sequence: Synthetic oligonucleotide
  Target: ATXN1; (-) strand; PAM type: NNGRRT; PAM sequence: CAGAGT
gcactgattggtccatttta

SEQ ID NO: 16867 - DNA, 20 bp, Artificial Sequence
  Description of Artificial Sequence: Synthetic oligonucleotide
  Target: ATXN1; (-) strand; PAM type: NNGRRT; PAM sequence: GCGGGT
cagcgtggaaggggacccga

SEQ ID NO: 16868 - DNA, 20 bp, Artificial Sequence
  Description of Artificial Sequence: Synthetic oligonucleotide
  Target: ATXN1; (-) strand; PAM type: NNGRRT; PAM sequence: GTGAGT
tggagccacggaccttcaca

SEQ ID NO: 16869 - DNA, 20 bp, Artificial Sequence
  Description of Artificial Sequence: Synthetic oligonucleotide
  Target: ATXN1; (-) strand; PAM type: NNGRRT; PAM sequence: AAGAAT
tttgtggtcttgctgacttc

SEQ ID NO: 16870 - DNA, 20 bp, Artificial Sequence
  Description of Artificial Sequence: Synthetic oligonucleotide
  Target: ATXN1; (-) strand; PAM type: NNGRRT; PAM sequence: TGGAGT
ggttgcggtgagcctgtgtc

SEQ ID NO: 16871 - DNA, 20 bp, Artificial Sequence
  Description of Artificial Sequence: Synthetic oligonucleotide
  Target: ATXN1; (-) strand; PAM type: NNGRRT; PAM sequence: GAGAAT
tacttaggcggctgaggcag

SEQ ID NO: 16872 - DNA, 20 bp, Artificial Sequence
  Description of Artificial Sequence: Synthetic oligonucleotide
  Target: ATXN1; (-) strand; PAM type: NNGRRT; PAM sequence: CCGGGT
tactaaaaatacaaaattag

SEQ ID NO: 16873 - DNA, 20 bp, Artificial Sequence
  Description of Artificial Sequence: Synthetic oligonucleotide
  Target: ATXN1; (-) strand; PAM type: NNGRRT; PAM sequence: GGGAGT
caggcgaatcacctgaggtt

SEQ ID NO: 16874 - DNA, 20 bp, Artificial Sequence
  Description of Artificial Sequence: Synthetic oligonucleotide
  Target: ATXN1; (-) strand; PAM type: NNGRRT; PAM sequence: GCGAAT
accttgggaagctgaggcag

SEQ ID NO: 16875 - DNA, 20 bp, Artificial Sequence
  Description of Artificial Sequence: Synthetic oligonucleotide
  Target: ATXN1; (-) strand; PAM type: NNGRRT; PAM sequence: GTGAAT
tagtgagttggcatgtcaga

SEQ ID NO: 16876 - DNA, 20 bp, Artificial Sequence
  Description of Artificial Sequence: Synthetic oligonucleotide
  Target: ATXN1; (-) strand; PAM type: NNGRRT; PAM sequence: CAGAGT
aaagtagtgagttggcatgt

SEQ ID NO: 16877 - DNA, 20 bp, Artificial Sequence
  Description of Artificial Sequence: Synthetic oligonucleotide
  Target: ATXN1; (-) strand; PAM type: NNGRRT; PAM sequence: GTGAGT
atgagccacaattaaaagta

SEQ ID NO: 16878 - DNA, 20 bp, Artificial Sequence
  Description of Artificial Sequence: Synthetic oligonucleotide
  Target: ATXN1; (-) strand; PAM type: NNGRRT; PAM sequence: GTGAAT
tgcctactgttggagaattg

SEQ ID NO: 16879 - DNA, 20 bp, Artificial Sequence
  Description of Artificial Sequence: Synthetic oligonucleotide
  Target: ATXN1; (-) strand; PAM type: NNGRRT; PAM sequence: GAGAAT
acatgtgatgcctactgttg

SEQ ID NO: 16880 - DNA, 20 bp, Artificial Sequence
  Description of Artificial Sequence: Synthetic oligonucleotide
  Target: ATXN1; (-) strand; PAM type: NNGRRT; PAM sequence: CGGGGT
gctggtggagttgcttgaca

SEQ ID NO: 16881 - DNA, 20 bp, Artificial Sequence
  Description of Artificial Sequence: Synthetic oligonucleotide
  Target: ATXN1; (-) strand; PAM type: NNGRRT; PAM sequence: TGGAGT
tgttggagaggtgatgctgg

SEQ ID NO: 16882 - DNA, 20 bp, Artificial Sequence
  Description of Artificial Sequence: Synthetic oligonucleotide
  Target: ATXN1; (-) strand; PAM type: NNGRRT; PAM sequence: TGGGGT
attaagttcattaccttata

SEQ ID NO: 16883 - DNA, 20 bp, Artificial Sequence
  Description of Artificial Sequence: Synthetic oligonucleotide
  Target: ATXN1; (-) strand; PAM type: NNGRRT; PAM sequence: TGGGAT
accttggcctcccaaagtgc

SEQ ID NO: 16884 - DNA, 20 bp, Artificial Sequence
  Description of Artificial Sequence: Synthetic oligonucleotide
  Target: ATXN1; (-) strand; PAM type: NNGRRT; PAM sequence: CAGGAT
ttgagtttcaccatgttagc

SEQ ID NO: 16885 - DNA, 20 bp, Artificial Sequence
  Description of Artificial Sequence: Synthetic oligonucleotide
  Target: ATXN1; (-) strand; PAM type: NNGRRT; PAM sequence: TTGAGT
ttttgtatttttagtagaga

SEQ ID NO: 16886 - DNA, 20 bp, Artificial Sequence
  Description of Artificial Sequence: Synthetic oligonucleotide
  Target: ATXN1; (-) strand; PAM type: NNGRRT; PAM sequence: CCGAAT
cattctcctgcctcagcctc

SEQ ID NO: 16887 - DNA, 20 bp, Artificial Sequence
  Description of Artificial Sequence: Synthetic oligonucleotide
  Target: ATXN1; (-) strand; PAM type: NNGRRT; PAM sequence: CCGGGT
cttactgcaagctccgcctc

SEQ ID NO: 16888 - DNA, 20 bp, Artificial Sequence
  Description of Artificial Sequence: Synthetic oligonucleotide
  Target: ATXN1; (-) strand; PAM type: NNGRRT; PAM sequence: TTGAGT
tctcgctctgtcacccaggc

SEQ ID NO: 16889 - DNA, 20 bp, Artificial Sequence
  Description of Artificial Sequence: Synthetic oligonucleotide
  Target: ATXN1; (-) strand; PAM type: NNGRRT; PAM sequence: CAGAGT
tttttttttcttttttgaga

SEQ ID NO: 16890 - DNA, 20 bp, Artificial Sequence
  Description of Artificial Sequence: Synthetic oligonucleotide
  Target: ATXN1; (-) strand; PAM type: NNGRRT; PAM sequence: TAGGGT
tgaatgcttagcggctattt

SEQ ID NO: 16891 - DNA, 20 bp, Artificial Sequence
  Description of Artificial Sequence: Synthetic oligonucleotide
  Target: ATXN1; (-) strand; PAM type: NNGRRT; PAM sequence: TTGAAT
tgactcactcttcctttcac

SEQ ID NO: 16892 - DNA, 20 bp, Artificial Sequence
  Description of Artificial Sequence: Synthetic oligonucleotide
  Target: ATXN1; (-) strand; PAM type: NNGRRT; PAM sequence: TGGAGT
cttaccattgatgagttcac

SEQ ID NO: 16893 - DNA, 20 bp, Artificial Sequence
  Description of Artificial Sequence: Synthetic oligonucleotide
  Target: ATXN1; (-) strand; PAM type: NNGRRT; PAM sequence: ATGAGT
gtttcactttcttaccattg

SEQ ID NO: 16894 - DNA, 20 bp, Artificial Sequence
  Description of Artificial Sequence: Synthetic oligonucleotide
  Target: ATXN1; (-) strand; PAM type: NNGRRT; PAM sequence: GGGAAT
tggattaggctttggcttaa

SEQ ID NO: 16895 - DNA, 20 bp, Artificial Sequence
  Description of Artificial Sequence: Synthetic oligonucleotide
  Target: ATXN1; (-) strand; PAM type: NNGRRT; PAM sequence: CTGGAT
aagagagttagggccttgat

SEQ ID NO: 16896 - DNA, 20 bp, Artificial Sequence
  Description of Artificial Sequence: Synthetic oligonucleotide
  Target: ATXN1; (-) strand; PAM type: NNGRRT; PAM sequence: GAGAGT
tcagccttcatagaagtgaa

SEQ ID NO: 16897 - DNA, 20 bp, Artificial Sequence
  Description of Artificial Sequence: Synthetic oligonucleotide
  Target: ATXN1; (-) strand; PAM type: NNGRRT; PAM sequence: CTGGAT
aatgatcttagttaaatttt

SEQ ID NO: 16898 - DNA, 20 bp, Artificial Sequence
  Description of Artificial Sequence: Synthetic oligonucleotide
  Target: ATXN1; (-) strand; PAM type: NNGRRT; PAM sequence: GAGAGT
gctgcatttgcccgtaacaa

SEQ ID NO: 16899 - DNA, 20 bp, Artificial Sequence
  Description of Artificial Sequence: Synthetic oligonucleotide
  Target: ATXN1; (-) strand; PAM type: NNGRRT; PAM sequence: TGGAAT
tattagggctctaggatttt

SEQ ID NO: 16900 - DNA, 20 bp, Artificial Sequence
  Description of Artificial Sequence: Synthetic oligonucleotide
  Target: ATXN1; (-) strand; PAM type: NNGRRT; PAM sequence: TAGGAT
cagcataattattagggctc

SEQ ID NO: 16901 - DNA, 20 bp, Artificial Sequence
  Description of Artificial Sequence: Synthetic oligonucleotide
  Target: ATXN1; (-) strand; PAM type: NNGRRT; PAM sequence: CAGAGT
ttccatttctatagcactgg

SEQ ID NO: 16902 - DNA, 20 bp, Artificial Sequence
  Description of Artificial Sequence: Synthetic oligonucleotide
  Target: ATXN1; (-) strand; PAM type: NNGRRT; PAM sequence: AGGAAT
ataagcagtaatattttgaa

SEQ ID NO: 16903 - DNA, 20 bp, Artificial Sequence
  Description of Artificial Sequence: Synthetic oligonucleotide
  Target: ATXN1; (-) strand; PAM type: NNGRRT; PAM sequence: ATGAGT
atttccatcagagctcttag

SEQ ID NO: 16904 - DNA, 20 bp, Artificial Sequence
  Description of Artificial Sequence: Synthetic oligonucleotide
  Target: ATXN1; (-) strand; PAM type: NNGRRT; PAM sequence: ATGAAT
ttagcaggcgtgaaaacgac

SEQ ID NO: 16905 - DNA, 20 bp, Artificial Sequence
  Description of Artificial Sequence: Synthetic oligonucleotide
  Target: ATXN1; (-) strand; PAM type: NNGRRT; PAM sequence: ATGGGT
cttgatccatgggttgcaga

SEQ ID NO: 16906 - DNA, 20 bp, Artificial Sequence
  Description of Artificial Sequence: Synthetic oligonucleotide
  Target: ATXN1; (-) strand; PAM type: NNGRRT; PAM sequence: CAGAAT
actccttgatccatgggttg

SEQ ID NO: 16907 - DNA, 20 bp, Artificial Sequence
  Description of Artificial Sequence: Synthetic oligonucleotide
  Target: ATXN1; (-) strand; PAM type: NNGRRT; PAM sequence: ATGGGT
taaaaattactccttgatcc

SEQ ID NO: 16908 - DNA, 20 bp, Artificial Sequence
  Description of Artificial Sequence: Synthetic oligonucleotide
  Target: ATXN1; (-) strand; PAM type: NNGRRT; PAM sequence: CAGAAT
ctgtggcaatgatagcctta

SEQ ID NO: 16909 - DNA, 20 bp, Artificial Sequence
  Description of Artificial Sequence: Synthetic oligonucleotide
  Target: ATXN1; (-) strand; PAM type: NNGRRT; PAM sequence: AGGAAT
acttttcccagatccatcag

SEQ ID NO: 16910 - DNA, 20 bp, Artificial Sequence
  Description of Artificial Sequence: Synthetic oligonucleotide
  Target: ATXN1; (-) strand; PAM type: NNGRRT; PAM sequence: GTGAAT
tcttaatgacatctacaatg

SEQ ID NO: 16911 - DNA, 20 bp, Artificial Sequence
  Description of Artificial Sequence: Synthetic oligonucleotide
  Target: ATXN1; (-) strand; PAM type: NNGRRT; PAM sequence: ATGAAT
tgatattttgacctcttccc

SEQ ID NO: 16912 - DNA, 20 bp, Artificial Sequence
  Description of Artificial Sequence: Synthetic oligonucleotide
  Target: ATXN1; (-) strand; PAM type: NNGRRT; PAM sequence: TGGAAT
ctcaagtcatccatgggggt

SEQ ID NO: 16913 - DNA, 20 bp, Artificial Sequence
  Description of Artificial Sequence: Synthetic oligonucleotide
  Target: ATXN1; (-) strand; PAM type: NNGRRT; PAM sequence: GGGGGT
gaaaccctcaagtcatccat

SEQ ID NO: 16914 - DNA, 20 bp, Artificial Sequence
  Description of Artificial Sequence: Synthetic oligonucleotide
  Target: ATXN1; (-) strand; PAM type: NNGRRT; PAM sequence: CAGGAT
acaatgttagctgtgttagc

SEQ ID NO: 16915 - DNA, 20 bp, Artificial Sequence
  Description of Artificial Sequence: Synthetic oligonucleotide
  Target: ATXN1; (-) strand; PAM type: NNGRRT; PAM sequence: ATGGGT
tttttgtatttttagtagag

SEQ ID NO: 16916 - DNA, 20 bp, Artificial Sequence
  Description of Artificial Sequence: Synthetic oligonucleotide
  Target: ATXN1; (-) strand; PAM type: NNGRRT; PAM sequence: CTGAGT
aattctcctgcctcagcctc

SEQ ID NO: 16917 - DNA, 20 bp, Artificial Sequence
  Description of Artificial Sequence: Synthetic oligonucleotide
  Target: ATXN1; (-) strand; PAM type: NNGRRT; PAM sequence: TGGAGT
tctcgttctgtcacccaggc

SEQ ID NO: 16918 - DNA, 20 bp, Artificial Sequence
  Description of Artificial Sequence: Synthetic oligonucleotide
  Target: ATXN1; (-) strand; PAM type: NNGRRT; PAM sequence: CGGAGT
tttgtttgtttgttttgaga

SEQ ID NO: 16919 - DNA, 20 bp, Artificial Sequence
  Description of Artificial Sequence: Synthetic oligonucleotide
  Target: ATXN1; (-) strand; PAM type: NNGRRT; PAM sequence: AGGAGT
gtgttcacagtatcttcatc

SEQ ID NO: 16920 - DNA, 20 bp, Artificial Sequence
  Description of Artificial Sequence: Synthetic oligonucleotide
  Target: ATXN1; (-) strand; PAM type: NNGRRT; PAM sequence: TAGAGT
catagtagaactttcaaagt

SEQ ID NO: 16921 - DNA, 20 bp, Artificial Sequence
  Description of Artificial Sequence: Synthetic oligonucleotide
  Target: ATXN1; (-) strand; PAM type: NNGRRT; PAM sequence: TGGGGT
gggaggtggttgctgaaagc

SEQ ID NO: 16922 - DNA, 20 bp, Artificial Sequence
  Description of Artificial Sequence: Synthetic oligonucleotide
  Target: ATXN1; (-) strand; PAM type: NNGRRT; PAM sequence: AAGGGT
ccataatcgttttgttggta

SEQ ID NO: 16923 - DNA, 20 bp, Artificial Sequence
  Description of Artificial Sequence: Synthetic oligonucleotide
  Target: ATXN1; (-) strand; PAM type: NNGRRT; PAM sequence: TTGGGT
cctggacactcagagatatt

SEQ ID NO: 16924 - DNA, 20 bp, Artificial Sequence
  Description of Artificial Sequence: Synthetic oligonucleotide
  Target: ATXN1; (-) strand; PAM type: NNGRRT; PAM sequence: TGGGAT
acctcagcctcccaaagtgc

SEQ ID NO: 16925 - DNA, 20 bp, Artificial Sequence
  Description of Artificial Sequence: Synthetic oligonucleotide
  Target: ATXN1; (-) strand; PAM type: NNGRRT; PAM sequence: TGGGGT
ttttgtatttttagtagaga

SEQ ID NO: 16926 - DNA, 20 bp, Artificial Sequence
  Description of Artificial Sequence: Synthetic oligonucleotide
  Target: ATXN1; (-) strand; PAM type: NNGRRT; PAM sequence: CTGGGT
ctcactgcaagctccgcctc

SEQ ID NO: 16927 - DNA, 20 bp, Artificial Sequence
  Description of Artificial Sequence: Synthetic oligonucleotide
  Target: ATXN1; (-) strand; PAM type: NNGRRT; PAM sequence: TGGAGT
gtcttgctttgttgccaggc

SEQ ID NO: 16928 - DNA, 20 bp, Artificial Sequence
  Description of Artificial Sequence: Synthetic oligonucleotide
  Target: ATXN1; (-) strand; PAM type: NNGRRT; PAM sequence: GGGAGT
tttttttttttttttgagtt

SEQ ID NO: 16929 - DNA, 20 bp, Artificial Sequence
  Description of Artificial Sequence: Synthetic oligonucleotide
  Target: ATXN1; (-) strand; PAM type: NNGRRT; PAM sequence: TTGAGT
tgtgtctttttttttttttt

SEQ ID NO: 16930 - DNA, 20 bp, Artificial Sequence
  Description of Artificial Sequence: Synthetic oligonucleotide
  Target: ATXN1; (-) strand; PAM type: NNGRRT; PAM sequence: CAGAAT
agtgcctgttaggaagagtt

SEQ ID NO: 16931 - DNA, 20 bp, Artificial Sequence
  Description of Artificial Sequence: Synthetic oligonucleotide
  Target: ATXN1; (-) strand; PAM type: NNGRRT; PAM sequence: AAGAGT
tttctgtagtgcctgttagg

SEQ ID NO: 16932 - DNA, 20 bp, Artificial Sequence
  Description of Artificial Sequence: Synthetic oligonucleotide
  Target: ATXN1; (-) strand; PAM type: NNGRRT; PAM sequence: TGGAAT
gtcttggcctctcaaagtgc

SEQ ID NO: 16933 - DNA, 20 bp, Artificial Sequence
  Description of Artificial Sequence: Synthetic oligonucleotide
  Target: ATXN1; (-) strand; PAM type: NNGRRT; PAM sequence: TGGAGT
ctcactcttgtctcccaggc

SEQ ID NO: 16934 - DNA, 20 bp, Artificial Sequence
  Description of Artificial Sequence: Synthetic oligonucleotide
  Target: ATXN1; (-) strand; PAM type: NNGRRT; PAM sequence: CAGGGT
ttttttttttttttttttgg

SEQ ID NO: 16935 - DNA, 20 bp, Artificial Sequence
  Description of Artificial Sequence: Synthetic oligonucleotide
  Target: ATXN1; (-) strand; PAM type: NNGRRT; PAM sequence: CAGAAT
tatttggcccgaattcttct

SEQ ID NO: 16936 - DNA, 20 bp, Artificial Sequence
  Description of Artificial Sequence: Synthetic oligonucleotide
  Target: ATXN1; (-) strand; PAM type: NNGRRT; PAM sequence: CCGAAT
tattttaactcctatttggc

SEQ ID NO: 16937 - DNA, 20 bp, Artificial Sequence
  Description of Artificial Sequence: Synthetic oligonucleotide
  Target: ATXN1; (-) strand; PAM type: NNGRRT; PAM sequence: TGGAGT
catagtttcatgtgcctctt

SEQ ID NO: 16938 - DNA, 20 bp, Artificial Sequence
  Description of Artificial Sequence: Synthetic oligonucleotide
  Target: ATXN1; (-) strand; PAM type: NNGRRT; PAM sequence: GAGAAT
ttttcttcttaataactgaa

SEQ ID NO: 16939 - DNA, 20 bp, Artificial Sequence
  Description of Artificial Sequence: Synthetic oligonucleotide
  Target: ATXN1; (-) strand; PAM type: NNGRRT; PAM sequence: TGGAAT
tttcagaaactgggttgtat

SEQ ID NO: 16940 - DNA, 20 bp, Artificial Sequence
  Description of Artificial Sequence: Synthetic oligonucleotide
  Target: ATXN1; (-) strand; PAM type: NNGRRT; PAM sequence: CTGGGT
tctcattctaatttcagaaa

SEQ ID NO: 16941 - DNA, 20 bp, Artificial Sequence
  Description of Artificial Sequence: Synthetic oligonucleotide
  Target: ATXN1; (-) strand; PAM type: NNGRRT; PAM sequence: TGGAAT
ttcttattttagggaccaca

SEQ ID NO: 16942 - DNA, 20 bp, Artificial Sequence
  Description of Artificial Sequence: Synthetic oligonucleotide
  Target: ATXN1; (-) strand; PAM type: NNGRRT; PAM sequence: CAGGAT
tggggtttcaccatgttggc

SEQ ID NO: 16943 - DNA, 20 bp, Artificial Sequence
  Description of Artificial Sequence: Synthetic oligonucleotide
  Target: ATXN1; (-) strand; PAM type: NNGRRT; PAM sequence: TGGGGT
ttttgtatttttagtagaga

SEQ ID NO: 16944 - DNA, 20 bp, Artificial Sequence
  Description of Artificial Sequence: Synthetic oligonucleotide
  Target: ATXN1; (-) strand; PAM type: NNGRRT; PAM sequence: GGGAAT
ggcgcatgccgccacgccca

SEQ ID NO: 16945 - DNA, 20 bp, Artificial Sequence
  Description of Artificial Sequence: Synthetic oligonucleotide
  Target: ATXN1; (-) strand; PAM type: NNGRRT; PAM sequence: CCGAGT
aattctcctgcctcggcctc

SEQ ID NO: 16946 - DNA, 20 bp, Artificial Sequence
  Description of Artificial Sequence: Synthetic oligonucleotide
  Target: ATXN1; (-) strand; PAM type: NNGRRT; PAM sequence: CTGGGT
ctcactgcagcctccgcctc

SEQ ID NO: 16947 - DNA, 20 bp, Artificial Sequence
  Description of Artificial Sequence: Synthetic oligonucleotide
  Target: ATXN1; (-) strand; PAM type: NNGRRT; PAM sequence: TGGAGT
gtcttgctctgtcgccaggc

SEQ ID NO: 16948 - DNA, 20 bp, Artificial Sequence
  Description of Artificial Sequence: Synthetic oligonucleotide
  Target: ATXN1; (-) strand; PAM type: NNGRRT; PAM sequence: CGGAGT
ttttttttttttttttgaaa

SEQ ID NO: 16949 - DNA, 20 bp, Artificial Sequence
  Description of Artificial Sequence: Synthetic oligonucleotide
  Target: ATXN1; (-) strand; PAM type: NNGRRT; PAM sequence: GTGAGT
tggtgacctctactttcctg

SEQ ID NO: 16950 - DNA, 20 bp, Artificial Sequence
  Description of Artificial Sequence: Synthetic oligonucleotide
  Target: ATXN1; (-) strand; PAM type: NNGRRT; PAM sequence: AAGAGT
tacaaaaatgatctaccgtt

SEQ ID NO: 16951 - DNA, 20 bp, Artificial Sequence
  Description of Artificial Sequence: Synthetic oligonucleotide
  Target: ATXN1; (-) strand; PAM type: NNGRRT; PAM sequence: TGGAGT
tttattagcttgaacagttt
